United States Patent 9,518,277 (GENETICALLY ENGINEERED MICROBIAL STRAINS INCLUDING CHLORELLA PROTOTHECOIDES LIPID PATHWAY GENES) - sequence listing, part 7

SEQ ID NO: 21667 - DNA, 61 bp, Chlorella protothecoides
agccgccacgcatgaatgggggacgcatggctggacgtgcatggacatgaacagagccgcc

SEQ ID NO: 21668 - DNA, 61 bp, Chlorella protothecoides
aaggacgcatgtgggcaagtcaagcgccccgcccgcagcctcacttgtgacgtcataaacc

SEQ ID NO: 21669 - DNA, 61 bp, Chlorella protothecoides
atttctggggcatgagccctgaagctgtgctgttgccagatcaccccgggccggcgtactc

SEQ ID NO: 21670 - DNA, 303 bp, Chlorella protothecoides
ctcggagtataaagccgaaggacattgacctaccagaacacaaaaatctcccgatcccaaagtcttccatctccccactcaccaacacctctgcaatcatgtctggacgcggaaagggaaagacctccggcagcaaggccgtgagcaagtcctccaaggcgggcctgcagttccccgtcgggcgtatcgcccgctacctgaagaacggccgctacgctggtgagtgcatgtgtcgatggttcgttctgtccgagatacagacttccaagttggccgttattgaccctcctccccctccgctcc

SEQ ID NO: 21671 - DNA, 61 bp, Chlorella protothecoides
aggtgaaaaggtacaaaggctgggaagtccattcgctttcatgactccccaggttcaggtt

SEQ ID NO: 21672 - DNA, 129 bp, Chlorella protothecoides
atttgcctggtcccaggagtgcaaactgacaatcaaacttcccgcccgggcctacactggccgcccacttggaccccacaatagcgttgcattctcgcattccatcccacaccaccccttcctgtgccc

SEQ ID NO: 21673 - DNA, 135 bp, Chlorella protothecoides
tgcagcacctatggttgggtttggggagatcgttgagttgggtcgaggatgcctgtgctcgaccagggcagagggagtcacccaggagccgtgcccctgaacagatatgggcccaaagttggcccctccacagca

SEQ ID NO: 21674 - DNA, 115 bp, Chlorella protothecoides
atcgattagggcccccacctgtgggcctgccgacaaggggggatgttgcccacgtgtccccaaggcccgagccagaattatcggctgcatcgcggatcaggtccccgggctgttc

SEQ ID NO: 21675 - DNA, 156 bp, Chlorella protothecoides
aagcagggtgggctgccctcaggaagctgggtatcgacgcgcacaaaacggccttccaccggcagccatgtgcgcgagggtttcgtgcggacagaaacgtcgcccgtgcagcacatgattcccgtcgtgaaaccagctctcagctcacattgcact

SEQ ID NO: 21676 - DNA, 69 bp, Chlorella protothecoides
tccgaccgcacacgtaactcgtacaggcggaagaaagaagttgctgaggggtgcaggatgccagcggcg

SEQ ID NO: 21677 - DNA, 4929 bp, Chlorella protothecoides
  modified_base (586)..(644): a, c, t, g, unknown or other
  modified_base (2542)..(2672): a, c, t, g, unknown or other
  modified_base (3855)..(3864): a, c, t, g, unknown or other
  modified_base (4126)..(4135): a, c, t, g, unknown or other
cttgcacagaacttgcgaagggtgcccaaaaaggcagttcaatcttgatactcactgcaacattaagactggcttcgagaccggacgggcgattttgtgtgtctacccaggcgatttccaaattgactcatcattcggggcacggggatccaatcttgtactaaacacatagggtatcccaacacatatggtaaagtctgggctcgggctggagcccgatgtcatgtagacatgtattgtagctgagttgatgggcttccaacgcatggcacgagagattagagctggagatggtaggggacctcttatcaataacttcaagttctccggctacctacggactgaaaatgagagctgagagtccttgttactgaaaccatctgctgcttacaaccccaggagtacatccatgttatgaggactgtggtgggagaatatcacacaccatcctttgtatctttaggaggtcctgttcaggaggcaaacccattgacgatactacacaaacacgtagcctgtatagtcagtaagcagtggtgcagaagatcagcttaagcaggtctgggaatacaaaatcccccccccnnnnnnnnnnnnnnnnnnnnnnnnnnnnnnnnnnnnnnnnnnnnnnnnnnnnnnnnnnnaatgtgcagaagagctcttggaagcacatgcattgcacttcacccttgcccagtaacgcttattccgctgtatgatttgacagcgaatggacgaaatcatcatcagaggtatcaaagctttggtgcttgagcttctgaggagagtcgcgcgtatttttgtgtttactagagtctacagatcaagatatcctgttccatagtatgatctcgtggaagagcatggccagtgtgctgtaaggttggagagtaatcctcaatcaccatatacccacaattgattgtattgaatggtatctgcattaaaatggagactctgtccaacgtacccatttgtccttgaaaaactatgtacaacgtgatcttggtcgacatagtttaaaggatcatcaatcaggaggcgctcataggaaatttatgtcatgccgaacaagaacactttcataagctcgaagcttacaatgaatcgtcgcggcagagtctgactgcttttacgcctataaattaattgtttgagtacagttcatggggacagatgggcactaccaaagcaattgcaagacgccagtcagacgtatcgagtaagcaaagtctgcaggaacgagtaacttcaccaatccgatctcaaactcgtctgcgacagcatgctcagcaattcgcctctcgaagtgtctcggtgcattacctgtattacagaatcatgctggcaccgacagtctggtttccatttgggcagaatggcaggaagagttggggggatttccgggtggtactgcaactctacagcagtataactttgcgtttgctgctttgaagctggtgagacaaagtggttgtgttgcgcaattcagaacaaccctcaagtgccaatatgccacataaagcggagccatcgaatgcgttctgctgccacactgtcagcgtgtgactacccatcaggatctgtgttgcagaatttccaaaagcaagagtaactgcactcggcgttttctatcagcgggtgcagccgctccggatcagatctgagctcattccgatcgtccgatcaccctcgaactcccctcagcgggagcagctgtttaattggcagaaaagttgcttgtcgacccacaaatcatgctcgtcttctcggtgaccaggcataagtgcggaaaggcttcaagaagtcgagagggacgcatcgcaaggcgctagtgatggctcccgcatacctgttatccagtatgttgctgattatcactcgaagactccgagaactttggaacgggcatgcttttggtggaatcaagagaccccacctcccttttcatgtcacacatgcatttgacaacatgttctcctcattgaggttgtagagacctggataccgtgatgtcatcgaaatctcctcgagccgtcctgctcactgcaatgtgactgccaaggaatgatccgtgaggattgtgggatggtgaagtataaacgatgtatagaagacaaccgtagaggcactggccggaatctcgcttccctgcatcttttatctgtgcacagagcctcatcatgaaagctgtcgcatgtacatccccaccattacaaacttgatattgcgtgtcaacactgaaaaccattttcagccttgaacaggaccgtggtactcctgaaaagaggaaacgtcatcgagtaacagccagcatgaatcgattccaggatatgcagtctgagagtacacatcaactgaattatctttacatcacaacaacgagatagttgaatatcatccactgtcgccttcgcaatctgcgtgtcattcgagttgtcctgctctccaagcacagatactgcacagatgaatagaaactagttgaaatatcgccgcaaaacttatatctcaatattgaatcgtgaagcgagcaaacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacagtcctggacggtctgtcttatttcaacgcacaactcttagcagactttggcctccgacagctcatgaagccccacttctatcgaattatgtttggtcggtttctcaatcctttacacagcacagtctgaaaaaacaccccccatttgtcaagtacctaacgtaaagatgagttgggcttccaagcatgagctggtgtcctgttcaggtgctctcaaggcattcgatactagcttgacatcatataatcccgatgttcgtaatctataaggcatacagaactggatagtagatggtatgatggtatcttcggagttccagtaacttataaggggagctatgcatatccgataaatgtccattctgttcctaaaacagcggctggtgcgagatatcttacttaagcattaatcccttagtgcctcttccctgaatatcgcagcaatctgataatcatcacatcttgagacagaatgacagcagaagtactgctctaccaactgtcggttgaagcatggacaatgccatacctttgtgcggggcagtgtcaccaccagcaggagttaagcacatgcaccacaaaagtccctccaggaatgaggcagacaaagtgaattaccatccccaattttgttcaaatatactttttgacatgcaggaatggcgacttggtgagttggtgaattccgaaaattgcacgacttgggtcctcatgtccaaagggacatggccttggcctcgatggattgtggttagctgtcaagtgaacgttgcgatgcgattagactcgccatctatgttgctcgtcgcgcacttactgtggtgtttgtatatcaaggcagatgggagttgggttgcaattgccgatgtgaatgtcctcgagggactggttcttgacaccggcataacccactgaatagcttttcaaaattcagaaagtatggctcgtagggagatgatttcaagcggagatgtgccattcggggaattgcgaagtgaattccaggtcataggaatacactctggggcctcgagagcgacatcccgcgagccggtgcaattggaataaaagttgtgagatgagttgtccctgttggaacctatggagatatgaaagatcttaatatatgattaataaaggatacaaattccctcctcttacaattgcgaaaggttgctnnnnnnnnnngtcccgcgagccggtgcatttggaataaaacttgtcagatgagttgtctctgttgcaacctatggagataaaaaagatcttaatgtatacttactaaaggatacaaactccctcctcttacaattgcgaaaggttgctgttttacacaggatgctggggtccattataaataccattacgcagagtagcttaatctgcaagaacaacgaagaagtctcgccaattgccgctgactttgcctatcccaacgtctgtggtgctnnnnnnnnnnggatattcgtaatctataaggtatacagaactggatagcagatggtgtgatggtatcttcggagttccagtaactaataaggggagctatgcatatccgagaaatgtccattctgttcctgatacagcggctggtgcgagatatcttacttaagcatgaatcgcgtagtgcctctttccagaatatcgcagcaatctgataatgatcacatcttgagacataatgacagcaaaagtactgcttcaccaactgccggttgaagcatggacaatgccataccttcttgcggggcagtgtcaccaccagcaggaattaagcacatgcagcacaaaagtccctccaggaacgaggcagacaaagtgaatgaccatccccatttttgttcaaatatacttctcaacatgcaggaatggcgacttcgtgagttggtgatttccgaaaattgcacgacttgggtcctcatgtccaaaagggcatggccttggcctcgatggattgtgattagctgtcaagtaatcgttgcgatgcgattggactcgccatctaagttgctcgtcgcgcactcactgcggtgtttttatatcaaggcagatgggagttgggtttgcaactgccgatgtgaatgtcctcgagggactggctcttgacaccggcatactaacccactgaatagcttttcaaagttcagataatatggctcgtaggaagataatttcaagcggagatgtgccattcggggagttgcgaagtgaattcctggtcataggaatacactctggggcctcgagagcgac

SEQ ID NO: 21678 - DNA, 245 bp, Chlorella protothecoides
gggcatcaccagctacatggtgggtccaggtgggggtggttctggcaccttagtggatgacttggcggtgggatggagggtctgaccatgcccgccagcgtcggtcctgaagaagcccccagggggactgcggatagaattcgacggcgaggcgtctcgcccatctcctggccaggcaccagggattagcttgtgatcggacccacacctggccccctgagcctcctggaccactgcatgcatgc

SEQ ID NO: 21679 - DNA, 132 bp, Chlorella protothecoides
agggaactggtgggaagcaagccctcccctcgctccatctgaggactcgaaatccgccacactcacctctggttcaagcttcaaggcctgaatgtacttggaacgtgctgtgtcaaagtcatcttgcatgaa

SEQ ID NO: 21680 - DNA, 76 bp, Chlorella protothecoides
aactcgttctgatattgtattgagcttgagcaaccttgtgagccaagaagtgtccccgtgattagccgtattctgc

SEQ ID NO: 21681 - DNA, 433 bp, Chlorella protothecoides
gcatatcttcgactcgtgcgccgcatacgctgctggctggtaagctgcaatttcagcctcacacacgaacgctgcttctacaattattaatggcaaggtatattcgaggttttgttcctgtctgggttacacattttcatgcaacattattccaagctcactatgagtggcacacggcaaggtattcgccggataatgtgcagatgagcaggtggtgatagggagatccgacgcatgtaccgctgttgggttcgccccgagcccctgtgcatcgcggaattcctgttggaaccgttgcgatgcagacggcggtgggaacattatttcgtgtgcagatgtacggatacaggcccgcggagcagaggtatccggacacaatgggagcagttgtgcatacatcgactgggggtgggggtggggagatggggggtgg

SEQ ID NO: 21682 - DNA, 134 bp, Chlorella protothecoides
gcagctcgctggcctcccgcgacaggcctgagagcggtgatttatgttttgggaggggggaaatggtgattgtggggagtgcggcaggtgaggctatgcgtgcttgggtccaggattgtcgcgattacatgcat

SEQ ID NO: 21683 - DNA, 142 bp, Chlorella protothecoides
gcggatgcctgctttgaacactctaatttactcaaagtaacctcgctgactccgggccccggacagcaaagcccaggagcgccgtccccagcaacaggggggcgccggaatgccagtgcgcagagggcgggggcgtgaaccc

SEQ ID NO: 21684 - DNA, 101 bp, Chlorella protothecoides
ctcacactgcactgatgtacatgaagccggaaggctgggggcgggcagacgtggggaaggggacccccccctagagtagctcatcgctttccgcgcttccc

SEQ ID NO: 21685 - DNA, 77 bp, Chlorella protothecoides
atctcgtcccgtgcctctgcaaacttctcattcagggcatccacctgtggagagaggcggatccgcgagttacaagt

SEQ ID NO: 21686 - DNA, 150 bp, Chlorella protothecoides
ccctggaccgcagggatcggaggaggtgaacttgctggcggtcttgaggtccccggcgcgccatgccgccatcagcctgaggcatggacccactgtctcaacgaactgcccagaccccttctgcacccatccccgccacccacctttccg

SEQ ID NO: 21687 - DNA, 126 bp, Chlorella protothecoides
tgtgaggtcctgcgtgcagccgggcttgtgcgccaggccgtccgatccacacgtggccctgacccagctccctgcacagatctcgccttgtttctcagccgcctgtgtcgtgtgaccctctgctcg

SEQ ID NO: 21688 - DNA, 64 bp, Chlorella protothecoides
ccccgtcagcgcagagaacctgccaagaaagagcggagggaagagcctgttgccattccgtgcg

SEQ ID NO: 21689 - DNA, 165 bp, Chlorella protothecoides
atgggtgggccctctgatttttttatggtgtgcggacgcagcctgggtcacgctcttagaccctgggtcaccgccgccgctcctcaagcatgactttattttgtcccttccctgtattctgaccaacgcacacgtcctgtccatcgaccaaggcatgcacatcac

SEQ ID NO: 21690 - DNA, 81 bp, Chlorella protothecoides
gcgggtaccgattcttgatggtggccttgttgagcgcgaggtagtcgacgcacatgcgctgcgacccgtcctttttgtcga

SEQ ID NO: 21691 - DNA, 135 bp, Chlorella protothecoides
cattgtttcaggtgttcggggtttgtgtgtttaaattatcgtactttcacagcattgcatcgctccatgttgcatggccattttcagtgcgcgcggatctgccacgatttgaattgttgcaaccccaggtcacca

SEQ ID NO: 21692 - DNA, 61 bp, Chlorella protothecoides
ggtcaaggaaggaaaggaaggaaggggcattgtgctcaccacccacaggtacagtttaggt

SEQ ID NO: 21693 - DNA, 138 bp, Chlorella protothecoides
agtatctggccaccgtgtacgccagcccgagggccaggggcgccgcgatccaccacgtctggcagaccaggcggagcgagcccaacaggggtcgctgcaggccgatggggaattcgcggatgacggcgttgttcagct

SEQ ID NO: 21694 - DNA, 66 bp, Chlorella protothecoides
ctttatcgagttcgaaaggcagcatcttaatcttttcattgcaaagcatgtgctctgacgaacatc

SEQ ID NO: 21695 - DNA, 161 bp, Chlorella protothecoides
tgctcagtcatgatgcaacttttacttagcttgaaatgacgattcgtgtcttgttggggaaccagaaagatgtcttcccctggggaacaaaaggtggtctccaagcactcaatccttgaggaaagggcactcatgtgactgcatgcaacaacgtgctgttt

SEQ ID NO: 21696 - DNA, 108 bp, Chlorella protothecoides
aaccacgaagctgcttcggaatggtagtctcgcgagaggtgcgttactttgtgtgagaccatgcctcacgcatggtgtgctgtggaagaccgcgagcgccatggcccc

SEQ ID NO: 21697 - DNA, 263 bp, Chlorella protothecoides
ccaggaagcttgattggtcgtttggctggacgatgttgagggtgtatgctcagcttcacactgctccttgagtccaaacctggtgtctgacagcaatggtgttgatggggtggttgaagctcgagtagttgtttggtgcattgccgagatatagaagtacttttgtgtgactagatggctatgtcgtcgttgttggatgtgagattttgacattcaggttgttgattccaagtaagcctgatgttcgactgcctgggctacat

SEQ ID NO: 21698 - DNA, 61 bp, Chlorella protothecoides
gacccgtgtgaccaaactttacgaagcatagcagcctctaccactgaacctactcgggacg

SEQ ID NO: 21699 - DNA, 61 bp, Chlorella protothecoides
aggatggcactctcgcacccgtcccgaaggctcgccctcagtccccgagcatctggatgaa

SEQ ID NO: 21700 - DNA, 254 bp, Chlorella protothecoides
tatacaatacttgtgctcacctcaacatgcatcaggacctcctttgcgaggtgcaaagactctaccatcccttgttctgcgctgacgactccattggtctgacagcggatcaggatctcagacaggttgggatgctcctttgtgtagctcgacagctgtacatgggggctgcaacggcagagaggatggagtgcgttatggtgaaaagctatgacatccagacggccatgtgacatggtgtgatctcaaaatgt

SEQ ID NO: 21701 - DNA, 199 bp, Chlorella protothecoides
gtatgctataactgtcggattggggcagtcatgcctttttgggcaagcagcactgttgcctcagcccctcctctcttgcacaacacacagaccatacttttgggaatgtcctcagagaggtcatgtggatgcagtgagtcaccagtgtcgtgtgggactcgctatgcccagaagaagtgtgttgctccgctcatcggcc

SEQ ID NO: 21702 - DNA, 61 bp, Chlorella protothecoides
aagcataatactattgcaagaatgttgcttcttccggagtgaacgcgacattagcctcggc

SEQ ID NO: 21703 - DNA, 61 bp, Chlorella protothecoides
gccattggtgaggatgacggcaacttgaagtatggcgtcctgtgcagggtctagccctgac

SEQ ID NO: 21704 - DNA, 1356 bp, Chlorella protothecoides
cagcccaccccctccccccagcccgcctcccagtccacccccaccgtcccctccgccaccaccacctccaccttcgccacctcccccatatgatgcatgtgcggatccgaatgtgcctgtggcgtccggaaccacctgccgtgggggcctcaatcctcacatctgcgtgcgcaatggtgtcccaaccgccatctgtatcacaacagctccagcaagtgccccgttgtgtgtgcgtccatgggccgttccaagcttaggtatatgtacctcggtctcgaaccccaccctgaccatctgcaactacaataatctatacttcgccgtcatatgcaaggtgttgtcctaactgcgctctcaccagcccctttcaccctttccacccgcatccgtgctctgtgccgtgcacatcccagctagggctgaaaacccaagcctcgcatcgcatccggggacgtgttgaaagaaccctgccctgtgtgaaagaaccctgccctgtgtgaaagaaccctgccccatgagaggctgaattctctgggaaccattctggagttgacacatagagaagtttgtcttacagttgagtgtgtctagggggagagaatggagagaaaagggtgcagatcaccccagaggaagggtattggatgccttgggctcaaagtgagacggcgggtacacgagaggttgcaaaggcaggtggaaggtatgtgtcttaattggatgtcattggaagcttcattgagagcgctctgaatgacaatattggctgcgtgaggccgcgtgtcgttgacagggtgcccaagagaggatcacgtagtctgcggcttcacctgtgcctggcagtgtctggtgcggggcaggctgtgtgcccaggcaatgagagtaaatgtagtgcttcccagatgaagtatcctacatctgtccccgatctcctctaggggccaggtgttttaggccattttgcctcaatggcggagaggcgaagatccaatagggatggagatggggaatcggggaacaggggtacctcgcaactatgtgcggcaagacaaggctcactgtatgcagctgtgttctcaagaggggatcagtcaggaacagggtgactgggccaacaggatcaacctctgttcttaccatcgaatgtgtgatctcttgggagactcaggctggtatcacaggggcattgcctggcaggcattcttgccacgggcctcctgcagccctgcacagcattggaggggcgcagtgaggttacaatgtctgcatgcgcgtatgcattggaaatcagtcataagggttgggcgtggatgactgttgagtcaagactctgcctaagacatcagctaccccttg

SEQ ID NO: 21705 - DNA, 77 bp, Chlorella protothecoides
gtggggggaatgtgattcggtgcagggcagtgttgactctgtcctgttcgtggggcatgcaagggaacatgagggcg

SEQ ID NO: 21706 - DNA, 126 bp, Chlorella protothecoides
ttccgccatggcgtttgcgatggatctggagtttcagtatgttaattgtctggatactgctttttgccctccacctgcgcctctccctgtgctccttgtacgagaggtgtcgcgcctggatcatgc

SEQ ID NO: 21707 - DNA, 61 bp, Chlorella protothecoides
cccaggaggaggtcaacggaatggtcgactgccggacaggggtcgccaggtcccgccgcgg

SEQ ID NO: 21708 - DNA, 76 bp, Chlorella protothecoides
ccggacaggggtcgccaggtcccgccgcggtgctgattactgtccaggacgcgcatgcatcctctgccggcaacgg

SEQ ID NO: 21709 - DNA, 271 bp, Chlorella protothecoides
gccggagagggtgggcccacaacagagcggcatgggaggatgctcaccatgcacagcaccccgcggttggcccagatcgggcaggcgattgctctggcagccgggggttggacattttttatggcaagctttttcctcgtagtctgtgactgttgacggacccagggccccgccctggaggcgcaacgggagcagatgagggcctgacaagctccgaataattcccatgtcagcgtgaaacttcggagtcgaaagtcgaaaatgtgagttc

SEQ ID NO: 21710 - DNA, 112 bp, Chlorella protothecoides
gacctcacatttttcctgcattcttcagcatcagtttctgcacctcgtagaaactgtcccaggtctcatcagattccgggaagagggaagcatctatatgaggggggggggg

SEQ ID NO: 21711 - DNA, 62 bp, Chlorella protothecoides
cctttcttgatcagctccaggaccatgtgaaactcgtactgcaaggaggatgggagggaaga

SEQ ID NO: 21712 - DNA, 262 bp, Chlorella protothecoides
cttcacgcaccttggcattatatgctctgggtgtcttcaagagtgccctgatcaggaacaggacgggagagcccgcaccgcagcggcagagcgtgaggccgtcgggattgggtgccaccggaggtggcaccacatgccgtggttgtccagtatacacactcaagcagagtacctgtcaaaactcgcccgagtacgttatttccgtgctggccttgaagcagcaaggcccccaccccttgggtatctggactgatctgggcat

SEQ ID NO: 21713 - DNA, 68 bp, Chlorella protothecoides
agctgcaactccgtccacttctcggtgcagagaactcacacttccagctcctgtgccgtcggttcggg

SEQ ID NO: 21714 - DNA, 78 bp, Chlorella protothecoides
gcccacgtcgggccatatccaaccggccgtgtcatctctccccccccattccattgacaaacagtggagggcgtggag

SEQ ID NO: 21715 - DNA, 92 bp, Chlorella protothecoides
acaggaggcatgcaaaacgacacatggtgaggggcccgataacgtgtgacatccttagcattggctccaagccctctcaccatcaagcatct

SEQ ID NO: 21716 - DNA, 62 bp, Chlorella protothecoides
acccccacggtcctcatgtacggcttcctggccgtgtccatgaccaccgccttctgggacaa

SEQ ID NO: 21717 - DNA, 78 bp, Chlorella protothecoides
ggatgccctcagcacaaaggcacctgggcatggcgagaagcatttaagaacaccccgcttttcacccacctctgtcca

SEQ ID NO: 21718 - DNA, 220 bp, Chlorella protothecoides
cagactgcgaggagtcgagcacgtgcggaaggatggagacaatgagcggatgcagacgttcgtcatcaatccggcacaaatgcgctttcaagtctgcctgacggagggaggaggtctgcagatccccacagagactgggatatccgcaagccggtgcgtcacgtgcggatgggagttgacgggctagggacatcgtcagagctgtacgcatttgcgcccc

SEQ ID NO: 21719 - DNA, 76 bp, Chlorella protothecoides
ggtgggtgggtgtgttcaagggggaaggggttggggtacctgagggattgatgccagaggaatcgaatattgggat

SEQ ID NO: 21720 - DNA, 80 bp, Chlorella protothecoides
ggtgcagaagtgtggaaacgggtcatgacgtagcataccaactcacaagtaggacaaccccatccatgtcgatctgtctg

SEQ ID NO: 21721 - DNA, 74 bp, Chlorella protothecoides
ggacatgaatgtatgcatccacgcatgaagggacatgaatgtatgcatccacgcacatgcacccacccgcatgc

SEQ ID NO: 21722 - DNA, 61 bp, Chlorella protothecoides
ggaggtcacggcctttaagacccgcagctcacatctcaacatctccagtgctgccatcgcc

SEQ ID NO: 21723 - DNA, 61 bp, Chlorella protothecoides
cctcccagcacagtcgatgcgcttctcttcatccttcttcgcgtcattcttcctctgacgc

SEQ ID NO: 21724 - DNA, 244 bp, Chlorella protothecoides
aacccccgcatcctgcagcctttcatgagcgtcgagggggtcaagccctgaacacccccgccaactttcccgccgcggcactcgtgggtgtgtgcggcgctcgagggtgtgcggcgctccttgcgccgtgggtcccttggtggcctggtgggtgcctccctttgcaacttgatacattgaccgtgctccctgcattcctgaacctgaatcaagctgtgagcatattcccgttgctcaacctgta

SEQ ID NO: 21725 - DNA, 109 bp, Chlorella protothecoides
actcttcacgctccctcccttgttctgccgagctttctcttgagttccaaatgcccctctcacacccgctgaccccccctccactcctcctgcgcagatgacattctag

SEQ ID NO: 21726 - DNA, 76 bp, Chlorella protothecoides
gggaggggaagcaggcccccccaaaaagctgatggacgaggtgcactcgcaaagaagcacctggtcagcatgagca

SEQ ID NO: 21727 - DNA, 83 bp, Chlorella protothecoides
aattctcgagtccgggagcaatccccagggctcttcggtaaccatacttgggttgattgaagccacaatcgtggtaacgcatt

SEQ ID NO: 21728 - DNA, 67 bp, Chlorella protothecoides
gtgagctggtggctacatggaaaatcactcctgagcggatggctattgctgagcgcgatgtgttccg

SEQ ID NO: 21729 - DNA, 80 bp, Chlorella protothecoides
actattaccagggactacatctgatgtactctaaatgctgcacactttgacacacgatccgcttgccccagtcagccctc

SEQ ID NO: 21730 - DNA, 77 bp, Chlorella protothecoides
ggcacgggggttcagggccccccgtcagggccttcctgccggccggccccaggaccgagctgcggcgcgcggtgctg

SEQ ID NO: 21731 - DNA, 77 bp, Chlorella protothecoides
accaccgctgtcctgggagcttcagaacgctccactgaacattgtgcaacacccctccgtccctcccccaacagaaa

SEQ ID NO: 21732 - DNA, 111 bp, Chlorella protothecoides
catctgtgcatgcggtggcatgccatgtgcctggttagggcatgtgtcccatgggagccgctcggaagtctatatggacagggaagttctcagatcttcctgctggctgat

SEQ ID NO: 21733 - DNA, 76 bp, Chlorella protothecoides
catacctaagtcaatgcatgtataaccatcaactcaaagacgcgcaccccacgatcacagccatgacaaggcccct

SEQ ID NO: 21734 - DNA, 77 bp, Chlorella protothecoides
ggcggcgggcatgatgaccatcgagggaaggaagctggccaaaggatgggcatggcatctccatcatacctgcagag

SEQ ID NO: 21735 - DNA, 78 bp, Chlorella protothecoides
gggaagggaagtttctcggttctgggaaggggggagactgggatggctaagatcagtgggaagagggaggcccgggag

SEQ ID NO: 21736 - DNA, 79 bp, Chlorella protothecoides
gggaatgtgagctggcaagcttagacccctttacaccctggcggatgatgatggctggtttcgattctcagaacacagt

SEQ ID NO: 21737 - DNA, 65 bp, Chlorella protothecoides
acccctgcccacccctccctccgccatcagtcgtacctgcccctcgccgcgggctacttctcctc

SEQ ID NO: 21738 - DNA, 61 bp, Chlorella protothecoides
gttgtcttggcaaggattgcgtgcctcgtgtcgatgcagtgtagccttggtcccccagcgg

SEQ ID NO: 21739 - DNA, 61 bp, Chlorella protothecoides
gtaggtggaaagcatggcagtatggagacacaaaggtacaaggctcgagggtcgctccctt

SEQ ID NO: 21740 - DNA, 61 bp, Chlorella protothecoides
ggcctggagttgtgcaggcagaggcaggagtggcctccattcagagacttgcacgagattc

SEQ ID NO: 21741 - DNA, 120 bp, Chlorella protothecoides
aggggatctccacctgcgccccgattgacgtccagagaccccccaccctcacttggcaaaggcggtgtcgacaatcttctgcgagtccaggccctcgggcacctccacgactgtcagggt

SEQ ID NO: 21742 - DNA, 178 bp, Chlorella protothecoides
ctgctgcatcacgttccgtcacctatttctatcctgttgggcatgctgtcccagcacaagtgattgccagcagactgcagatcctccttcttgaaccatacctcatacttgggctggtaatgtcaacaaaaggcaccatgctgctcataccttgcagatcgagctgtgcagcggcaaa

SEQ ID NO: 21743 - DNA, 237 bp, Chlorella protothecoides
gtgggccacacctgaatgccagggaggtgaattgtcgaggttgtgagtggagggcaagttcaaaacggggagccaagggctgcttcgaccccaaaggatagagaaggagaagcttgaacaggctccccggcaggcaatgcctggagtatggtgcacactgcatgctgacaattcaagaacaccgcctttccttggggggcaagggaccaggccactacattccacctcgcatgtgaa

SEQ ID NO: 21744 - DNA, 112 bp, Chlorella protothecoides
tccggcttgaggcatcacttgtcatgcgcttagctgcctgcccgtctctctgtgcaatgaatacagccttacagacattcgtcgctcttctcctttgcagcaagccataata

SEQ ID NO: 21745 - DNA, 8367 bp, Chlorella protothecoides
  modified_base (106)..(115): a, c, t, g, unknown or other
  modified_base (880)..(889): a, c, t, g, unknown or other
  modified_base (1586)..(1595): a, c, t, g, unknown or other
  modified_base (2845)..(2854): a, c, t, g, unknown or other
  modified_base (3516)..(3575): a, c, t, g, unknown or other
  modified_base (3653)..(3662): a, c, t, g, unknown or other
  modified_base (3977)..(4013): a, c, t, g, unknown or other
  modified_base (4244)..(4253): a, c, t, g, unknown or other
  modified_base (4484)..(4497): a, c, t, g, unknown or other
  modified_base (4606)..(4615): a, c, t, g, unknown or other
  modified_base (5427)..(5495): a, c, t, g, unknown or other
  modified_base (6740)..(6749): a, c, t, g, unknown or other
  modified_base (6825)..(6951): a, c, t, g, unknown or other
  modified_base (7126)..(7135): a, c, t, g, unknown or other
  modified_base (7374)..(7383): a, c, t, g, unknown or other
  modified_base (7757)..(7795): a, c, t, g, unknown or other
agccagctgcagaccacacgagaggaggatatactagagatttctcaacccaaagagacctaatttgcaacaggacatggatggctgtcccttgcgcaaggtgatnnnnnnnnnncaacccaaagaggcctaatttgcaacagggcatggagggctgtcccttgcgcaagttgatgaggaacacacgaatccctgcccacgtaaactcccaagcctaccttttgaccgtttgcagactgccaggagactgggggaccccccgaatacgcagccgcaatggcaggcgagtctggctggtgcaggtccgacgggactttgttggctccctcagaagcttggcatgaaacgtcctcttcccttatgggcgcaagagctccggtgctgggactgggaccttgtcctggctccacaatgtccttgaggacaaaggtgccgcctgggccctgtgtgccgtcagcgggcgatgcccccccggctttcgcacgctgtagcgatggagcgcgctgagcgctagactccccggctccctcggtggcctggtccgtagaagagtctcgctccatcgatctgtcaccagggaaggattgacgaacaagacctccaagttctcttggcagcaccaaacggattctgccctgtagcacaaggaaggggaatgacgcgaattcacggcaaaggctcactgtttctcacttcagcctcttcatctccattttgaggatcacacacaccttgatcgcgctcttgatgtgagggatcacagtgcagagcctccccagatgggttgggcggcaggatgtcgcgggcgccgcgggacgcctgggataaaagcagtctccaaacctgaagagatccaaaaaagtgattcagtgtcgggggnnnnnnnnnnccgggtaaggattgacaaacaagacctccaagtccacttgacagcaccaaacggattctgccctgtagcacaaggaaggggaatgacgcgaattcacggcaaaggctcactgtttctcacttcagcctcttcatctccattttgaggatcacacacaccttgatcgcgctcttgatgtgagggatcacagtgcagagcctccccagatgggttgggcgggaggatggggcaggcgccgcggggcgcctgagataaaagcagtctccaaacctgaagagagccagaaactgattcagtgtcgggattgcaacctattcctatgcacgtcgggtaccacacgaagggcctcttaccagagccggtccatcgcaaccgtgaggtcatagcatccatgaagctgcattgcaactactcatagcggttgtgatggagctgaaactgaatgggatagactgttccgagaggtggttgagtgacagctgggagctcgtcgcgaccccttgcggggggacacatcgaaccccggaggtcagggcgcggctgcggaacccctgtcgcaaagctcaggggtgaatgccaccaaggagtcgagtccatatcataaccattcagcgaaataacagagactaaagttcccgttccgcaatcgcgggcttctcgcctgtctaaaaaactgccgttggacgcctgcaagtcnnnnnnnnnntaccattcagcgaaataacagaaactaaagttcccgttccgcgatcgcgggcttctcgcctgtttaaaaaactgccgttggacgcctgcaagtcgcggcgactactccatgctgccgttcgaggagaccggactttgttttctgtctcaacaggtatttaggttgtacagtttctgcaccgaaatatacgctgcatcacagatggctcggcagttgcgccggtggacatcgcttgcgcccaagtttgcggcctatatgggcactcagctccatacaggggtatagtggacgcctggggtcttgcactgcgggtgacttttatagtcgcatgatggcacagttgatcatccttgagacaagtctgtcacactcacgagggacatccgggcgctgatctgagttgcaggatgacaagtgagctcttgatgatcaagggatagctctctgcctcttgtttttgggggtgtgccagtcccagcagtggggcgtgctgcacttggtctgaagtagagttgtcacatgccatgtccccgaacgcatttgtggggattgtttattgggcatggctgggctgcatggccacgactcagtgcacacgcatgggtggaagggggaacagtccggagaggtaccccgcaacaaccttcccaggccgaagtgcaggcccaccctcggcctgcgctgccttgcaagccttgaaaacgtcgagctgggtcaggttggcgcgtggctgccaggtggcctcgttgtcagggtagccctgccacttcaccaggcactggaagccgcggccgacgcgcttgttcttgaggatggtgaaagaacccaaacctataccaggttggatcctttgcgtaccatccttgaagtgacacacgtggggagctcgtcttacaggggagtgtgtccagaggagaatggttgagagaataggtgcagattgcctcagagcaaggataatcatgctctgggcttggagtggaaggcaggcgcagaagaagtcacaaatgcaagcgaaagaaacgtgccttgatcggatgcctatggaagcttcgttggaagcttcctggataccagcattagatccctgaagccgggtgtcgttgataagatgcccgagagaggaccacgtagcctgcagcttcttttatagctggcggccctcggcacttccggcgctccgcgactctcgcggtgcacgtcgcatttcttaatagattatattagtatcagtattcaggactgggtcnnnnnnnnnngttctcgcctgtcttaaaaattgccgttggacgcttgcaagtcgcggcgactactacacgctgccgtccgaggagaccggactttgttttctgtctcaacaggtatttaggttgtacagtttctgcacctaaatttacgctgcattagatatggctcggcagttgcgcccttgggcatcgcttgcgcccaagtttgcggcctgattgggcactcagcttcatacaggggtacagtggacgcctggggtcttgtgttgtgggggccccctctccggaggcttcccccctttctacctgcatccgtgccctgcgccgcgcctacgccgcctggcaccgtgcctgaaacccaagcccctcaccgtatgcggggtcttgtctgtaacattcctatcttaggtcatatacagcggtccaccgtagtagggtctaacccgcccccacaacagtgcagattgcctcagagcaaggatatttatgctctgggctaaaagcgagaaggcaggtgcaaaagaagtcacaaatgcaggagggagcaacgtgtcttgatcggatgcctatggaagcttcgttggaagcttcaacggtagattcccgaaacagtgtgtcgtcgataaggtgcccggaagagggacatgtagcctgcagcttcgtttgtagctggnnnnnnnnnnnnnnnnnnnnnnnnnnnnnnnnnnnnnnnnnnnnnnnnnnnnnnnnnnnntgtgggatggtaagggcctgggatgcatgtttggtcacaagttgtgaagagaaaggcctgaatgtgcagaaagtgatnnnnnnnnnncttaagtagtggcacgggccagacacgagcgtgctgaaagaatgtctctgagtgtcagtgctggctcagattcatgtacacggcgggtcacaggcttgggcagtccaggaggacggcagggtgagaaacagggcagattatgggtggatggtcttgacatctgatcatcgtacttcgcgaacagcttcaggggtgggatggtaagggcctgggatgcagatgtttggtcacaagttgtgaagagaagggcctgaatgtgcaaaaagtgatgcacggctgggaattcagaacatgagatttgcaaagatgctcctnnnnnnnnnnnnnnnnnnnnnnnnnnnnnnnnnnnnntatgctcactttgtacatagcaaagctcatcgtaaaccttatgccctttctgccctgctccaatcctgcttgctgtgagcacacacaatgcacggtgacaagcctcaaatgaaaacagatcaaacttcctacttgatttggcgtactaccggactttgagcttcttgaactacttaatgtccgatctgtaaaaagataagcgaggatgtaatcaagagtgaccaagaacannnnnnnnnngatgctcacttagtacatagcaaagctcatcgttaaccttatgcccttcctgccctgctccaatcctgcttgctgtgagcacacacaatgcacggtgacaagcctcaaatgaaaacagatcaagcttcctacttgatttggcgtgctaccggattttgggcttcttgaactacttgatgtccgatctgtaaaatgatcatcgaggatgtaatcaagagtgaccaagaacannnnnnnnnnnnnnttgccaatacaatcagtaccatcttatactatttcctggctggatgtccattgcacatgctgcatacctggtgagtatgccacttggtgcttctgccaactgggataannnnnnnnnncttgccaatacaatcagtaccaccttatactatttcctggctgggtgtccattgcacatgctgcctacctggtgtgtacgccacttggtgcttctgccaactgggataagggtgatggcacgcaaggcattggtgggtgatggggaactggtggctgctgaaccgcttgctgtggctgcgtaggggtcagctagaatgcatgagagagggaacaacacaaatcacgtgcagcaatgttgcttatgtacataagacatggcccctaggttttttcagcacacagagcacgcaccgccagtgcaagcatccagaatgggcacctttgacattgcacggcgcctacaggcagaggcaagattagccagctcatgtgcgttctctgcctctgacttaatccatgagcctaaagcggattgcgcactgcagggattgaatgtcaagttggggccaaagaggtgggagacgaatgatggttgcgtgatcgcctgtggcaaagcaccacacagtagacaagtccctccccagcttcacatctgtgctgctgaaaacaccttgtacctatgcactggcaactcgcttgccgcaggagatgtggatgaggattgtgctcctttccctgatgtttccagttcttccctgagaagcttctgggcaaactgcttcttccaatccttgttcttcaggcagttcgttatcatggcttcctgcaattaggaagagcgggaaaacgttgtgaggctacacatactgcgacagagtggatgagctggcagctgagcggatgacaagagtcacctcatcccagatggccnnnnnnnnnnnnnnnnnnnnnnnnnnnnnnnnnnnnnnnnnnnnnnnnnnnnnnnnnnnnnnnnnnnnngtcgcgcaggccactccaggcagcagaacccctcccgttctcatagagcttcgcccggattctgtggtggaagcaaggtatgcataccgtcaacatgtcggagaccatgattggacgaggtaaggaggctttacgtttgatggtgggagtgcgtacggcacatgcttgggggctgattcagcctcttggagtcagcgcctaagagtgatctgttctgctcatgcataatcctggtcactcacctgtcgtccatctcggtgtcatcctccacattgtcaatcggttgtggcaggctggcttggattgggggccagtaggcactgtaatcaggcacagggggctccccctgtggcggtgaagggtaacaccatgtcccgtcatacctctgcaaggtagtgttcttgctcagcaagagatgcattgtgcagtgtagcacgcagatacactctctccagcagcggcgggtcctcgccaaactccccaaacccagccatccggagcgcttacaattgtagatttctcatccgtcattgtaccatctcctttacccgagatgtcagcgtctgggaatggggctccttcccgcgagtctaaatcgcatattttcagactgcgaattcagaggggagatttgtgtcatggccctgactgacagggccgagccaaaacctcagtgcagagttttttaatacggactggcggtacaagctcaatacaatacatatacataaatagtgaacctcacaagtggcgaaatccttcgggggacaagtgttggactgcgcggcctccctcccgagccgccatctgatgttcaagaggtgccacgatgactcaaggaaacttgattatcttcaacaagcacatgagcacgtataggatgaaatttatcaaacggcgggttgtcgctcgtggactacatcccccccacacacaagatgatggagctagaaagctggttggcgggagctgggttttgaactggatttgcagatgacaggagaccatggcccaattctggcctcataagcttgccgagtgagccaggttgatcgccttgttcgtaacgagcacgaccttgccgaccgggagcgccatcatttgttcaatagcaggatgtagagtcccagaccagccaggctaacaaggcatgtaccaaagaggctgtggacctgttgtgggggtgggttagaccctacaacgtggactgctgttgttgtgggggccccctctccggaggcttcnnnnnnnnnnaccgctagaggacggatctcctaccaataaggaagaggcctgtagaatgctactctatggtcgcacttcgagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggggcccctagcccccaacacacaatagtggaaacccggggccgcatctacgcggccagcaccaacatgccggccaacacaaacccggtgcctgctgcgacgcccgcgcccgccaacccagcggacgcgggcacccccgctgtaatgactatggcccaccttttggagatgnnnnnnnnnngtagaaaatgaggtagatttgcagagatgctttaatagctcagctgcattgagcagtgtaatagacgactagatgaagcgtacactgtagaaatggagacctgggagctcctaatacaacaaggagacacctgcaaggatgtggaccatttgcctcagaggaaatatcgagtgatctggtgccgaagagcactgcgcattgcacactgcatgccctgcctagcctgctctgttcccgcnnnnnnnnnnaagtgatctggtggcgaagagcactgcgcattgcacactgcctgccctgcctagcctgctctgttcccgaatgttgtaagctcaaacactggcctgcatcaagcctcaaaacatcccggaaaatacatataccttggtctttcagcctacaggatctccaactccttgaacttgttgatatccgatctgcaacaggttcagtcaacacagaaggttcaaggacactgcacagcaggcaaggagacctccagcccatccagacagtatcttccttgaccacttccagcctgggtatccaacacagttcctgcccacctggtgagctcgccagctcgtgcctctcctgtctgggacacgagggatggcacgcaagnnnnnnnnnnnnnnnnnnnnnnnnnnnnnnnnnnnnnnncgggcgcatatggggagctggtggctgcttggccggatgctgtagcagagaagggtggtttcgaatgcatcaaagaggagtgaacagagtacgtgggccgtcaactgcaactgtgtacagaaaacatgggcccagcatacatcagcaaacaaatcaaccatcaccagtgcaagcatccaggcggtgcacctttgacatcccaacacgcccacaggctggagcaggattggtcacctcatccatgtcatctgcttcagacgtaaactctgaaggtggatcagaacgcgcactgcagggattgagtgtgaaaatgggcgaaatagccgaatggttggttggttggtggtgtgagtgcttgtggcaaggatgtacaaccttgatgagcccgacccagcctcacaactattctgcttgagacgctatgtacctagacggcggtgacaggttcgctgtaggaagtgggaaggagtggagtggcactttccctgatgcttgcatttcttcttcaagaagttgttaagcagctgtctccttccaatccttgtcgctcatgaaatcagctattatggctt

SEQ ID NO: 21746 - DNA, 80 bp, Chlorella protothecoides
gaggttgtcgcatgatcatggcccggccaatgcggccagtcgtagcttattgatgccgagtgcagattgcgttggtgtca

SEQ ID NO: 21747 - DNA, 397 bp, Chlorella protothecoides
ggtttggggttgtatatgtacaacccagttcattgctcacgagttgcgaccttcatcccccggcgcatcaaacggcgagcccaacccctcctcccgcgggttatacctgcaccatgacacttgcctggtgtacagagcccagagatcgatccatcgtatgcagcatggaggccgtgaccagcatcctggttgatatggtcaccttcgagattaccttcgacgatgaacaagtgaggattctggatacacgcccaaccagcactgtcgtcgaggagatgacgccgtttcagagcacaacttcgaagggaaaaattactgcgactacctggaaccgggatggatcaagtgtccattctgctgcgatcgctttggcgccctacccttcaccgcctccacc

SEQ ID NO: 21748 - DNA, 63 bp, Chlorella protothecoides
cagcagcgaggtgcggctccagggcgccttcttgccgggcttgggggagggaggcggcgatga

SEQ ID NO: 21749 - DNA, 80 bp, Chlorella protothecoides
gctcactccagcaaactggtacagggcgtgccggtctctttgatgacaccaggcacgctgtggggagctgcactcgccct

SEQ ID NO: 21750 - DNA, 80 bp, Chlorella protothecoides
ggcgatcctggggtcggcgccggacaagcgtgcagcgcttcctgaagactgccgtcccccaccccctctctttccattct

SEQ ID NO: 21751 - DNA, 75 bp, Chlorella protothecoides
agcttcaaggacgtgtatgagaagtggattctggctgggaacgacagatctgccatgccggtacggacctgatgc

SEQ ID NO: 21752 - DNA, 93 bp, Chlorella protothecoides
atctgcttcttcagctcgtcgatgatgcagaccttggggttgtaggtcagggagaccgtgggcccggcgcagaaggggtccaccttctcggag

SEQ ID NO: 21753 - DNA, 76 bp, Chlorella protothecoides
ggtgtatgatcaaatctgatcactccaagcagtccccagcattcgcactcgccgtgggcccggcacattcgggcac

SEQ ID NO: 21754 - DNA, 61 bp, Chlorella protothecoides
ggacgaactccctgtcctggagatgggttccgatgcgacgacgtccgacgtctggggcaac

SEQ ID NO: 21755 - DNA, 66 bp, Chlorella protothecoides
gatgcgacgacgtccgacgtctggggcaacgataccaccccggctgtttcccgagagccctcgcat

SEQ ID NO: 21756 - DNA, 123 bp, Chlorella protothecoides
ctcaggcgaggtaactgtctcagaactggctgaaggctttccagtggaaggaaccacctggtgtaggatgggatcgtgtgattggtgcgatggtagccagtccagatcaccggcgcccgtcac

SEQ ID NO: 21757 - DNA, 72 bp, Chlorella protothecoides
gcaggctggggggcttgcgatcgggatgcaaatcagcgttggggccccggcggtggggcaagagacctgctt

SEQ ID NO: 21758 - DNA, 61 bp, Chlorella protothecoides
tggcagcagggagagcatctcccatcccaactcaaagtctcacctctcagggtactcctgc

SEQ ID NO: 21759 - DNA, 79 bp, Chlorella protothecoides
cctacttgcctacagaacattgacaccgaccagattatccccgcggagtatctgaccctggtgccgtccaaggtggggt

SEQ ID NO: 21760 - DNA, 76 bp, Chlorella protothecoides
gggcacatggcccctgtgctgacgtcctgggtgccaggcatgccccagctccctgggcgacagactccccggcagg

SEQ ID NO: 21761 - DNA, 61 bp, Chlorella protothecoides
atcaagtttgacatcataggctgttctgggttttcacatggtggaatccattcccaaaatc

SEQ ID NO: 21762 - DNA, 61 bp, Chlorella protothecoides
atcacctatcaccctccaatctcaatacgcaccctcaggctgccttaaaaacactacaagc

SEQ ID NO: 21763 - DNA, 80 bp, Chlorella protothecoides
tgacggtggatgtgatgctgatgcttgatgccctcacacctgctcctcaaacctcgcccatctgctcccccacctcgacc

SEQ ID NO: 21764 - DNA, 61 bp, Chlorella protothecoides
cagcatcaggcgcccagggatcagccagttcccaaagctggtgaaggtgcatcgctcctcg

SEQ ID NO: 21765 - DNA, 79 bp, Chlorella protothecoides
ccaaagctggtgaaggtgcatcgctcctcgtaccgctctgtgcttggtatggaggtaattgtgagtatcggttgatggg

SEQ ID NO: 21766 - DNA, 2033 bp, Chlorella protothecoides
  modified_base (725)..(734): a, c, t, g, unknown or other
  modified_base (895)..(904): a, c, t, g, unknown or other
  modified_base (1919)..(1928): a, c, t, g, unknown or other
gtaggagagccgccccacgctcatgcgtctggtgcccgggccatgtcggactttcaaatcttcgtcggttgtacttgtcgtgctgtggaatagtaccaatggcggcatccgtctaatggacctagagtaaaatacacaacgtgagacaagattcttttctgaattcgatgctggtacccggtgctgatggaccttgcattcgtactggggcggggatctaacctaaaccaaagtaaagtttccccccaattgtccacagtgatggcagtagggtgccggtgagaagccatgcaactgtatcaaagaatgcttgcatccgtcaccctaagccacatctgttgaggaacattcctgttggtaggcttcacctcccaggggggcccatgcttccaaagtgggaaagtcccaaggttcttgatagcctacccatggaccctaacacccacattggaggataaggcccctgtccacatgggctcaaaagcgcaatatatctgtgagaatcgtaacttctgtcatgagcttcctccaggtgactcctgagtcgagatcctggatcgtcaagctttgaacttacccctcttagcctcattgctccaattattgtattctagggcctccacttccctgagagactgcatgctttgagactgctcaaggggaggtgttgcaactcaaatgagagccgacggacgactctctccgataggctctcttccttgagnnnnnnnnnncgagagactgcatgctttgagactgctcgagtgaaggtgttgcaactcaaacgagagccgacggaggactctctccgataggctctcttccttgagagagaccacttccccaacgactggggtggggattacccacacacgcatcctgatctggttcctgnnnnnnnnnnccacttccccgacatttgaggtggggatcacccacacacgcatcctgatctggttcctggtttatggacgatactgctttcaaacagacaaccaggatgggggaatgagcatggaagggtaccagagtgtctctgaaggggcgcagatcccatgggcggaggtcataactcctcaaaagcaactagcgagctagtcggcggggatccaggcctccagaatgcgacgggtgatggggtacgcacatcctgccatggggatattgagagcaaggattcgtggggcatgcattgccaagacccttgcaatctctgcaacatgacgagctgccttggaatgccaccttaatgccttatccttgtgccttacctggaaggacactcctcacgctggtccagtcgcacttggcaacgccattggagactgggcactcaaattccagtgcattcgaggttgcgcccggatcgaactcgcactcgatcttctcactgcggatcgtcccgccctcgtgatcgcatttcagctgtccatcgcaaaaatggcacctgagcggcgcgtagtagtgcagaagatcaggtcgcagtgcccgtcccgcatgggtcggccatcatcttcatctctgtcgatcatctcggagcagccgaagatagctcatgcacatgctattgccaacctctcgtcactcactcaatttcatcgttgtcccactggtcggtgaatgtgccgctacactcctctggctcgacaccctgcgagagggacgatgcgggtggtcgcacctagcatggcttcggtcatggatacatgcacaggcccattcccggccttggatggcccttgcaagctccaaaagccatgagcgatgttaagaagccgttcacttaccgcgtactgctggagggtgcgcgatgcgcttgcgcaagcgaccaacaagaggaggggaaggatcaggcgcgagaccgccatgctcgcggatgtcgtttcggagctcgggctcaagtgccagcaaactttttnnnnnnnnnngatgcacgggcccattcccggccttggatggcccttgtaagctcccaaagccatgacagatgttaagaagtcgtgcacttaccgcgtactgctggagggtgcgcg

SEQ ID NO: 21767 - DNA, 70 bp, Chlorella protothecoides
gtgcggggtctgggcatcgcgcgggcggggaccgtcgagcgagccacgcagcttccagctggcgcaggcg

SEQ ID NO: 21768 - DNA, 79 bp, Chlorella protothecoides
gagccacgcagcttccagctggcgcaggcgggagccgcctcgcctgtgcctgccaccgctgcacacccacaccccagct

SEQ ID NO: 21769 - DNA, 169 bp, Chlorella protothecoides
tgcacccctccccgcaccgacctctgcgagcccgaagcggagcaccgaggccgcccactccacgggttccagctgcaggccggcttccgcctgcaggacgccggccgcctctgccaggtccatcgcccggtccctggcctctgccaagcgtggcggcagggtcacctcc

SEQ ID NO: 21770 - DNA, 73 bp, Chlorella protothecoides
cagctcgtagcggtagccgcggcacacctgatgagagattgtagagggggaggggggttgactccatgaccgt

SEQ ID NO: 21771 - DNA, 91 bp, Chlorella protothecoides
gcatgctcagactgggcaccctcgtgcactctgattcctgcccacggaccaggcatccggtattcctggatgcgtgcaagcaagccccctc

SEQ ID NO: 21772 - DNA, 241 bp, Chlorella protothecoides
tgccccccagtcttcctcccccattcccccatccccctctattcttctcaggcgcaaggggtttgcgggtgcaggcacttccatcgagtatgaagtgaggcctaacgacccattcaagcagttcctgatcgacacaattgatgctgcgaccctggcaacctgccaccccactccatcaaagatctgcaaagccatgtccatagtagagtgccttccggcaggcatgcagaggtgtttgccg

SEQ ID NO: 21773 - DNA, 72 bp, Chlorella protothecoides
cctaaccctaaccctaaccctaacccaaaacctaacccaaaccctaacccaaacccaaacccaaacccaaac

SEQ ID NO: 21774 - DNA, 63 bp, Chlorella protothecoides
ggtaaacctacatgctgaagcctccccttcctctgtcaatgctgcacaggctgagtttgacgc

SEQ ID NO: 21775 - DNA, 542 bp, Chlorella protothecoides
ggcgagggtgcgggggtgggttgggcgggcgaggggatgggcgcgggggtggcgggggcaggcgaggggacggcgcccggggtcccgccccgtgccgccgccgacgagaagcaggcctcgaactcgggggcgccgctggaccggtggtcccacgtctcggccacgagcaggaccgccccgtcagagacccctctccctgcatcggccctgctgagaccctggtcgcgcgccaaggaagcccaggccgcacgggagcgcgccggtttccacgagcaaatgccgcgcggcgtgttcgaggcggacgagggcctgcaggagcggcgggtgctggagtacctggccctgggcgacctgcaggcggcggttggcttcctgctggccagcccgccggaccgcagcgcgcgctactaccgcgacgcgctgtgcacgctggccatggcctttgccgtgggtgacgacgccggcacgcgcgagcggggcggcgcgggggccggcgacggggggcccccggaggggacgccggggtcgaccgcccccgcgcc

SEQ ID NO: 21776 - DNA, 88 bp, Chlorella protothecoides
gggggtgggggggggggggggggggggggcgaatagacaggcatggaggggttgcagacaggacggcaggagtttgggactggtagga

SEQ ID NO: 21777 - DNA, 751 bp, Chlorella protothecoides
gattcccccagtggtgctgacctagagattctctgctcctgtctaagtgttccacgtgccatacatccacatctctgttttgagcacggatgtggctctgatgcctcacccaacatcccccctgatacttgcaagttgtcccttcccctttccgactccatcattccagacttcactccattcccaactccatttcattcccagcttcagtgtatcacatgtacgatctgattctgtaatttcaaccaatgagcgatccacccaacgctttgagagcagtttggtggggagggcaggacggttggaagagggaatcatgaagggacatggctcacctatccagtttggcctgactctggaagttttcagcgctatgctatgctgcatcgacagtgcgtcatgtatgagagtcgactctgcaccttgggactaccggccaagcagcttggcccccaaagagatgcgtcggcagctcacagagcgcgggaaacagaagtagatggtagcacatgatgaatggacttactaacttggtcgcatcaaaatagcaagtgagcgcactctagttgcacaccaaattgctggttgagctttggctactctcatccacccctccttaagcacctgcaagttgatgtagcgcgacgcgagccaatctctggggccttgtgtatgctgggagtcgagtagccttcgacattgtcggaaaggccttttgtatcgcgtacggagcggaaggatgtatcaatac

SEQ ID NO: 21778 - DNA, 61 bp, Chlorella protothecoides
accctcattgaaggtgtgccctggttgaagcaggaattaacagggcctccatcagtacagt

SEQ ID NO: 21779 - DNA, 259 bp, Chlorella protothecoides
tgccccgctcagatacttggtactacaaatcgcatccctgcgctcagaaggtcggactcgatccgccccgctccacctttctcagcccttgccgccagcgcacccgatgagaacctaaatatgcgccgctggctcatagcctgcactgtgcctacacatagtgacttgatgtaaggtatatggatgctcccgacaggttgaaaagcattggggccggtgggcagagacgtcggccctcccaggcccgtcgccccaccaa

SEQ ID NO: 21780 - DNA, 121 bp, Chlorella protothecoides
ggctatggtaatgtgattgagaaatgtcgtcaggctgctgtagcgtggaccttcataccggatctgcaaccccacgcggatatccaatcccttgggtcctcgcgctctgtctgcggaccct

SEQ ID NO: 21781 - DNA, 74 bp, Chlorella protothecoides
cagcagctccgacagcgtggcttgctgcgggaagggggggcgcattgggaaacgagactcagagggaggggggg

SEQ ID NO: 21782 - DNA, 126 bp, Chlorella protothecoides
agacgtgagctggtccgagaatgccgaggtcccatcatgctgggcaacgatggccacacacgcactctccttctggatatcttgtgtcgttataaatcgagcccagactctcagcccatccctgcc

SEQ ID NO: 21783 - DNA, 61 bp, Chlorella protothecoides
gtatagttgtcaatcgtctgatagccgctgcgcgaggatctaagtacccatgagatgggcg

SEQ ID NO: 21784 - DNA, 80 bp, Chlorella protothecoides
ctttgtgcaagcatcatctgtgtaagtgaattgggggagttggtgattgtagacaggcggcacagcttcatcgttgtctg

SEQ ID NO: 21785 - DNA, 69 bp, Chlorella protothecoides
cgagtcatgcactgcacaggcactccgaaacctcgcagggcggattccatggctggacggcgcaggcac

SEQ ID NO: 21786 - DNA, 167 bp, Chlorella protothecoides
ctggagccgttgctctgcctccactggggccaggacctgaggtactccatcgcttgcaccctgtagagctccggatcgactccgttcttcacgccttccttgtgagtctgccaccacttaccagccctccaaatctcatagcaatgcatgttgacgaatatctggga

SEQ ID NO: 21787 - DNA, 67 bp, Chlorella protothecoides
aatgcgttctgggtcctccacatgattgtgcgtggcatcctcccttcccagatccttggcaggcatg

SEQ ID NO: 21788 - DNA, 61 bp, Chlorella protothecoides
tccatctcgtaagtcgacacccccgcctccaaccaagaggttgcctccagcccataaattc

SEQ ID NO: 21789 - DNA, 75 bp, Chlorella protothecoides
acccgtgcgccctggaaacggcaaagggccggacaaatttattctacgaggaggcagtgaagcctaggtacaccc

SEQ ID NO: 21790 - DNA, 213 bp, Chlorella protothecoides
atgagggaccatgcggggccttcggcattgcaggtgctcactcggttaggtgctagcagatgcagttcagttgccactttactgacgtgcaggatgcgggctcagcttttcttgctacggaaagagggagccagagggtacacggaagtattggactttgtcaacagcctttctggtactgtgtataatccctctacatctccatcggaacag

SEQ ID NO: 21791 - DNA, 71 bp, Chlorella protothecoides
gccatcgatcgaggcgggaaccgctggaggattctacgacgcgaatggcacctggtgcacaggctactggg

SEQ ID NO: 21792 - DNA, 61 bp, Chlorella protothecoides
gctcgtcaaccaccaccaccctgcacaccccccgcaggcgccgcaagaagcgtatccaagg

SEQ ID NO: 21793 - DNA, 76 bp, Chlorella protothecoides
ggggggaaggtggcagcgcagccagggcccgagcccggcatgcgagggggggaaggtggcagcgcagccagggccc

SEQ ID NO: 21794 - DNA, 552 bp, Chlorella protothecoides
gcatgaggagacatcgttgcgtgtcacgtttaatgagcatgcgagtcgttgtgtaaccctttttacaggttcacatgttcctacaatgatctgattcttgctggacataacaatgctttctcatgtcgagaaacgtaattcggctgtttaaactttcgcgaaatgacaggctcctttgctgtgagggcattcacaaacctcatttgccaatatctgacgttacagatcaatttaggtacacaccagggtcatattttgcatactgcatgacacggattcaagcttggccattttaagcccgactcctgcattgtgcggtatctgtacaaaatagctgtagctcctgatcgttcggtggaagatatgcgggattgacgagacgttcagcataataaacaaacttcaggcactgcccagcttaccttgttgccctgagagcagtggtagagtgttcaggacggcaactcctctttcatttctaccaaccaccacgacgagtcacaaatacttagccaattacaatcctttttgtcaacatcagtgatctcatga

SEQ ID NO: 21795 - DNA, 62 bp, Chlorella protothecoides
gcgatgcatgtcgccccgccccaccccgagcgcacccaaggcactcacgcttgcgaccctgc

SEQ ID NO: 21796 - DNA, 61 bp, Chlorella protothecoides
aacaaccaaaaagtccaacggccagatgcgaccgcggatctccacctccacgccgcgcgcc

SEQ ID NO: 21797 - DNA, 29593 bp, Chlorella protothecoides
  modified_base (246)..(297): a, c, t, g, unknown or other
  modified_base (422)..(431): a, c, t, g, unknown or other
  modified_base (994)..(1003): a, c, t, g, unknown or other
  modified_base (2295)..(2304): a, c, t, g, unknown or other
  modified_base (3357)..(3366): a, c, t, g, unknown or other
  modified_base (4382)..(4391): a, c, t, g, unknown or other
  modified_base (5059)..(5068): a, c, t, g, unknown or other
  modified_base (5537)..(5546): a, c, t, g, unknown or other
  modified_base (6029)..(6038): a, c, t, g, unknown or other
  modified_base (6322)..(6331): a, c, t, g, unknown or other
  modified_base (6778)..(6787): a, c, t, g, unknown or other
  modified_base (6877)..(6886): a, c, t, g, unknown or other
  modified_base (7566)..(7575): a, c, t, g, unknown or other
  modified_base (8275)..(8284): a, c, t, g, unknown or other
  modified_base (9079)..(9088): a, c, t, g, unknown or other
  modified_base (10306)..(10315): a, c, t, g, unknown or other
  modified_base (10870)..(10879): a, c, t, g, unknown or other
  modified_base (11286)..(11295): a, c, t, g, unknown or other
  modified_base (11691)..(11700): a, c, t, g, unknown or other
  modified_base (12159)..(12168): a, c, t, g, unknown or other
  modified_base (12591)..(12600): a, c, t, g, unknown or other
  modified_base (12883)..(12892): a, c, t, g, unknown or other
  modified_base (13896)..(13905): a, c, t, g, unknown or other
  modified_base (14063)..(14072): a, c, t, g, unknown or other
  modified_base (14149)..(14158): a, c, t, g, unknown or other
  modified_base (17396)..(17405): a, c, t, g, unknown or other
  modified_base (18475)..(18484): a, c, t, g, unknown or other
  modified_base (18643)..(18652): a, c, t, g, unknown or other
  modified_base (20779)..(20788): a, c, t, g, unknown or other
  modified_base (21209)..(21249): a, c, t, g, unknown or other
  modified_base (21430)..(21439): a, c, t, g, unknown or other
  modified_base (21718)..(21727): a, c, t, g, unknown or other
  modified_base (21807)..(21816): a, c, t, g, unknown or other
  modified_base (21953)..(21962): a, c, t, g, unknown or other
  modified_base (23003)..(23012): a, c, t, g, unknown or other
  modified_base (23893)..(23902): a, c, t, g, unknown or other
  modified_base (24093)..(24102): a, c, t, g, unknown or other
  modified_base (24202)..(24211): a, c, t, g, unknown or other
  modified_base (25641)..(25650): a, c, t, g, unknown or other
  modified_base (26100)..(26109): a, c, t, g, unknown or other
  modified_base (26683)..(26731): a, c, t, g, unknown or other
  modified_base (26882)..(26891): a, c, t, g, unknown or other
  modified_base (26954)..(26963): a, c, t, g, unknown or other
  modified_base (27026)..(27134): a, c, t, g, unknown or other
  modified_base (27616)..(27625): a, c, t, g, unknown or other
  modified_base (28054)..(28063): a, c, t, g, unknown or other
  modified_base (28308)..(28317): a, c, t, g, unknown or other
cgtcgcctcctccgccgcgcggcggccggccgcgtcacaccgcgcccgcgcctcgtcgacgtcgcgcagcgcctgcagcgcgggccggggatttggagcaagcgtgttgggggtgggatgtggtgtggggcaggggaatccgggtgggggtgggggactgggtgcaagcggaccccgggcggcatgacaaccccgagccttcgccgcggtcgccccccgcggcgaacgtgttcaacaagaccccgnnnnnnnnnnnnnnnnnnnnnnnnnnnnnnnnnnnnnnnnnnnnnnnnnnnncgatgccacctcctccgacaagtgggccccacccacttccctcgccccccacctcctccagtgcggcgcgcagatcccccgcctcgcgcgccgcggcgtcggccgcagcgcaggcggccgcccgnnnnnnnnnngcagcgccgcctccaggcgcaccgctgcctcgcgctcggctgccgcccaggcctcggcctgcgagaccgccgtagcctgcatggcctccagctggtggagcaggggccgggtggcggagggcagcgacgcctcgacgtccgccgaccgcgcctcggccacggcgcagcgccgctgcagggcggtgacctcgccgctcagcagctcctcgcgctcctcccaccgcatgcgctgcgaggaggggtgggggtgggaaggggtggcgggaggtactgtgcaaacatggtgaatcgaaactgaggaaaaggtgcccgccagcaggacaacatgcggctctctgtgtgtgggtttgcaaggaagtcatccacactcgtgcatcccctcaggcaccgctcgagggcggcaggcttgcggcggcccgcacgcacgaagcagcgtgctcggatgacgacatggccgcccccacttcacacttctccaccctccgtccacacgccgcctcgcctcccactcaacgcgacgcacagccagacaacacacgcgcacacctgggcctcggcctcgnnnnnnnnnngtgtgtgggttcgcaaggaagtcatccacactcacgcatcccctcaggcaccgctcgagggcggcagccttgcggcggcccgcacgcaagaagcagcgtgcttggatgacaacatggcctcccccccttcacacttctccaccctccgtccacacgtcgcctcgcttcccactcgacgcaacgcacagccagaccacacacgcgcacacctgggcctcggcctcggccctaagctccgccaggctcttctccagggcggccgcacgggtctcgctgccccgcagctgctgcaccgccccggtcctcgcggcgtcggccgccctttgctccgctgccgcctgtgggaggaaacagaggcaggaggtgtccgggcaccgatgggagcgcagtgccctctacacgcctgccactgcagggtattgctcccctgccgctcgtcaaatgcacacacccctcgggcctccgcgatcgccgggtcctgcacaggcgacgcaacagcccattcgccctttcctcacggcacctgggctgcgtgggcctcctgcagcgcctgggcgtgcgtggcgcggtccgccgccagctgggcggcgtgctgctcccgctgcgccgccagctcggcgagcgcgctttccaccctggccccggcctcggaggcggcctgctgcgcggcgcccagcctggcgcccaggtcctccacctggccgctcagctcgcggttctgctggcgcagcttacgcagcgtggtctcctgggccagctgcttcttgctcagcttctcgccttcagccatgacctgacggtagggagcaggaaaggggaattttagggggcagaggcacgggcctgtgacggtgcagggggggaagggggttgcctgaattcagacccagcttcacttgcgcctctgggccaaagacatgagcgcgagggccctgtagcgtcaggcacttgcgcagggttccttcgccgcccagaagaatacaggttgctggacagctcgccagcagcagctaacctcctggatcatctcgtccttctccttgagcttgtcctgcagggcggtggtctgctcacagctgcggcgcagcatgtcccgctccttggtgagggcgtaggccttcctctctgccgcggccaggcgcgccgagaaatccctgtgcgggagcaggtggaggatgcagcatgtagagtgcctggggtggatgagacaggtcacaaaaggtccatagcagcctggcaatggggaaagcagctccctgaggcagagattcgccgtggatcaccccaaaccnnnnnnnnnntacaggtcacaaaaggaccatagcagcctggcaatggagaaagcagctccttgaagcagagattcgccgtggatcaccccaaacccttcaccccaaaccgccatgcacacccgcctcctctacctctccagctcttccacgtcctgctgcgagactgccgcggccttgagcgccagctcctcattccgctgagtcagccgctcaatcacgctggccatgtgcgccatctgcaggcagcgaggttgggagaggatgaaggcgtcacccagcgatcagtttggtagctccaccctgccgagcggtgatcccgtgcatggcgtcaatcaatcgcacacagtcataaacaccctcactccgagacgcagccacagccgcaagcatccccacacgagttgacaaaagcgcgatgaaacaacaaagcgcacctgaatggccgcctgctccgcttgctgctcccgaacgcgcagggtctccctcagcaacgccagctcggcggcaggaggtcccatggggaggtcttcagcagctggacttggcccatcatctgatgcttttggtaaggggctcaggacacttgcatcctcctgtatctggaccgccataccctgatcaccagtggcgtccttgctatcgtcccggtccagggctgatgccgggctgggctcgccattcggctgggtggactcttcctcctgcgagcgatcgtcgttgccatccagctctgggtctcgtgatggagctgcagcggaaggggaggtctgaccagatcctacagcctctgctgcggtcgttgtacctgctggcgtagcagtggcagctgcagaggatgactgctggtgctctgcctttgcagggcgctcatccaggctcgctgccttcccctttgactcgacgatgtcgtcaggcttctgcacccgaggtgcatcagcaggtgcatcattgccgctggagggctgagcttctccggcgctgagcgcctggggagactgttgccgaggtgagtctgggtcactcgcctcctgccgctcgtgctgctttggcctggggcctccnnnnnnnnnncgactcgacaatgttgtcaggcttctgcacccgaggtgaatcagcaggtgcatcattgctgctggagggctgagcttctcctgcgctgagcgcctggggagactgttgctgaggtgagtctgggtcattcgtctccttccgctcgtgctgctttggcctggggcctccgtcagcagcagcaggagcgtcgcgcgagctggagggatgtgcggggctcagcggcgcggcctgcaggcccacatcatcgtcctcgctccagccctcggatcgagcatctgagcctggagtggaatgcccttcagcggctttggctgcttctagcaccgcctcagtcgggtccgaggcggtctctgcagcatccggcaccggtggcaacgtctccgcaactgccgaggtctcctcctcgcctgcagtcaggcagcgaacgatcagcacctgatcactgggtttgcaagaatttcatcgcaccgcacccctcgcaccttgctccggctcatcgaatgccgcggagtcgtcttgcacctcccctcgcagggtggcgtccagagtggactcgatgtcctcccggatcttggagaagcgctccccgatgtcattcaagctgctcaatccggctgcaaagtcgggcatggaaaacccaaaccccgccatggtgggctgagcgcctcgatcagcgctgcttcacacagcactgaggtttgctttttccgacagcctggcagcgagctgccctgggcaacgcatcagcatcacaattgtcgacgcgacaacgaattaaccagggcttgcgatgtccaggtgtctcattaactttggccaccttgttcgaacgcgaagtatcgacttcgcgctcggaccggcagaggaggtgaacatgtctccagaggttttcatgtttgggttgatctggaaatctcaggatggaatgtgagcttctccacttgttctaggacgtttcaacgaaacagatggtctggtccacagcgttcagggattccatggactcccagatgtgnnnnnnnnnncacttgttctaggacttttcaacgaaagagatggtctggtccacagtgttcagggattccatggactcccagatgtgtcctgtgggtctcaatgacatttttggtgcacacaaatcacagcgcacacgatgtggtgaactgcttgattggaagaagggatggtaaaagactacaggtgcagggccgcatgtctagggcgcaaacctccagatccatatgcttccctctgtccaggtggagcctccgcctgctgactcgcctcgccctgcgggatgcattcgagccgcgcgaggaccacctcggccgggccactgacggtccatgcaggcgttgtacctctcgccaatcagggtcccaccctctttgcagggaattccaaggtattcaggaccatgagctcggtgccggattgaagcagcagacgccttcaagatgagcgtgcgccagcgccctccggcgtctcatacagggagctcaggatgcgaaccgcctcctccgccctgggccggcttttgggctcggccgaccagcaggcctccatgaggttcaccaccgcttccgggcactcctccggtaccctgcaaggaatgggtgaagggggttgaagcgaggtctgctgcccttgctcctagcatgacctggcacctggaaacacccacccacctgannnnnnnnnntgaaggggtttgaagcgaggtctgctgcccttgctcctaacatggcctggcacctggaaacacccacccacctgatgggtcgcatcttcccccgcttggggatctcggacgtcaccagctcccagagaacgacccctgtgggcggatgacggaaagtagtgcaaggatcattggtatcgatccctctgggctttcgtctcgtgttgatgcgctccaccagcatggccctcgctggtgtatgcctgcatgctggttgccaaacgactcaaattatgcccacccttaccgtagctgtacatgtcagactgggcagtggtccgcagcccgaggatgacctccggtgagcaccagttgaaggtgccacctgcagcagagggagcgccgtaggaaattggtgccagagactcctccatggcaaggagaatattaagatgcccgacctcgacgcaaatccatgaagtaaacagannnnnnnnnncgagcaccagttgaaggtaccacctgcagcagaggggaacgccgtaggaaactggagcctgagactcctcaatggcaaggagggtattcagatgcccaacctcgacgcaaatccatgaagtaaacagagtagcgggcagcccaccaacgcccaaagggcgagaccttcgcgctgccgattgtacagtgggtctgtgaaggtggcaggcagcatgcgggcgaggccgacgtcggtgatcttggcgctgccgtagtcgtccaggaggatgttggaggtcttcagatcgttgtgcacgatcctggggatttccgggggggaagggatcatgcaggggctcacttggggctgaggtgcaccttgcacggagcgcaaaccatgcctccacttgcgttagtccggaggctttgcactgtaagaagctcatccctcctcctcccaggtgagctgcaggttgccaatctggcacgcacagccccccccccnnnnnnnnnntacttgcgtcagtccggaggccttgcactgtgaggaactcatccctcctcctcctgggtgagctgcaggttgccagtctggcacacacagccccccacccgcgcacatccccagacgatctgtacttatggggcctcctcgaccggtcaatcagtgccacacacacactatttccaaccccccccaaacccactttctgatggacaagtacactaggcccctggcgacatcaagcgcgatgcgccagccctggcggtgccagtccaggcgcttggcacgcagcnnnnnnnnnnacggcctcctcgaccggtcaatcagtaccacacacaccatttccaacccccccaaacccactttctgatggacaggtacaccaggcccctggcgacatcgagcgcgatgcgccagccctgacggtgccagtccaggcgcttggcacgcagcccgctccacacgtcaccacccagggctctctccatgaacagcagggtgttgcccctgacctggtctgtgcccatggccatgaagctgacaatgtacttggagcggcaggtcttcaggatctcgatctcccgcagcagccgcttctgcgaaggtgtccagatgggcaatgatgagggtggtattggtggctgctggactctctacttctgcatgacttctctgcaatgcgcacttgccgggagtcaaagaaaccaagggcatggtccgtgcttcctgcagcccatctcggcagacannnnnnnnnnactccagacgtcaccgcccagggctctctccatgaagagcagggtgttgccgctgaccgggtctgtgcccatggccatgaagctgacaannnnnnnnnnttccagatgggcaatgatgagggtggtactagtggctgctggactctcaacttctgcatgacgtctctgcaatgcgcacttgccgggggtcaaatagaccaagggcatggttcgtgcttcctgcagcccatctcggcagacagattcattacctacgagccaggcttgccccctactcgagtgtgtgcccacccatttcccagggtaatgggtcaccacgccccaacccacctccatgacgagctgggcggcctcggtttggtccccgcccaggagaaccttgatggccatcagctccccattccgaagcctcccagagtacaccttggcagggagcagggtgggtggggtgtcaagaagtgcgagcatgtgtgtgaggctaggggcagtctctagacaaccttacaacacccagtcctccccatccacccagtacctctccgaatcgacctcgacccagaagcttgcgctcgccagactcggggtccacatcaaactcaaactcggttgccggaaggaaatagtgatgggaggagggcggggcagataccctccggaagggctggagcagctgcgccccaaggcctggtggcagtgggatgggcaggcggtgagcagtgtctggagagtttttcagaaataaaaacacaaagtcagacttgtgacatcttgaatacccnnnnnnnnnnagtgagcagtgtctggagagttcctcagaataaaaacataaagtcagacttgtgacatcttgaatacccagcctttcctgccgggtaagcgggagtgcatacgcaagtggaaggctgtgtcaggaatgtctaaacagcccaagcgaccaccaccccaggcctcactcttgatgctcctggagtcagagctggaccctccctcctcgccttccgtcagctgaccatgtgcaagagaacaccagtgatgtgagtgactcacctcttatacagagagatagtgacctgccatttgcatgccaaaactctccaaagagtcaaccatccttccccagcatccccgtcctcaccccgtgatctgctggcagccaagggcggctgggcaggaggaagatccagaccaggaggcccaccagggctacgccgaccagggtgccaatcacgataccagcaattgcgcccccactcaggccgccgtcctctgggtctgagctcgcgggtgttggtgcctctgtggactctaactccccctgtgaagagagggattttgatacaacggtcgacacattgcagcagccgtgccgatggagtacagccacctgcactccacttgtgtatccccctggacagccagtgcactcgtgcaatattagggtagcctccatcttactccaatcaagacatcgccgggccgacactgagnnnnnnnnnntcccctgtgaagagaggggttttggttcaatggtcgacacattgcagcagccgtgccgatggagcacagccacctgcactccacctgtgtaccccctagacagccagtgcactcgtgcattgttagggtagactccatcttactgcaatcaagacatcgccgggccgacactgagggtccaatcccaggagggcctcttggtcgacggttggccacgggtccaggcgcgatggggggatgtcctcccacctgtcccatcgcatgaatgtgtcattgaccacgagggccattgtatagcaggcagggtttccaaaatagcccttcaggaccttgcccgtgctggccatggtgatgtatacctgcacagggggatcttggagagtgctggagggtcaactcaccctggacatgacggcgggcagagagcacacaaggagagtgggtgcgaaggggcgagatcggcaccggggtggctcccactggaggagactcggtcaccaggccctgcaattcaagcacgctcacgaggcagccagctcaatcaacttgcctggcctttctcgtctgcgggtcggaaggtgtagcccatgtcggtgcccgttgccaatccagagatgggctggaccttgccggcgccgaggatccctccctcacaataccctcctggcaacgtcacaagagtttgccagcaggggattctggtgagagcccaggctaccttgatcagattccaacccggcactcagcatgcacgcccatctccaacatcctctctccccacacgctctcatcagnnnnnnnnnntgtcacaagaggttgccagcaggggatttgggtgagagcccaggctaccttgatcaggttccagcccggcactcagcatgcaagcccatctccgacatcctctctccccacacgctctcatcagcctcacatgactgctctccagcttccctcacctggaatcacatactgcccaaaaacggtcgccacacgttccggctccgaggccggcaccatctctgcagatgtttggtggtgggtggcccgatctcagggcagcatggtgcgacaccagcctccgcctgtgcaacagaccagcaccgcctgcccactcccaacatctggccgcacacaacacactctgacccctcaggtcgcccgccatcgtatagaagacacccaccgagctgctgaagcatgctgctgaccgagtctggattcgggacgaggagcgtgatgtttgccgccggacggagggggaaggccgtgcccggcatgtctgggaacctcccatccagcaggccaagcatcatggggtatatgcggagcttgtcgatgtaggcggcgcccaccgtgatggcaccctggttgtccaccacggtccgcgaccgccagcacaagccctccagccccgggacctgggcgaggtcgaccacggggggcgcgctcatcacaaaggcggagtcgatgatgtggatcgtggcccctctgcagctctccagtgtgtccaggatgggacggctctggctcgacggcgtgaccgcagaggatgagagggtggcctccatctgaagggtgggtcaggggcaaggggagtgaccggccccagctgcgcttgtgcccatggacgcggaatgggtgggacctgggatcctcagccaggtgcgtttgcccccgtcgataggttgctgggcgcaagcaaccccagctttcctcctgacacccccggtgccaaacctgcagctcgtcgatcgacaccgtgaggatgcgcgcgtcggagccattgatgaagggctggagcaaggtggtattatcttgaaaccagtggagcaacatgatgccaacactctcggggctggtcaggaagagccgtgtatagtgcctcctgagccctgccctcaggggatcttgaatggcaagagagggaagatgcatttgagtggctggagactccatgctcctgaacatctcagggaacattgacttgaaactgacgtacctgcaatgctctcgttctgnnnnnnnnnntggatcttgaatggcaagagagggagggtgcatttgagtggctggagactccatgcttttgaacatctcaggaaacatcgacttggaactgacgtacctgcaatgctctcgttctgagttacgctgttcaaagggatgaaaagggtaggtgcctgggtctcattttttaggagcagggagagacctaggttgtccagggcccatacccagacatcaatgggatacagggtggctgccccagtcacagcttcccaggccgagccagggatgcacgagctggagatatcgggggcctgcggtggtggagggggtgagttttcgtccccttttacgtgttcgtcgcgtaggagcgaaagggtcggtaggactgcccgtaatgaatcatcccgacgcatagtgcgctcgacatgcgtgtgagactatcccgaggccgaaccctggcttctgtcgggctttaatacacagaatactcaccagcgatgcgctcgacgcgatgctgggacccaggagcatgacgacgaggcacgggacgatcctgagcactcctgccgcgtnnnnnnnnnnctgaatacacagaatactcaccagtgatgcgctcgacgcgatactgggacccaggagcatgacgacgaggtacgggacgatcctgagcactcctgccgcgtgaggcccatgccccatactcactccgtactaagaagacattggaatgggcttcgtacatccatttgattagaactttttcctttacacatgtatatgaagtggacatgggctcgtttgagatgcatcgctcgcttcatgggccgcacagagtgtttctgattgctcgggtgttacaattcctgatccccggacggggggtgggggggacatggaaactaaaacagcatgaggcgagggaaggggtacgacatgtacggagggatgggcatgcacggtgtaatatcgtgatagagattgtcttgcannnnnnnnnnaactcaaacagcatggggcgaaggaaggggtacgacatgtacggatgcatgggcatgcactgtgtaatatcgtgatagagattgtcttgcacgattggagggtcatcattgccttcctgttcactcggagatcgaggttggaggcgggggcgaaacttctctgagccctcgagggacacgatgagcgggtgcacgatctcctacgtgtctagtccgatgtcatcgaactctacacaaaatcaggtccatgcatagcacgagcattcgtcgccggttaaactgttattatgagaagagcttgatcccatggcttgcggcgagtcctgcagcctcgggagactacgatcaattacttactattgcaacccttatgtgaatagcctggaacgatgcgannnnnnnnnnaaaaataaggtccatgcacagcacgagcattcgtcgccggttatactgttattgtcagaagagcttgatcccatggcttgcgtcgagtcctgcagcctcgggagactacgattaattactcactattgcaaccccttatgtgaatagcctggaacgatgcgaacattcaattcctcgagcatggtgatgctcacccatgcttcgcgctattgaggatgagtctaacgtgttttcgtggtgcagtgctggaggtacggtgtcgaaccctgacacgctaacagtactgcatgccaaggctaagtacatatttggccaggtttagaatacatctgggtcctgtgttatgtcttaatggtgcacaacacttgtttgtttaatgagcatggccctgttgatgaaaatgtggctcttcttagtggtacctactgggtaaattcgtcccataaaggtgtcaagggnnnnnnnnnngctgtgtcctgtgtaatgaattaatggtgcacaacacttgttttattaatgagcatggccctgtcgatgaaaatatggctcttcttagtggaacctgctaggtaaattcgtcccataaaggtgtcaagggcagtttagtgggacagcttctaatgatctttcgaaggcatccttcgacatatcactctagtcaaagatggatctcagtaccagcaagagacaggactgcattgcttcgcgttgaagataatttcaggcagtgaaagccagaaatttctccacctgctcatggtggacacataagaatctgtgcgccctcagatactcatgtcttgcggtttgcacagccaccccagaacctttgccgctctcctctgtgcatgtctccatatttccccacgactgcaggctgattgggaattnnnnnnnnnnattgacgataacttcaggaagtgaaagccagaaatctctccacctgcccacggtgcacacataagaatctgtgtgccctcagatactcatgtcttgcgctttgcacagccaccccagaaccctcgccgctctcctctgtgcatgtctccatgcttccccacgactgcaggctgattgggaatttcccaactcagggcggtcctgaaccccgctcctcctctcatcatcgctctgcccacaagcgaacccaaaccccatctccccgcatccctgttcccaatgnnnnnnnnnnccggtcctgaaccccgctcctcctctcgacatcgctctgcccacaaacgaaccccacccccatctccccgcatccctgttcccaatggatggcgcatgtacatgatcgtctcactcaagtgcagctgcatcggcagctgtttccttatttctgtcccgtgcaagcacccagggtcaatcagggggccaccacctcagcgccgcgcgtccccgccggggtctctggcacgtcgggcatgcgcaccaccaggttgcggtcgccatacacgttgtccaccctgcaggtggtgggccagaacttggactggcgcacccagggagcggggtacgcggcctgcggaacagggagaggagggcaggtgggggtcaccaaggatggcatgacgctgtctggcaggagtgaggccaggggtctgccctggtgcaccatgttgtcaccaccccttcagagtcgggagcaaggcacccacatgtaatgctgacattctcccttactcctcccctcccgaataatcctcctgcccaccttgtcgcgggagtagggcctgtcccactcatcggccatgacgacgtgggcggggtgcggggcgtgcttcagcacgttgttcgcccggtcggccttcccggactcgatctccgcgatctcctcccggatgccgatcatggcctccacgaaacgatccagctcggccttgctctcggactcggtgggctcgatcatcagcgtgcctggttgcagtagttgaaaaggggtgggtgagcatgttggggccaggtgtgctggagttccggcttgactcaggacaggctggggacaaactacacatgctgcatccgcgcactggaaaaacatcctgcagggtccctgctcttatacatccagaaatcagcctccatgcaccaccctgccaagacacccaggctgcacctgacactggccaggacatagtcggtccatggaagccgtagtcgatcagacgcttggcaatgtcctctgcctcgatnnnnnnnnnncttccggctggactcgggacaggctggggacaacctacacatgctgcctccgcgcactggaaaaaacatcctgcaggttccctgctcgtatacatccagaaatcggcatgcatgcaccaccctgccgagacacccaggctgcacctgacactggccannnnnnnnnnaggagggttggttgacttcctgagaccagacattgcgagtgttcttcccttgtatcagaccaggcttgcacagagcnnnnnnnnnngggagggttggttgacttcccgagaccagacattgcgagtgttctccccttgtatcagaccaggcttgcacagagctctgcgagctgcatgactgcaggccaggacccccccacccccccccacctgatgtccaggatgaactcatgggcgcaggtgccgttggggccgtggaagagcacgttgtagtgcttctccagcctcttggccatgtagttggcattcaggatggccagcttggaggcctgcggtgattttggggaggaggaagggggggttgaggcaacaggcgacaggtgggggatcatgaagcctgaccaaggagtccacgagctgtcgacagggatcacaccccaggcaccccatcatgctcacgttggcgagagccttgccgcccatgagcgtgatgtaggcgtaggagatgggcaggatgagggccgagccaaagggcgcggcggagatggcgccgcaggcctgctcgtccgacttgaagttgggcagcgcccccgtggggaccaccgggttgctgggcaggaagggggccaggtgcgccttgaccccaatggggcccatgcctggcaggggtgggagggcggggttggcgtgtgtggatggagtgggaggggagggtggaagcgtggggccccggccaacgaagcgcaagcgagcactggtgtgcctgccagcccggcagacctcgggctcacctccccttcccgactcctattgatttgacagcacaccgtgcccctccagatcggcaagacacacccacccacctcaaacaaccgaccccgacccaccaggcccgccgcccccgtgcgggatgcagaaggtcttgtgcaggttcagatggcacacatcggcgccgatgagccccggcgcggtcagtcccacctgcgcgttcatgttggcgccgtccatgtacacctgcccgcccgcggcgtggatgatgtcgcacacctcgtcgatgccgttctcgtagatgccgtgggtggaggggtaggtgatcatcagcgcggccagctccttctcgtgctccttggccttggcgcgcagctcctcgatgtccacgttcccctgcttgtccacgcccaccggcacgatgcgcaggccgcacatggcggccgaggcggggttggtcccgtgcgccgacacagggatcaggcagacgcggcggtgcgcgtcgccgcgcgccgcgtggtaggcgcagatggtggccagccccgcgtactcgccgctggccccggagttgggctgcagcgacaccgcgtcgaacccggtgatctccgccagctgctgggccagcgcctcgaacatggcggcgtagcccgcggtctgggaggcgggggcgaaggggtgcagcgccgccagctcgtcccaggtgatgggcagcatctcgctggtggcattcagcttcatggtgcaggagcccaggggtatcatggagtgggccagggacaggtctcggttctccagccgcttcaggtagcgcagcatctcgtgctccgtatggtagctgttgaagatggggtgctgcatgtaggggctggaccgcgccgcgccgccgatgccggtggaggcgtcggcggccagcgaggccgcgtcgaagtcgggcgcggagccgccgttgagcagcgccagcagcgcgtccacctgcgccaggccgcaggtctcgtccagcgcgacggtcaccgtcgcgccgtccagcttccgcaggttgatgcacgcctcatgccccgccctcaccagcgcgtcggcgtcggggacggcgatgcgcacggtgtcgaagaaggggtcggcgcccacctccaggcccaggcggcgcgcgcccgccgccagcacgccggccagcccggccacgcgctgcgcgatcctggcgatgccctcgggaccgtggtacacgccgtacatggcggagatgttggccagcagggcctgcgcggtgcagatgttgctggtggccttgtcgcggcggatgtgctgctcccgcgtctgcatggccatgcgcagggccggggtgccggtggagtcgcggctgacgccgatgatgcggccggggagcacgcgcttgtactcctcgcggcaggccaggaaggcggcgtgcggaccgccaaagcccatgggcacgccgaagcgctgggcgctgcccagcgccacgtcggcgccccactccccgggcggggccagcgccgccagggccagcaggtcggtggcgaccaccaccttggtccccgcagccttggccgcggcggccagctcggcgtagtcgcgcaccgagccgtcggtggcggggtactgcagcagcacgccgcaggtggtgtcgtcaaaggcaaaccctgtctcgtcgcccacctccacctccaggcccaggcccttggcgcgggtctgcaccaccgcaatggtctgcgggtggcagcgctcggagacgaggaagcgcggcttcttgccgcgcgccagcgcgctgcacattgccatggcctcggccgcggcagtgccctcgtcgagcaggctggcgttggccagggggagggcggtgaggtcggagaccatggtctggaagaccagcagcgcctccagccgcccctgcgcgatctctgcctggtagggcgtgtactgggtgtaccacccggggttctccaggatgttgcgcaggatgacggggggggtgatggtgccgtagtaccccatgccgatgtgggaggaggccaccttgttctgctccgccagagccctgggcgattgggaaaggggggctgtgttgaatcgggggagcttggaggagagagggtgggggccacgtattaatcaagagcgaggggggagcatgacttggtggggacatggtactcaggcacaggcgctggcagtggaagcggtgcggctcgcgagaggttgtcatgcaggactcagaaaggaacacaccacaacccccgagaggtggatcccgccaccacccattgagcccgcacctaaactccttgatgaaggcggactctgtgatgccgtcagggtgggagttggccagctccatcacaccctcgcgccgtatggaggccggcacagtggcgtcgatcagggcgtccagggagtcgaagcccagcaggcccaccatctccttcacctcgtttggggtgatgctgttgtgccgcggctcaaacctgggcaggagccagagagggaaggaggggatgaggatctgtgaaagcatggtgccagacatgtcagatcatcgatggnnnnnnnnnnggagagggaaggagggggtggggggttgtgaagaaatggtgccagacatgtcagatcatcgatgggatcaggaaaaggtgccccgacagggcccctgagcctgcttgcagtcacgatcgacgacgcctccatgccaccaggcatcgcacgtgtcgctgggctgcaaggactcgatggagatcgcccgcaccccccggctcgcaaagctcgggatgggtccggaggaacatgggaggcgacatgcgcctgtggggagggacccgggggggggtgatgaacggacctgcgcgggctccgcggcggtcggtacctgggatgcgctggccacatcttcgcagcagcggtacggtgccgagctacaagcatggatgcatcccacctgtgaacatggaggtagatccggcgcatcgctgcacgccttgcaggggtagggcaccccccgtggcactccctgccagggcagggcccctcagcagggccaccaggcgggagagggatcggctgcgccccatggctgatgacctagtagatttattccgactgatttgaggaggccagcgccgcgcatggaacttatccggagggcagacccgcgcgtgacgacccctgccgggctgactcagggcgcgccgaggcgaaatccgccctggccacgcaatccagggcctgatcctccgggatccggctccactggctggcgttacacggcgtgccttttccgggtataccgggctgcccagcgcacacacagtgcccagagccccaaccagcatgccagcacccaggcccatgcagcttgcagcaggtgaggtgtgggggccgccgcaggatgtgcgggtctgcattggctgggtggggccagtccgacaggcgcctggggcctccccagcaccccaccaaacagccgggctccagacgctcgttcctgagtgggattggataaaaaagatgtatggggccagcagcgcgagttcacgcgattcaattgcggaacaaggcgtgccgaggggtacatgtactctgtcgtggatgaagatttttcaacagagatacccatgtactttgctggnnnnnnnnnngtaaggcgtgccgaggggtacatgtactttgtcatggatgaagattcttcaacagagatacccatgtactttgctggcaccacacgaagcttcatgccctgtctgatgctcacacaacaatgcatacatccccagccgtatccacccccccaacccctnnnnnnnnnncccactacctcacgctgctcccgtttcgcctctgccagctcccgccgcaccaggccgtcgcccggcgccagcctcgccgcttcgtgcaggtcctccaccgccgcgtcggtttgacccagtgccctacgcgccaggcctcggcggtacagcagcttcggccgggcggcctccacccccagcgccagcgcctcgccggcggcggccgccgccgccgcccagtcgcgctgactcagcagcacggcggccacattggacagggtgggcgcgcggatggcctgggcggcgtcgaggtgccggccctccagctgcatgagtaggtcggcatctaggtaggacaacgccaggtggtacctgcgcagcgccatctcgccgtcgccggctttgaagagagcgttgccctcggctcggcgccgctccgccgcctccagccggtcctcaaacagcatggaccccaccctggcatcctgaacaagggaaggggaaactgccggaatgggcatgggctgtgttgcatgccaaactcactcaagtcatacaggtttccaagagcatatcaaaccaaggcagcctctggtatcccgcctgcaagttcccaaggattggcccaccctttgcagccgcatgccatgagggaccaagcagaatccgcctcgtacctcatccacctcctcatagtccagaagctccagctcgtacactagaccggcatggggcggcacggtcgggaagctgaaggatccggcgacgccaaatccataccgtggcgccacctctatccttgccagctcgcccggcaccatggtcgcaaccgccaggttcaggcccgtctcccttgcagtgttgactgggctaagggatgggtgccatgtggtgagcaaggcaaccatggtgacgcctgcgcggtgtatttcatggctaccaatgcccacttcctctgccccatgctcacccctgccagcgacgagcttgaccggttcgccctgcccctccgaccgcgtgtccatgaacacggcatcgccctccactaatcgacccacatagtggactgcgggagtgtggggtgcggggaggccttgacgttggatgttaatcggcatgcttgcagcgacccagcggagtgatccacccacctaggcaccgggcgtgcttggggggacaggtccccctcccttctcgcaatatgaacttcacaacgccaccatcatcggtgatgacgtgcttctctaagggaccggagggtgggtccgtgttcatcgtggcagtggaggggtgctgggggggagaatagcaccatgcccctcttaaaaccgtcttctatacatcgagaattggcattcttatgcagctgcgctgtgtgaggtgtcctgcgaaaggagtccgctccacgtggttgtgcatgtcccagcggcgagatcgatcaggcgaagcacattggccgtggctggtccaagaagaagctggaaactgctgcgtcttgggcccgaggttcaacatttggcataaattggctgtgcgggggactcaaaaagtgtagattaccgcaattaccgccaccctcagtgctgtggaattgcctaggacacggacccctcatgaagatcttgatcttggttgcggtcatgaccgcactcctagcccaggcgtttgccgattcccggcgcctgctggccaaggaacctgcagcggaggacaaaagcaattcatgttgccaggatctggccgccattgggttttcgagcaacctgccggtggtggtgctggacacgggcggcaagaacatcacgaacaagggtggggacgtgaaggtgcgggcctgcacgtgcagcgatggcgccggcttcaaggaatacaatggcaccggcgtggcgtccgtgcatggatccagcagtgcactcttcgacaaaaagtgagtacggatccggattggcacatgaaagccggaatgtgccgaaaccgtgtggtgggtgtcggcagcaccgattacgcttggtagctggcctcacctgctccgcctggtacacatcaagagcatgtatctctgcaccttacccagtataccattcttttacaaggcccattcacctccaattagcctgcaaaccaccacttctcctgcaggtccttcannnnnnnnnncatctctgcaccttacccagtattccattcttttacaagtcccattcacctccaattagcctacaaaccaccacttctcctgcaggtccttcacgctgcgactgacacacaagaatggcaccaagaacagtgcttccttcctcggcatgcccaagggcaacgagtgggtgttgtacggcggggacgaggtggacctgaccgacggcatgagggactacgtggcctacaacctggctcgtgcatcgggcgagtacgccacccgcaccgtctggatcgaggtgtttctggtggttgagggtagacccatcgccccttccgactaccatggcatctacatcggcgaggagcacataggacgggtgagtggagggcacaaaggagacgtaggcattgttatgttgactggaggaacacatggacnnnnnnnnnnnnnnnnnnnnnnnnnnnnnnnnnnnnnnnnntgagtagccaaccccagacgccagtaatttcctggcacgacacaactttgctacccttcccagagctcattacaagtttgaagctaggtatgacccttaaatctcttgtgtaggtacactttcattttgtcgtccataccttacatgccactcctcccccaccatgccatcgccagggaannnnnnnnnncatgactcttacaactcttgtgtaggtacactttaatattgtcgtccatacctttcatgccgctcctcccccaccatgccatcgccagggaaaagatcgtgtcaatgtgaccaagtggaccaccgccgacccgtctggcggctacatcttcgccttcgacaacaacaactacggcccgacagacctcctgacagagaccctgcccggctacgacttcccatttgtcatcaagtgcgtgctgacaaggggtacatggggtggcagcctgactgcgcaaannnnnnnnnntatcttcgccttcgacaacaacaactatgggccgacggacctcctgacggagaccctgcccggctacgacttcccatttnnnnnnnnnncgctgccgcctgctttggctctatctgctgggtttccagggcttgggggaggtgacccccagcttgacagcgctgtacacatatcaaagcgaaagcgtggagcaagccttctctattcccctccacacactcacacnnnnnnnnnnggctgccgcttgatttggctctatccgctgggttttcagggcttttgggaggtgacccccagcttgacagcgctgtacacgtatcaaagcgaaagcatggagcaaccccttctctattcccctccacacactcacacgcacctctaggtatcccaagtccaaggtgcccagcgagaacaagctggcttccagctggctgtcaacgtacctgctggactttaacaccgccatcctggccgacgactacctgacagccagcccggggtacacccagtacattgaggcgcccaccttcatcgactacttcctgctgacagaggtgaccaagaaccccgacggctacaggtagcgagggtgggagtgctctggctatgggaggacgaggctggccggcatctggcgggtctgtgctgggtgggccctctgttagccatttagatcagtgagtcaaccatcgccttgtgcccatacatgtgcatcagcaccagtccctgccccgcccttagcaggcttcaccagtccaatgcaccctcctcgcaattccaccacagggactccatctacatgcacaaggatgccggcaagggcatcgccatgggtcccgcctgggacttcaacgaggcctttggggagtgctgtgggtatccgctggagggctacaagcagggtggaaagagcggaccaggcatcgccgggggtgggtccatctctcccaacggctggcgcttcctggtttgcgaggacccggagcggtgcctcgtggagccgaccgacggggtcagcacatggttcaggcgcatgtggaacgacacccgcttcagcgtggccgcggccgagcggtgggccgagctgcgggcggatgcctggtcggacgacgccatctccagcctcatcaacagcacggccgtcaaggcaaggggaggctgggctcctgttatgggtggggtgtgcagcgacgcagccgctctcgttcaaacctgccgggtgtgtcattcccacctgatatcgcgtcgaacctggccgcaaacacgtgaggctcannnnnnnnnngaaacctgccgggtgtgtcattcccacctgacaccgcgcatcgaacctggccgcaaacacgtgaggctcatgccaaaccccgccgccccccaaaaacgccctgcagatccacccggccgtcacacgtgactacaaggtttactccaaggtcctgctcaagtcctggtatgcctccaccgaggcccagtggaccgccggtgagtttcttgcgcaattgcagccaagggcttgggtgtcacggaatctgggtatgctgcggaggcaggtttcttgcatcagtagccccagaacctgcaggcatctgaccctggactggacctcctccttggatgtcttgtagaggtccaggacctggagacctggctcatgcagaggctgaggtggctggatgcagagttcagtctggtggcctctgggaagtatgtgtaccccaccagcgacctcatcctagtgcctgccggcgagaacttccccaccattgctaccgcaagtctggctgggtgaacattcaggtaatccacatgacccaacctctgttatatatctgaatgcccagccacaccgctgccaagtctatgcatcttttgagaaattgaccacgaatacttgtgctctatacttgcttgagtcaaggtgacatccactccatacaagacctcaagggagccacgagggatgcggggatcgatcgggcatctgcaatgcctgtgcagggttcccgctctgcaagctccgactcagggtcaccatcagcaattgcaggcagtgccgaagcttccctcattggcatgatttgcggttctaatggcgaatcagcttatagacaatacgtcaaggcaagggtcgccctcgatcaccaccgtgtgtaggtacgagcgcgnnnnnnnnnntggacatctgcaatgcctgtgcaggggtcccgctctgcaagctcgactcagggtcaccatcagctattgcaggcagtgccgaagcttccctcattggcatgatttgcgtttctaatggcgaatcagcttaaagacaatatatcaaggcaaggggcgcccccgatcaccaccgtgtgtaggtacgagcgcgnnnnnnnnnngagcctgtgccggtgcccagaattgcggacacgggttcttcacgggcgcgagcctgccagggagccgttgcttggtccaagactgaaccaccccagcccnnnnnnnnnntcgaagtgaccaggcgtgcgcccaatacaacctaaagcatcgtcgcgttcagcttgacagtattgtatatgattacccacgcggtatcctccaagggcacaaaagcctgtgccggtgcccagaattccgtacacgggttcttcacggtcgcgagcctgccagggagccgtagcttggtccaagactgaaccaccccagccccgccgagggtggcagctgtgcacatgggcatttaaagctgtcccttctcaatgtaatgtcttgcaccaagttctgagtgattcgaaagcctgccgcgtcgagaataatagtcgtcacgccgtcgctgcccaccatgcgctggagtgcggttgcactcgcgcttgccgcgtgcgcagccctctgccagggtgcctccacccggagtctccagcaggcagacgccgcaccagcccctgaggcggaatctggagcctgctgcgcgaggctggaagcgttgggctggaccggcaccctgcccgtggtgatcctggagagcacgaaacccattcccctggaggagacggtggtcctcaactactgcacctgccccaatggggccgattttaagagtcacgagggagaggccaaggtcggagtgcgtggcaacagcagcaagaaggctgccaaaaagtaggcagtggggcattttgggctttagggttggagggggacatagctggagtgtgtcaggacattgtgcctggtgtagccctgcctctccatgttccatcgtgtgctgcgttgacctctggactccacaaatgggcagcacgccaggccctctaatcccccttctcactctccacctcccccacacatcggaatcaggtcctacaagatgaataccatccaccccaatggcaccaacgacaatctcaaattcctggggatgcctaaggagaatgactgggtgctgtatggtggggacgaggtggatctgaccctgggaatgagaaactacctggcctacaacatggcaagggccactggagagtacgcttccaggtgggtaaaagatgtgggtgagggtgttgtaaccctgcaatggagtggagtctgagagatttctcccccaggtagaggtccttggcctgcttcccaggcctgtgaattagatgggtgggatcccattggtgttggcttgctgctgctcttcgattagccaccagaccttttcgccattccccccaacccaggactgtctggttcgagctcttcctggtggaggatggtgcccccctgaccctggagaactacaacggcatctacattggagaggagaagatcaagcgggtgagcggggggacgtgggatgggtgatgcatgcctcgatgtgcacacctcaaggccctgctcccctggcccctacccccacgtttctcccaggacctgcctcattctccctggcnnnnnnnnnnaccctgctcgcctggcccccacccccacctctctcccaggacctgcctcattctccctggcatgaatgagttgatcttcatgacaccgctcctgctgcaggacaatgaccgtgtggacatcggcaagtggacggcagagaaccccacgggcggctacctttttgcctttgagaacgacaacatcaagcccgacgacacccctgtgggacctattcccggcatggaggacccctttgtgctcaggtagagttggtgggattatttgctggctggcacagacatgtgggcaatgatgaaggggcctgcagcttggtgaccctcccgccatgttgctttctgcacaaggtatcagaacccagcccattcacagaccactgcacccatccatcccccctcctgcctcgccctctgtgcctcgcagctaccccaagaacgagcctactgctgttnnnnnnnnnntcagcccattcacaggccactgcaaccatccatcccccctcctgcctcgccctctctgcctcgtagctaccccaagaacgagcctactgctgttacctggctggccaagtacctgaccgaccttcagacagccctttttgctgacacatggctggacccccaggacggctacaccaagtatgtggacggcccctcctgggtcgactacttcctcttcactgagctgagcaagaaccccgatgggtacaggtgtgtttcggaggatgcaattcattgtgctcttgattacggggtagacttgccaaggcatcggccatgcatcgggatgcatgaagatctccctccccaaaacatcacagtctcctgcaccgccatgcactgccactcgcccaaccaagtctcctcaccccttgccaccgagcagaggctccacctacatgcacaaggacgtcgaccagcccctcgccatgggtcctgcctgggactacaacgaggcctttggcgaatgctgcggcttcccctttgagggctacgaggagaatgggaagagcgagcctggtgcgatggggtggtnnnnnnnnnnnnnnnnnnnnnnnnnnnnnnnnnnnnnnnnnnnnnnnnngtgtgcaaaccagtcgacagccagccccatccttgctgggcctgccggtgtgttttccagacccgagagttccgcattctctcagagttgctggcaccaacaatggaaggcaccttcagcaagcatgtccctcctctacttgcaggtgtgnnnnnnnnnnagggggggttgcgggcctgggggctgaagggcagggagacttagctggcagatggtggccctnnnnnnnnnncgtgggggttgcggacctgggggctgaagggaagggagacttagctggcagatggtggccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcattctctcagagttgctggcaccagtaatggaaggcaccttcaggaagcatgtccctcctctacttgcaggtgtggcggggggttcggccatcgcccccaacggctggcgcttcctgatctgcgccgacaaggagcgctgcgtctttgacccatacgacggcatcagcggctggttccgccgggtgtggaacgacacccgcttccgcgaggccgccgcgacccgcttcaccgcgctgcgggcgagcaactggtcggacgccaaggtgtcgacgctcatcaacgacgccgtgcaggaggtgtgtcactggacggggtggcgggaatgggatgggctcaatgagaggggtgctggacttcgtggtgggagggtgcaccgacgggggaaaccgacgccggctgtctagcaacgatgaatgtactctccttacaggacctctcacttgcccccttgcccacccatacatcatgggcaaccnnnnnnnnnncctccttacaggacctctcacttgcgcccttgcccacccatacatcatgggcaaccccacactccaccccacccgccacagatcgagcccgcaatcctacgtgactttggcaagtggggacagtacaccctcaaggactggtacgcgaccccggagctccagttcacaaccgaggtccaggaactggaggcctggacccagcagcgcctcgcgtggatgggggcggctctggagagggctgcctcacccacgtacgcctacccagaggacaaccaggtccccatccctggggcagctggccccgtcgcagcgtcgactgcggggtagatgatggcaggtccacgcctgtcctttgaatcccagcactgcgctcagtgcctctcagaccgtcttctgagtttgtttcatgctgccaaggagtgtgcttgnnnnnnnnnncccccgtcgcagcgtcgaccgcggggtaaatgatggcaggtccacgcctgtccgttgaaccccagcgctgagctcagtgcctctcagaccgtcttctgactttgtttcatgctgccaaggagtgtgcttgcgtggcaatcggtgcagatcatgtacattcctctcacccgagctgcttagggctcctgcaacggagagggcccttatcccggtacacgcgcgcgcacgatcggtgcagcaacatnnnnnnnnnnacgagctgctcagggctcctgcaatggagagggcccttatcccggtgcacgcgcgcgcacgatcggtgcagcaacatgcccctccatgcaactctgtgcgtggtgacgcgccccccgctggtgcgaccgagtacaatatacactgtggagcttgataacgtacactggaagctcccgcatacgatgtgttcgcggctgggctagcttgtacgcctcgggactcccaagaaggagagccagggtattcagcgaccccaccccatgcgcgagcgcatgcaatcgcgccgttgctgagcctcatgctgcatgcatgacgacgctctgcatgcgtccagggaaggggccgcaccggtggacgcatggcggttcttcggtggttgggcccccagcctgccggccgtcgacaggagggctgcccacgctccggtccctgaggacacgccttacctcctcccacggtgcgctgggccggattgtgttgaaatggtctggtcggcaccatgcccgagcttacgaccctcaatggtcactcccgcaggcctggcctccgtctcggggccccaggtcctcgctcagccggatgtggctgggcccccacaccccgccccacagcctgcagtcgcgcacgcgagcatcgcatcggatgtcgcctgcgatcagcctcagcagcgaggccatgcaatggcccagcatcttccaacacctcaggtccctgagcctgcgctgccccggcccccccggaaggcgtggaacaaggggcgccccatggatcccgagacccggcagctgctgagccagggcgccgcgcagcgctggaaggaccccgagtaccgcgccgccgtctcctccaagctcaaggtctgagtgtgccctggtggggagggggcggggggggtaggtgcccgccgatgcagcagcccagccgcactctctgcgtgtgtcaaggcggcgggcgggagtgtcgggggctgcgcccctcagcacacccccacccatctctcgcactctcccacacaggggaagccggcctggaataagggccaggagatgagcgccgcctgccgggccaagatgtcggccgcgcggacggggcgggtggtcggcgcgcgcacgcgcgcgcgcatggccgcctcccaaaccgcgcgggcgccgtccacctacgcggcgtgcacgggggagcacctggcgggcgtgcccaagagtgccgagcaccggacggccatcgccgcggggcaggcgaggcggcacgccaccgcgcgcgcgctgcgggcctacc

SEQ ID NO: 21798 - DNA, 66 bp, Chlorella protothecoides
ccccactctgggaatttcccctatccgcaccgcgggacccttcccatctctttggaggttgcagcc

SEQ ID NO: 21799 - DNA, 75 bp, Chlorella protothecoides
tgctcaagcgcccggcgcgggatgcggcctgccatgggcccggcccttcaagcccggggcttggagattagcggg

SEQ ID NO: 21800 - DNA, 104 bp, Chlorella protothecoides
ggtcattcggcctgatctcagctgcatagtgtcccccagccatcaaggtatgtattgcatgattgggggctgggagagcactgcacattggagcaggacatgcg

SEQ ID NO: 21801 - DNA, 99 bp, Chlorella protothecoides
gacctgggagagtgggcatgacccggcattcagtactcatgcaggggtgccaggaagtggcaaggactcagacccagcaagtacagtactgggcatcca

SEQ ID NO: 21802 - DNA, 70 bp, Chlorella protothecoides
gggtttacgtgtgggtgcaaggacaaggatatatgcaaacggtatctggcaaaggcaacaatgtcgtctc

SEQ ID NO: 21803 - DNA, 66 bp, Chlorella protothecoides
agtcagcggccgcgccagctgcaaagaccaatgaactttgaggagcgtcagcgaccccagagccag

SEQ ID NO: 21804 - DNA, 95 bp, Chlorella protothecoides
aatagggggtctctggggaatttgcacattcttgtcgaacttcaatccttcacatgaacaccctcgacgtcaccgcagggagactgcgggacgca

SEQ ID NO: 21805 - DNA, 61 bp, Chlorella protothecoides
cgttcggtccagggcaccatagtcccgcccgggcaatcccctggcagggaccacggcatgc

SEQ ID NO: 21806 - DNA, 75 bp, Chlorella protothecoides
tgcctatccccatggtcggatcccctccactccctgcgtccctgcagacgaggccggtaggggcccggtgctcgg

SEQ ID NO: 21807 - DNA, 77 bp, Chlorella protothecoides
gccgccgctggacgttctgggtggtcaacttcgcacggcgctgatatgggcggcacccgcattcccaggtgcgaagg

SEQ ID NO: 21808 - DNA, 61 bp, Chlorella protothecoides
aggccttgcaggccacctccgcctccacctgcacctccttggaggtgctggggagctccag

SEQ ID NO: 21809 - DNA, 61 bp, Chlorella protothecoides
tggcaccattcaaatcagtcagagcgacgttcttgccttccatcggctgcgcgtcatcctg

SEQ ID NO: 21810 - DNA, 61 bp, Chlorella protothecoides
ataggtatgcagcattataaggggcatgatcgcgcaagacgacctacctcggcgtgcgtcc

SEQ ID NO: 21811 - DNA, 1103 bp, Chlorella protothecoides
  modified_base (170)..(256): a, c, t, g, unknown or other
  modified_base (414)..(423): a, c, t, g, unknown or other
ccgctgctgcagtgggtcacgtcctcctgctgtaaagccagctcaagattggtgcattgctgtggtacgccatggtagacaaagctgtagctgatttgcgcggtgcccatgcacaggccccagccattgcggtctgcttgtgcttgcgggactgacattcgtccccacgnnnnnnnnnnnnnnnnnnnnnnnnnnnnnnnnnnnnnnnnnnnnnnnnnnnnnnnnnnnnnnnnnnnnnnnnnnnnnnnnnnnnnnntaatggcggcaaagaggaggagggtctcagcagtgagtatggagcaggccggggacaggcaatcgagtcaaagcttgcagtccaaggagtgtaggcttaactgtgggcaaaatgcagtaagtcagaccctcgcccataccgacaggcgacccgacacnnnnnnnnnntgcacaggacccaaccactgcggtctgctcgtgcttgcggaactgacattcgcccccacgctgccccacagacaaaccactgcaagggcctaaacggcggcaaggaggaggaaggtctcagcactggatattgagcatgccgggaacaggcaagaaacgcaaggctcgcggtccaaggagtgtagccttgactgtgggcaaagtgcagtacgtcagatcctcgcccatatcaacatgcgacccgacacagaccgccgacgcgccttggagacacacatcttggagctacatgaatcttcttgaccctgctcaatcaagcttacctagacttccaagacctttgacaggggagatgcgcccgccagcagctcagcagacgccgcggcactgcctggcatctgggatgccatcaggtggaaggacgctgaggccttgagcgcacagcccacccaaggcttgtcgcttgccaatactgcagctcacgcgtcgcagacactgatgatcggaatggtccacaggcccagctccagtccagtcgcaagccaggcatctgctgtgcacactgggtgcaaggccagccaatgcaacggcggcaccaatgcaactcgctgctatgcccatgcataagcggctcgtccattgcagcgacgggcaatcaggcttgctgtagggtggaccgc

SEQ ID NO: 21812 - DNA, 61 bp, Chlorella protothecoides
cagcaacaggattgggcccaagtcccacaggacccccctgtcagatccgccacaaccagca

SEQ ID NO: 21813 - DNA, 141 bp, Chlorella protothecoides; identical to SEQ ID NO: 2179

SEQ ID NO: 21814 - DNA, 124 bp, Chlorella protothecoides
ggccggagagggcaaggttgcacaaggagcaattatgcacagtgccgttgtgtcttgccagactgctcgaacgactctggctgttgtcctcctgaaaaataaggatccacctacatgtgacatt

SEQ ID NO: 21815 - DNA, 61 bp, Chlorella protothecoides
ctccacaggcaggagcgcagaccgtgcggctggccagcccccctgtcgcgggcgctgcggt

SEQ ID NO: 21816 - DNA, 123 bp, Chlorella protothecoides
taaagcaggacacaatgtgcaattcccttcatattagggtacagctgatggacaccacacctatgcccagaggcccccattcccccacctccctcctcatgacagcgttgttttcaactacct

SEQ ID NO: 21817 - DNA, 61 bp, Chlorella protothecoides
gggatgcagcaggtcgggaccacaggggagcctctggctaatcactcaggagttgcatctt

SEQ ID NO: 21818 - DNA, 76 bp, Chlorella protothecoides
aaccctctgggtgcatgcccatgtgcacgggtggtgctcttgatccccggtcctctttccctcattccatcggctt

SEQ ID NO: 21819 - DNA, 61 bp, Chlorella protothecoides
actgatctgaaaggccagcgaagacccggcacccccccatcacctcccctgcagatgccct

SEQ ID NO: 21820 - DNA, 61 bp, Chlorella protothecoides
aggcgagaaggtttttagggggggggggggagtaggagtcgcatgagaaatcgcaggtcaa

SEQ ID NO: 21821 - DNA, 65 bp, Chlorella protothecoides
gtaggagtcgcatgagaaatcgcaggtcaaaaaggcaccaggcatgagcgcctgcgcaggaccac

SEQ ID NO: 21822 - DNA, 72 bp, Chlorella protothecoides
cacggttggacggccaacccagatcatgagccaggacctgacaggctgcctcggtgcatgacgccagggagg

SEQ ID NO: 21823 - DNA, 2444 bp, Chlorella protothecoides
  modified_base (742)..(751): a, c, t, g, unknown or other
  modified_base (1058)..(1067): a, c, t, g, unknown or other
  modified_base (1695)..(1704): a, c, t, g, unknown or other
  modified_base (2031)..(2040): a, c, t, g, unknown or other
  modified_base (2160)..(2343): a, c, t, g, unknown or other
gggaggggatcgcatgggtgaaggaggggagcgactgggcgatggcggtgatcgctttggtgacggcggcggtcgtttggttgacggcggtggttgcttgggtggcggcgacggcggtcgcttgggtggaggtggtggcggcgacgattttttgggaggtgggggtggctctagcaggctgatggcacgttcacgaaactctgtgagcttgcagtcgttgaccactttgctgtctcccactttgtcaaagcagcggttgctggttcccttgttattatttccccaattggaagagcctgtgtttttatttcctgcatagtttgatgttggaggaggtgttgcacatggctgcgggcggtgcaatacaaggatatccgcagctgagtcttccgctcaccaatgttatcgttcccaacattgttggtgccaaaattccgcttgcccttgttgccggatccgatgttgccattgctatctgctgtgcaagccgtctgcccaggcttgaggcactccaccgccacaatgaccttggtagagcggggcgtcaccagctctgtcggactgatgcgggcggcactcatagacagacccaaaatattcagggtcgacgtccgcacactccccgccttgctaaagcccttccgcctattggtaggatgaggggaggtttgaaagtgagggtgactgtcacaagttgtcattgcaatacgcattcttttgtaatgttatcacccggcgttcnnnnnnnnnncgaggggaggtttgaaagtgacggtgactgccacaaaatgtcattgcaacacgtattcttttgtaatgttatcacccggcgttcagaatcatccgcagacactttcatgcagcgttcctcgatttctgtccttcctcctacttgcagtaggcggtggcactgtcctcagtcagaaactcgacatgggcgcccagtctgcatgggtgtgtatgagtgagctgtaagggagcattccgatacaaatggcctcagtaaggactcatgggaaccatgcaacgcctacatgcaggcagcccaccggatgcgnnnnnnnnnnacccagtctgcatgggtgtgtatgagtgagttgtaagggagcattccgatactaatggcctcagtaaggactcatgggatgctccgcctacatgcaggcagcccaccggatgcgtacgggagagatgccggacgcttgcccggctaccattcccggagaccatccacccacctacaactcacatggcactgggaagagcaacaaacgtcgagtcgcaggctccctgtgggttcgaggaagatttggcgactgcgaaagccctctgtggtggaaattggctgtagacactcctccccctcgcaagcccgtaaggcaaaactctctcaccgaaatgatagcagcaccagacaggatgatgagcgcggctacaataacccgattatatgtctgcctccccatcgcggcaagattggggcccttctatgactcttgatattctgcaagcgttcgtgtcccagaggttcctgcgaactcggttgtcactaaactgccgtcgcagagcactgtgtcttcttccagatccaggagacgcgtgatgataatagctgtgaacttggatggatgtactccctcggcacggtatgttgaagaaatgacccggctgcggaccggacggcagctaaaggtnnnnnnnnnnggtactgtgtcttcctacaaatccaggagacgagtgatgagaattgctgtgaacttggatagatgtactcccccggcaaggtatgttgaagaaatgatccggctgcggaccggacggcagctaaaggtaccgccgggaattctccaggatcagacggaagtcgcgatctgctgttccacgaacgcacagtggaaattgtgtatctactgtagtttcgaagatgccggtattctatatttaggtttcatcaccaagaatggtctgctgtagctcaaggtgaggttaaggggttgcacggttactaggccacattttgggggaaccccnnnnnnnnnnggtgaaaattgtgtatctactgtagtttcgaagataccggtattctatatttaggtatcaccaccaagaatggtctgctgtagctcaatgttgtgggggcgggctggcccctacaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccctcctgatgactggcaattggatcggcagcccctgccaatgagcttgcggcctgagaacgccctggagtcagtatcccatgacaagtctgccacac

SEQ ID NO: 21824 - DNA, 245 bp, Chlorella protothecoides
ctctgaccatctggatgccggcatggaccgctccgccagcgagtggaggggatccctgcttcgcaggaacatattctcgttggtgaaaagtggggaggaccggatcacgcacacatctcagattcagtgttgctggagtgcgagaggcagcagaaggaaggaagacattggttccctttgaatgcactcaccgggcgtactggcacatccgctctggcaagggcagaaggtagaaagtcgtaggt

SEQ ID NO: 21825 - DNA, 213 bp, Chlorella protothecoides
cgaagtgaccccggtcatcgcaccactgtacgtggatggatcggtgaagaggggggtggtatcgagggtggcgcgctcgcttcgcgctggggctggggggcgagggcagctgctggtttggtgtggtgaaggtttttcttacggaatccaatgcgtgtatctttctctgcagccgaccagctgtacgagtagaagggcagtatttcagctgaa

SEQ ID NO: 21826 - DNA, 76 bp, Chlorella protothecoides
cctggcagggcggaggcgaggattcgagggcgattcactgcgcggtgggtccctccaggagccagcacaggaccaa

SEQ ID NO: 21827 - DNA, 71 bp, Chlorella protothecoides
atcagagtctggcgcgctgggcttatactgccacctggcggccaaggtgcggtgcgagacatcgcgggggg

SEQ ID NO: 21828 - DNA, 79 bp, Chlorella protothecoides
cttttagaatcggggcccccgccgtgtcgcggcggggtccccaacctcgccatgttcaaagggagttcctacacggggc

SEQ ID NO: 21829 - DNA, 69 bp, Chlorella protothecoides
ctcgtggctccaaaggctggcgtgctcgtcattccaaaggctggcgtgcttgtcgccccaaaagctggc

SEQ ID NO: 21830 - DNA, 106 bp, Chlorella protothecoides
ctttggagccacgagcacgccagcctttggggctgccggtacacctgcccttggagctgctggcactccagcttttggagccaccagcgcgccagcctttggtgga

SEQ ID NO: 21831 - DNA, 912 bp, Chlorella protothecoides
ggcgccagggccgggctctgggcaaatgacaaagatcccgataccaatagaccttgtacctcttattcattgcagtcccggtttgagcacagacagtggatcggcaagtctttcgttgagcgattggtgatggaggtccactctgtaaacccaacgtgcttttgctgcagtggtacttgtgtcagaccctggggttcacattaccctgtttgagtcattcacacctcacatacatcgtgcacgtgttctcacgtgtcacactgagccgaggaattgcagaccaaacgctcgtcctgttctgacgctgggggagcatacagactcaaacggcagggtctacaactactaatggcggaatcaagattccccgaggcaatgctcctgccagcccttcttcaatctttggatctgatgtcggctgcaattcagtcgatgagctcatacgtgtgggatgcctgttctccagattcatgctctgtaaagtggtggcatacccaaaatagagactgggcggcatcttgatgtagattgtacagctccgatgcaatccagcttgtgcatcagtggaaaagccgcaaccagaatgcgtgacagtatcccggtgctgcagcactaggccggccaccgttgcagcaagggcaccaagaggcagcttgtaggtcacactcagctccaacataattcttcgggctgcttgcagtcgatcagccagcctgaggcacgatctgtcttcctcttatgtggtaaagcactgttcttatgggaagagtgttttgtggaatgcacaatgggttctactggaaacctgaggatgtatgtttgcccagtacgaagtgcccttacatcacaagatgggacctccggtccagctgcagcacccggtatcgagatcttgctgagggcctcgaggca

SEQ ID NO: 21832 - DNA, 61 bp, Chlorella protothecoides
ggagttccgagcctggttggctgttgagggtaggaaggacacagccttgttcaccctgcgc

SEQ ID NO: 21833 - DNA, 64 bp, Chlorella protothecoides
tcccgagaaaatcatcagctctgccgaaaatctgggggaggtgctgcgtggggaccggatcctg

SEQ ID NO: 21834 - DNA, 61 bp, Chlorella protothecoides
ctggcctcctgacagaggggcaactccaggaccccgtcttcctcaagcccctgctcgagaa

SEQ ID NO: 21835 - DNA, 114 bp, Chlorella protothecoides
ggtgcgcgcgtacggacacattcggtccgagacaccgagggcgccgcagacgccggaaagattcgatcagatcggggcgagggatgtgaccggatgtgtcacctttgagttgtt

SEQ ID NO: 21836 - DNA, 176 bp, Chlorella protothecoides
taccgacccctccacccatcgttcccatcatcctctgcgataggcacggaccacatctctatttgttggagcttggcagcgcggataccttctgcgagtaagtgctcgtcatccctacatattttggctgacaagaacatgtcacagaaccaagagcccatacttgtgatcggccc

SEQ ID NO: 21837 - DNA, 159 bp, Chlorella protothecoides
tcaggcccacatcataactgcaaggggccacggcagcctgtattgaggttgagatacaaggacacagtaaagccttgaacaaacacaagcaccagaattcctcacttctgccgcctcctctccgtcactctccgcatcagaccctgtgcatgaattgtt

SEQ ID NO: 21838 - DNA, 61 bp, Chlorella protothecoides
acaatccctggggcagtatccaactcccctagagctgatagacatgatggagaggatggac

SEQ ID NO: 21839 - DNA, 79 bp, Chlorella protothecoides
ctccaactactcacgtcggaaactcaaacatggagagcaggtttgctggtggtgcctgcgtagcctgcatcccacttcc

SEQ ID NO: 21840 - DNA, 64 bp, Chlorella protothecoides
agaaccaaatgttctggggtaaaaagaaggaccccaagccagatgtagccaggtgggcttgacc

SEQ ID NO: 21841 - DNA, 116 bp, Chlorella protothecoides
cggccctttttcgggttgagagcatcctcatctggtccgacgtgtggatgataatgttaagatggcatacaggacgcccctcccgacattgatcatgcgggaaatgatctgtgacg

SEQ ID NO: 21842 - DNA, 61 bp, Chlorella protothecoides
acacaagccataccaggctcagaccagattgcagtgtccctcttcagtttcgcaactgcaa

SEQ ID NO: 21843 - DNA, 77 bp, Chlorella protothecoides
cagatcggcgcggggggtggtccctccagcctccagcggcggcccgcccacgccagcgcccgtcgcagcgacagagg

SEQ ID NO: 21844 - DNA, 61 bp, Chlorella protothecoides
tcagggggcgaagacgctcggtgtggagggtggggaaggtttcacgggagctgactggaac

SEQ ID NO: 21845 - DNA, 78 bp, Chlorella protothecoides
agtcccagctcttcaacacacccacaagactggttgtcagtcgagaagtacaggtgcgcccgtggtccgggcacacct

SEQ ID NO: 21846 - DNA, 265 bp, Chlorella protothecoides
aaaatccagcagaaactcacatgaccttcggaagtgggtagaagttggttgtgcatgcgtcctgggagcaggaggcgtgtgggcgtcaccgtccggatatgatacgtaacgtgcaccctccctctgggcaaatattgtgcttgcaaacaaagtccatttgacccacccgtgagagaacaccaaggctcaacaggaggagcattgtgctccagaggggtgtctgtcgctgcgacggcatcttgccgcgccaaattttggccaaaat

SEQ ID NO: 21847 - DNA, 811 bp, Chlorella protothecoides
  modified_base (172)..(181): a, c, t, g, unknown or other
tctgaggcttactgccggtgagccgtggtcgcatggactctgcagatgctggccagagaggttctggcggtcgatgaaacccgggggctgcttgcttgtccaagtgccgaggggcctggttcacaggcacacttcctggatctcttccaatccgcagattgaggggatacgnnnnnnnnnnttgaaggtcctggtggtcattaaatccctgtgactggtacttctttattatgtgacaagcggcgtggtgcacacacatgccccctgagtctcatcgtactacaggctcagaggctacaagggtgattttgaagagttcaccggcacagtcactttgacaagcccattcaccgagttcaccatcggcacgatcaacccagccacccatgggatctgcacacccactcctgacagcccctgtgactatgtcacgctggtgatatgttatccagaggaagttccccattgctatccatcatacctcaacgaaaacttgggcaccggcaatgacggctataaaaacacaggaaacaacaacaagggcgactggaaccatggtaggtcgcaggggtttgtcaacttggctcacaaaacgcctggcacgacgtgaaattcaccgattctggcggtcgccaccaccacagggaatggcaacactggcaatttcaacactggcagcaataacacaggaagccacatcgtctgccataactgggcatcggattccccatgccagattgagtacctcaagaatgttgagacagtctttctggcaggagagccccccccctcacctccccctccacccccc

SEQ ID NO: 21848 - DNA, 153 bp, Chlorella protothecoides
aatgcagggccacagggtctgcgagcatcaacctgcctcgtctgcatgggcagcgtcctcttacactgggtctagccctcagatccccctccattccctcctgcaccccctcccccactggatgcaggtcgtcctacggcatggatgccgtgt

SEQ ID NO: 21849 - DNA, 92 bp, Chlorella protothecoides
atgtctgtgagtgacccagtgtgtatctgagggctggctgggtgggatacatatgtgctgttctgtgtcgcaagtgtgggaggggctcatgg

SEQ ID NO: 21850 - DNA, 80 bp, Chlorella protothecoides
aggctgtgcctggggtgacttggaagtgggtcctgccaggtaatatatatttcaagtgccgggagatcatgagaacccag

SEQ ID NO: 21851 - DNA, 1988 bp, Chlorella protothecoides
  modified_base (1311)..(1369): a, c, t, g, unknown or other
gcccgcgagggaggggacgacgccgagaaaggacctgaggcggagccgggcgaggccgccgagacgagggtggcggggcgggcgaggcggcgggcggcggccaggcccggaccggccgggaggggcgaggccgctggccccagccccgctgccgagcctgggggtctcgacgcggccgcgcctggcgggctcgaggacgccggggctccagagggtgtggcctggatgcgggccccaaagccagaccctgagcctgttaccacgcagggggacgaggcgcgggacgcagccgcgcctcccgcgggtgacgctgcccctgtggaggcagcccggcccagcgccgacggggcgcgggacgctgccgtggcagtccctcctgcatccagtgcaggccccaatccggcgcaccatccagagactgagtccctgcacagcacggtggatgccgagcgggttgtgcttgcggaggacgagcgggatgctggcgtgggtgcgggggggaagcctcgcagagatgtcgagcgtggcgctggcgaggatgcggagcggcgtgcctgcgacagcgcagagcgggaagctgccgcggagggcgacatcgcagttgcagggcaggaggggcgtgcgaggaagcaggaggactccggcaaaggcgaggccggtctgggagcctacactgtcaacccgcaagatgacgctgcgatgtctgtggaggagccagggggcgctgacctggcggctgcgcctgacccaggagcggacgaggtgccgttctcagctgagccgggtgcgccagctggcactgccatgcctgtcaatgttgaagcgacgactggcgacgctggcaacggggctgcagtagcgacagcattggtcaaaacccaaggtccagcgccgggcgacgtggcgacgcctgccgcagccccagcggcctcgggcccagaccaccaggccctcgcagtcacccctgcagccgtgccaccgctgcaggcccaggccgtgggggaggagggtgcagggcccccgacgaccacgcccccagccacgcaggccacgcgcgccgcgacgcctgccgcggcgcggagctccgtcaagcaggcggcgccggcctctgcgaggccggcgcccccgaggaagcccctgccagccagcctggcctcgcccacgtccccgctcggcccgcaaggaaaggccgcgcgtgcagcgtcggggctgcacggccccggcgccacaccgccgggcccccagcaaccgctcgcaggcgaaggcacggagctgcagcgtgagcctttcctttggcggggggggggaagnnnnnnnnnnnnnnnnnnnnnnnnnnnnnnnnnnnnnnnnnnnnnnnnnnnnnnnnnnngcagcgggcttgccgattggcacaggggtgtgcaggagaggtagtctgcttgcttgctgccagagtgcacgcgttccgcctcccgccgtccaactgcctggatcggcctgcgcagggctgaggagcgcacagagccacctggactccgccgcgcaccgtttcttccagtgcatcgacaccgcgctcaaggcacgttggtgtgaagagggtggggggtgggagcatactgtcacggcccaaggtgtctcccgggcatgctgcctgccgagtcgagccatgtgctcgcccgtcgtatccctcccctcggccccgatggcatgtgtcgtggcacgggcgtcacagcctgcatcatgcctcccgcccctcccgcgccatgccccacacagacggctcgggagatgcaggccgttctggatcaggtggcggcggcagcaccctcccccaaggcgctgtcggccgccaatgggttggccaagtcggtgaaccgctgcgccaagggcactgccaggctctttggggcgggggccgatgggcccctggaccagctgcacgatgccagcctcggccttgccctgctttccaggtgagatggctggaacatgtgggggtgcgggggggg

SEQ ID NO: 21852 - DNA, 69 bp, Chlorella protothecoides
aatgacgggggaggggggtgaatcacgggggagggggtgaatgacgggggaggggggtgaatcacgggg

SEQ ID NO: 21853 - DNA, 62 bp, Chlorella protothecoides
gggccacagtgacgccactttccactgtctgcgcctgtcccagtgggctgttgacctcgtgg

SEQ ID NO: 21854 - DNA, 72 bp, Chlorella protothecoides
cctgcataggcagtgcagtgcttgggagtggaaacgcagcctaatagagagcagcctggaatcagcagggat

SEQ ID NO: 21855 - DNA, 62 bp, Chlorella protothecoides
agccactccagtatctcggggtagagatcgtactttgccacgacactccatgtctggcacgt

SEQ ID NO: 21856 - DNA, 237 bp, Chlorella protothecoides
tcctcctctccatccagcgctatatctccaacatctgcggtgtggaggacattgtcctggtgtttttttggaagcggggatgttcatccaggatggtaggggtgctcatgaaccgtccggtgccccgcctcatcaggccaatccgcttgctcgagcagttgccatgagcttgacgcctgcccagaacacacccacacacacacacacgcctccctttcctccatcagtgtctggcac

SEQ ID NO: 21857 - DNA, 80 bp, Chlorella protothecoides
atcccggcagtcttaataagacgcccatcttatcatgcatgccctgtatcatttcagctccctccatgggtcttcctgta

SEQ ID NO: 21858 - DNA, 254 bp, Chlorella protothecoides
gatgtcgcgctttcctacttcaacccaggcgccaccacggcacagtgctgccagggaggccgccaccatcccgggggaggtcagggagttgaccaccacgtcgatggtgcccaaaagggttgtggcctccgttgcaaatgctacggtttgggtgagcgtggtgacaggtttgagacttcacgtctgcatacaaatccttgcaccaggacgctgaaggcagcactgaggcgatgagcatgcaaggattgcaagta

SEQ ID NO: 21859 - DNA, 80 bp, Chlorella protothecoides
gggagcagggacatccagaacacaacggcaaatggatccaggttggtcacggcactgggttctggtgctccctgcgacat

SEQ ID NO: 21860 - DNA, 114 bp, Chlorella protothecoides
ccatgctagtgcactggttcagtggagaagtgcgtgctggggcattcggtatgtgctctgcatgcccacaggtccattgtacacgagttgaaccaattgcggcccaatcagcgt

SEQ ID NO: 21861 - DNA, 61 bp, Chlorella protothecoides
gtccctgggcatcctcactgtcgccatcgtgaccacccccttttccttcgagggccgcatg

SEQ ID NO: 21862 - DNA, 80 bp, Chlorella protothecoides
aataatcggacatggattcccatgcaggggtcccagagtttcggcctgtgaattctctgtctggttgccattttcccctg

SEQ ID NO: 21863 - DNA, 69 bp, Chlorella protothecoides
tcttccgcatctttcaaggtctgtcggtggcgtggtggcgtgtggtggcgctatccatgtgacaaggtg

SEQ ID NO: 21864 - DNA, 75 bp, Chlorella protothecoides
gacatcagccgaagagggggttgagggataggattggtggcagtttaggtttggagagcatccgtgagggatggc

SEQ ID NO: 21865 - DNA, 79 bp, Chlorella protothecoides
tatcaaacaatcctacaatgacacccccccccaaaaaacaacaaaacaaacctgctatccgctcgatgtgggcaagggt

SEQ ID NO: 21866 - DNA, 1065 bp, Chlorella protothecoides
ggagtcacccagccctagccccagccccgaagtcccttagaatgagttcaggccgagccttgaccactgttttcagacaatgtatcgccgctgtcagcccttggttgatatgatgatgggcagtatgtatacccccagatccaatggctttacaaaccattcttcatgcaggttccttgccctcaggtctgcctccgctgttgttccaatcagtcagatattgccaaaaggacaatgttgacttgattgttgtaggtctctcctatatgctttaccacgggatgggactgttgattgtaatactagtgggagtttaaatcagtgcttaaggagatgaaggattgggtgaagtttggcttttgacacaggtgcatgccacatacatgtgcagcacccaccatgttctgtcgaccaaatcctcagcagtctacgagggatctgcaaagctgcaccgccactccctccaaaggctgccagtcgcaaggggtaagtgcattgcttacagcaacagccgaaggtcacaggtccacgaacaccataccatggctgcctctgggtcacacctcgttgctctatcaaccttcctagcatctgcctgcatcagtccccttccctgctgagagattgcatcacaaaggaaaggggaaggacacagagtatcgctcatgctcaaggctccacaatgggtcaaccccacttggaaatccgcagttcacaaagaccgccaggtcgtgcaatgttgctctgcgtgttgcggggccttccgccttccagcatgcctatggtaggtgctgggtgctcgggaacatgcaactctcaggattgagcaactgcagtcggcccttgacatgacagcctagctcggagtgcatcagctagccggcgtggggcgtctccaggatgtagacctccgctgtatcaggctcgcgtagggttactagggcgggttttgggggaaccccggttttcgttttcgggccctttttcgtccctcttgcccactctcgtgacttgcatcagaagaatgatgaatataaacacgaacaaagcttgttagaggccaat

SEQ ID NO: 21867 - DNA, 76 bp, Chlorella protothecoides
gtcggtgacactgtgacagtgtctggggtgttggagtgggaggggcatccattgggctcagcccgtctgaaagccc

SEQ ID NO: 21868 - DNA, 76 bp, Chlorella protothecoides
tggcatgcctggcaggacggcgcaaaggcttcctgcagactatctcccttcaacattggcctccctttccagcatc

SEQ ID NO: 21869 - DNA, 71 bp, Chlorella protothecoides
gatctgactggcgcagttggttgcctcaatggcgaaccagagggggtgggaggaaaggaaggggaagcagg

SEQ ID NO: 21870 - DNA, 61 bp, Chlorella protothecoides
aggtacatgattcactcgtgtgcggctagggatgcaaggttcaaatgacaggtcaaccgag

SEQ ID NO: 21871 - DNA, 80 bp, Chlorella protothecoides
ccctccctcttttattctccgcctgcgtgatcgcatgtgagtggcggggcttctctgcgaggctgtgtactgtgcgctgg

SEQ ID NO: 21872 - DNA, 73 bp, Chlorella protothecoides
gcatgcacggcatatctcgttgtctgtgccgctgcacaactgcgtgcttcatcccatgcgtgctttcggagaa

SEQ ID NO: 21873 - DNA, 61 bp, Chlorella protothecoides
ggttgcacgatctctcgtcatgcttcacgaattgtagaaaccgtcttacttcaaatacgat

SEQ ID NO: 21874 - DNA, 78 bp, Chlorella protothecoides
cggggtgtgccggggggtggtcagtgtgtgggggtttgtggtggggagttgtgaaagcaaagctcagggattccacga

SEQ ID NO: 21875 - DNA, 61 bp, Chlorella protothecoides
ttcagcctttgtgacgaaaatactggcaggagacagtgggcctccccagatgcatggcgat

SEQ ID NO: 21876 - DNA, 20560 bp, Chlorella protothecoides
  modified_base (527)..(536): a, c, t, g, unknown or other
  modified_base (1308)..(1317): a, c, t, g, unknown or other
  modified_base (1389)..(1398): a, c, t, g, unknown or other
  modified_base (1470)..(1479): a, c, t, g, unknown or other
  modified_base (1709)..(1719): a, c, t, g, unknown or other
  modified_base (2269)..(2278): a, c, t, g, unknown or other
  modified_base (2703)..(2712): a, c, t, g, unknown or other
  modified_base (3589)..(3598): a, c, t, g, unknown or other
  modified_base (3834)..(3843): a, c, t, g, unknown or other
  modified_base (3994)..(4003): a, c, t, g, unknown or other
  modified_base (4554)..(4563): a, c, t, g, unknown or other
  modified_base (4854)..(4863): a, c, t, g, unknown or other
  modified_base (5232)..(5241): a, c, t, g, unknown or other
  modified_base (5741)..(5750): a, c, t, g, unknown or other
  modified_base (6204)..(6213): a, c, t, g, unknown or other
  modified_base (6741)..(6750): a, c, t, g, unknown or other
  modified_base (7142)..(7151): a, c, t, g, unknown or other
  modified_base (7444)..(7453): a, c, t, g, unknown or other
  modified_base (7514)..(7540): a, c, t, g, unknown or other
  modified_base (7976)..(7985): a, c, t, g, unknown or other
  modified_base (8206)..(8215): a, c, t, g, unknown or other
  modified_base (8599)..(8608): a, c, t, g, unknown or other
  modified_base (9111)..(9120): a, c, t, g, unknown or other
  modified_base (9516)..(9525): a, c, t, g, unknown or other
  modified_base (9652)..(9661): a, c, t, g, unknown or other
  modified_base (9946)..(9955): a, c, t, g, unknown or other
  modified_base (10527)..(10660): a, c, t, g, unknown or other
  modified_base (11650)..(11659): a, c, t, g, unknown or other
  modified_base (12572)..(12612): a, c, t, g, unknown or other
  modified_base (12826)..(12835): a, c, t, g, unknown or other
  modified_base (14552)..(14716): a, c, t, g, unknown or other
  modified_base (14787)..(14796): a, c, t, g, unknown or other
  modified_base (15487)..(15496): a, c, t, g, unknown or other
  modified_base (16292)..(16301): a, c, t, g, unknown or other
  modified_base (16497)..(16506): a, c, t, g, unknown or other
  modified_base (18860)..(18869): a, c, t, g, unknown or other
  modified_base (19271)..(19280): a, c, t, g, unknown or other
  modified_base (19932)..(19941): a, c, t, g, unknown or other
  modified_base (20035)..(20044): a, c, t, g, unknown or other
gcgccgcgctcgtgccgcacgcgcgcgtccgccagggtcaggcccagcacgcggtgccccttctcggccgccagctggctgggcgtggcgcccgtggcgtcggccgcggccaggcactcccccgcgccgccctggagcagcagggtgcaggcctcggcgttgccgcggatggcggcccagtgcaggggcgtgcagccctcggcgtcggggcgcgcggcggcgctgccggtgaagagcagcaggcgcagcgcgtcggcgtgccccttgtaggcggcccagtgcagcggcgtgcggccgtcgtcgtcgggcgcgtccaggtcggcgccccagcgcagcgccaggtggtgcagcaggcctgcctgcccatactgcgcggcgacgtgggccacggtgtacccgcgcgagtcgcgggcggccaggtcggcccccgcgcgcaggagcgtctcggcggcggggacggaaccgcgcaccgcggcccaatgcagcggtgtctggcgcgacgcgtcggccacatccacagcgcaccnnnnnnnnnncagcgtctcggcggcggggacggacccgcgcactgccgcccaatgcagcggtgtctggtgcgacgcgtcggccacatccacagcgcaccccgcgcccagcaggtaggtcagcaccgctacacggttgttcagcgccgcccactgcagggcgtagaagccctggtcgtcgggggcgtggaggagggaggggtcggcccccgccagccgggttagcacgtcgaagtcgccgtaggcagcggccttccagactgtggagggttttgaagtggggggggaaagggggggtcgcgacgggctgcaggcgacgcctcgaggtgtcagcacgacatgcatgcccctgggtacctgtgtcgatggtctccggctccttcgacatggcttggcagttcttggtggtgacgggcggaaaccgatagcccgggatcaccgtgctccgagcgtgtcgcccatcaacctgggcaccctgccaggactcggttgtgaaccagatatggtaaacaggaaaagcttggcgagcaaaggttgcgtggcgcgagttctcagcattgctgtgcaaggttgccgtgcggggccacgctaagcgcccagaagatatgcttggagggcgcgctggatttggcctgcgatacgtccgtcgacagtttcgttacacaggctcgagcgtccaccgatagttcctggaagcatcagttcgacggtattgattatggtagtattaacccgagacacggacggaggagtcatctgcgcttgacgcagcaagttcccactnnnnnnnnnnaacgactaccccaaagttgggcaggggtggtcactgcaccgtaacggaggggcatggagtctcccatgctgnnnnnnnnnngacgactaccccaaagttgatcaggggtggtcactgcaccataacggaggggcatggagtctcccatgctgnnnnnnnnnntctggaagcatcaattcgacggtattaattatggcagtattaacccgagacacggacggaggaggcatctgcgcttgacgcagcaagttcccacttgtctggcccagtcttgatattggaggaatgcatgatggggttacaagaaccctcccatactctggatagcctgatgctaactacttcagcactcgatagaatttgagcgggagacatcaaggccattgcttggnnnnnnnnnnntacgacccagtgtacatcctggagatcctgcggtgcttcctggccaaccccagcacgcggaaagtggacgctgcggaccccgcccccgcctccaactggagcctggcaggggaggagctgctcgccgcctgtcgcagcgacgagggcattccccccttcctcgtcgcgcatggggttccggctatgctgggcatgctggcgtttggtgtgcagtaccaggacgcagaggctggtaatcggacccgcagtctggcctgggggctgctggcgtcagtcgctgacacccaccctgaggctgtgacaggtcaggcccagctggcttccggaatccactcggtgctcagccaggggaccccacccgaggacactgccctcgctgcaacccacatcctgcgcctcgccctggaagaccagcaggtgcctggttgggtgcggcctggcctctgtaagaccgctcgagtcgtggggctggccatgtcggtcctgcaaagaaaactcacctactataatcgcaaggagcatgctgctgagtcactgcccctgcgccaannnnnnnnnnacctctgtaagaccgctcgagtcgtggtgctggccatgtcggtcctgcaaagaaaaatcacttactataatcgcaaggaccatgctgctgagtcactgcccctgcgccaacccgtccagcccttctctggttcccctcgacaggtctgcgccgcattcagagacgcctttgccagccatgaagtcctgcttgccctttggaacctgctgggaggctcctcaaacctagaactcgccacagaaatgtatgatggattgatgggggagttcatcgtgcaggtttctgttgctgatcgctctaacatccacatgcagagagatgctgtcgtcaccaagctggaccctcagtaggtgggctaagcacccgtttcctcatcttccatgtatgttatcaacgtcccatgcccatgcagtgtgcaggccgtnnnnnnnnnngaacctagaactcgccacagaaatgtatgttgcattgatggggggagttcatcgtgcaggtttctgttgccgatcgctctaacatccacatgcagagagatgccgtcgtcaccaagctggaccctaagtagtgggctaaggacccgtttcctcatcttccatgtatgttgacagcgtcccatgcccatgcagtgtgcaggccgttgccttgctggcaagactggaaagcgtggaaggaggggcgcgctgcaatctccttcgttccagcttcgcggcctgcatgctggacaacatgttgagctcgctgcggcggccccacaccacctcgggatctgactcggatggtcggactgatgtgtgctccagcgcaggttcggaagatgtacaggagggagcgagggatcctctgtgtcaggcttgcgcagacctcgttgcattgtaccttgactcaaggctaggcgccacggtggggcagcccgacggggctgctgaggatgtagcggccaccctgcaagtgctgcaaaggggccacggtcttattgacccagaggcctggtcagcctgccgagccacactggcactgctggctgcggaggagcagacggtggcacaggctgaacagctgactgaccgagcaggtctccactgatcttgagggatgctgcctacgtgattacccagtacaagtgtcatgaaacccattcttggcctcccagacttcttgggagatgaggagcacaacatgacacgtcaggtgcctcaagatcatgaacgtcaagctcgcttgcacccccagagaagcatccaatgcacgtttgctcccagagcatggcatttctgaacaacccaagctttggtatgtcattggtcccgtgtnnnnnnnnnntgaagcatccaatgcaggtttgcttccagagcatggcatttctgaacaatccaagctttggtatgtcattggtcccgtgtagtatgtggaatttcgcgttcattaactgccaagatggtcgaatccaaggcctcatgatgtcgactagggcaggagcttgattggaaaatgtaggaggaaggcatggtgtcaatcagggtgacccggggaaaccggtcaacaccggtcaacagagnnnnnnnnnnaaaggcgtggtgtcaatcaggtgaccaggggaaaccggtcaacaccggtcaacagagggcccaccacggaagatcagacttgcgacaggaggggttctttggactacccaggcgcgcgatgtgggactgaatcaaccccatggcggatatnnnnnnnnnntaccacggatgatcagacttgcgccaggaggggttctttggattacccaggcgcgcgaggtgggactgaatcaaccccatggcggatatcacggcggtggatgagactatcaagcgcctcgcgtcctataaaggggtgcggggcatcttggtggccaccgccgacggcgtaccggtgcggacaacgctcgagcaggatgccgctcagcagtatgcagccctggccaccacactcgccagtaaagctcggagtatggttcgtgagatagcgagcgacgacgagctgcaattcctgcgggtgcgaagccggcgaggagagatcatgatcgcgcctggcgccgacaaggagagacagtactgcttggttgtggtgcagaaccctgtctcggaataacccccccccaagcctgcattgactccccctcgcctgcctcatacatttccacgaccttatgccatgctgtttcgtggattttcatgttgcgattcatccacagccgtctgtgcagtttgacagcgtcacagtgtatgcgatggcagccacacggtggnnnnnnnnnnaaagcctgcattgactccccatcgcctgcctcatacgtttccacgaccttatgtcatgctgtttcgtggatttccatgttgcgattcatccagagccgtctgtgcagtttgacagcgatacagtgtatgcgatggcagccacacggtggggcagtaagccgaaggtctctgcacatagccccagactggtgtgagcattcgcgtgctgcacgcagcaaatgggttcaagccactgctggaaaccaggccggcattggatcagggttccacaaggtgtgggtgctcctcccnnnnnnnnnncctctgcacatagtcccagactggtgtgagcattcgcgcgttgcacgcagcaaatgggttcaacccgctgctggaaaccaggccggcattggattagggttccacaaggtgtgggtgctcctcccagaactggttgccaatgatgtccacatgcaagacctgcagcacccacttttcccgcacgccccagctcccatctggcttcttcaccctgacttccgcccgctggcggatgagggttgagccctgccaaagggagatatgggagggagggagaggtcctcagaaatgaggggggccctgggcgttctgttgccccttcttcctacggtctgatcatgggacgcacagtacatccggctacccgtnnnnnnnnnngaaggcacatatgggagggagggagaggtcctcagaatgagcggggccctgggcattctgttgccccttcttcctacggtctgattatgggacgcacagtacatccggctacccgtggccaccttgcgaaagcgggcggggatgtcattgtagttgataccgtactcggagaagagcagctcattcttatggctgctcagcgtgccctacagtgaggtgtgtgtcgggttgccacgctgatgtcggcggcatacctggctggttaggtgtcacctagcactctaatctcatggagccaagaagtagggtcctcgcccctcctttccactctccctctatgtgttcaggcacaccttgagtctctcgtgtgcagctgcctgatccatgccgcccttcaccagagcccagaaacaggcgttgtacttcagcaattgggtggagaggaggggaaggttggcgatgacccaggccgtacgggtacagcatgctcagaggccccnnnnnnnnnngcagcaatggggtggagaggagggcaaggttggcgatgacccagcccgtacgggtacagcatgctcagaggccccatctcgactgcgcaggtgtagccttgtgcctcgctcccctcctctcaccaggttgtttatgtgggtgtccacctggcgccaggacaggtagtccctcagcacggccaggttggggtagcacaccgcccgaccatcaaacatgggggtggacagcaggggcgtttcgggcaggaactcggcccaccgcctgacataggtggccgtgaaacaggagaccaccagcgagacgagtttggaggcccgacgccctgcaagtgcaatggcgtgggtggacacgctgggcgggcctgacgcggccaggcggggaggctgggctgcgcccggggcatggagatgccataaggaacacacacacagtcgcacccctgcggagcactcnnnnnnnnnnggacgcggccaggcggggaggcctggctgcgcccggggcatggagatgccatgggcacgcacacacagtcgcacccctgcggagcactcgagcacaaacgagagcacaggccgagggaaggagccaggacatcccatctcctcaccatataattttgtgctggggggcagcacgaaactgtactcgtcgctctccccaaacgccaggcgcacgtctgggaaggcaagcatcactgcctgatggtggttggaagggttgtcaggttctgattgagtgggaggaatcacccactttgaggcaatctatgatgagatggaatgagcacgagcaccgttatccaacgcacccttgcagcaaaacactatcacgcatgcctgtgccgctcaattgcaacacagagatcacctctgcggatgcatccatcaaggccagggcccggccgtcatttggcttctcaaacttgtgctcctcacagaacctggagttgtgggaccagtgtggagccaggtgatgtccctgagcaagagnnnnnnnnnnttcaagcttgtgctcctcacagaacctggggtcgtgggaccagcgtggagccaggtgatgtccctgagcaagagacggaccacaacctcaattcaagatcgggctgcccaagtaacaccttgtgaaccctttgccatccactctgaggacgatccagcagccaggcaacagcctgtcgtcttgctcgaaggttcgcacgtactcatacgcgctcttcgccatccaggctttgcggcatcactcggaactatgtcaggaaaagggcgtcattatggtgggggttccaaggtcggaggcctttttggccacggtatgctgaagcagccggcatgcgcgcaatccacataagctggacgggacattctgcaaggtactggtcagtgtcaagaggnnnnnnnnnnatgctgaagcagtcggcatgcgcgcaatctacataagctggacgggacgttctgcaaggtactggtcagtgtcaagagggacaccaatgtcagagcgatgttggatcttactctggaatttggaggtggcgacgaaccggctgttccaggcgaaacagttgtcgtagattgatgatgcagtagatgggcacgcgcatctacgacagaggttgtttgagatactatcgcgcaaggctttccctcatgccgctgtagagcactttaccccgcactgggcgcggtcatgggtgacnnnnnnnnnnggatgggcacgcgcatctacgacagaggtcgtttgagatactatcgcgcaaggctttcccnnnnnnnnnnnnnnnnnnnnnnnnnnnaattgcctgcaatgcacagcatggcccgatcggcttcatgaatgctattcacctcggcccacatgcgccctcctcctagtccaaccaatatagtgttggctttattttgcttgcgcttccatccagcagaccatggagctgtgcacagtgatcaaaggaggactgtcacacttggtaatgacacagcaatttagaagcatctcagacacccctgcgctaccgggagttctaaatgcgagactggccgcgaggtgtccctctacgtggggagttgatcatggacttgatacagatgcgggataggcatgttcatggtcgtccatgttttaagatcgactgacatcgagttgcccatctcaaccatctaggatgagacatataggtctaacaacatatttcatccgaaattttccctggtcatacttgctgaacctannnnnnnnnnaacaggtctaacaacatatttcatcaggaattttccctggtcatacttgctgaacctacctttgccgagcttcgggtgcaagctgcatgatgatgtccgtacaatacctaccgcgactagggatgtgatgacgaggtatcacacgcatgggcaaaagactggatcttttgagcgttcacaattgttcatctcgcattcttgcgtcagaggaggtgaagtgnnnnnnnnnnttggatcttttgagcgttcacaattgctcaagtcgcattcttgcgtcagaggaggtgaagtgctcatgattccaagttgaggggtgttgttagcaatgtgtggtgcatcgatattcacggcgaagaatcaagagcgggccaggatctcctcgtccccggcgcgcattgcctgatacatgagtacgagctgcgggtgcgcagtacacaatccccttctccatggcatctttcacttgctcacaattgattgcgttactgcaggcactgcgctcacaattgctgctgggcttcggtttcgtcaaggtcgcaagacgcgccatttgaatctgtgccttcccggacttgccaacctcgccgggtacgaaccattacagagagcaccannnnnnnnnngccggtttcgtccaggtcgcaagacacgccatttgaatctgtgccttcccagacttgccaacctggccgggtacgaaccattacagagagcaccaatgttcatcaacacattacatgggaatgtgaagtggaattgacggctcagacaccctaagtcggactaccctggatgaaaccccaaccccccgccctttccgtcgcagaccataatgcacgacaaagacactacgaatgcgtcgctgcgatcgatgatcgactatatacagtgcagcgtcatctccggaaccccgaatgagcagcgtgcgcgccgacagcgagctctgcagaggctgagggagatgcccagccctggcttggcgccatctggtgaggtgggagggaatcgcctgcagcaacggcccgtttgcgggcggattcgttgctgtgatcggatgcaacgccatcagttgtgaagctctgtgcttagaattgtccctcatgtgcatgatgcaggaccgagaatnnnnnnnnnncgcaggcggattcattgctgtgatcggatgcaacgccatcaggtgtgaagctctgtgcttagaattgcccctcatgtgcatgatgcaggaccgagaatgcggggtgagggctgtgatgaggatgagcagggcgtcgtctctgccgagatgacaggcgagggcagcgctaagctgcggatcaccttgctggcagcaggttttgtgattggtgagtccaccaagggcaggagggctttcacgcgaggatcacctcatcatgttgcgtccagtatggttgtgagcaacgatacagcacatccaccagccccactatttccaggaaggtaccattcctgcagaacccctttttccccacgtcgcaatctagcacttactatcacccaacccctaccgacnnnnnnnnnnatatagttgtgagcaacgttaaagcacacccaccagccccaccatttccaggaaggtaccattcctgcaaaacccctgttccccaagtcgcaatcaagcacttactatcacccaacccctaccgacnnnnnnnnnngggaacaacccgcatgcccacccatctgtcgtacgcccaggcacaaatgcacacacctgtcgctgtctgcacggagggatgccgcaaaggggaccgcatggcggggtggaggctggtacatgaagtccaccgacccaatgacctgcacccggtccacggcttgacctgtcgggtgagagcgggaggggtttgaatggcgtggggggcaagatggagcagggcgaacagggtggtcgctgggcgaacaggagccgggcggcaatcactctccttagggcacagcannnnnnnnnnagggccctctggagcgtcagtgcgtgagattacgcatcgcaccggctcctccatccgcagctggaacgagaacgtgaaagtgaggggaaaggaccgcaaagtgcggaccctgatcatcgaggtgcgtggttcctcacccagcctcccacccacaggcattgccctagggctgctcttgcaccattgaccactgcacctgactttgcctgcgccgtctgccctgccaaagggattgccttgtgccgtttcagacctgaacagcattgatgcccatgccccccgcctcccatctacatgcaggggcctccctgcagcatccagatggcactgcagatcatctctggagctgttgcgcgttacaaagacctgtgcgaaggcgccttctgcggtgagatttgaaagtgggaaagggttgtgggagaacggttacagctctgctagggtcaaagacaactgtggccttgctgtgccctaaggagagtgattgccgcctggcttttgtgcgcccagcgaccaccctgctcgccctgctccatcttggcccccacgccattcaaacccctcccgctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcgtacgacagatgggtgggcatgcaggttgtgcctatgatcctggcctgcagggtcgtggcgttgatggctaggcaagggcgtggcgctttgggtccatgtatgagtggtgttagctaccctcagtttgccaccctccctgcacagcccggctgttccttgtcatttagtgcgctgatctcaccctccacaatcccctgatggctctgaaccacagcatggcgcgagggtggaacaggaagcacccccgctcacccatttccccggcgggcaacaaggagaacctgcaggccggtgacgccggtgcgtttaagtgctcgatcaagaatccaggctgggcagccctggtcccaggctgtggtctgccccccgtcaaggtgccgagggtctggcggttccagtgggctgcctgcaacctgaatgacacatgcagatcagctgccaccttggactccgcccctgtcaccaacctcccatgcaccatcgtgccaggtgccacaccagcgcaccaacccccgcaccccatgtgcgcaggagccctccccgccaccgccgatgcccgccaccccgctcttcgactcccagctctgcatgcctgagcagtatccctggagcatgctgcaggcgtccgcacaccttgcggccttgggccgggcctgcgaggacggcaacctggccccatcggcacgctgccaggacgtcacgcccatgcgcctagactttggcctgggtgcccattctggtatgctggcgcgctcaaggggcctgacgaggggtctcaaagtggatgtgatggtaccctgggagcgacataccaccggcgtgcctcgagtgcattgggttgccagtgccaggtgccaggcatgccgccgtgcgtgccgatcctcacgcctgcccgtcccctcccaaccccgcagccgccgaggctgcgtcttgggatgcatcgctcctgctgcccagcaagccgtgccccgatgtccgtgctcnnnnnnnnnntccgaccccacagccgccgagactgcgccttgggatgcatcgctcctgctgtccagcaagccgtgccccgatgtccgtgctccacattcgcgcacccaggcgcccgccttcagcctctttggtcccctgagtgagtgctggagcaggacgagcaaccttgaggcttggtggggatggggatggcgagcaagctgcacagcccactcctgccagagcctgggtcatcagggtcacgccacaagcagcggatgcaatccacctgagctggtgcccccaatccctccctgccctgcagctgggtacgaggggcagcacctcgcaaatctgtcgcatggatccccgccctctgggcccaccgcccagtctgtgctggcggcccagctggacgccctcaatcgccaggtgggctgcctcatgcaagggcgtgcacagcgcgtgagctgccgctgactgaggctaggcctctgtcttttcccgccgtgtctgagatggtggcacagacactgctccccggttacaactccttccactcccttggccgtgcagttctccttcaaccaaaacatggaaggaatgcacctccctcagaccgctgagctcgcgatgcccacgcccctactctccgaacacgtttcccacttccccggctggatgtgagactatcagccctgcctttcccatccacgaaggcagttcgacccccagcaaattcgctgtctgcgaccatcactggcgaccaatcccgtgctcctcacatcacaccctctggaccactgctcactcctgagaccgcgaccccaacttgggagctcaccacagcaacaactcgacggcaggggaggtacagtcacccaccccgcaccctcctccctcaaccttgcccctgtccgcgccctccccttcctcctgaaannnnnnnnnnnnnnnnnnnnnnnnnnnnnnnnnnnnnnnnngccttgcgctggcagtcgttgctcacatccctcacatctgattcctctccacatgcagccgctgcacctgaaatgtctgcgaacattcaagcccctttgtggctcccccaacctgccccgtggcccctttcaggaaactgtcgtcttccatcccaggccagcatgcttgttaagattagcctagacctccaagcccacctgttgatcccccaannnnnnnnnngggctgtcgtcttccatcccaggccatcatgcttgttaagattagcctggacctccaagcccacctgttgatcccccaaatggacctgcctgatacgatgtgcactgcctataaacgcaggcacaatgcaccatgcccctagctgtggttcagctccatcgtgttgagctgcctctgcgtgcaccatttccttgattgctgccatactcagcatgtgagccagtctgggacagatttggttttttaaacatcatccagacccaagctactgcatggtcttaggtcagcctagtaggcttgtactcatgaaaacatggcgtagccatccactttgaacacccctgggcagcgcgcctccttcaataggtatgaacccgtccagtcctcgtgggagcacatgatgtgaatgcagtatcgatatttctgtattgtcgggggggcaccatcgatgaaggataggtcctgcttgaaatgtaccgggcgcacgcgcagtgcaatgcatccctgttctcggggtgggggagagtggccagagcacgctgggcgcgtggtctcggcggtccggcgcgcgccaggcctaagctagtgatctcagcatccaccttccagaatcaaggcgttggcatggaaatccgtcagagctattcgtgcgcgattagcagcccagggagcgtgtaaggatcccaccgcttcccggcttcaaactgtcggggccactgccggaacaatgtgtcggggcctgagtttgagctgccaggccaccggccccagcgagatgaacaacataaaaacgttgcgaacctcgaagaaaagattgatgcagaatctttgcactcgccgcacatcggaggtgtgctcctgccgctccttccgcatgtaccaggaggtgagtgctggcgacccgcacccatgagccgaggtttctcgagatgtgccctccgtctcagcccaatgcctcgacgatctgtgcaggctctggagcttgctcgagtgcaagactatgaggcttccaggcaggcgttcgaaaacaccattcaaatgtgccccaacctggagacggcctgggtgtcctgggcgcaggtgggtctccccatacggtccatggagtgaagctctcgcccgcatggggtaccagtgtccctgtacatgcagcaccgcactgtttgacctgtgcgggcgatgcccgaggtgactgcgctgtcatcaggtctatgccccctccattggtgcccgattttgtcttgctgctcagcacacaagtgcacgcccactcaagggatccacatcactctccctcctgtgccttcagatggagaagcgctgcggtcgaagcaaggacggcatcctgcgatcccgtgccgtcctccagaaggcactggcgctgaaccccagctccccccgcctctgccaggcctggggcctgctcgagctccagcgcggcaactggacggcggccagcctgctcatcgagcgcgcggtcctcctcgacgccagcctcgcgcccgtgctgaagtggcgggctgtggagacggcacgaaagctcgcgcaggaagcccacgcagcgaaggctcgaccgaccctgcagtccaatgcatcctgagccccactcctgagaatgaacccctccccaacatccaccctgttccaaatgatttgtggcagcccctgatccgagttcacaagaacatttgattaccatcacacttcctagtatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcaagggagggcgtacttctcagcaacctttcagattcctctcgaagaatatcgagaaggtaattcgcnnnnnnnnnngttctggtgtccacgctgatgaaaagcttacgtataagactcgatcattaggctgagagaacactctccctcgtttcctcctgtgagcggcgagctcgggatataaggacgcgcaagggagggcatacttctcagcaacctttcagattcctctctcgaagaatatcgagaaggtaattcgccaaccttaaggccatggcggcaaccttcacggaccagctcaaggctttgtacaagcaggagtggcaacgagagccgaaccgctccgccaacctggtgagaaacaatcgccatgctcggatcgaggccaaattctcaaatacgatccaccataccatgccgccatccacctccccttcgcagtcgctgttgaaggcggtggccttcttcaccggtgccgtcgtggtggtgcggacctggggtgatgccttcatcgcctagttgaggagctgaatcccaatttcgcgatgcccaaatttgaatctttggtgcgctgagtgcggatctatgacgcagatgtgcgagtggggccgctcaagcgtgtttggcctcttcccaaaggcatggaagaggtgacctgtgctcagtctccccaaacctgcgagggctctctcccctccagagccgacccctaacatcacatgtgcctgccattgagggtataacttagtcttaaaggcctgaagtggannnnnnnnnngaacctgcgagggctctctcccctcaagagccgacccctgacatcacatgtgcctgccattgaggatataacttagtcttaaaggcctgaagtggatgcataaggcgcgagaggtggctgtgagggggaaggtgtagagcaacaagctgcagtgacacattatcatggggacacgatggtatgcactctggactacgtcaggcaggtgaatcaaacgtgaggcgggggcgcacggcaggcagccggagcacacagggtctgggtcggtggggtctgggtggtgcggcgccccgctcgaccctcggcccctcgcccctggcggcctcgccggcgcacgcgccgctcgtcggcgactgggccgctcgatccatcaggccacgccctcgcaggaggtgcgtggcgcgcaggtgcaccgcgcgtcgaagccctgggacgtgcagcaagagtcgaagcggacctcggtgccgttaacctgagcgtgccactgccacaggctggacaggggctggaactttgaccccgggtccagctctgccacggcgcagccatagtcgcaccaggtgttggggtactccaccgacccgtcgaagcactgcgcgtgctctggccagccagccttgccccagtgcagccgggccccacacttttcgcggaacagctggatgaccgtctggaactgggtgttgggcttgccggtggagcgggagatgtagtcctgttatgagagggtgtggtggtgatgtggggctgggatgttgggccagcgtgctgattggaggggtcacatggggagggnnnnnnnnnngtgagagggagtggttgtggtgtggggctgggatgttggaccagggtgctgattggaggggtcacatggggagggatcaggctcgacggggtggcccactccccccgcccgacagaagcatcgctcccggagagcacaagcctgcccatcgatgcattgttaatcgttgatacagtacccctgtccgtcaggtgtnnnnnnnnnntacagaagcatcgctcccggtgagcacaagcctgcccatcgatgcattgtttattgttgatacagtacccctgtccgtcaggtgtcatggacgcccagggcccccaacacatagggggacacagtgagtggatgttcatcccccacctcctcaccagcaacctcaacccacctcgatgttgatgtacatcctgggcccgccgtgcgtggggctcaagtagaactcctcgccgttgacgaagcggatgaggcccggggtgcggaagccctcgtacagcttggcggggccgtagatctcggcacccacctcctgcaggcaggtgccggcgcgctccagggggatgctgacctcgtactggtcgtagggcgcgaagctggcgctggcagtggtgaactcggtctggctcaggaaggccctgttgattttttgggggaaggggtggtattggatgagggggaggacggattgatggatttgggagatccgggggtgcactgtgatgaagcaagaggggcagctgaaagggaggaagggcaggagggcgcagaacagtgtggcatgtacgaacagcgcgcgggaggtgagggtggggctggcctggctcggacccatgccagggggacaggggagttgggatatgctcggtgaacctcagcatcaccacgtctgatggaagaggtagcacagggagccgcgcagagtccaccagaccccttcccccggccaccccttcccctgcacacacagcaacaccctctcctcacttgcggcgctcgaaggtccccggccgcacgtagttctgggtggcgatggtgtagaaccgcgtccagccgtcggtgccgtagcggatggcggcgttgggtctcacggggtcggtgtaggcctggtcaaagacgatgtcgtcggagggccccgactgtgcggacacctcgggcgtggcggcgtcggcggggtcgatgttggggatgacgtcgctgggctccttgtctgagtaggagtagtcggtgcgccagatcacgcggttgggcaggaaccagaagagctgcgtctcgtccaccgcgaacagcgcggccttgatggcgtcctcgttgcccgactcccgcgccgcgacgtagtcctcctgcacctccagcatctgggcggtgaagttggcaaactgggtggtctccaggctgcgcgtcaccgcctgctgcggcacgatggccagcgtcagctccgtgatcacgcccagacggcccacggagacgcccgccgcgcgccagaggtgggggtgcgactctcgcgtcagcgtcacctctgtgccgttggccaccaccagcttcagagcgtgagtctgggaagagagggagccccaggtcatggaggagccgtgggtgccggtggccaccgcgccgccaatggtctggtcgatgaaccaggagaaggcgggcagcgtccagcccgcgggctgcttgtacgccgtgtacttggacagatagtccagcagcatgcgctgcggcacgcccgcagcgacggtcactcgggccgcatcctcgtccacctgtgtcgccaggaattgggatgggaggtggggtatcgggggataaggggtttgtgtgtgcacggaagcgagagtaatgtgaagagcttggaggatggaggttggggcaaccaaggccaggctgcgggtgccgcgcatctcgaaccaaaaagcacgcaggagggtgtgggcaccggaacccaaacaccccagccggagaaagccgggcccatgcccacagcatatttggcgtcagccaggacccacacacgtgcaagaacccaacacgagtctccacggaaaacctctgaaaccaaccccttggcttgcctggatggggaagtttgggggcgggccgttggcgccccactccgtggggtcggaggggttctcgatgaagttgacggtggtcagtagctcggtcatgaccaggttcagggaggagtcggccgatgtgttggcgcagaactgttccttgttccaggagtggcccacgcccacggccttgatgtgctcgtaggactggaccagctgcttgagctcgtcgatgtcggcggggcgtcccaccttggtggaatcatcgcactggaagaaaccctggaagtttgcctgaggagggagggaggggttgatgggttcttgaggcatctggggaaacttcctcatcaggacagagggggaggggggggcagcacacgcatcgtcgtttgccggatcaggagccagcacttgcgacggacagcggatgcccggaatgtaatccacattacaggtccgtgtcgtgtgcatggtggccgggaaccatatggcacgagctcacgactcaccagctcannnnnnnnnnttccacattacaggtccgtatcgtgtgcatggtggcctggaactctatggcacgagctcacgactcaccagctcatatggcagcccgcaggagccatgtgtggcctcctccgccatgcggcaagtccatgtctgcggcgcgccggtgaagttctgagcgaaggcacacccgagcaaggagatcaggcagacgaggcctgcgaggcgttggcccatgcttgccctctgctcagacgccacggcgtagtatgagctgtggggagcgcccaccacaaaagcggacagagaaaaaatatgccgagcagccctaaaacagcgggaggccgggcataaatattccaaaagcttgtcgcgatgacttttatccgcgacgagtacagcgggctgggagggagaggtgcannnnnnnnnnggaaaatgtatgccgagcagccctaaaacagcgggagaccgggcataaattttccgaaaggttgtcgcgatgacttttatccgcgatgagtacagcgggctgggagggagaggtgcatcagcttcttgcgcgggtcaggttcacatacgcttggtgcttggacatgccgaggatctcagtgtgaccacaagggtacgcgttcgatccctccatgcggaagctcccagcacagatctcttgcaaaggaagctgccccagcgtccgcatgagccgcctagcatctctgcatcgggtctttgtgcagtattgcttggtttgcacgccggggtagggctgcgtgcctgtccgacatgagataaagcagtcacgtgggggcaaaatctatctctaccccccatctccatggggtgcggtggtccgccccgatggccagtcgaatggtggggaatcccgacaaataattgcaacttattgctctttgttttttaagactcatgtcgggcatccccctgcccggtatcgtacgtcgaagaggtgtcggggtcaccacttcccgccatggatcgaatctcttcttctggcatcctcagtccaggcttgtgtgacccttgctttgcaacccccatggatgtaaaagcttcagcgggcagannnnnnnnnnccggacctcacccctcagatcgcagcatgcagcgcggcccgcgccctgcttgcctctgccgcctgcaggcccaggaccaccgccgtccccgccnnnnnnnnnnagatcgaatctctccttctggcatcctcagtccgggcttgtgtgacccttgctttgcaacacccatggatgtaaaagcttcagcgggcagagcaaggggacacagagcgcgcatgctgtgagcaatggccacgttccgccccacaggacagacggacctcacccccctcagatcgcagcatgcagcgcagcccgcgccctgcttgcctctgccgcttgcaggcccaggaccaccgccgtccccgcccccagggccttcagctcccctgaccgtgccagcaggccccctcccaggcacaggcccagcagggcagcgagcgcggctctgcccagcggctgcgctttctcgctgcccagccctgccagcgcccaggcctggggcgcgagcagggccgcgccgcccgccaggtcgcgcgctgcgcgcacggcgtcgccccaaccgcgcgcgccctgcgcgtgcgccagcatggcggcgccgttgagcgtcagcgccagcagcgcggccggcggcaggtac

SEQ ID NO: 21877 - DNA, 95 bp, Chlorella protothecoides
gaccccctgggcctggccgacgaccccgacgcgctggcggagctgaaggtgaaggagctgaagaacggccgtctggccatgtttgccaactttgg

SEQ ID NO: 21878 - DNA, 80 bp, Chlorella protothecoides
ccagccagtcgcgctccctgtatgggatgtcagagaagggggtgtggggttggatgcagcacgcggcacgagaatgcttc

SEQ ID NO: 21879 - DNA, 74 bp, Chlorella protothecoides
aatcccgggcgcgggaaaattgctgggcgcgggcagcgcttccggggtgtgcagggatgcagggcaacccacca

SEQ ID NO: 21880 - DNA, 61 bp, Chlorella protothecoides
cgagcccagcgcggcgccgccggcggcgtgggagtccaggtagggcagcgcctcgggcgcc

SEQ ID NO: 21881 - DNA, 77 bp, Chlorella protothecoides
gaattgctcccaaggctcaaataacttttgaatcaatcagcaaggtagcgcatttgcataatcatgtaaaagggggg

SEQ ID NO: 21882 - DNA, 61 bp, Chlorella protothecoides
tgctgaggcagaggtatgcaccgtggtccatggcgcccaggttctgggcatgtccatgtgt

SEQ ID NO: 21883 - DNA, 4924 bp, Chlorella protothecoides
aggggtagcggcaggggccgcgggtgccggggcccgtgcctgaggcgctgcgcctcgcccctggggccctggggcacggccttgggggcccggtgcccggccctggggccctgcgcctcggccctggggcgcggctgcttgcggcctcctgggcgctgcggctgcggctggggctccggctggggctccggctggggctgcggctggggctgaggctgccccgaggatggcggcgacctccgtcggcacctcctccggctcgggagccgcacccatgaggatcgaggccgcgccggaggcgtggttccccggcacgaggctctggatgcggctgaacagcgcccccaggcgctggcactcctcctcggtgtgacaccagaggcccaccacctgggcgtgcacacaggggcggtgggtaggaggtgcggggcgtccaccacatgtcggtgtgaagcaggactcaaacatggtgcaggggcgcccttcgagctttggcaggccccccccaggtctgaggagatggagcttgcaagactctctctctcccgggcacgcatggccctccgggcgtgcacccgggcacccaccttggaggagacctcatcgatgtcagtgcggtacatgatgtatggtttgtggatctccgatgtgaaccccgccccaatgtcctccatgaagtcctctgcgacagggagggggggcgagcatggagggcattgttgtggcaactgcgccagccgctgaccacatcgcccgccccacccacccttgccggtcttgttcagaacgatgtaccggaagcggggctggccgcgcctcttgaccacgtacagggtgccctccacatcggtcttaatctgcaggggttcaaggaaaggcagcccgcagtcagaatgcacgcagggactacaagaatgtagggagcacgagcggcccgatgttgcaaacatgccacccaactcacccatgcaggcccctctggattgaatcggtagagcacgacgtggctgacggtggctaggagctgccatgcaaagaggcatgaagggagggacagtggggcagctgcccagggtgcggagtgggagtggtgcctagcacccgatcgcaccgtacctcctcgatatcaggatcgatgcgcttcaataccccgatggctttctgatctgcggcctctctgttcagcactggcttcatcgcggccatcgcgcctcggaaagaagaccggggcgggctaagggaagcgctgcgtacctctgtgatgtgtcatacacacatgcaatgctgcgatgccagtgattgatgtctcgcaccgcctgggcctcgttgtgtatgctcatggacgttagagtgttgatcgtgcgcagcacacggggcatggagtccagcgcccgatgagaggaatcgaacggcagagctccagacggagatctgaaggcgcccttgatacgagcaatgcggtgttgatctttaggctaaaacttgaacagctgcggatcaagacccgctccgaattgatcccatctttgcacctgctagcccggcgtgtacccagtgtctctcgggaccatgcacgcgtcggacgcatgagcccagagccaatctagcatgcttaccgtcatcattaccctcctggtaagatcgaggcatcgatcgtcagggcactctgggatcaggagcgggtcttgaggtcgaccagtctcggcacctgtctctcctgatgaaggcacttggtctgctcaagctgacagggatccgaactgctgtaccctgtccaggccggtgcgctgcttctcgctgcgtggatcgcatcaaacgtgctgcaacaactcaacaaggagagtgcattcagcgggcccgccgcctcctttgagaaccccatcaacctcgacaaggtgggttcagctgtggggatgctccagcaggggtgcggcatgtggatcagagatgcatgcctgatccctgctcaagccttgcatcgtctgttcaaatactgtgtcccgtcatcttccctccccattgccctgttactggcccctgcaggtacccactccctcgctctttgatgaagccaccaaggccctgagcatcgtcattcccgcgtataatgaggagttccggctggggtcaacgctcgacgagaccttcaggtgtggcaggggcttgctgtgttgccagacagggtccccattcaccctcccccaattgccgggtgtgctggagggttctcggaatcagcctccgctcccaccaatcaacaaaaaccgctctccttgaacgcgccacgcagctacctgcagcggcgccgggatcaaagggggccctatttcacctacgaggtcattgtggtcgacgacggaagccaggatgccactgtggggtgagcaggcactgattttgtggcgtgccgtgtgtaccctttgccatttaaatgttgccttgacatggatgtcagggctcaccagcatgggtgctgactggcgtgaggccttggctgaagccctgggacctcgggacatcatcttccttggcgttgcggccggtctgggggcatgcgggcggtcggggcgtcctccccaagtcctcaacaagtagtatccactcgccgccaccagccacatgcacttgaatccctggcaggtgtgcggccaagttcacccgcaagcatggcgtggatgcgctgcgcacgctgcgcctcccccagaatcgcggcaagggctacgccgtccgggcaggagtgctggtcgcgagaggtgatcatatgggggctcccgggggcggggagaatgggatggcatgtcaatgcaggggggtcagtctgcgtgcagaatcgctgcctgagtggcacggaggtctcaaatcgattcactctacccaccgctcagggcaaaacatcctgctcatggatgctgatggggcgacacgcgtgtctgacctggagcgtctagaaagcgcggcacaggacgtcatgcagcaaggtgacctgggatggagtgtgggcttggggttgggtcagcctgagccacttgcggttttgttgcgggctgttctccgagccagcaggagggtcactgcagtactgtcacccttgccagggtgactgatttcgtgccattggttggattgtcctcaggcaggctcgataacaccttcacaacaacaggtaaggagagcctggagccgagcgggggcagtcctccccaccaggcgtttgtccttggctcaagggcctacctcgaggtgggtacggcgcacgggcatgctcaggctgtgcccagatgacagggattttcatcagaagcgccctgcattccaggcagcgccccctcctccatggcccctcggagaggatcctgcagtggtgtgcatcgcatcgccatgaagtgagccaccccatccccatccccggccatgccttcaggagtcgagtaaggccaagcgtacggcgctgcgcactttcctcatgcacggattccacttcctggtggctctggtggtgggaaggagcatccaggacacccagtgtggcttcaaggtacccattgcagcccgaatggtgactgtgattgcacatgtacaggacagcgggggtccttcaagaagtggttcatcacatgcctcgcggttgacctggagggctccccgccgtgccccagccctcttcccactccccttaatttcaaccaaccccgctgcagctgtttacccgggatgccgcaaggcgcatcttccccaaccagcggctgcagcgctggtgctttgacgtggagctggtccacctggcccagagtctcaacgcaagtggatgcacgattggactggcaggggccagagttttatgtgtggagatgtggaagggcaagcccccggaagctgcaccttggcagccaggggtctgtgccaggcatgtcttccactcactgtgccacctggcttgcaaggtgtgacgccgacggccccaaaacccccgcccccctctcccacgcagatacccatggccgaggtgcaggtgacatggacggagattccagggtcaaagctgcgagtcacatctgtcatctccatggccctggagctggtgctcgtcaaggtgggttgctagcaaaggtggcaatagctgggcaaggggaggtgggcgacgccgatgacacactggctgtgcgctatttcttattatttccaatgcctggggcgtccctagcaggtaacccctttgcacgcttcctcgtgcaggtcgggtatggcacgggagcatggcctctgcatggccacctggacctccagcgctagacccatggagggggtacgtgggaggcgggagggaggtcatgtcgccccttccccctccattgcgcatcataccgcccctccctgcaagctgcctgtgctgtggtttgggttgtcacaggcggtcactcacccacacactggcgtggccctgtgtctggctgctgcagtctgaccccgtgcaagcttttctgtgagcacgcatcgcagcgacagcggagcacggcacccaacttcttgcacacacgtgtggatacagtgtcctccccgcgcatcactgcctccagagcttcagcacccggtcctttccccccgaggccaccgaggcgccgtcgggtgaccagtccgcgcagtacacctcgtccgcgtgccccggcaggtccatggccagcttccgcgtccgcgcgtcccacaccttgagcgtgctgtccttggaccccgacaccaacagccggctgtcggcggaccaggccacctgatacacggcgcccacgtggccgcgcagcgtgccgatgaaggtgcccttggccccgtcccacagcttgactgacttgtcaaagctggcggaggcgatgacccggccgtcgggggagaacagcacctgcgtttgatgagttgtgggagagtaagggggggg

SEQ ID NO: 21884 - DNA, 61 bp, Chlorella protothecoides
agcagaagtgtcctatggcttgtgcattgggctccctagactgtcgaatgtatcttcatct

SEQ ID NO: 21885 - DNA, 61 bp, Chlorella protothecoides
caaggaacctggaaaaggttctatatctaccccagcaccagaggacccgacacgaacgcgc

SEQ ID NO: 21886 - DNA, 61 bp, Chlorella protothecoides
ccctcgagctccagggcgccgacttcctccaccccgcccccccgatcaaacagtgcgacac

SEQ ID NO: 21887 - DNA, 61 bp, Chlorella protothecoides
tcgccagcgcgaagaagagcgagcgcaacaaccgcatgtgcaccttcatgttttattgttt

SEQ ID NO: 21888 - DNA, 2819 bp, Chlorella protothecoides
ccccccccccccccccctccccctcccccccgaggaatacatgtctgaaaatacctcccccagatcctgacctgcaacatgccaccagccgcatccttttcccctttgccaaggaatcccaccagtttttttggcacgtggtgccgtcactacttgcacccaccatgtctcgcttgcctcctgcctgccagggaacaaccccagcacccttggggacacgatcctctggtccctttgcctggtgattcaaatgtacacaccccgcacccacgatcatcaatggctgagcatcaaacagcgcggcaaacaagcaaggtctcttgtcatcagtcgtggtggtgggaccccgacccgggcttgacgctggggaggtgggtgggggtgtcgatgatgtgcaggcaggtcaggcccacagcaacagccatcccaatcacgatcaggacgatgaagccctcaaagtacagcgtctgcagcaatggcaggaagaaaggggggggagggtgtggaaaggaggtatggtgtgatgcggagggctatgccgccggcgaccccttggtgtattgcgcggcctgctgtccctgtgccttaatgactcatcatcacaccacactgaattccaccagaccccagcactcgcctgtcgctggcaggtggcgtcgcacactgtatagttcttggtgccctcccgtcgcgcgtacttgtcaaagccgaggctgggagcggagacgtactgggcctgcaggcggcgccgctgggagaaagggtggcatgggaggatggtcagggcaacgcatgggcgatgggtgggtgtgcaacctatgccgccaacgtggcactggatcgccttcccaccagggctggccgagtcccagcacacagcctcgtacgaggttcccaaacaggaatcagtctggctttcagagaaaccattgaccaactgacagggactgaatcatcgcaaccccctgtgcaacaccactcaacccacacccacctcacctcacccccctttctacaccatttcccgtcacctgggcagccacctcgccggcggggagctcgaccaccagcatgaggggctggctctcggcagacagccggaccacctcgttcagcaaggcgggctgctcggcttcctccccggcacagaccaccacgacgtcgcccgagggcggcgcggccagcaggcgctggagctcggcggtggtggctggggcgccgggggctagaccctgacacgaccccactacatgcgcgcggcgctggccggccaggatctgcagagcgtcgaagatcacgccctcgccaccctgcgacgtggtcgaggggagttgaattaagtgcgagatggtgcagaccagggtgagggaactggaagaatggagccatggctccttgccctgcctggctgtgcgggatggcgaggccaggacagagaccgagatggcaggatgcaagacatcacacatgtgtcccctcccccgccccgcccccatctatcctggcactcacggcatgggaagcgctggggagctgcttccagccctctgcactatcgaggcggggctgcagggtggcctccaggccggagtcacggctgtgactgacatacaggatgatgggggtgtccttgcccaggggcccgtcgctgcgtccggtgctcagcaaggcctgcagcgcctccagcgtcgtcacagcctgcggttagggatgcatgtttattctaagaagtcatgggctcgacatgcagccggttcgtggtcatgcagcggcccttgagcgactcgcacctcctggtccacccccacgctggcgaaggcagccttgggtccccacgctgagataggggtgggcaccgcgcccattgccgcgactgccaggaggaccactcctagtacaccgagcgcggccgccctgcctgtgctcccgttgcgcatcgcgcccggtttggacctcacagggtttgccagggggcagtggatcgtggggcccgactcctggctctgatgcgtcgagaactttgaaagggatagatcaaagggttgaactcgttgagtgcgaatcaacgggtgatcgctcccctaagggccagggtcccaggggcgcgattctaaaggttcggcatcgcgccccggcttggcaatgtgtgcgtgcccctagctccactgggccacatgcctgccaccccctcaacccctcatcttcatccttgaattcccgcaggttgcccccaccccgactcttttcctgcaggcaggatggtcacggataacaacagggtggtgttgagcgtcaggcccgtgggcgcaggcctccgccggcagtgccatgcgtgcactccgaccaaccgagcccgtctggcagagcccaattccaaggtcacgaggcgcggtggcgtatgtccttcatggtgctcttcacgcgcgcgtacagccgcgtctccaggcgcgtgagcttgctggcaaaggacatggacttctcctgggacttcaccagctggcggcgcagcttgaccagcgcctcctggccctcggcccacaccagcttggtctgcaccaggtcccccgccaggcggtcgtgctcctcgcggaacagcgcgttgacgtccgcgcggttgcgcgccgccagcaggtctcgctccagcgcctccagccgcccgcgcagctcgccctcattgccggtgcgcagcgcggtgacctgcgcccgcagctccgacaggcgggcggccagctcgccgcgctccgcctgcgcctcggccagccccgtcaccgccgaggccagctccgcggtggagaaggcggccagctcgcgggcggccg

SEQ ID NO: 21889 - DNA, 92 bp, Chlorella protothecoides
ttcattggctgtctaagccttttggagatggcaaaggtgttcgtatggagtttctcatccaaataatctgcagctctgggttttcaatctgt

SEQ ID NO: 21890 - DNA, 79 bp, Chlorella protothecoides
atggtggcgtcgagacgccgtgccttttcctttgcatggagtatccccatcaacatgtagactcccacacgcccagtca

SEQ ID NO: 21891 - DNA, 74 bp, Chlorella protothecoides
acagatgaccgaatgtacgctttcagtcttaggacgccatgccttcgtaacgcttacatgccgggttgttctcc

SEQ ID NO: 21892 - DNA, 61 bp, Chlorella protothecoides
gcaacgacggcaacgagaacatgggaaacaagaacgtcggcgacttcaacaggggtgagtg

SEQ ID NO: 21893 - DNA, 119 bp, Chlorella protothecoides
atactgcagataggaactcactgacagaaggcttcgccaccctctggattcagcaggtagagcgaattcatgtacctggaaggggccatgggaggatagactgtgcccatgggtttctg

SEQ ID NO: 21894 - DNA, 2573 bp, Chlorella protothecoides
  modified_base (495)..(504): a, c, t, g, unknown or other
  modified_base (769)..(778): a, c, t, g, unknown or other
  modified_base (986)..(995): a, c, t, g, unknown or other
  modified_base (1126)..(1135): a, c, t, g, unknown or other
  modified_base (1190)..(1199): a, c, t, g, unknown or other
  modified_base (1388)..(1397): a, c, t, g, unknown or other
  modified_base (1905)..(1914): a, c, t, g, unknown or other
ccaaaccagaaggcatgagcttgcactatgccatgtgctcaagcccttgttactgtaatgcagcgaccccgaatggaagctgcgacgcaaaatcgggaggcaagaatggagtccagccgggctgacgagctgggacctgaaggtgttttctccccactccacaatctagctcctgcccttccctctatagtgaggaacctccccctcaattgaagacgccgccactcgtgttgtgcaaggtgtcatgccgctccaggaatagtagagcttcccctttcgtctgagacttctttcccttcagaatcttgccaaaacacacagatgaaagatcgctccaccaaccgtctagcaaccttcctgcctcagaggaagggcatgttcacctctgctgcacctccctcgcgtacttcacctggaagcttgtaagtcacaagaggcacgtcaggtgggttagggtcgcctggccgaagcctcgagtccggcgagtgtggcggnnnnnnnnnntatgtgttcaagcccttgttactgtaatgcagcgatcccgaatggaagctgcgacgcaaaagcgggaggcaagaatggagtccagccgggccgacgagctgggacctgaaggtgttttcttcccactccacaatctacctcctgcccttccttttagtgaggaacctccccctcaattgaagatgccgtcactcgtgttgtgcaaggtgtcgtgccgctccaggaatagtagaacttcccctttcgtctgagacttctttccctnnnnnnnnnnatgaatgatcggtatataaagagtatgcagcgcggctggattatcttgacagacgtcggtgtccggcggttttccggcccgccctccttccccgagacccgtgcctgcgtccgccgaggctgtctgcgatagccaggaagctccgttctgcccttcagacaccaattctgaggacaagccgtagcgcagtgtgtcgagccgccacttnnnnnnnnnnccacaagaggcacgtcgggtgagtactgctcgcctggccggagcctcgagtccggcgagtgtggcggtgacgagcgggcaaccagcacgctctcgcgtcgcctcactgcaagcacatatcgctgacatggnnnnnnnnnnactagccattctctttgtcgttacctcatgtccccgtccgcacaaccctggagcnnnnnnnnnngctagttattctctttgtcattaactcatgtccccgtccgcacaaccctggagcagctggttgacgctactgactgtcttcggaactatttacgtcgtgaccgtgagtcatttcattgataactcaaagagaagcgtgatttttctgcaggtttgggcccctagcgcactctgatcccgggttttccannnnnnnnnntattttattggtaactcaaagagaagcgtgctttttctgcaggtctgggtccctagcgcactctgatcccgggttttccatccgcgcacaggcggactgcgacccgagaataggattcttcagtcttcccaccatcttgtaagtcgatacccttgccgatgtaagaacgtcagaacagggtcccatcacgatactatttgcattctgttccagcatcgccacgcgctcactcgactgcaagcaacccattctgtacaggtatgatggagagttgtacctcgcacacggtggaaacccggaggcttactgcaggtgggcctaagagtgggaagtttggctattgcgcacgggtgaggctggcccggcagagcgccgtccacaggagatggggcagttctgagagagcgctcaccgcgacaacgcaggctcaagggcttctctacgagtgcactcgccgatattcgtctgttaagcaacggagatccattctcagatgcagccattaagnnnnnnnnnnactctacgagtgcactggccgacattcgtctgttgagcaagggagatccattctcagatgcagccattaagaccatcaacccggatggttgggccgtgtgtgacccttccacgcattccatgaagaaacattgcccctacctgggcattgtcgagtgtctgccggaaggagtgtcaaagtgtgagagctgggacaccacaatcgaggacacgattggcacaggcaacgaaggaagtgctaactggggtaacaacaacttcggcgaccagaatcatggtgaggattgtatgggcgtgtgacagactcgtttaaatagcattggatatcaacgactcatgtcccactgctgcaggcagcggcaatcgcggcgaccgtaatgttggcgacaacaacgttggcgatggcattgtttgtaataacaagcgtgacacctccccatgcctactgtcagacctcctcacctcggagaccgtggttgtccatccaaggccatccccgccgccagtggtccctccgcctccccagccacagcctccctcaccaccccccggggaaggtggctgtgaccccagcatcgccttctttggactgcccactgtggagtaagtccgggagggtgcgccactgccaccctcctgcgctcccccatgggcacctgc

SEQ ID NO: 21895 - DNA, 610 bp, Chlorella protothecoides
ggcgccgacgccccggccgacggcgacctgctgagcgcgctgcggtccctgcagctgcagctggagcgggcgcagccggggcccgcgctcgcggaccccggctcgtgcggcgggcgggagcgagaccggcgctggaccggcgcccatgccggagccatggattcccgctcgtcctgctcgacttcctcggggtctggcgcctctgccgccggcgacgacgccgactcgcacgcctcgagcgacggcccgggccagggcgcctggctgcccgccgctgcggcgcgcgtggacctcggccctgcccgcgaggaacccggggagggctccacgtcgcccccatcctcggacgccgacagcatggagtccggagaaagtccctcgcccgtggccgggcccaggcccgaggcctcgcccgagcagacggcggcgacagaggggagcagctcgcccgggctccccgccacgctgggcatgctgtcggcggagctgggcgcctggcgagcgcaggcgtcccccgacccggcgcgcggggcggcgctgttcgcgcggcgcgcgcgcctcctcaaggctgcgggccagggcgcggcggcgctggccgacctgcactgct

SEQ ID NO: 21896 - DNA, 66 bp, Chlorella protothecoides
aatcgtgctgggtgtgggaaatgtttgcaaatgaagacaatcgcttggctggtcacagaagcatgg

SEQ ID NO: 21897 - DNA, 61 bp, Chlorella protothecoides
gacgatatgcatctgaagagcattccctgacggcatgcttcaggcttcaccaaacaagtgt

SEQ ID NO: 21898 - DNA, 424 bp, Chlorella protothecoides
ggtgagggagagtcctcagggctgggagatggggattctaagggactggagctcggtgcattttgaggaccagggttgggtgactctccagtactgggactggacgtatttgtactcggtgcaggggcttcttgacggcaatcaagaccttgactgtctgatgttgggttgcctatgctgcacgcgattcgagaatcagcgtcagatccagagttagtttggaaggaacctggctgtgatgcggtggcgcttccaaaggcctgcgaagggagacacgttgggaaggtcgagggattctgaggactggtcatatggatctgattaggtcatgttcgcaaagactggtaccatctttctgactgggtaacagccactcacgtttgccccgtcggggtcgagagaggcaccaccattgacggatgct

SEQ ID NO: 21899 - DNA, 61 bp, Chlorella protothecoides
cgcggtcatctacctgcagcaggaggggcgtggcatcggcctggccaacaagatcgcggcc

SEQ ID NO: 21900 - DNA, 72 bp, Chlorella protothecoides
tacctctgcaatgcagctgctccccgacccacacctcaagctgctcgataccactgagagcatgccccagat

SEQ ID NO: 21901 - DNA, 150 bp, Chlorella protothecoides
cgcagcgacccagttcctgcttgaaactgctcactgtacacctgtgctcggagatctcatcacttccaatgggtacaaaggatcatgctcactcctgatactcctgaagtcaaaattgtggtgagtgctgcaaggaaggatgcaacactg

SEQ ID NO: 21902 - DNA, 70 bp, Chlorella protothecoides
tgtacgagtggacctctgcgcgccatattgtacgttcttaaagatccctcagactgtggtcccttctggc

SEQ ID NO: 21903 - DNA, 68 bp, Chlorella protothecoides
gatctcatcaagaccaaccgttcctgcaccgtacccccctcccctattccgcacctggagcaccgtgc

SEQ ID NO: 21904 - DNA, 71 bp, Chlorella protothecoides
ccgccacatgcaggggccaggcgcccccacgatcatcaagccaaatcacccacatgcacacatcatgaatg

SEQ ID NO: 21905 - DNA, 207 bp, Chlorella protothecoides
cccggcacccagtccttgccagggctcacgggagccgggcggtgcatcatgcagagcattcggggacggtagacatgatggccacagcgcctgcagtgtatacgcaggatcagggggggcgcgcacatgatgggtgcaggatctgtgcgtcccgccatcagcctctctgtctccgaagtgtggtgccttgcaggacgccctgctcca

SEQ ID NO: 21906 - DNA, 61 bp, Chlorella protothecoides
acccagctcacaccacccaaacatctgcacaaataccaatgagcacttcctgcgccagctc

SEQ ID NO: 21907 - DNA, 61 bp, Chlorella protothecoides
atcttatcgtaggttggaaggattggctgggaagacccgccccagatttcagaacgcgcaa

SEQ ID NO: 21908 - DNA, 977 bp, Chlorella protothecoides
gtggccctggcgggaggtactgcgcacacctcctgccccatgggagcaccaccgtctgctgagcccacttccctcgactgccaaaccctagactgagatcggatcactcaattttgcgccgcagcggcgagagtgcgctgtctgctccagaatcgctctatttccatgtgcactccccaggtcgtatgtaacatgcgcgttgcatcccgctttttaattgagcccctttcgtcgctgaatcagcgaaagcaccgcgaaacaatgcctgtcccgtccatgcatctcaacagcctcatgcaaggtttgcacaagcaagaccattctgatctgggaacttgtaggtgttgtatgggggaggttgtgctcttgaatcaagtggtatcacgtttccggaacaccccgaaacgtgcatgggcttattgcgatgagagcatttcccaccgcgattgtctcacgcgcatttcggagaaggtttgcagaacactccaggacatgaaatgccttgtcacgtatgaaccatctcccacggccttgaaaagatcgctcgacttccattctagatggtgcaaaaccctacgactcaagaaggtgccaccgactcaggcattgggcacggcgggcagggagaagagaggagttgatcaaaactgctcgatcacgttcccccatggcgatccgagcagcacatgatgcatcgaggtggcgccgttgcaaaggagttgcgcatgggtcgaagcagggagaaggaaacggcgaggcgtgccgcgggggtgaattcagagtcaaatctgcgcctgccccggcgctcctgacggggattaacccccacgactgtatccatcgacactcgtctcgggggaataaaagcggcgacccagctccagaggcgcaatccttctcacaatctgtttaactttcaacaaagtataagtcaattcaacttgacacaatggcaggaggtggcatggccagcgttg

SEQ ID NO: 21909 - DNA, 112 bp, Chlorella protothecoides
tggtaactgctgacagtggccagctatgggaagatccagatactgaaagtgtcttcttgacttcagccacttgattgcctggatatgaagtatctaggtgtttactgctccg

SEQ ID NO: 21910 - DNA, 63 bp, Chlorella protothecoides
tctaggtaagcttgattgagcagggtcaagaagattcatgtagctccaagatgtgtgtctcca

SEQ ID NO: 21911 - DNA, 75 bp, Chlorella protothecoides
tccccagttggcagtgcccacgttggagttacctgcagaggtagcaccatatccctgtttactctgtttcaccca

SEQ ID NO: 21912 - DNA, 63 bp, Chlorella protothecoides
ggtccaccaaaagctgtgggacgaggtgcactctcaaaaaagcacttggtcagcatcaggatg

SEQ ID NO: 21913 - DNA, 64 bp, Chlorella protothecoides
aggccaggccccgtcgcaaggtggggacgaaccacacgacccgcgacaggagcacctctgtgct

SEQ ID NO: 21914 - DNA, 61 bp, Chlorella protothecoides
gcggcactgggtcgtatctgcaggcattgcacagccacagtctgaggggctagcatgtgtg

SEQ ID NO: 21915 - DNA, 66 bp, Chlorella protothecoides
agggtagaggcctgtgatccctgtgcctgcctttgggcccagccccctcagtacctttcgatgcca

SEQ ID NO: 21916 - DNA, 80 bp, Chlorella protothecoides
cacaatgtgaatttaatggacgtcctcgtttcattaagagtcgtgcgcggccttgtgagttgtgttgactgtcgcaagcc

SEQ ID NO: 21917 - DNA, 74 bp, Chlorella protothecoides
gtatgtattatatatatattgaatacattttgtgtgcaagcagtctgcgctcgaggctgaagggtgtacctagg

SEQ ID NO: 21918 - DNA, 71 bp, Chlorella protothecoides
catcggctgtgtccaaaggcatgagatcatggacactgggacccagtcactttgtttcagactggatttcg

SEQ ID NO: 21919 - DNA, 61 bp, Chlorella protothecoides
ccgtcaagatgcccgagtccccgcatcatcaccccttccacgccttgccccgtaccagctt

SEQ ID NO: 21920 - DNA, 61 bp, Chlorella protothecoides
ccagacctgccgcacctggtagcccttgcctagcaggctgccggcaatcgaggcaggggag

SEQ ID NO: 21921 - DNA, 111 bp, Chlorella protothecoides
aagagacatgggaggaggccctctgtcccgccgaccacaaacatacaggcaaagcagcactgtcgagcgtcgaccctcgttcccttcaaattctcacgtggatgccggcgg

SEQ ID NO: 21922 - DNA, 61 bp, Chlorella protothecoides
catgtacactcctgtaacaatcccgagcgtggaccttggccctgcatacgggtcccagcac

SEQ ID NO: 21923 - DNA, 65 bp, Chlorella protothecoides
gctatcaccatcagccaccccccctgtgctgtggtatggaggtctagccgcagactgtcctcgca

SEQ ID NO: 21924 - DNA, 451 bp, Chlorella protothecoides
ggtccatgcttcatccagaagggccacaagtactcgaggactttatctctctgcgagtccaatagccgtggcgtgtgtgcaagcggtgaagacatgctgtgtggtagatatttcggctggcacctcaacctcgactgggacctttgcaaggagaggcgcgtatcccagacgcgtcaatgcccgacgggacccgtgtcccgtgccatgcagccaccagtcaccttcacaatggcgttctggtcggtaactctcttcagtgcagagtcctgtaacaaggaggccgcattgaggcgaggctgtaaagagatatattgtaggagcttgctcgtaaacggagttttgtgtgtgtggtggtggtggtggtggtgggtgacttaccagtctgtcagtgagtcttggaatgtcggcatatcgtatggtgaagatcctgttcaggtctgccagtgcggcg

SEQ ID NO: 21925 - DNA, 139 bp, Chlorella protothecoides
tcgcgatgcggacggtgcggtgcctcgactatcatgctgcaggaagtcctgcgggtacgaccaaggtgccgtcgtatcccctcctacacactgccccgcacctgccaacgccgcctcgtgccgctgctggcagaggatg

SEQ ID NO: 21926 - DNA, 129 bp, Chlorella protothecoides
gcatgacgcctgttgagaccccgggccagccacccaaacgcatgctgtcagacacttgcggggacagccctgggatcagcacatcgacagtgcagaagacaccgagggcaagccttgaaaaatactctt

SEQ ID NO: 21927 - DNA, 415 bp, Chlorella protothecoides
gggagaatttctcacccttgcaggaggaaaatacaatgtactccccagtactagatcctggagctgctgggagtgcgcatttggctctgcaagaacaggatgcaacccaccctgttgtccactccactctccatcctacaggagaagaagagacggggctggcccatgctgttgctggcgtggtcctccttgggcgtcatctatggaggcaagtgtggacagccttctttcccgggttggagagcatgtgtggcagacaggaatgggagttggagcatgtgcgcttccatcgggaaactcgcctctccaaaccgctcatcaaatgaatgtcctacaaccccatcgcatccttctccaccatgcagacattggtacatcgcccctatgtaagtcactgcagtcatgctgagaggga

SEQ ID NO: 21928 - DNA, 61 bp, Chlorella protothecoides
cagccattgtggggcctccttaaccgtgccgcctccctgcagatccagaaggccttgaagc

SEQ ID NO: 21929 - DNA, 66 bp, Chlorella protothecoides
ggtgtcacaggtatgatgccctgctgggagattttattgtttgcgtcttctggggtgcagattgcg

SEQ ID NO: 21930 - DNA, 79 bp, Chlorella protothecoides
tgggcaccatgcagtggtccagtccgtttcatgccttgggaaagcctcgcaccccgcccagccacaggcgtcagcatca

SEQ ID NO: 21931 - DNA, 109 bp, Chlorella protothecoides
ggagcaggagggtcacagtcgggctgtgtacgccatcgccttccaggtgcgcatcatgtaaggtggctgatctggctgcgatctcagacaatgcacctcagtcattccc

SEQ ID NO: 21932 - DNA, 203 bp, Chlorella protothecoides
gtgagggggttcgccatggtatggacgccaggccagacgtgggcagcgacggtggcggtgggtccgacactttctcgagaagcgctgccgagcaggagatcgcgcaccgccgcggtctgaggcaagtaatgttcgaacagctatgctgacacgtagtgatgatgatggtacgactccccgacatcgcaagagacccacactgc

SEQ ID NO: 21933 - DNA, 75 bp, Chlorella protothecoides
agcaagaggaaggcccgccagccaattcccgtccccagtccatgaccacttgccgtagatgcgcccggacttgag

SEQ ID NO: 21934 - DNA, 123 bp, Chlorella protothecoides
cacctggtgctgcgcttgcgcggcggcatgcagatcttcgtcaagacgctgacgggcaagaccattacgctcgaagtggagtcctccgacaccattgacaacgtgaaggccaagatccaggac

SEQ ID NO: 21935 - DNA, 61 bp, Chlorella protothecoides
cacctcggcggtgttcacctccaccaggaacgtccccgccgcggtggaggagatgccgatg

SEQ ID NO: 21936 - DNA, 61 bp, Chlorella protothecoides
acgtcgtggatgggcgacaggtgaggggggtgcagattttgggggactggggaggagtgtg

SEQ ID NO: 21937 - DNA, 268 bp, Chlorella protothecoides
gacagcccttagccatgatcaagacggctgtagctgctcagaatggtcctcatgggcacagactaaatactacaatgcaaattcatcacactgcttgatttgactccgttggttgtgtcagacaagatgcaatccctaacttgatatcagacttacggcaagagaatggcgtgatgcatgaccccctgtcttgccggattttaacatcacagatcaggatccattgcaatctgagcagcattctgcttgttgtttcagttaatgattt

SEQ ID NO: 21938 - DNA, 173 bp, Chlorella protothecoides
ggattgagatgaatgggtcggagcacattgagggggggttacgtggctaatcttgcacagtgtaagcagcccacagagcagcacacccacacctctggtcacttcaagtatgcacaaacaattttatggccatcttccccaaatgcacttgccacgcaggtcttcacaggatt

SEQ ID NO: 21939 - DNA, 252 bp, Chlorella protothecoides
aagaattatgttggagctgagtgtgacctacaagctgcctcttggtgcccttgctgcaacggtggccggcctagtgctgcagcaccgggatactgtcacgcattctggttgcggcttttccactgatgcacaagctggattgcatcggagctgtacaatctacatcaagatgccgcccagtctctattttgggtatgccaccactttacagagcatgaatctggagaacaggcatcccacacgtatgagctc

SEQ ID NO: 21940 - DNA, 10019 bp, Chlorella protothecoides
  modified_base (1388)..(1397): a, c, t, g, unknown or other
  modified_base (2417)..(2426): a, c, t, g, unknown or other
  modified_base (2853)..(2862): a, c, t, g, unknown or other
  modified_base (3743)..(3752): a, c, t, g, unknown or other
  modified_base (4624)..(4633): a, c, t, g, unknown or other
  modified_base (4700)..(4823): a, c, t, g, unknown or other
  modified_base (4887)..(4896): a, c, t, g, unknown or other
  modified_base (4954)..(4963): a, c, t, g, unknown or other
  modified_base (5449)..(5458): a, c, t, g, unknown or other
  modified_base (5781)..(5790): a, c, t, g, unknown or other
  modified_base (6983)..(6992): a, c, t, g, unknown or other
  modified_base (7097)..(7106): a, c, t, g, unknown or other
  modified_base (7393)..(7402): a, c, t, g, unknown or other
  modified_base (7838)..(7847): a, c, t, g, unknown or other
  modified_base (8190)..(8199): a, c, t, g, unknown or other
  modified_base (8322)..(8331): a, c, t, g, unknown or other
  modified_base (8400)..(8409): a, c, t, g, unknown or other
  modified_base (8646)..(8655): a, c, t, g, unknown or other
  modified_base (9373)..(9382): a, c, t, g, unknown or other
  modified_base (9840)..(9849): a, c, t, g, unknown or other
ttcccccgccccgccggccccggcggcgccgagtccctggccccgcccccgccctacgcgtccaccaacccgccgcccggcgcgctgcgcttctccaccgccgccgtgcccgcctcgcagtccctgcgcgcgcgctggcacctgcccttcggcgcggtgctggcgccgctgagtgaggcgggcggccccgtgccggtggtggatatgggcggcgcgggcatcatccgctgctcgcgctgccgcacctacgtcaacccgcacatggcctggctggacggcggccgctccttctcctgcaacgtgtgcggcacggtgaaccagacccccgtggagtacttctccgcgctggacggcgcggggcggcgcctggacctggccgaccgccccgagctgcgcgccggcgcggtggagtacgtggcgccccaggagtacatggtgcgcgcgccgcagcccccggcctacgtcttcgtgctggacgtctccttcgccgcggtgtccagcggcctgctggccagcgtctgcgccaccatccgcgcctcgctggacgccttccacggcgactcgcgcacacaggtggccttcatcacctttgacgccacggtgcactactacgcgctgcgccccggcgcggccgcagcgcccatgctcgtcgtggccgacgtggaggagctgttcgtccccctgccggacgagctgctgggcaacctggtggagtgccgcggggcggtggaggcgctgctggactcgctccccgccgcctgggcgggggccacgggcgtggacagcgccaccggccccgcgctgcaggccgccttcctggtcatgagccacgtggggggcaagctgatgctgttccaggccgcggcgcccagcgtcggcatcggccgcgtcaaggcgcgcgacaacccttccctgtacggcggcgaccgcgagtactccctccgcgtccccgacgaccccttctacaagcgctttgccgccgaatgttcgcgctgccacgtctgcgtggatgtgtttgccgcgggggccacctacatggacttgccctccctgggcgccatgcccaagtatctgggcgggcagctctactactacccgggcttctcggcggcgcgggacggcgccaagctgcgcgccgagctggcgcgcaacctgtcgcgcgagaccggtgagtggctggtgggggtgggttggttggagggggagttgggggggcgtggcagtcgcaggcccggcggcggtagtaagggatgggagggtgggtggggagcaggggccaacgaggcctcaccctcctcccagtcctcctcatgtacgcctgggacccctcgacacccccaaaccccgacaccctcaaaacgcctcgcaggctgggaggcggtgatgcnnnnnnnnnntggcaagggatgggagggtggatggggagcaggggcaaaccaggcctcaccctcctcccagtcctcctcgtgtgcgcctgggaccccctcgacaccccgacaccctcacaacgcctcgcaggctgggaggcggtgatgcgcatccggtgcagcaagggcctgcgcgtcagctccttcttcggccacttcttcatccgcaccaccgacctgctgtcgctgccggtggtggacgcggacaaggccttcagcgtggagatcgcgcacgaggagagcgtgctgacggggcagacggcgtacgtgcagtcggcgctgctgtacaccgcgtccaacggcgagcgccgcatccgcgtgcacaccgccgcgctgcccgtcgtgggcgacctggccgacctgtaccgcgcgctggacgccggcgcggcggccgccctgctggcgaaggcaggcgtggagcgcagcctggcctcgcgcctggaggacgtgcgcctgggcctgcaccacaaggcactgatggcgctgcgggagtggcgcctgctggtgtcgcgcggggccacgctgggcgcccagcccccgcccaacgccatgctgctgccgcggcgcggccgcgcgctccccgccctctgcatgggcctggccaagaccgccgcgctgcgcggcggcggccgcgacgtcaacaccgacgagcgcatcgcggtgggccacgccatcgtgtccgggcccgtggacgcgctcctgcgcctgctctaccccgccgtctacgcggtggcgggggcggaggcggcgtgggggcggccgggacccgatggctccatcgcccttcccccgaccgtgcccgcgggcgtggcctactgcgaccccgccggcgcctacctcatcgacaacggccgcctgtgcatcctctggctcggcgccgccctggggccggccttctatgaacaggtgcatgggcggtggtggttgtagcgggtggtgggggattgatgatgtgcggttcacggctgagtgcgtgagggggggcccgcnnnnnnnnnncgaacaggtgcatgggtggcggtggttgtagcgggtggtgggggatcgatgatgtgcgggtcacggctgagtgcgtgagggggggcccgcccgccgccgacgcggccgacgccgacgccggcttcctcagcaccccatcctctccatgcacccaaggtgtttggcagcgcggccgatgccggccaggacccgggccagctgagcctggagccggcgcgccccggctcggagctgtcggcgcgcatcaacgccgtgctgggcgcgctgcgcggccagcgcgagctgtaccaggcaagagggatccggggggatgaaggaggggtgttcttgtgttccggctcgcgctgtaactcagggcaccgtccccttgcctcatggtcctcatgcattcacaaagacaccccccccaaaaaaagtgccccccccnnnnnnnnnnttgtcactcagggcaccgctcccttacctcatggacctcatacatccacaaagaccccccccaaaagacaccccccccccccttcacccatccttgcgtgcagggctgctacgtggtgcggcagggcacgcctatggaggcccacgtggcgccctacttcgtggaggacgcgctgccctcctcggccagccccggcttcttcgagttcatgcaggtgctgcagaaggacatcctgggaaagtagccgctgcgccagtgaacctgtagcatgtcctgcctgccggcacagcgtgaaatgctgctccaggcttgagtgaaacccaggcagacaggaaacagggactggagggatgatagtcgagctgtgggaagcatggcatgggcgggtggtggcgagcctgtccggcgctcgcgttacgtggcaccgggcagccgcatgtccggagagttactaccatggcgcggcgctgaattccgatggatcagcccgcaaagttgggaaatgctcaccggacttgggacaggaggtgccttcatgcgcacccctggatcaggcctctcatttctggacaaggatgcatgaagcactgtacggaacacggatgggtcctcggaaagcctctctgaggacatagtgctgtagaaccacggtcatgaaatgtaaactcgcacttcaattatgcttcttgtgtgtcgccggtgaagttgtggctgtgaaggtacgccaacatttagccaaggaggcaggagtattatacggccgcagctgtacatggagaccttgctgggaatatgcacgatatatttggccatgcaaccttgcaacctccctcttccaatctcaacaggcaaagcttggtgtacaatccctcaacgttgtnnnnnnnnnngtggcaccgggcagccgcatcgccggagagttattaccatggcgcggcgctgagttctgatggatcagcccgcaaggtcgggaaatgctcaccggactcgggacaggaggtgctttcatgcgcacccctggatcaggcctcccatgtctggagaaggatgcatgaagcactgcacagaacacggatgggtcctgggaaagactctctgagtacataatgctgtaaaactacggtcatgaagtataaactcgcacttcaatcatgcttcttgtgtgtcgccggtgaagttgtggctgtaaaggtacgccaacatttagccagggaggcaggagtatttacggccgcagctgtacatggacacccttctgggaatctgcacgatacatttggccatgcaaccttgcaacctccctcctccgatctcaacaggtaaagcttggtgtacaatccctcaacgttgtcaaccgggacgtgaatgcagcggtgaacatcctgatgctgaccaagtgctttttgagaatgcaccacatccaacagcttttggtggcccctgcttcaccttccctccaacacccccccccaccccgggtcgccatttgatgcaacaaagtgcgccagcgacatcccgttgcgggaatgagctgctagcaacaggcgcaagcccggtaggggaacaaggatgttccgtgctttcccttttgctggacccccaccgcgatggatcgttgattgcgacgaaagtgcagagattatactgggttctagggcgcaacgcatgtcgattagcactgatatttatgacatagtagagggtcgtgtttgtggggccaacacgccctctagatcgatctctagagccccagcgccccccnnnnnnnnnnaacaaagtgcgccagcgatattccgttgcgggaataagctgctagcaacaggcgcaagcccggtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggtcgtgtttgtggggctggcacgccctccagatcgatctctagagccccagcgccccccnnnnnnnnnngttacaattttgagttcgttatcgtctgccgaagaactggtgggtttcgtgcagaggnnnnnnnnnncgttgagatacggttaaaccccacccaccatcgcatcgcaacaaacctcgagatgcctacagggcacctcaaggcctttgtattgctaatacttatgtttttgagctcatcatcgtcggccgaagaactggtgggtttcgtgcagaggctctggcatcctcccatctcgccagcagcgtttaacccaggatttccccattcgcagaataactcgagagaatcagttgctgctggatatctagcctctctgtcgaaaccgaacagttattacctacgacatattgctccaaatgtctcatccgacagctctacaagtcttcgtcatgacctcatatctggtcgcctcgcgtcagcagagtcctcagccgagagggcccagaccccgacaggcgtgtggggacatttgagaacctccagacagtaccaagaagaattcggacacctttatctcgcataatgtgctgttctggacattgggctttggannnnnnnnnnatgtggggacatttgagaacctccaaacagtatcaagaggaattcggacacctttgtctcgcagaatgtgctgttctggacattgggctttggatgagcagtatgtgccatgctcccaagctatgtgggtcaaagcaggcaaaacactgggcagcaaccacattttatactctgcccaacttgtgccttgatccagctatccgacttgtgtaatgccagtgcaagacctggtcctcctacttgcagatggattggggttctcagctactgtgcctccaacctctggccctcaagactccagcccaccacctccaacgtccccnnnnnnnnnnaggttctcagctattgtgcctccaatctctggccctccagactccagcccaccacctccaacgtcccctcccacacccccaccgccaccccccccacctcccgcgccccctgcgcttctttcctatggagaggtaatggagtttggatgccctgaaggacccacatgcattgccctgtcgctgtatttgctccctggccagtcactgaccactatccccagtgccaacccaggcactggcttctacctggctcttctacgaggcccagatcagcggtaccaagccctcttggagcagggcagagttcagaggggactcccacctggacgacctggtcccagggggatggtgcgtctgcaggcagcgagcacaggaaggggtctgggagctgtcatggcatcgcagcgccgccagtacacgactggtcggcatgctcattcatgctgctgtcgccatcgccccctggcgtcatgatcagtatctaatgcagggattcatgagttcctgccgtgctgggctgggcgtccgagacagcttgcacccggctcccaccccccctcctccctcccgcttggcgcaggtatgacgcgggggactttctgaaggtcaacctgcccatgggcatcagcgtgtccttcctggcctggagcgtgctggaatttcccacggcctttcagctcacggcctccacgaatccggccctggacaacctccggctggccgccacctacctcatggactgccacgtcggggagcggcagtatgtaggccaggtcggcgaccccgccgccgaccaccagttctggggccggcccgaggagcagaacgtcagccgcccggcctatgtctggctggactccatgcctgccagcgacctgctgggcgccgtctctgcagccctggcctccagccacctcctcttcaaggggagcgacgccgagtttgccgctgcgctgctgagccacgcgcgggagctgtacgcctgggccaaggccgacactggtgtgctgggaggcggggtgcggtgaggggcctccctccgcgcatgccctccctgccccagccagccagccagccacgccgcccaccctcgcatctccccatgtgcatcgcgatgcaggcctgtgcggggcgtcgttccccgccgccaccaaggtctacgcctcctcgcgctacctggacaagctcatgtnnnnnnnnnnagggaggcgggttgcggtgagaggcctccctccgcgcatgccctccctcccccagccagccagccaatcacacggcccaccctcgcatctccccatgtgcatcgnnnnnnnnnncgccgacgcccacgcgttctggaacgcgtcggggggctacggggacgtcttccccagctgggactccacccacgtgccggcggtgaacctgctactgcaactcgccagccagggtgcggctgtccccggccaggccgagtacgagcgctggtacacctcgacattccaggcggcgtggctggatcccaaaggcaagcctgctgctgtacccaaggggtgggtggtgccgcgatggaggctggccatcaccaaagcctgttccgcggtgcaagtgcccgtctcccctnnnnnnnnnncgctgtacccaggggctgggtggtggtgcaatggctgctggccatcaccaaagcgtgttccgcggtgcaagtgcccgtctcccctcgtctcggcgttcgtccattggaagcaggagtgttcttctgcccctcctcaaccttcctcctcaacccctcggtacgtccccggcccccacagcgagcgtgaagctcaccaggaccccgctgggcctggtataccccacctggagcacctggggtatcctctcctactccaccaacgctgccttcatgatggcgctgcgtgcctcctactcagcaaacgacagggagtcagcgctggcctttgtccggagccagctgaactatgccgtgggtagcacgggccggagcttcgtggtggggctgggggtggacccgccgcggcagccccaccacgccgccgcctcgtgcccannnnnnnnnntgctggcctttgtccggaaccagctgaactatgccttgggtagcacaggccggagcttcgtggtggggctaggggtagacccgccgcgtcagccccaccacgccgccgcctcgtgcccagacctgccggcggagtgcggctgggcccacttctcggccgcgggggcgaacccccaggtcctgaccggggcgctggtggggggtccgccctcaggggatggatcgtatgtggacctcagatccgattacaagaccaatgaagtggcaatcacatacaatgccgggttcgcaggagccttggctggcgccattgccctggcctgactcctgctgtgcatcaaatnnnnnnnnnngtcgtatgtggacctcagatccgactacaagaccaacgaagtggcaatcacatacaatgccgggtttgcaggagccttggctggcgccattaccctggcctgactcctgctgtgcatcaaatnnnnnnnnnnaagagtgcggctgggcccagttctcggccgcgggggcaaacccccaggtcctgaccggggcgctggtgnnnnnnnnnngatgtgcggccttggagtcacggggcggtaatgctttgccacctctctccatgtgaactttgtccagtgtattctactcatgccttgcacgacgcccaacactttcagctgtcgaccacttctgcatgcgtacgtgaatgtccagggactagacatgacaacaagatatgtgctttccgatttcagttttagaatgggggtgaaacgagcagggacttccagggggaacaatacctnnnnnnnnnntatgtgcggccttggagtcagggggcggtaatgctatgccgcctctctccatgtgaactttgtccagtgtattctacttgtgccttgcacgacgcccaaacctttcagcagtcgaccacttctgcatgcgtacgtgaatgtccagggactggacatgataacaaggtatgtgctttccgatttcagtatttagaatgggggtgagaggagcagggacttccagggggaacaatacctcgggttggggaagacccctgctgacagtgcggtgcggctcccggacccaccggagctggaggagggacccttgtgcacatggcaaatccacagagtctatgaggattttgacactaaatgctattttctcgacactggaagctctttgtgtacggtgccgcacggcatccatgacagaaaagttcaagtgtgcgccacttcagctggaggagagtggctcccaaaatgtcgcccagacgcctaggagtatccacggcctttctcattttttcaatatatgcctgcgcacacgggactgccatagtgacggtgagagcgcgtacttggagcgcggtgcccgttgtatgcctgcgcagtctcattgtgacctgtcaggacatctcgcccgtccatcttgtggcataggcttctgcaatacaaattgacaataaggaagcaacagctgtgacgtcggcgatgtctaagactttgccggatgagnnnnnnnnnnacggcgaccattgtatgcctgcgcactctcattgtgacctgtcaggacatctcggccgtccatcttgtggcataggcttctgcaacacaaattgacaataaggaagcaacagctgcgatttcggcgatgtctaagactttgccggatgaggctcagatcttgaaatctccgagtcctccagatgtcaacgtagcactgtcctctcccgagcccacgacagctcaggacattgtccgtgcttcaggtatgttctagggcactcataagtgaaactgtctttatatactgcgagatggggagagctcttgtagcttgagaatgcttggtagacttctaattttctatgtctctgttcaaacttgctttggcaatggatgcccagaatggacgtcaagcatggcttaccatttcatcgtctgcaatcgacttcagtaggcaaggggaagccccctccgccnnnnnnnnnnaaatggacgtcaaacgtggcttaccagttcatcgtctgcaaccgaattcagtaggcaaggggaagccccctccgcccaagcgcaaacctcctcctctatccaagcgccgccctccccctcccaaaagacatcgccctcctcctccccaaaagcaccgccctccccctccc

SEQ ID NO: 21941 - DNA, 119 bp, Chlorella protothecoides
ctctgagccagtaccagcaacagggctggcatgctcaaggtataagtagcctctcacattgcaggaacacctcaaccaacaacctccaaaccctaccagagcgcttggcggccttcatc

SEQ ID NO: 21942 - DNA, 105 bp, Chlorella protothecoides
gcagccggctccccacaatgcgcaggagggttgcacacctgtgatcgtgaatggagcaggtagagctgttgtttcatgctgagcaaaggacaggtagccgggtgc

SEQ ID NO: 21943 - DNA, 97 bp, Chlorella protothecoides
atgctgagcaaaggacaggtagccgggtgcctgcgtcgcaagaggcaaccattaccgcgtgagttgtttgatctggcgagtataggagcctcagcag

SEQ ID NO: 21944 - DNA, 61 bp, Chlorella protothecoides
acttcaggcagcacggggaaggcagcagccacgctcgtcgtgaacaagtttggaccgcagc

SEQ ID NO: 21945 - DNA, 62 bp, Chlorella protothecoides
cgctcgtcgtgaacaagtttggaccgcagcacagcaggaggacgtcatgtgctgtgggctgg

SEQ ID NO: 21946 - DNA, 218 bp, Chlorella protothecoides
gggggaggctgggaaggacgcccagagcccacaccatcgcacactggttccctactactgaatagagctgggtggatgagtgctgacaatctgctttatcccaagacgtaacacagtgtgaatcattattaatacaacagcgctgacagtccagcctcagcacatggtcatgggggcatgcaacgggtatggaagggggtatgacttggatgggaagg

SEQ ID NO: 21947 - DNA, 79 bp, Chlorella protothecoides
gctcccggtcccgtcgcccctccctcctccgatccactggaccaccccaagtcaagcaccctcaaatcactccccccag

SEQ ID NO: 21948 - DNA, 80 bp, Chlorella protothecoides
agcgggggtccgaccagcctgcctgcctgtctgcctgcgccaccccagcagctcgccatgacagacgccggaataaggca

SEQ ID NO: 21949 - DNA, 81 bp, Chlorella protothecoides
ccgcatagctgcaaacatgcggtggaggccaccctcagggtaatccagtttggcgcccaagaaacactggaggtggtggtc

SEQ ID NO: 21950 - DNA, 61 bp, Chlorella protothecoides
ggcgcccaagaaacactggaggtggtggtcagcaaggtctatcagccccccattgtcatgc

SEQ ID NO: 21951 - DNA, 61 bp, Chlorella protothecoides
tgcgcatatgggaccagcgtcgttcttgttagcaatccgtcctcagccctggtccctccct

SEQ ID NO: 21952 - DNA, 77 bp, Chlorella protothecoides
tggcccgcctgcctgcctgcccagcctaacgggtctggaaaatgcttgcatcaagcgatgcactgcgagggcagacc

SEQ ID NO: 21953 - DNA, 68 bp, Chlorella protothecoides
cgactttggcgcgctggaaagttgcatttcgtactggggcaggcgccgcctggagtccgggacagtca

SEQ ID NO: 21954 - DNA, 78 bp, Chlorella protothecoides
ccctacacagatagagtactacgataaggctgaaataaagaataatgatggcttcttgacccctgattggatgctggg

SEQ ID NO: 21955 - DNA, 67 bp, Chlorella protothecoides
gatggccttgagattgggtcacgcaatgtgcttctaccattccagtagtcattccataacgtttggt

SEQ ID NO: 21956 - DNA, 66 bp, Chlorella protothecoides
ccctgccacttgctgggaagtcaggcaggagctggaagaagctggagaaggttcctccgctcccgc

SEQ ID NO: 21957 - DNA, 756 bp, Chlorella protothecoides
tttgaactgcgtggatgctcgagttttgttcactgaatgtaaatcataatctgaccgatttgatgtggtttcatcccagtacggggggtagggctcctttcgaagctggatgtcggggggaacctcccgtcacccccgtcccgctcagcgataagccgggcgaagccatgtccacccaaacccggcggtgggcgcctcgatgaggcagatgttggattgttctttgaggatgctatcatgctggtgagtctcttgattttaggtccgcaaaagcaagtcctggcccttgcgtccatgaggcacatttccgcggatcgggcacattggactgggcaggtgaccaccatctagtatacaccttgaagctctcccaaggctgcaggctgttgtagacatctgcacctgatcagccccgccaccgccccgtatcaagccgagttcctgtattgccgtttgaccacagtgtcctcagtgggcctgcgcgtcaaaaagtgtttgcgaggagggatgcgacgcttggggcctgtatcctgatgttgcatggatcaatgtattatcttcgtctccaatgccacttaaagcatcgcgttggtgccgcagaggccccatcgagggaggagacgcaaaggctatcggagaaacctcttgcctatccataacaaacagttccaccacccggcatttggccacatggaacatgcatcaacaggaaggctttgtgatgcggctctaggacggtgcaaaagtctctcctga

SEQ ID NO: 21958 - DNA, 64 bp, Chlorella protothecoides
cccgcgcacgagaaggaactgctgggcatgatccacgccctgaccaagtggaggcactacgtgc

SEQ ID NO: 21959 - DNA, 61 bp, Chlorella protothecoides
caagcagctgtatgcttgggggaagaagtacccaggtgacgtctggtccagatattttccc

SEQ ID NO: 21960 - DNA, 205 bp, Chlorella protothecoides
acgatgaatcctagcccgtgcacaggcttcctatcaactgtgcgtcgtagtcagcttggacctgggcggcttcaaagattccgcggcgggagtccggagtgtgcctgccggtctaggtccacaaacctgccaccatgaattgaagcgctagcccgtcgagtccggaataaagcacgcacgaaggcaccatccttttcagatccat

SEQ ID NO: 21961 - DNA, 61 bp, Chlorella protothecoides
gggcaaacgaggggggaaaggcgcatcgatcctaccttatcaggacaccagcattgctcat

SEQ ID NO: 21962 - DNA, 61 bp, Chlorella protothecoides
cgacaccgaaaagttccaggagtggctgagcaagctgctttcagagcacggccccgacatc

SEQ ID NO: 21963 - DNA, 177 bp, Chlorella protothecoides
gctgcagctgcccaagagtgacgattggaggatgtttaccgtgcccgaggtgtgaggcattgccagatgccgtggaggagaaggggttttgtgtcacagaaatgtctttcgcttcttcggttcaagcccgggtgccttcctcgggaagctttgggagggttgccctttgctgttcat

SEQ ID NO: 21964 - DNA, 61 bp, Chlorella protothecoides
tgtggcggctcaaacaggagagttagggggtgggggaggccagcactctggattgtattgt

SEQ ID NO: 21965 - DNA, 70 bp, Chlorella protothecoides
ctcgaggtgtttatcgcgccatcacacaaataatcaaacctaccatctaattgctcgctatatgttgtgt

SEQ ID NO: 21966 - DNA, 103 bp, Chlorella protothecoides
atctcgacaatgcgcgccccatgaacctacgagtgcatgtcttggtcaaataatacatgcgattcttcgttacagggctgatcgaaattgccacctgtatatc

SEQ ID NO: 21967 - DNA, 80 bp, Chlorella protothecoides
cagcaacctgtgcatgaccagcagagagtgggacgggttcaagaccacctatttcctcccatcgcatgcaggagggttat

SEQ ID NO: 21968 - DNA, 67 bp, Chlorella protothecoides
tcagtgatgtcccggacgaggtggctgctctcactaagccctgattatacaaagctggggtatcgga

SEQ ID NO: 21969 - DNA, 74 bp, Chlorella protothecoides
gcggtgtccagggagggcagcgtttctccacgtctgcatcggggcggcgagcgactgcccctctggcacctgca

SEQ ID NO: 21970 - DNA, 125 bp, Chlorella protothecoides
cctgggtgaattgcatgacctgggggggtccggaaagggatgggaaaggggccatttgggatccatggggaatgatcactggtagagttgcgctccatgaggcatgcctttgttgcaagtgtggt

SEQ ID NO: 21971 - DNA, 2656 bp, Chlorella protothecoides
  modified_base (1090)..(1179): a, c, t, g, unknown or other
  modified_base (1453)..(1538): a, c, t, g, unknown or other
  modified_base (2189)..(2198): a, c, t, g, unknown or other
gatgcgccgaggtcagacgcgagcatgcatagtttgcctaccaatgcctaagccagcactcctccgtgcgagggacacaccagctcgccttggaatggtcccagccgcagcaccagcactgcgtctgtgtatggcgagggcagggggaatgtgtgttaggggagaggcttgcaaacactgggcgatgaggagctgatacgcagcattgaaggggccggggaaaagccgaaagccaatcacataccacgcatcgagtattgccctgcagaggtgcagcaggcatacaggctgatggaacacaggccacagcgatcctccgcctcagtgctggccatcgttctgggtgacgccattcacctctgctcaccctgcggccccactgtcatcaagtcaacctcaatcccccgatcgcacctcaccaagcattgtgctagggcgatgccgctgctgcagtgggtcacgtcctcccgccgtaaagccagctgaagaccggtgtgtcaccgtggtacgccatggtagacaaagccgtagctgattcgcgcggggctagggcacaggccccagccactacggtctattcgtgctttcgggactgacattcgtctccacgctgccccacagacgcaccactgcaagggcctgaatggcggcaaggaggaggagggtctccgcactgcgtattgagcatgctggggacaggcaaaaaacgcaaggctcgcggtccaaggagtgtagccttgactgtgggcaaagtgcagtacgccagatcctcgcccataccgacatgcgacccgacacagacatagacagccgacacgccttggagacatgcatctgaaagtgcacaaaacttccttgccctcgctcactcgatcataccatgagttccatgacagttgagttaaagggtgtgcctgtcagcagccaagcagacgccgcggcactgcatagcatctgggacgccctcgagtaaaggatgctgaggccttgagcgcacagcccacccaaagcttgttgcctgccgatactgcagctcacgcgtcgcaggcactgatgattggaatggtccaaaggcccagctccagtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacagatgcaactcattgctatgcccctgcataagtggctcgtccattgcagccacaacacaatcaggcagaacaggatgttcactgctcagccaggggcgttgcatggtcgcgtgagcacaccaagaggcaacaacacctctgaaggactgtataatagagggagtgtgggggtcgctgcaatggcatgacgcgcagcatggattgcatccccaacttcagacatggagccatgcagcattgactcaatgtcaccacattattcccaccannnnnnnnnnnnnnnnnnnnnnnnnnnnnnnnnnnnnnnnnnnnnnnnnnnnnnnnnnnnnnnnnnnnnnnnnnnnnnnnnnnnnnccaccgtctgggcatatgcatggctgcaccatgcggcctgctgcagagctcgccatgtgtggtgatcacacggcgcaagcggccatggagtgtgcgactgcagcatccctcagggcgacaaacgtcgccaccagatgatcaatccccctgctggtcggtgtcgtgtgctccagcacctgctcagaggcagtgggctcacatcaccctccggcagcaagcggggtgttcaatgcggcccgtgcacagagcatgtaccagtatggtgaagcaaggtaggctcatgataggagcagccacgatcctgccagcgcaggaacgtgagttgcccacacaaaggaatgggcatgccttcgaccatttgccagatcggactcgacaccctacacagatagagtactacgataaggcagaaataaaaaataataatgaggttcttgaccctgattggatgctgggtcacatcgacgatcaagcagccatcctgggcggtgcccgcgccctgactcagatcgatctcgactgcgagctagacatcgtgcccaggacgcaatcccgttctcattctaccaaacgttatggaatgactactggaatgataggaagacattgcgtgactcaattcaaggccatctcatcgtgtctccgagggtnnnnnnnnnntatcgtgcccaggaagcgattcgctctcattctaccaaacgttctggaatgacttctggaatgatagggacacatcgcgtgacccaatctcgaggccatctcatcgtgtttccgagggtgccgcccggaaccccgctggtgggaggaacactgatcactgatcatccacctctgatcggcatcactcggacactgaatgaatttgatcagctttacgcactattgcagaggacttatcgatgccgttgagcattgagcctcatggctctcctgcctccgcatcaaggtgctgagagtctgtgcacagtggacgagatcgtgacctcttacatggtcaagggggagctgatgtcttaggcagagtcgtgaatcaaaaatcatccacgcacagccctcttggctgatttccaatgcacctgaacatgcaaacgtcgagaactcactgcacccctccaatg

SEQ ID NO: 21972 - DNA, 78 bp, Chlorella protothecoides
gtgccttcccgcgaggcccggcacctcaccctcccacaaactcgcctcgtgtttcgaagaaagtcctgggtctcatcc

SEQ ID NO: 21973 - DNA, 61 bp, Chlorella protothecoides
gtgtttcgaagaaagtcctgggtctcatccgatcccatgacgatctccaactgcaagtgag

SEQ ID NO: 21974 - DNA, 61 bp, Chlorella protothecoides
gctcgccggcgtgaccatcgccgagggcggtgtgctccccaacatccagtcggtgctcctg

SEQ ID NO: 21975 - DNA, 449 bp, Chlorella protothecoides
gcgcggcggcacgcgcgtggcccgcggcggcgccgccgccgcccagcatgcccgccgccgagctggcggagggcgagcgccggaccttgggctccgccagcatgatcttgacgcggtatccggccacctggccagaggcctgcaccgcctccatggcggcggcggcagagctggagcgcgcgtacttgacgaagacgatgcccttggaggccaccaggtcggtcttgcaatactgcaggtcggggaaggcagacatggccgcctcgatggccgaaccgtccgcggacttgggcaccaccaggaagaggcggctgcgaggcggggagttgtctgggtccaggctcgcgtcctcgcaggcgcgcggcacggccgtgcccatgtgcatgctcctgcacggggtatcgagtggagtgggaggtgggtgggtgggtgggggggaagagttcaac

SEQ ID NO: 21976 - DNA, 61 bp, Chlorella protothecoides
tagagcgtgccatacagacagctcggctggtacagggtaccattgcaaatccacccaggtg

SEQ ID NO: 21977 - DNA, 71 bp, Chlorella protothecoides
gcgatggagcagtggagtggggcgggggggaacttttttaatgaggagcattggaggtcatgagcattgct

SEQ ID NO: 21978 - DNA, 61 bp, Chlorella protothecoides
tcgtcgccgctgtcgtcctcgcctcgcgtcgaggcatcggccttcctgggacgaggcttgc

SEQ ID NO: 21979 - DNA, 170 bp, Chlorella protothecoides
gttaggatgggcaggtgtggatgattcctgggggcccgtggtccgccgcagggcctgcagagcgaccaatcagggacgcacacaacgaggcctagccatgcatgcatgtattgatacatgcttgcacactcggagcgagtggcctgcacaacccgctcactgtggaaggc

SEQ ID NO: 21980 - DNA, 203 bp, Chlorella protothecoides
ctcgtcgagaacattgccctccaggtatgcgtgcttttccttgtgtggaaatgacggaaccagggagggagcaagcaggggcacggcacgaattacaatgcccctcctttgtcatgggggatttgcccatctggccacacctctatcatttttatcacctgcctggtgcaagacaggaggctcatgcaactcaacaaggcccc

SEQ ID NO: 21981 - DNA, 65 bp, Chlorella protothecoides
attcacactctgggtggggggcggttgactgcacccctcacccctcacctctgccccatctggac

SEQ ID NO: 21982 - DNA, 61 bp, Chlorella protothecoides
gacggcggtgacgttggcgctgtgctggtcaaaggacagcaccggctgcgggttggcgctg

SEQ ID NO: 21983 - DNA, 95 bp, Chlorella protothecoides
caaaggatttgtgcactgctgctgcacgatgtcttgcaatctgtgcatgcagagccgaaacctgcggcaatggttacccttttgcattcacactg

SEQ ID NO: 21984 - DNA, 126 bp, Chlorella protothecoides
tctgaaggttatcaccattcaaaatgaggaattaagagcatatttatttctccaccttgtcacgaggtgcatattgagtgaagcatttacttagcgactgaaatttacagttactgccctggacaa

SEQ ID NO: 21985 - DNA, 153 bp, Chlorella protothecoides
aggacagaaggggctcgatcctgatgctgtcttgcaagacaccggagtcgaccgggcccaacaccaaattcatacaacacaacacgcactcacccatgcatggactccctgtcaccaggctgcggcggaggcagagtgcgagacgctgcgcgc

SEQ ID NO: 21986 - DNA, 85 bp, Chlorella protothecoides
cacctctgcctgccgctggccaggcgactcatcgcggagcgcgaaaggcgataggcggccgcgccagctcccgcgcaggctccag

SEQ ID NO: 21987 - DNA, 276 bp, Chlorella protothecoides
atcgggtgcaggaaccagatcagtgacagcatcgagtggaccgcctctcaggtcgacctcgacaggtgcgcaaggatgacattcctccaaatggttaccccaatgcttgctgcttgtgtcgacaatccatcttctactgtttcctttgcagcagagggagaaccatccaatgcacaacaacctcggcctgatgagacacgtagacggaagtctgcctcccaaacgggacatcctgcacaacaggcctacggcttggctgccagaccgcctgcaatc

SEQ ID NO: 21988 - DNA, 77 bp, Chlorella protothecoides
ggaggcagcccaggtcgcggtccctcggcctgcttgcacatggattagatccaacacccgagcgccataccttccgc

SEQ ID NO: 21989 - DNA, 601 bp, Chlorella protothecoides
tgggagggcgtgcgggttgcggtgggagggggtctatggccgggtagtgtaggtcgagaggcgccagggtctgcaacacgggtcccgctattaagacctcctcgcgcatcgctgggcctcctccctcccgctccacccagcagcatgaccctcccttctgtgtacgaggtcccacatccgcaaccacctcctcccctcccctctcttccccccaaatgacccctaccagtgaaggagaagtaggggagcggcaccgggatggggatgttgacgcccaccatgcccacatccacctcgctctggaacttgcgggcggtggcgccgtggctggtgaacacggcggtgccgttgccgtgcgggttggcgttgaccaggtccagcgccgcctccagcgagtccacctccaagcagaccaggacggggccgaagatctcctcccggtagcactccatgtccggggtcacgcccgtcagcaacgtgggccccagccagttgccgcgcggatgggccggcacctgcacgccgcgcccgtccaccagcacgcgcgcgcccgccgcctcgcccgaggcgacgaggcgctccgcgcgcgcgcgcgcggcgg

SEQ ID NO: 21990 - DNA, 79 bp, Chlorella protothecoides
agacgcgcacagggccgcgggcaacgccgcactcgcggcgggggactgtgctgcggcgctgcgccactatgcgctgggc

SEQ ID NO: 21991 - DNA, 80 bp, Chlorella protothecoides
ggtccagcggcatacaacaggcacaggggggtcgatacagaggaattgaggaggcagcaagacccaacgagggacaaggg

SEQ ID NO: 21992 - DNA, 225 bp, Chlorella protothecoides
tcaggcttttgctggactggctctgtgctcattccaggcgtcgctattgtaacaccacaagcgaccttggggcggggtgtgtgagccgaaccgccttgaacgccctgaagacggtggcatgggcccggcatggttccccaccgcctcggcacacagcacgagggcagccaccagcggcgctggacgccatggccctgcgcagcccagggacagtctgtccgagga

SEQ ID NO: 21993 - DNA, 71 bp, Chlorella protothecoides
tggtcagcaccgcaacccggcacgcccatctaatttgattgtgcaggccatcggcattgccctctgatctg

SEQ ID NO: 21994 - DNA, 101 bp, Chlorella protothecoides
gggcacccctggcattgatcgaggtcaccggcgagactccgcggcctgtcctccacctccccacttgtgcactccaggtggtataccgggccatgtcccag

SEQ ID NO: 21995 - DNA, 854 bp, Chlorella protothecoides
ggcgtggcgcggcagcacgccgcgctccacctggagcaccgccaagtccatcgggccccggaagacgtgcagcacacgggcgggcagccaccgcgggggccggcctgggtccggggcccaggccacccacgccgcgcgcggcgtggggagcggtttgggctcgccgccgccccttccccccgcgccgccgcctgggtctgcaaacaggtgcgccacggtgaggatgtggccacgatgcgagaccagcacgccgctggcccagcctcccctggccttcaccgcgacgacgctgcgacccgctgctgccgcggcggggggcgctggtgacgctgggagcttgctcgtggatggcgtgtcaggcgagtggggtccgacaaaactgggcgtccccctgcctgcctcagcgctcaggccagcgacgccggctgccccttgattctccaggtcccgcaccgcctccaggacgcgggccatgggcacgaggagcgtggccacggcgccgccgccaccgctgcgtggcgccaacggcccgagcagcacgcccaggggcccggtgggagtggcggccgcgtcggtcgccgccatggcgtggacggggctgccctccaacccgggcaggcagaccagatctgagagccagagcacgggctggggcagccgggagcagtccggcacgctgcccgacagcatgccgcgcgccaacagggactggaagtgggccggggcgacggtgccaaagggggcgcccactgcgaagatcccggcgccgagctgcattgcaggggctgagccgcatccccctttgcccgcgccaggcgacacagcttccagggccgccgcgcccgcctcgcccg

SEQ ID NO: 21996 - DNA, 75 bp, Chlorella protothecoides
caggtgcgccacggtgaggatgtggccacgatgcgagaccagcacgccgctggcccagcctcccctggccttcac

SEQ ID NO: 21997 - DNA, 72 bp, Chlorella protothecoides
ggagacaccagttgcattctcagggagccatggctgaggtgtttgattcgtattctctgcacagcgtaaggt

SEQ ID NO: 21998 - DNA, 73 bp, Chlorella protothecoides
agtgagcgatgaatgtatgcgggcagtcaggttgggacgatgatcgctgcggtcagtaatggggaggcaagcg

SEQ ID NO: 21999 - DNA, 103 bp, Chlorella protothecoides
caaataccccaaaaaaacaccccaagaaacaacacccctcgcaccttggggtcactgggcagctcgcactcaaagacagcggtgggccggccctggggctcgg

SEQ ID NO: 22000 - DNA, 61 bp, Chlorella protothecoides
cccacccctgcacacaccatgcacatactcttcccacctggcgccggagccagccaggaga

SEQ ID NO: 22001 - DNA, 118 bp, Chlorella protothecoides
ccggcaatcaggcagagccacgacagtgcacatgtgacgctaggttggcagtacctgctctgggtcagagcattctgcgactccttgtctcctgcttccgcatccatgccccctgccc

SEQ ID NO: 22002 - DNA, 130 bp, Chlorella protothecoides
gtgcctggatcagacacaaggacgcaggggcccagtcaggacgccacatgtacatcatccacctcaggagttgcatcccgtacctaaccaccaacccacaaacaggcctcccactccccccaggacccag

SEQ ID NO: 22003 - DNA, 75 bp, Chlorella protothecoides
ttccccccagctgctgaatggggacccatttgaggcgggggctgacatgtctttccgactgtcgaccagtgcgtt

SEQ ID NO: 22004 - DNA, 2698 bp, Chlorella protothecoides
gcccgcgctcgaggggggcgcgccggcgccgcccgcgcccgaggggcccctgtccggcgacggcgccgctgcatccggcggttgcaggcccggtgaggggaagaggtctggggcgtcgacgtctgcctcggccgtcccggtggcccgctcgcccggcgccgccgctgcgggcggctccccgtgcacagcggccatcgactccccggcccggcctgactcctggctgcccagcgatgcgtggctgtcggtgccgcccagggaggagcggcgggagcccatggccaggcgcagcaggtgcgaggccagccgccgccgcttcctcacctgggagggggagggggaggcgggggtggcccccatgccctccgcccccctgggcaccaggaacacggccaggcggcgcgccaggcgggtcaggctgggatgcgccgagccggttcggcccccgtcaggggaatgcagcaggggtgccgtgtcggtggcagcctcgcgctcgaggtcgggctcgtcaccgccctcaggggccagagccaggtcgagggcgagcctgaggcccctgtgccacaccttgagggtggccacgtctgcaagggtcgtgggttgggggagtgtttggtgaggtttcaaagagggctggagtgggagggtgaggaaattggctgggcaggggaggtggagggcaggtgctggaggggagggaaggaggggcggggaatgccgaggagggccaccagcaagccagctgtgtatccttaacaggcaagcaaggcaacagcaccctgagtccggggcagacactgtcccatggtgtggtcagtgttgggaggccagggtcggggcagtgacttctgccctgtcccccaaatagaccattcacacaggcagccaccaggtgcacctctgctctggcgcatgtctgccagccaggttcccacccaccgccatcattgtcctccaccgatctcagcacgtaccagggaactggagggtcaggggcgcgtcagcgacaaagattagggtgagggtctgtttatcaatgtcggtcgtcattgtctgcaaatagtaaagtcgtacaaacctgcacagagaggaggggtgggggggaaggggaggctgaggtggaggtaacttgccattagaggcatccggctgggcaaagggacgatgggaacatgctgtgccatcaccgtcatcatgcagtgtcgcagcacagtgtctcatctggacctcctctggattccttgcaaagctgtccataacccttttccagccccgccccctgattggaacaagaacaaagcgccccgtctccatccccacagcaccagggcaggatgcccaaaccacgcacttgttccatccccagcgtagggtacaggcgtcgtgggacagctggaagtaccgcaacttcccagggttcttgggcatgggtttgcccagccatccccccaactggagggggagcaaggtcatgttgcctgcgggacatgtggattggtgtgttgagtatgctgcggcagcaaggattcaagcattcggagccagcccagacagcagccagtggtggcatcccctcacccgttcacgcaagcactgcatgcgcaagctcctcgtgcctgcaatcacaaatgccatcagccacacctcccaccgacccctgcccggcttcccacgtacgtgaggtagcggcggtggggatcacgcgcagcttgaaacgcgccttatcgaggcagaggaggctgcgctgcgccgacgccaggcgatacagggcgaggagtctgggcaccagaaagggacagggggttggtgatgagatgggctcggggcagtgggcatgagctcgtgggcgcatagcggggtagtggcctgggatggctgcttgcagactctcaaggctgttcctgacgtcatccacatgcccctccccacagtaactcgacgacagaaacacagcccctgcccctgctcacgcgaacgtagagccgatgctgaagcccgccacgacattgagggagacgcgtgccgagaagaggcgctggtcgtggtcgttagagtacaggatgatgacggagatgggctggaccagggacgcagccagcgccgctgctatgcactcggggctgagtcggtgtgggaacatgagaggggggggtgatgggatgaatggattggctgctggctggggagggtgcaaccggctcggcagctatgcatgagcaaagcacacgtctgtcgggggagcacacacaaacacggagggtcacaccctgccctgcatgtgggtatatttgcaggacatggggttcgaccacccccccacccagaatgccgcccgccgtgtctcacctggcgattccgtgcgtgggtctcggctgggccagcgccaccaccaccaccgccacggcggccgcggtggcaaagaggccgacgatggccatgaccatgagcgcgacgtccacgccggtgggccgctctgcagagcccatcactcccagcgccgtcagcagcaccgccatgaccacgcacaggcggtaggcggtgttgaaggcgttggccgtgaccgcggcgcgctgcttgaccccggcgccgtgccggcgcacgtccaccccgatgtgcgacagcacgcgccaaccaaactgacggtaggccagcatggcaaagaccttttgggggggggtgtggaggggggagggggggg

SEQ ID NO: 22005 - DNA, 64 bp, Chlorella protothecoides
gagttcaatctcacacactccttttgcgtcccagaaggtcggcatggcacttccggtagcaaag

SEQ ID NO: 22006 - DNA, 139 bp, Chlorella protothecoides
catcacccgcgcaaaggtgcggtcctgcttcgggtgcccgttcacgcggatgtcgcccgtgattacgccctccgtcttgcgccccgccagcacgtccatcagcgtcgtcttgcccgcgcccgacgcgcccatcagcgcc

SEQ ID NO: 22007 - DNA, 61 bp, Chlorella protothecoides
gaccttgatgggtcgctggaggatcccggcaccccctccgccgccacggggacggtcaacc

SEQ ID NO: 22008 - DNA, 61 bp, Chlorella protothecoides
taagacaagcacatcgttctaggagatgtattatgcaccaactaaagccactccttcccca

SEQ ID NO: 22009 - DNA, 75 bp, Chlorella protothecoides
tgctcaagcgcccggcgcgggatgcggcctaccatgaacccggcgcttcaagcccggggcttggagattagcggg

SEQ ID NO: 22010 - DNA, 61 bp, Chlorella protothecoides
atgagtgcataccatgaaaggtactggctgccgtcgtcacatgtggtaccgatggggtctg

SEQ ID NO: 22011 - DNA, 71 bp, Chlorella protothecoides
atctcaccctggcccctcatccttctcctccccccccccaaccgaccccacacctgagctgagccccccgc

SEQ ID NO: 22012 - DNA, 129 bp, Chlorella protothecoides
agtctggtaccgctggacccccatgccctgcgcggcaacaaggagagcaatcgtggtgatcagcgtgcgggactcggccgaccaagcatcctgcctctactcccacaccatgcagtacctgaagcagtg

SEQ ID NO: 22013 - DNA, 61 bp, Chlorella protothecoides
agggggaggacgcagggctggctgccggagggggggaggacgcagggctgggtgttggaga

SEQ ID NO: 22014 - DNA, 86 bp, Chlorella protothecoides
acagactcgacagacaaactacgttattgtctagggtatatgcatgaggtcttcatgctcatcacgattgtgacgaatgaccagag

SEQ ID NO: 22015 - DNA, 61 bp, Chlorella protothecoides
accgctatatcaagagaggaggggggggggaagggaatttgaagtacgggtgtgaggcggt

SEQ ID NO: 22016 - DNA, 322 bp, Chlorella protothecoides
gatctggcgcagggtgtgcattgcgatggtgaggcgcccatcgcaagccatcaccgtggcctggcaatttggggtgcagctgtggctcatgcgtgacgcgattgtcccctgcaagggcaggggggcaagcaaggaggaaagggggaggttgttcttgggaaatcgggctgcggagctcagcaccgcattctaatctgccctgcgtagcacatgcctgcacacatcatgccgcaagcgctgcccagggtgccacatccacatgcgtcagtcgttgcacggctgtactgcacgtatgctccaccttggaggcggcgtcgatgaa

SEQ ID NO: 22017 - DNA, 767 bp, Chlorella protothecoides
gctctaggacggtgcaaaagtctctcctgaagaggagatctcctgaaagctgctcatggtccgtctttcaccccttagaatcaacggcgcagatgggacccactgcctctattcgacatgctcatttggaataagcattcaaaagatgatgggatttccacaggctcaggtgcaaagggcacgatcatgacgaccagcatgggcagcaggtttaatcacaagggacgggagttgcatccaaacgagccagcagacgtattatcctgcttctttgtaacattaaggaactccatctcagttggacgatgcagtccttgcacaggcctttgctgaattattctttggagatgtttctctcttacatcactcgctctgatagcctcacagaccttgaagctgcacgccccgccaaccgatcgttatcaagcgtctcacgacttgggtcatgacgatgtgctgtagaccatgcgctcaagacgtgtggactctgcgagacgctgtcctccatcactcggattctgaaagcattcgatcgccccatccaaccacactgattgccttggatttagcagcagatcttactatcacaagcacgtattgtcaagggatgcgcgatggtgatgcgggcgcagtcaggtgagttcccgttgcatcatggttgggtgatccgtcaatctccacggagccctacttacatatctttgggggaggggttcccacttgatcaacaaccaggtatcggcaggacagcttccctacattgagtt

SEQ ID NO: 22018 - DNA, 424 bp, Chlorella protothecoides
ggacgaggcatgcgatgtggcaggatgaaggctcaccaaaggctcctccacacaccttgatgttctcttcttcattccccaagccttttgtataaatggatgacattcctatgcagatgacagggtggtgtgattttggagatcatgcacgaaagatgtgaagcgtgccgattcaagctcgacggcgagcttgctcccatcaagtcataataatattaatggaacatgcgagtcaataccaggcaaatcgggcataatcttcatgctaaatactcacccatgcagccgaggccttgtggggcgaccttcaaacctccggcatgggtgccaagagttcgctggacgaccatttcgagaggtggatcagatctcgatggaacacgctgggcctttcaactcaatgtagggaagctgtcctgccgat

SEQ ID NO: 22019 - DNA, 77 bp, Chlorella protothecoides
tcagggaggaagcaggtgctgaacagtgtgagcatgcccgcccccacaggtgctgcccttggagcccatgacggagg

SEQ ID NO: 22020 - DNA, 67 bp, Chlorella protothecoides
tcggacccacgaatccgactgcttgctgcatgatctcctcggccttgcgccacctggttggaagcac

SEQ ID NO: 22021 - DNA, 548 bp, Chlorella protothecoides
ggcgcgcgacccgcacgcgcccgcgcgccagtgcagcgccgccagcagcgcgcagcgctcgttcagcacgtcctgcaggcgcagcgcggcatccgcgcgctgagtcagcgccgcggcgcgcgcctcgcagcccgccagcgcctcgcgcaacgctcccaccctctcccactgggcttccgcctcgcccggcagcgccgccagcgcctatttgggagggggggtaggcccatggaatgttggcgcagttatgcaagtgtgcgaacgcacatctcgtgagggagcaccgaacgactgcgcgctcggtgcttcccccctgcagcagcggcgggcgatcggtccaaccgggcaggccccgcgcccgccggcgccggaggcgtgtccacccccccctgcctcctcccacaccaccccgtgcctgcatgatgtcgtggtgggcctggtgcgcaaattccacgtggcccccgccggcgcgcagcgcggccgccgcggccgccaggccccgctggcacgcctcgggcgccgctccgtcgccgatcggcagggggagc

SEQ ID NO: 22022 - DNA, 76 bp, Chlorella protothecoides
gagtgcacaccatcggccgatcactcgcaaacttggtgattctatgatgttatgtaaaaagaatctgcctcgcaat

SEQ ID NO: 22023 - DNA, 73 bp, Chlorella protothecoides
gggcttcactcgggcctccttgttgagctatctccagaggaccaacatgcaccccctgccccggccctgcctt

SEQ ID NO: 22024 - DNA, 79 bp, Chlorella protothecoides
caggggctcactcagtcaagcacagggcttatagtaatcaggaatcgatctgcacgactatgaaaacagcactagcgtt

SEQ ID NO: 22025 - DNA, 141 bp, Chlorella protothecoides
cgccctctccttctctgccgcggcccaggcctcctgctcggcatgcagcatggcgttcactttcatagccatggctccaggggcgccgccggcagcagcatccaggatgaaggtgaggcgcttcagctgcgccgcacgatc

SEQ ID NO: 22026 - DNA, 140 bp, Chlorella protothecoides
ccccgcccgcgcctgaggcagcggctgagcgacgacgccccgcacggccagctgctcaccagcctgagggcgcacaacagccttttttccactttccccactactctccctccccgtccagctgcatgacgactgcctgc

SEQ ID NO: 22027 - DNA, 61 bp, Chlorella protothecoides
tgagcagaggcatgccaggggagttatgcgacctgcagctgtttacttgcagcgaaggtga

SEQ ID NO: 22028 - DNA, 77 bp, Chlorella protothecoides
acttttttgtcatgggcactgcagaatggtaagatgtttcacggatatagggtgttggctgcaggaggaacctacgt

SEQ ID NO: 22029 - DNA, 156 bp, Chlorella protothecoides
ctctccggatggcacggcaccctccatggtagccaggctggctcatgcacactcggagtgcggcatatcaatgcctagatttccattcagagcgcatgaccatgtcgtaatccataacacggctacttgatgcgttttaccacctgtcgctggcac

SEQ ID NO: 22030 - DNA, 79 bp, Chlorella protothecoides
ggcgctggtcagcagggtgccagagctgcatagtcacagtcgaaaggttttcacaggaggtgatgcagttctgagctca

SEQ ID NO: 22031 - DNA, 61 bp, Chlorella protothecoides
atacgacagacgatgggtctgctgtctcctgcccttacgacgacaggttcctgcatgttgg

SEQ ID NO: 22032 - DNA, 79 bp, Chlorella protothecoides
tcgcggggctgctcgcctcggcgcagggtgcgtggagacgtcgggtggttttgtgtgtgttttgtgtgggtgcggagtg

SEQ ID NO: 22033 - DNA, 76 bp, Chlorella protothecoides
cccctgccaagccgccattccctttcccctcttcctctcacctcaagacccacctgcaggatgtggacttcgcggc

SEQ ID NO: 22034 - DNA, 75 bp, Chlorella protothecoides
ggagcctgatgtatcatcaagggattctccggagtctccaatcaagtgtcccccccaaccaggagcgccactcaa

SEQ ID NO: 22035 - DNA, 67 bp, Chlorella protothecoides
acctcaggacactcctcactgctcccagtggacaactccgaaacagcactagccaccactcagtgcc

SEQ ID NO: 22036 - DNA, 61 bp, Chlorella protothecoides
ttccaccacctcctggtggccaggaggagggcagcgccccccaggaggggcaggcctcccc

SEQ ID NO: 22037 - DNA, 96096 bp, Chlorella protothecoides
  modified_base (655)..(664): a, c, t, g, unknown or other
  modified_base (2352)..(2361): a, c, t, g, unknown or other
  modified_base (3007)..(3016): a, c, t, g, unknown or other
  modified_base (3358)..(3367): a, c, t, g, unknown or other
  modified_base (3531)..(3540): a, c, t, g, unknown or other
  modified_base (4317)..(4326): a, c, t, g, unknown or other
  modified_base (4912)..(4921): a, c, t, g, unknown or other
  modified_base (5353)..(5362): a, c, t, g, unknown or other
  modified_base (5847)..(5856): a, c, t, g, unknown or other
  modified_base (6570)..(6579): a, c, t, g, unknown or other
  modified_base (7041)..(7050): a, c, t, g, unknown or other
  modified_base (7814)..(7823): a, c, t, g, unknown or other
  modified_base (8875)..(8884): a, c, t, g, unknown or other
  modified_base (9092)..(9101): a, c, t, g, unknown or other
  modified_base (10281)..(10290): a, c, t, g, unknown or other
  modified_base (10763)..(10772): a, c, t, g, unknown or other
  modified_base (11472)..(11481): a, c, t, g, unknown or other
  modified_base (11734)..(11743): a, c, t, g, unknown or other
  modified_base (11936)..(11945): a, c, t, g, unknown or other
  modified_base (13035)..(13044): a, c, t, g, unknown or other
  modified_base (13367)..(13376): a, c, t, g, unknown or other
  modified_base (13763)..(13772): a, c, t, g, unknown or other
  modified_base (14697)..(14706): a, c, t, g, unknown or other
  modified_base (15122)..(15131): a, c, t, g, unknown or other
  modified_base (16278)..(16287): a, c, t, g, unknown or other
  modified_base (16722)..(16731): a, c, t, g, unknown or other
  modified_base (17503)..(17715): a, c, t, g, unknown or other
  modified_base (17785)..(17794): a, c, t, g, unknown or other
  modified_base (18077)..(18086): a, c, t, g, unknown or other
  modified_base (18284)..(18507): a, c, t, g, unknown or other
  modified_base (18571)..(18580): a, c, t, g, unknown or other
  modified_base (19374)..(19383): a, c, t, g, unknown or other
  modified_base (19589)..(19598): a, c, t, g, unknown or other
  modified_base (20251)..(20260): a, c, t, g, unknown or other
  modified_base (20682)..(20691): a, c, t, g, unknown or other
  modified_base (20945)..(20954): a, c, t, g, unknown or other
  modified_base (21201)..(21210): a, c, t, g, unknown or other
  modified_base (21290)..(21299): a, c, t, g, unknown or other
  modified_base (21397)..(21406): a, c, t, g, unknown or other
  modified_base (22111)..(22120): a, c, t, g, unknown or other
  modified_base (23034)..(23043): a, c, t, g, unknown or other
  modified_base (24899)..(24908): a, c, t, g, unknown or other
  modified_base (25351)..(25360): a, c, t, g, unknown or other
  modified_base (26585)..(26594): a, c, t, g, unknown or other
  modified_base (27503)..(27512): a, c, t, g, unknown or other
  modified_base (28481)..(28490): a, c, t, g, unknown or other
  modified_base (31279)..(31288): a, c, t, g, unknown or other
  modified_base (31724)..(31733): a, c, t, g, unknown or other
  modified_base (32335)..(32344): a, c, t, g, unknown or other
  modified_base (32626)..(32635): a, c, t, g, unknown or other
  modified_base (33033)..(33042): a, c, t, g, unknown or other
  modified_base (33383)..(33392): a, c, t, g, unknown or other
  modified_base (33956)..(34046): a, c, t, g, unknown or other
  modified_base (34173)..(34182): a, c, t, g, unknown or other
  modified_base (34278)..(34287): a, c, t, g, unknown or other
  modified_base (34384)..(34424): a, c, t, g, unknown or other
  modified_base (35233)..(35242): a, c, t, g, unknown or other
  modified_base (35739)..(35748): a, c, t, g, unknown or other
  modified_base (38736)..(38745): a, c, t, g, unknown or other
  modified_base (39904)..(39913): a, c, t, g, unknown or other
  modified_base (40976)..(40985): a, c, t, g, unknown or other
  modified_base (41044)..(41053): a, c, t, g, unknown or other
  modified_base (42001)..(42076): a, c, t, g, unknown or other
  modified_base (42647)..(42656): a, c, t, g, unknown or other
  modified_base (42893)..(42902): a, c, t, g, unknown or other
  modified_base (43390)..(43399): a, c, t, g, unknown or other
  modified_base (43530)..(43539): a, c, t, g, unknown or other
  modified_base (43998)..(44007): a, c, t, g, unknown or other
  modified_base (45641)..(45650): a, c, t, g, unknown or other
  modified_base (46674)..(46683): a, c, t, g, unknown or other
  modified_base (47345)..(47354): a, c, t, g, unknown or other
  modified_base (47856)..(47865): a, c, t, g, unknown or other
  modified_base (47954)..(47963): a, c, t, g, unknown or other
  modified_base (48374)..(48383): a, c, t, g, unknown or other
  modified_base (48804)..(48813): a, c, t, g, unknown or other
  modified_base (49463)..(49472): a, c, t, g, unknown or other
  modified_base (50388)..(50397): a, c, t, g, unknown or other
  modified_base (50491)..(50500): a, c, t, g, unknown or other
  modified_base (51489)..(51498): a, c, t, g, unknown or other
  modified_base (53612)..(53791): a, c, t, g, unknown or other
  modified_base (54616)..(54625): a, c, t, g, unknown or other
  modified_base (54999)..(55156): a, c, t, g, unknown or other
  modified_base (55241)..(55250): a, c, t, g, unknown or other
  modified_base (55456)..(55480): a, c, t, g, unknown or other
  modified_base (56710)..(56719): a, c, t, g, unknown or other
  modified_base (56965)..(56974): a, c, t, g, unknown or other
  modified_base (57633)..(57642): a, c, t, g, unknown or other
  modified_base (57904)..(57913): a, c, t, g, unknown or other
  modified_base (58275)..(58284): a, c, t, g, unknown or other
  modified_base (58514)..(58523): a, c, t, g, unknown or other
  modified_base (58580)..(58589): a, c, t, g, unknown or other
  modified_base (58646)..(58812): a, c, t, g, unknown or other
  modified_base (59318)..(59327): a, c, t, g, unknown or other
  modified_base (59716)..(59725): a, c, t, g, unknown or other
  modified_base (61871)..(61880): a, c, t, g, unknown or other
  modified_base (62603)..(62612): a, c, t, g, unknown or other
  modified_base (63399)..(63408): a, c, t, g, unknown or other
  modified_base (64444)..(64453): a, c, t, g, unknown or other
  modified_base (65799)..(65808): a, c, t, g, unknown or other
  modified_base (68650)..(68659): a, c, t, g, unknown or other
  modified_base (68775)..(68784): a, c, t, g, unknown or other
  modified_base (68942)..(68951): a, c, t, g, unknown or other
  modified_base (69286)..(69340): a, c, t, g, unknown or other
  modified_base (69834)..(69843): a, c, t, g, unknown or other
  modified_base (70527)..(70536): a, c, t, g, unknown or other
  modified_base (70610)..(70619): a, c, t, g, unknown or other
  modified_base (70960)..(70969): a, c, t, g, unknown or other
  modified_base (71995)..(72004): a, c, t, g, unknown or other
  modified_base (72880)..(72889): a, c, t, g, unknown or other
  modified_base (73180)..(73189): a, c, t, g, unknown or other
  modified_base (73569)..(73578): a, c, t, g, unknown or other
  modified_base (73938)..(73947): a, c, t, g, unknown or other
  modified_base (74189)..(74261): a, c, t, g, unknown or other
  modified_base (74399)..(74408): a, c, t, g, unknown or other
  modified_base (74501)..(74510): a, c, t, g, unknown or other
  modified_base (75365)..(75374): a, c, t, g, unknown or other
  modified_base (75693)..(75702): a, c, t, g, unknown or other
  modified_base (75895)..(75904): a, c, t, g, unknown or other
  modified_base (76139)..(76148): a, c, t, g, unknown or other
  modified_base (77708)..(77720): a, c, t, g, unknown or other
  modified_base (77777)..(77786): a, c, t, g, unknown or other
  modified_base (78484)..(78493): a, c, t, g, unknown or other
  modified_base (79610)..(79619): a, c, t, g, unknown or other
  modified_base (82541)..(82550): a, c, t, g, unknown or other
  modified_base (83402)..(83411): a, c, t, g, unknown or other
  modified_base (84579)..(84588): a, c, t, g, unknown or other
  modified_base (85929)..(85938): a, c, t, g, unknown or other
  modified_base (86923)..(86932): a, c, t, g, unknown or other
  modified_base (87472)..(87481): a, c, t, g, unknown or other
  modified_base (87780)..(87789): a, c, t, g, unknown or other
  modified_base (88031)..(88040): a, c, t, g, unknown or other
  modified_base (88541)..(88550): a, c, t, g, unknown or other
  modified_base (88874)..(88883): a, c, t, g, unknown or other
  modified_base (89268)..(89277): a, c, t, g, unknown or other
  modified_base (89346)..(89468): a, c, t, g, unknown or other
  modified_base (90855)..(90864): a, c, t, g, unknown or other
  modified_base (91055)..(91064): a, c, t, g, unknown or other
  modified_base (91558)..(91583): a, c, t, g, unknown or other
  modified_base (94718)..(94727): a, c, t, g, unknown or other
  modified_base (94981)..(94990): a, c, t, g, unknown or other
  modified_base (95572)..(95581): a, c, t, g, unknown or other
gaggggggggggcgcgcgggaggggagggtccacgacgcgtggctccggagcaggaagcagggcaggagggcaggcgaagaccgtggaggggcagagccgtggggcgccccgcggtccctgctgcagcgcagggcttgccgggcagggtcggacggacccctgtttcacctgatccctccttccccctcctcccccgcgaacaccacgcctcgcagtcgctgaagatcgcgcagggcgtgtccgggacggtgagggacaaggggtcggttcggcgcaacgtgcccttcctcatgcaggccgtgcggcaggggttccaggactttggggcgcggtccgtggctgacgcgcacgccgcgctcgccgcgggggagctgcgcctgcgcgaccggaccggggcggcgctggtcgagggcggcatccacgacatgcactcctacaccaagcaggcgtggtgagctgtggcgtgggtctccttttgcatccagtgtgtcctgtaagcattgttccggggggctgagggaacggggtgggccggggctcgcacgattcgcagcaggcctgcaccagcagctgcagagcgcgcgttgaagacctggaaaggcgcgccgaaggaccctcagtccgtgagcggaagggcctcactgatgcctccannnnnnnnnnaggactcgcacgattcgtagcaggcctgcagctgcagagcgcgcgttgaagacccggaaaggcgcgccgaaggaccctcagtcggtgagcggaagggcctcactgatgcctccacacacactcggcaatgtgagggcgtaaacaacgcagcgaaatcactttgcatgttggtctgatcgcgtgctccacggggcgagggccgtgcagcacctgcgcaccctgccgctccgagtccccgacctgggctacatggtggcaggggatgcgtcaaacgatggtttcgcgttcccagacctccccaagcccaagccgctgcctgcaagggtgcgaggagctgggcggggagcgacatgatcacttgcacggcccgacacaccggaccctgacagtgcccctgcgtgcccgcagaaccccttgctcgagaggtccacggtgacagacagctcggcgggatccctggcagcgccctcggctgtgggtgtgcctgcctcgggggcagcaggccgtccccggaagaagctgccattccagataggatgcagccccatggactggctacgcctcagccgttccaaggccgacctgtcaggtggggcggctgtggggtgcttgaggtgtgcctctgagcaggcagggaggccgtgacacctctgcatggccatgtcgtgtgcaggcctgaagggtggcgcccctaggcgaggcatcacgctggaggaggtgaagcagcacaggacgcgggacaatgcatggaccgccattcgcggcaaggtgcggcctggtgcgaagctgtatgcggggaggccggtcgccagggtgattggcggatctccctttgcctgatgccccgccggcttcattgctgaggaggccctattctcgtttggcttgcaccccccacccggccggcctcccctcctcgctgcataggtttacaacatgagcgcatacatggccttccacccgggaggcgacaagatgctgctggcggtggcgggcaaggacggcaccgccatgtttgacaagtaccacccctgggtcaacatcaatttcctcatgtcggcgtgtgtggtgggtctgctggcgccccccactcctggccctgcgggggtcgagtgggaggacgacgcgccggcgcaggagcataagcccgatgatttatagcttacgaatcctccatcgcatagcaccctgctgagatggctctgacgctcctcgcagtaggctgcagtcgtcctcacccctctcaatgtttccggctggcagtcttccccgctcaccattgtaaaccatcggtataggctgtgtctaaaggcagggcatggttcacgcagggccttctgcctgcagcagggctcgggctcagacgccgccatctgactctgcagtacttggagcgggaggcgccgccgtctgcgtggcatcaaagtcggcatagtccacgcccagccggccgctgtggcctctccgcaggacaggccggaactggtgtccccaccgaatgtcagaggggaagtaggatctcctcgcctgcaaggccataggggttacaaggggggcagttcaggtcggcaaggggcccaactgcgggctgggggaggttcctaggcgcacctcctcgctgcatcatgcgacaaccaggcagccctgcatgctactacccccggccaccccagggcatgttccaaagnnnnnnnnnnaacgaccaggcagccctgcatgctcctgcccccggccaccccagggcatgttccaaaggatcccatccccctctttcccccacgccgaagaagaaaagcttgcctggatgggcgtggcggtggtctcatcaatgccgtccaggatgacgaggatctccacatccatctcatccagatcctcctcgttcaggccatacaaggggctgtcagcatccactggcaagggtcatgggcccgggagagtaggggattggtgtcggagctcacaatcttgcacaggggcctcccacattcgcccaagggaatctcacgggaaaccaatccatgcacacaccagtgtggtacaggatggagggcacccccatccacagcttcccgccgcccagctgtggcaagcagggtgggagctggggtgtaggaccgagggcgccgagaggcactgggcgcacaacacactgagtagtaaaccgatgcaaccttttccgacttctgcactcctcctaccacctggcattcatgcctgccccactcccgagcccatgattccttaggaggccagcgagggcatctggacccctcttcccctcccctccaacctcgggcctcgcctgcctaacgttcaggtcggagtagacgtactcatggnnnnnnnnnntgcttctcctaccacctagcattcatgactgccccaccaccgagcctatgattccctaggaggccagcgagagcacctggacccctcttcccctcccctgcaacctcgggcctcgcctgtctgacgttcaggtcggagtagacgtactcatggctgtctggtccatggtggacgaggcgcatgaagagcatgcgaacctcaggatgcagcagctgcggggaaggggacggggcggggagtgcgatccagggcccaatgcagggcgcttggcggaggtgtggtacacggcgcatggtcaaagtacccatggacctcaggaaagggtgcccagcaaatgcagcnnnnnnnnnntagtatgtagctacgtgaagttcttcgcaaggatgatgcccttccagcactgggtccaatcacgcaacctctcatgcagtcttcaagcggctcatcttgtcccacacatgcccactgccaggcacgatccagaaggcgtgcctgaatctcgcgtatacaacgcnnnnnnnnnngggtggaggtgtggtgcaaggcgcatggtcgaagtacccatggtcctcaggaaagggtgcccagcaaatgcagcaggtccacagcatatcaatcccatgcctcactcccaccctttccaccctacctgatgcttgcggaggttggccaccctgaagcagagccactgggtgccatcatcctggtcgtggcaggccatgatctcgctgaagcggagggtgctggccctcttggaaggcgtgctgcgcggagcatggggtgagggaatgtatggattatttgagcgagtgtgcagctgcgtgaagttctttgcaaggacgatgcccttgagcactgggtctgactacgcaaactctcatgcagtcgtcatgcggctcatcttggcccaaacatgccccactgccaggcacgatccaggaggcgtgcctgaatctcgcgtatacaacgcccagcagggcagcctgcagcaggcaggtggtcaacacctccgccaggatcaggaggttggtgctgacgcagtctggatttggcgccctggaacatgtcggcaagggagggtttgagtggatgaaagctggcatcaaaggagcactgggacagacagacccggcatgggtaggtgatgacagatgtgagccttcgagccatcgactggtcgctttgacaccatgtcagtgcagctccagtgtcctgcagactcgaccggaattcctgccgggctgctctaacatctgtcaccctctgagaaagcgccttcccctgagaaagcgccttccaannnnnnnnnntctgcagactcgactggaattcctgccgggctgctttaacatcctgtcaccctctgagacagcgccttcccctgagaaagcgccttccaatcaacacacttttcatcccctcaattcatcgcccatcacccacatgtggccgtatccaatggtggccgaggtgtgcacactaaaccacatggcgtgggagaactggtggaccttagtgatgcagccgtcgggctccagcatgtacagaaatgcgaaggtggtgtactgcgcggcgcacgggagagtggggtgagggggaatggatgctgcagagctagcctggggcaacatctgatcttgactatgacctgagcatttggatgccagcaccacgcttccctgtccccgcaccatgctcagatatgacagcaggaaagttaggaaaaataagtagtttggcatctgtggaggattgggaggtgcaggatgaagaggggtattgctctttgtgcactctatcctcaaggacccatcccccggtgcaatgccgtgcccgacgcccaagatcaggtccattccttcattacactgtgtcactcacgttcaccagggtgtnnnnnnnnnngtagcctggggcaacatctgatcttgactataacctgagcgtttggatgccagcaccatgcttccctgtccccgcaccatgctcaaatatgacagcaggaaagttaggaaaaataagtagtttggcatctgtgggggattgagaggtgcaggatgaaggggggttttgctctctgtgcattctatcctcagggacccatcccccggtgcgatcccgtgcccgacgcccaagatcaggtccagtccttcaccacactgtgtcactcacgttcaccagggtgtggaacatgtcgttgtagtacattgtcatcttatggttcatgttgtgacgttcgagggagaggctttgaatcgccctgcgtacaaacgagatgagagctggggatgatgatgatctcgtgactgtgtacctgcccgctagggtttggtgagnnnnnnnnnnctcgagggagaggctttgaatggccctgcgtacaaacgagatgagaactgggggtgatgatgatcttgtggctgtgtacctgcccgctagggtttggtgagctctcatggcggggtgcgaccacaaggggctcgacgcacctggcagcagccaagcgctggagggtgcgatgcctcttgaggggcatcgggaggaaggggctgtcgaaactcgcctccgacggccccatatagtccttggccgacctcattggggggggcctcaccgacttagggcttccaacactccagagtttgggactctgactgaaacgtagaggttttcattgtttacctggtgagaaatgctatgtatgggcagtgtgtcgtagcagatcagtgtcaaattggtgctggtccttgatgagatcctcgatcacgagccagcgtcgccaaggcgcgataaactgaatgagcttggccacacagatcgtgaacttggccacnnnnnnnnnnagactctgactgaaacgtagaggttttcatcgtcttcctggtgagaaacgctatgtacgggcagtgtgtcgtagcagatcagagtcaaattggtgctggtctttgatgagatcctcgttcacgagccagcgtcgccaaggcgcaatatactgaatgaacttggccacacagatcgtgaacttggccacacagattgtgaacttggggacagtgctcctgcacgcaccatctcattcactgtagaagctccaaaattgctcagtgcactcgaatttggtgcattgcgaaccctctgcccacaacctgttggtggcccgatcctgaccggggctgtccggacaccaccgccatgccctgacatcagaatgtcaaaccctttgtgatagtatcttcacgagcatggtcatagctggcgaggctgagacgggcattcccgacgataagcgcttcgccgtggagctagagtttgtgcagtgcctggccaacccccactatctgaactgtgagatactcgtttggggcgaggagttgaggagtgagggcggggggaatgggaggtggtttaacaaggagtatgcagtactcgagcgcggccagagcaatacctttagcgctcggcccgtgaccgatggtagggtctcccaattccactcgcaccccttgctccccctgcagggctggcacagcagcgcttcctagacgatgcctgcttcnnnnnnnnnnaattgggaggtggtttaactaaagagtatgcagtggtcgagcgcggccagagctgtacctttagcgctcggcccgtgactgatggtagggtctcccaatcccactcgcacccctcgctccccctgcagggctggcgcagcagcgcttcctagacgatgcctgcttcctgaactaccttcggtacctgcagtactggaaggaggagccctacgtgcagtacatcatgtgagggggtgcaggaggaggggtgttgagacgtcgaccgtggtctttctgcatggattgtgtcgtgcacgcgacgctctcaacgacgcgagctcacctgctcacccctgtggctgcctgggccgagcccaggctcatgtccgctccccgcgccggccccctccaccccccctaccaaatgcttctcgccttccagatacccgcatgccctcaagatgctggacctgctgcagagcnnnnnnnnnntttgagatgtcgacctcggtctttctgcatggattgtgccgtgcacgcgacactctcaacgacgcgagcccacctgctcacccctgtggctgcctgggccgagcccaggctcatgtctgctccccgcgccggctccctccacccccccttcccactgattctcgcgttccagatacccgcacgccctcaagatgctggacctgctgcagagcccagagttcagggcggccattgtcaacccggcgtacaaggaacacgtccactcccagcagctcttcttctggcagcactggcgcaccaaccgcctgcatgagacggcccagctcaaggaggtgctggccactcccgcagagtgagctggatggcactgccacgcacgcgcatgggtgcgggggcgagggcgggcggcggccccctgctggatgccgcggcatgccgtgcgcgacagggttgcagggtgacgcacggggagagtgtccccccctgatgcatgggttttttggcttgccagcgtgcgaggcttctcctacctttgccagtagctgttgagggagcggcgatgctcagtgtgctgtgtcagtcccgtttgattgcacggtgtggcatcctcacgggcattcctcctctttcacggtaccagcacttgcttcgcctgtacaaaggcactgcacgatgggctcctctgccagagcatgaggtcatccttagtcatccatgggtcggcctgaacccatcacacgcccagcatgcccagcatgacctgnnnnnnnnnngtaccgtgcgcgacagggctgcagggtgacgcacggggagagtgcccccgctgatgcatggcttttgtggcttggcagcgtgtgaggcttctcctacctttgacagcagctgttcagagagcggcgatgctcagggtgctgtgtcagtcccgtttgatcgcagggtgtggcatcctcacgggcattcctcctccttcacggtaccagcacttccttggcctggacaaaggcactgcacgatgagctcctctgccagagcatgaggtcatccctagtcatccatgggtcggcctgcacccgtcacacgcccagcatgcccagcatgacctgcaccaaggcgtcaaacaccaccggctgtgggtgcacgccgtccgcggagcaggcgtccccgcaggcgcggctcagcgccgccacgcccagccggcgccaggtggcggcgggctgcgcgcgcagcgccgcgtcgtaggccgccaccctgcgcggcgtcagcgcctcccgcttggccgccgtgccctgcagggccgtgacggtgtgggggcaggtgcagaggaggaggcggaggccagggagtcgggtgcccacctgctttgtgtgtggggggggggagggggggggggtggaaggccctcaggatggccacatgggacggacctcatggtatgcaaaggggttaatgcgcgtcaggttgcaaggggcacgatgggtgcaccacacctggaactgtgctgcggagatgagtgagtagattgcccattaagggccaggcaggattggtggcatgccctgaaacagtgcccggcccgggcccccaatgcacagagctgacggatctgcagcggtccaagggagtggcactggtagacatcttgcaggccctccacccgtgagcacacgttgagggggagcaggtcgttctcttgcacagccggccgatgaggcatgctgttgtcaggtgcaggcagcttgaatcctcacatcgcccccatcttcaacccacccattctcaccccgaacaggttcattttcaggattgggatgccgcccgaggtgannnnnnnnnnttcctcacatcgctcccatcttcaacccacccattctcacccccgaccaggtttgttttcaggattgggatgccgcccgaggtgaggatcgagctggtgcggagcctggcggcggtggagcacagactggccttcgggaccagcgagaagctgcagctgggggcggtggtgggggcgtttgccgccgccaaggccggcatcgttgccnnnnnnnnnntcggtggagcacaggctggccttcgggaccagcgagaagttgcagctgggggcggtggtgggggcatttgccgccgccaaggccggcatcgtcgcctgcgccagctgatgcgtggcacactttcacccagctgctggtggtctgcgaggagatgcggagtatttgcacagagttctacctgctccccatgcgcagctggcatgtgtaagcgggtgcttgcggtgcctggcagcttcagggtgcacacggccctcagcactccgggagttgctgagccctggcgagggcgcgacctcgacagcggaactgagggagctcaaggtgcagcgggagtcgcagtcgcctcccccgcactttgacgctgcgttctgagagtatgtttgtcattctgctcgccccattgggctgaggccacaaccactgtgctcgccaggctccctggggtttgagccacaccgaccggttcgtgtgcaaactccggcaccaccttgggcaccagatgccccccctcccccagcatgggttgtgcttgctcaaaaactgagaatgccgggccgcgaaacctgcccacctttgccaggtggggttctcctgccctcgcggcacgcgcacccgactgtcgacgctcgcggcgtgtgatcatgaagcatccagccatccaacccctctcacctgcccctcctcctccctcccggcatgcaccagggtatccatcttcaagtcgctggccgaggcgggcgatgccaccatgcccagccagcgcaagctcgaggcgtcgtccagcgacgactccctggcccccatgggccaggagggcgtcgagggacagagccctcccccacccccacgccaggaagactcccccgtcctcctgacgggggactccgaggccctgctggccaagtcccggggcatcaagcacaccttcaggctccgcgtgggcgtgctggaggtacggcatcagtgcgaggggtttggccttgttgatccctgcctgtgcttcgctggcgaccactgggccgtgtcctccctcgcgcttcgctgcggcccctgccgtcctcagcccccgccgtgccatttgcttgcgtctcatcccacgacaagcccgacctctcattctcgagcactccccacagggcgctacttttttgaaccagtatatcgtggtggacaccctggnnnnnnnnnncgctcttcgcctcatcccacgacaagccccacctctcattctcgcgcactccccacagggcgctacttttctgaaccagtatatcgtggtggacaccctgggccgcggctcctacggccgagtgaagctgtgcctgagcacgcaggacgacgagctgtatgccatcaaggtggtgaaccgggccctggtcaaggccgccagcaaggccagccggctgggcgcgggagccgccagctcggcccggggggcgggcctccttgcccggcgcggcagcggcgtgtccgccgtggccgcctcgccgccgcccgccggcgccgacctttccaggtccagtcccgaggccgacgccgacgccgacgacttcggcggcgacaccctgggcccgctccggcgagagatcgacgtgatgcggcgcctgcgccaccccaatctggtgcgtctgcacgaggtgatcgaggacggggccagcggcnnnnnnnnnngggtccagtcccgaggccgacgccgacgctgacgatttcggtggcgacactctgggcccgctccggcgagagattgacgtgatgcggcgcctgcgccaccccaacctggtgcgcctacacgaggtgatcgaggacggggccagcggcaaggtgctcatggtcatggagtacgcggcggcggggcagctgctggcgaagggccagctgtcgccggagcggcgcatgccggaggtcatcgcgcagtactacttccgccagatggccgcgggcatggccttcctgcacgccaaccatgtggtgcatggtgacatgaagcccgacaacgtgctgctttcgggcgactccaccgtcaagatcgccgactttgggcaggcccactttttcaggaaacgcgacacctttaatcgcaccctgggcacgccggcctttcttggtaggtagaagggcgggggaagggggggacaggtgtgcaggctgagtagcaggggaggcgcaagattggttgtgaggccctcgtgatgttcaggcttggctggtatgtggcgatgggttttggcgaggtgaagacattcgaggcatggaagcttgcatccgctggccgctcctgcgcccttcacccacgtcttcccccttctctcgttgcttcgccccgcagccccagaggtgtgtgccggggagacataccgaggccggcaggccnnnnnnnnnntccattttcccccttctctctttgcttcgccccgcagccccagaggtgtgcgccggggagacataccgaggccggcaggccgacatgtgggcgttggggatcagcctgtacctcttcatctacggggaggtacccttccacgtcagtgcggagggttatggggctgggtgggtggatggtcgacgtacgggggtgcctggactggggtctcagcggcagcacggtaacgtatggacgctgtggccccgctcgnnnnnnnnnngttggggctgggtgggtggatggtcgacgtaagggatgcctggactggggtcttagcggcagcatggtaacgtatggacgctgtggccccgctcgattacggggcacggtggcaacttgcccctgccggggttgtgacacgttaaacccacagtctgcatggcccagccagcatgatcaggccgggtgccctnnnnnnnnnngtacggggcacggtggcgacttgcccctgccggggttgtgacacgccaaacccacggtctgcatgccccagccagcatgatcaggccgggtgccctgcccacaacccatcgcaacactccccactccctgcagagtgagaccgtgctggacctgtacgaccagatcgcggggggcagcgtgccctacccggagcacgtgccggtgtccattgagctgcaggacctgttcaggaggatcctgaaccctgaccccgcggcccggctgacggcggaggaggtgcggggtagaaacggggaattgaggcgggaatctgggtcggactccagggtgcttcccgctgcccttgagcaaattacaggccacgggatccctcaaggcgaagcgatgaggtccctggtggcctgcgcgagcatgcctactacctgcggccgctctcaagctgcttgtatgtccatcacagcctaaaggcacgaagaatgagggaccccccctcaatcccactccatctaacccatccccgacctcattcttacacacacaccccaagacctccaattcaccacctgagcgcgcagatgatggagcacgcctgggtcaagggtgacttctgggcatccctgctctccagcttccagctggccgacggcacctgggccgcgccgccggaggtgcatgccagcatgcgcgctgaggacgtggcggccatcgtgttcccctcgccctcgccgcagggcgcttcccccgttgccggcacgtcgccgcggtccggggtcgctggggatacccccgccgaggcgacgcccacgggccgtgccggcgccgcgtggcgccggccgggcccgctgagccaggactcacccccactgctccaggccgcggcgcaggtgagtggcctgcagcgcctgccacactgggaggacggcctgcgcacgctggaagacgaggggcccaacatgtcagcggcgtcgctggaggacgccgcacggatgtgcatcggcggcggcgaggaccccggcgcggcggtgccgcccggcggccggggcctggcgcggcagagtcccacccaggccctggccgggacctgggcgnnnnnnnnnncggcgaggacccgggcgcggcggtgccgcccggcggccgcggcctggcgcggcagagccccacccaggccctggccgggacctgggcggcagccgcggcgtcgggccgcctgcactccaccctgtgtgggcgcccggtgccggacggcgcgggtgtgttggacgcagcgggaccgacggagcatgccgctcaggcaagcgaggcatccccggacccggcgggcccaagcgacggcggctcgacagagaacggcagcgacccacagttttacgccgccgcgaaggccgcccccctctgctcccccttccagggctcggcgcctnnnnnnnnnnctgggcgcccggtgccggatggcgcgggtgtgatggacgcagcgggaacggcggagcatgccgcgaaggcatgcgaggcatccccggacccggcgggcccgggcggcggccgctcgatggaaaacggcagcgacctgcaattctacgcctccgcaaaggccgccccgctctgctcccccttccagggctcggcgcctccacccgccgccgggccgaggccgggccccgacgcctccgccgtgccggcggaggcgtcgtcttcggtggccaccaggccctcggccaggctccacgccgcggggccgggccgcacgcagcccatggccatccttttgccccggcaccgctccgtcgcctgggacgccagctgcgaggacggcgcggggnnnnnnnnnntgtgccggtggaggcgtcgtcttcgatggccaccaggccctcggccgggctccacgccgcggggccgggccgcacacagcccatggccatccttctgccccggcgccgctccgtcgcttgggacgccagctgcgaggacggcgcggggctgggcgcctttgccttcaccccgggcacggcgcggggggagggcatggccagcagcggcatgttccggcgctcggtggtgctgcagcccacccaggcccagctcccctgccccagccccttccagagcgcgtgcctgtcgacgctcagcgcctcccctcccttcctgggccaggcaccggcctcccctgggccgggctggagccggggcgggctggcgcggcacgaggaggagggcggcgcaccctcctcggacccgcggacccggcggcggccgctggcacacacccgctccatgtcggtggacggcggggaggccggacccgcaccgcaccccgcgcggtcgctgcgccgcagctcctcccgagcgctgacggcggggtccagcggcaaggggcggcgcacgcatagcctgcgcgggtccagcccgggggccgagagtgcctccagcagcgccgcggagggcagcagcccgcgcggtagccgcccctccagcagactggtgtgtgtgggggggggtcgattgtgatgggaggaggagtgggttgtgggggcgccacacggtgggaccaccaccgtccagtccacaggggcatcctgcatcttgcataccaagttcaggcaatggcaggacctgggcacatgttcctcgcacaagcgcgcgcgcgcgcatggacgtccagagcatgagactcactccgcccccagaacccaggcccccccccccaaaccaaaatcccgcaggcgaacctggcgcggctctcgcaccgactggccnnnnnnnnnnggagtaggagtgggttagtgggggagctacacggtgggaccacgaccatccagtccacaggggcatcctgcatcctgcatatttaggtcaggcaatggcagaacctgggcacatgtttcccgcgcaagcgcacgcgcacttggacgtccagagcatgagactcactccgtccccagagcccagggacccctcccaaacaaaaatcctgcaggcaaacctggcgcggctctcgcaccgactggccagcgccgtgcgagggtgggtgtggatgggcgaccttgtggactgggatcactgccaggcaccccgtgctgccagtggaagtgcagctccagcccctttggcatgacgccccagcgacctgagccgtgcttgccactgcgcgcagggtccaggacatcgaggtcctgcatgtnnnnnnnnnnaactgggatcactgccgcgcaccctgtcctgccagtggaagtacaccaccagcccctttgccatgatgccccatcaccctgtgccgtgcttccccctctgcacagggtccaggacatcgaggtcctgcatgtcgcggcgggggagaaccttggcacgtcggacaacatgacctcggtgctctacatcgagtctggggagcttgagatcagctgggaggcgcgcctgcccttctccctctccgccgtgctgggccacgcgctgcgcaccaatgagtccttcagcctggaccatgggctgtcggggcccatggactccaccaccatcgacatggacatcggtgtgtggcgtcgggtggtagaggcgggggagggggggtccggagagtgtgtccatggaggaaactttgtctgaagcgtggtgcagggccatagagtgcgtgtgcagggaggggtcccaggtgtgtggggcagggctcccacacatggggctagagtgcgacggcgtgctcaaacatgggcgggctgtagcgcgtgtcactgtgtggtagtgccccacggttgcctctggccctctttccaggcatagcctcgcctccatcgctggccctcctgcatgcatgggcccctcgcgctgtcgaacctctgatcccaccaaacacacatgcacatcacccatcaacccctctccccctgccccacactcatgtctctttgcagagcagctgcagaccgacgcgaggagcatgacgctgacggggacggtgcgggaggcggcggagcgcgcggcgctcctgctgcgctccgccgccgtgccgggcgccatggacgacctgctcgtcacgcggcgcggcccgcgccagttcatcggcgcgctgggcatgctggaccccgccttctaccacgaccgctggaaggcctcggccgtggcgctgacccccgtcaccctcgtccacctgacggcctggggcctggagcggttcttggagcagaatccgctggtgcaagtgagcatgagaaggggggagggagggggattttgataggtgtccttggggggcaatgggttgacggatggaaggttgtatgcggcacaatcgctggggagttgacggcagtatggctcgcgcgaaagcgtggagaatgatgnnnnnnnnnnatggcgctgacccccgtcaccctcgtccgccttacggcctggggcctggagcggttcctggagcagaatccgctggtgcaagtgagcatgagaattggggagggaggggaactttgataggtgtctttggggggcaatgggtcgacggatggaaggttgtacgcggcacaatcgctggggagttggcggcaggatggctcgcgcgaaagcgtggagaatgatgggtgcatgtgttttggaggccgtggagggtgcttgtccagtccagggtctaggagatggggcaggggagggcttgcccgcctgcgggccctcccccctcccccccccaaccatgcagccgggacagtgagccgggtcgcctgcctccagatgtctgcacctgcatccccctccctcatctgccctggctgccaggtgcacctgcgtgccagnnnnnnnnnncaaaccatgcagccgggcagtgagccgggtcgcctgcctccgaatgcctgcacctgaatccccctccctcatcttccctggctgccaggtgcacctgcgtgccagcattgccctgacccaggcggaggtcatcaagctggagagcttggagaaaatcgcggagtgcatgcacacaacacgccagcgcaccgtcgagaggaggctggatgctgagggtcccaaaccaaacgagaaggctgactccaagatcgaggaagacgcggaaacggtgaggatcctgcggaggatgttgccgggaaggggagagatgcaggagacatgcaggggggagggtctgtacagctcgggctccccgtgcacaaggtccagtggcaaggatgctgtgcttgctctccacctttacgccacacatccctgcctcctgccccccgccccaggcgccggccaacgaggagcatgacgccatgctcgacaggttcgcggtggtgcactggctgcgggacaccttcaacaccctggggcaggatgccctgagcacgctggggctgacgtcggatctgacgcctgcattacgctcctcgaaatcaaacacaatgacgtaaattgaccacgctccgctccgctgcgccaatttgttgcttgatccagcttgtcagccaccaagatgtacacagcgagggctggcgccatacgatggtcaaaagggacatagtaaagttcgcgcgcgctcgatctccgaaggcccacgatcagtccatgccatgccccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggctggtcttcactcggcgggccctacaccgcattcccgagctcctgtatgacctccccctgaccnnnnnnnnnnaaaacacaatgacgtaatttgaccaggctccgctccgctgcgccacttgaccctgcttgtcagccaccaagatgtacacagcaagggctggcgccataggatggtcaacagggacatagcaaagttcgcgcgcgctcgatctccgaaagcccacgatcagtccatgccatgccccttgggggttcgatctgcaacatgcgcacatatcctaaacgatattttgtaacaattccgaaaatctaatctgtgcatccaggggctttgtgggccatgtcgacctcgnnnnnnnnnntttcgatctgcaacatgcgcacatattctaaacgatattgtgtaacaatcccgaaaatctaatctgtgcagccaggggctttgtgggccatgtcgacctcgacggcctgcgtgtttgttttgctcctgtgcatcctgccgatgcacctcaccgcggcttcggagttctccttcctggagcaggcccgggaagacatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggacggcggccgggtccggagtggtgggcacgatcggcaccgggggcccgccctttgtggcnnnnnnnnnngattggctggtgtccactcggcgggccctacaccgcatccccgagctcctgtatgacctccccctgaccagcgcagcggtcaggggctacctggacgagctgggcatcccacacacgtgagtgccgcctgcatgggctgcggtgttgcaagggagtgcaggggggtaaatcatgggtatgggcatggaggtcccaggcgatccagtgagccgacacccccataggccagcggccgggtccggggtggtgggcatgatcggcaccgggggcccgccctttgtggccctgcgcgccgacatggacgccctgcccatcattgaggccagcggggtggactttgcctcggagcacccaggcgccatgcacgcctgcggccacgacgcccacatgacgatgctgctgggcgccgcccggttgctcaaggccgtcgagcatcgactgccagggaccgtgagactggtcttccagcccgccgaggagggcggcgcaggcggggagcgcatggtgcaggagggtgagggcggtcttggggcagggattttgtatgctgggaatcagtgcggcacaagcgctacggcctgggtgccagcctgccgaccatcatctcattgcgctctattgaatcccagcgccgctgaccaacaccccctccttcccgcattccttgttatctgcgcttcattctccaatgagcccccctccctttccagcatgcacacatatacacccccataacactcccccccctccccccccaaaaaatcaacaaaaaggtgtgttccaagacgtcggcnnnnnnnnnnaggtcttggggcggggattttttatgctgggaatcagtgcggcacaatcgctacggcatgggtgccagcctgccgaccatcatctcattgccctctattgaatcccagcgccgctgcccaacaccccctcctccccgcattccttgttgtctgcgcttcattcttcaatgagcccccctttccagcatgcacacatatacaccccnnnnnnnnnntccccccccctttccccccccaacaacaaaaaggtgtgttccaagacgtcggcgcggccttcggcttccacgtctggccctccctgccctccggcggcgtgtactcccgccccggcttcttcatggcgggcgcgatccgctttgagctggtcgtgcgcggccgcggcggccacgccgccatccccgagctcctggccgaccccgtcgtggccagcgcggcgatcatcaccgcgctgcagacgctggtgtcgcgcgagacctcgccctttgactccgcggtgctctccatccccaagctggtggcagggcggggcagggcacaggcccacaacgtggtgccggactccgtcttcctaggcggcgtggtgcgcgccacctccgacgccgccatgcagcgcctgcgggcacgcgtggcggaggtggtggccgccgttgccgcagcgcacggctgcgtcgccgagctggactgggccgaggacgccacgccttactacccgcccaccatcaacgacccggccctccacgcctttgccgacggcgtggcgacggggtgggttgggttggggggtgtaacttctatctttgagggaaaagtgaagctctgccagccaggacggccccgccacaagaccacagcccccaaatcaacaccnnnnnnnnnntacttctatcttttgggggaaagtaaagctctgccagccaggacggcccgcccacaagaccacagcccccaaatcaacaccctgttacaccccccaaaaacaacatacaggctgctgggcgccggcgctgtgggagagtacgagggcaccatggccgcggaggacttttccttcatcgcgcgcgccgtgcccgccaccttcatgttcctgggcatccgcaacgagaccctgggctccgtgcatggcctgcacaccgaccagttcatgatggacgagagcgtgctgcccgtgggagcggcgctgcacgccagcctggcgcggaagtggctggaaagggaggcagcggccaccgccccaccagtgcaggacgagctctgactctcctaagggatttcttgagctccttggcagtgtgtggaaannnnnnnnnntcggccaccgccccgccagtgcaggacgagctctgactctcccaagggttttcttgagctccttggcagtgtgtggaaacggtgatgggacggcctctcagttccacgcgcaagcatatcccgtccaggccagcttccagagcatggctgccctggcgctctgatgtctggacgcccacaccgtgctaatttatgtccttatgccttgcaaaaagggcgctcgtcatccgcgccacaatctataccgtgcctcnnnnnnnnnngtgtctggacgcccactccgtgctaatttatgtctttatgccctgcaaaaagggcgctcatcatccgcgccacaatctataccgtgcctcatgctgagattgttgtatgtacactgaccaggagccctgttctcaagtgcacaacaagcacaagggtccaggcagaggtgctgatgtaggggatagggggacgggctgcagccagccagaggtaagaacctgctggcagccatggattcaacatcannnnnnnnnnatgctgatgtaggggatggggggacaggctgcagccagccagaggtgaaaacctgctggcagccatggattcaacatcannnnnnnnnntcggcctgcacccatgaatttgtactgcggtcgcagattgtactaggcactgcacctccacccaatcgagcttgccagccctcggcctgcttcgagcnnnnnnnnnngcatgcctgctcccatcatcactccagccccgctactccacttcttggaggtagtcggacacctcggcagcggtgaggacgcggaagacccgatcctcacccacgatccccacctccacggtctctcccgtcagctcgcctgcggagggaaggcgggccagggtgggcatcggtttgggggctgagagggtggtgtatggccggcctgcacccatgaatttatactgcggtcgcagattgtaccaggcactgcacctccacccaatggagcttgccagccctcggcctgcttcgagcctgggccaaggcctgagcttgaacccaccctcaaagccgtccttgagcgtgagcagggcggtgtggatggcatcctccagctcgatgtcctcgctgtacctcttctccaagaatgtgcgggcgttgatggcgttcttgccgatggctgacgccttccaagcaaagtaggagccggaggggtccacttggtacagctgcgggccgttctcgtccaccccagccaggagcaaggaaacgccaaagggacgcacgcctccagactctgctcatttgggggcggttaatgaggaagagggatctgaatggcgttccaacaaaggcgcagctgtgctgacacgccaagctcaggcggcccgcaaaccacgccccaaggccatccccccagcactcacgtgtgaactcctgcannnnnnnnnngagctgtgctcacacgccaagctcaggcgggccgcaaaccacgccccaaggccaaccccccagcactcacgtgtgaactcctgcatgacggccgctacctctcgtaccagctgcgccacaggcatctgctcgtgatactgcctgtagtaggtctgccctgccttcctggccttcctgaccaggactcgggagtcgggccccatgcccgcataggccaccccgagattgggagtgagcagggatatcttcttcaccgtttcctcgtccaccagtgtagagggcaatttcttctccgtggcgatgaccaccccgttgctggccttgatccccagactcgtggcgcccccgttcaccgctgcaagcgcatactcgatttgaaccagcttcccactaggactaaaggtggtcagactaaaggagtactgcatggggaggcagcgcgggagggagtgggtgcggaaaggaaccgatcacgctgtgacgtccaaggcgcctatgcggggtcccacctgagactcccccattctgctgatccagaaacgatataagcgaaggggctggttccagggatgggacgatggccgaggatagatctacagtttatttcgctgcctgtgggtgtatgcaattctcgcaggcctacaccaaagggatcaacgaggctgatttggagggcgatctgcaattccaggaatgctccatgccaggtgagatgctcccgattggtccgtttgctattggcattcattccgacggtgctcggccgtggtgcgtacccagaccactagggtaccgtgcacgatggcagatcacatcgccataaaccgaaaatcgtccccagctccaagacggaaaacctacccctgcatcgcttgccttaccaatgtgaacaagcgggcaaagtctcaacattnnnnnnnnnntgccataagccgaaaatcgtccccagctccgagacggaaaacctacccctgcatcgcttgtgttaccgatgtgaacaagcgggcaaagtctcaacattgctgaggtacagggtatgacgggcaccacacttgtcgaaactcgggaaggagagcaccccgaggcgacacccagcggccccgtggagcagcacacctacttgccattccacattcggtttgatgggaaggatcgacacatcttcgaggtgatttgcatgtgaacgtgatgaggagctgtcgatgtagatgacgtgttgagccttccctgttgcaaatgttgcacgcaccccaccccatgcaccaacgatggccgataatgacctccaaccctccccatctccagcccctcctgctcctgttggatggaagacacggctctgaggccatctccaagcagctggcccccatcatcatgccagggctgcagaccaacgatggcctgcaggggtgagtgggatgtttggcgcctggggaagtgctactgagcacctcttccatgaacgcttcatcttctcatccaaaaggaaacctccacgcaaaccgtccctggggcagccagctgaagaagcaggttgatcatgcgctgcgggtgcttccaaggaagggcgtgccccatccacacacacatccatcctctccaacgtcccctggggcagcaccctggggtctgcccccagatgtacccagatatctggagatttcggtgcgtgagggagggaggggctctgctgtgcactccatgcatcgagcttcttgtaagggacgtgcttgtcctccgacactgcggaaccctgtcatgtatgattcctgaaccggattgccgccctgcacaatcccttccctcagctcacggtgcccctgggcagcaaagtgttcgtggaccggttggtctgggacatgcgcgccgccgtcgatgagagcaacatctatgccagcacagtggctggggatctgggcttgccctgggtgtccgctgccgtcatctccaagcggctgaaagagatcttggaccaagtgtggaaggtgaggcccttgtggcaaggcggaggaggcgatgtaaggactggtggtgggagctggtgggaacaactgtgtctgccaggtttgccaccgcacccacttccttgcccacggcctgcatctggatcagttgccgacaggtacgcatgcttcacctcaaaccctcacaggatggcttggccactccaggcgtcgtggcacaggacccgagtgcagcaccccccatgaggtcagcagccacttcctggccctgcctcgtgacacgtgagaagtttgctgctgctacgcaggggagcaaaccggtgacgggtggcgacgggcaggaggagggcgcaggatcagagcacacgacgaacaaggaaaccattgagcacatggatgtagacaactgaattgaataagaatgctggtttaacccctgttgagaaacaagacagtcccattctcacaatcagtgggtttgtaaggtcttcatcatgcatgcatataggccaacgtgtcggctggcggtcggggcgcgagtgcgtaggtttaattgaaacccgaacggcgacgagttgatggcattcaacaggaaatagatgcccggactgttttgtagagatccagcgccattgagatgacgagcgctgtcgagacatgcgtcctggcgaacgccttgccctcttccctcttacagaggatacaggtgcatttgcgatgggccctcgctctgactgctgtggcattcacgatgttcatgctccccgcaattccttcacgaatttccactccctccagagcgatgcgaaggcccnnnnnnnnnnttgctgtggcattcacgatgtccatgctccccgaaattccttcacgaatgtccactccctccagagcgatgcgaaggccctggccgccagccccaactattggtttcccttggagtgcttggattcgccagcaaccgcggccgaggaggcagcggctcacctgtaccatacatgtatagctgcaaaggatgtgaaaggcgtcgtaggcgccgaatactgggttcaggcaggttcactggcccctgggaagacagcagctgtgcttaagactttgggtataccatacagccctgagggatgcagactccatcaccctctgcaccccaacatccctgacaacagatatttgagaagggacgaggtctcagctttcacatggacaaggtttttgtaacagttgtgggttggaaccggcgacctatgatggtgggcagagagttccnnnnnnnnnnggcttccacatggacaaggtattttgtatcaattgtgggtttgaattggcgacctatgatggtgggcagagagttccaagagaaaacacctcatgtggacgacagcccaggccaagagcaccctccttcaatctcattgatgactgttaagcacagcgccctcagccagcttccttctggcggtctgcacccacaggacgagcatttgatggccaacgaggggcggctggtgacccccctcatctcgtcagtgctctacctcactggcacagcacagaacccccagcgccaaggtgtgtggttgaggggtgcacccctccctcctgtggcccaatgcaggcgtgtgcatgctcccgctgggaggatggagacgcaggtccgaatgccctgtccccctgcaccacatgcctctgcagggccaactgtcatcctggaccagaggtttgatgccgagctgggagcggtgaccccgcccagtcccgcctggagcacgctctccttccccctggcaggcaactactgcatctttgatggcgcgctgggtcacggcgtgctggacgccggggacgaagcggagatgcgggccactctcttaatcaactggtggcagcaccggccggaggcggtggggcgagcgccgctcatgcctgcgcaggccgaagcggccgagggcggtgacgccgggcttggcagcgatgccagatggaagctggccgatctctgtcttggggagcgcgctcttcccatccccagcattgccgtggacgccgccaggctggcaggggaggacgacatgctcctggtgagttgcctggtgcgggccagtccttaggagtctgccgcggctgcccttctgtgaatcctgacgtgtctgcatgccaggacaggcacctaaactgccagctccacattagtcaacccacccccccctccccccactcacagccggacaatcttcttgcggagaatggggtcgcattgcatgggccgggtgccgtgcatgcggtgacctttcaccaccagggcctcagcctttgtcccattgatggtggggaaggactgagcatcgctgccgcgctggtcttggctcaggatggggagagcagctctgagagtggggacgaggaatagttgtggagggattcgcacctgacgctggagagtgacctggtgggcggcgtgcgcatgcaggctgccgcgagtatttcctatcctaataagatgnnnnnnnnnnccggagagcgacctggtgggcggcgtgcgcatgcaggccgccgcgagtatttcctatcctaataagatgaaacataagaaagcttgatggcccccagattcacgttgggcattcgaggagggaacacaatctgtgtagaaataatctaggttttggccatggggtagcagctgaacatccgacgcgcgccgggctccctgccgagtgacttccctcctaggcaccagctacaggcagatcgtcccgctcgcgtatgcatatcctctgataccgctggcacgaccaattcggcacaaccgccctgcatcgccaggtggagggactaggtcacctgtccaacctcccgtcactcgctcctgggctgttccaccggctggagggcacgcgaggctgccaacaaacaacgcggaactctacatcctcccctgaataattgaactgcagattagtcgccatggtcaagctcactgccaccatgcttctcaagttcatgggcgcagaccgggacccggtgctcctgggctccgcaaccgacctctcgtccttcggtttttttcagcgcagcaccgtgcgggagatgctgatcttcgtgtcccgcaccgtggccaggaaaaccgcgattggagcgcgacagagcgtgcagcatgaggagtaccttgcccacgtctacaaccgggacggcctggtggccgtggtcttcactgatgccacctacccggcgcgggcagggttctgcgtggccaatcaggtcatagacgacttcactgcccaggatggggattcctggcgaaggaacacgagcgatgtggagacggggaacgcattgctggaggccgccctccaaaaataccaggtgtgtcaaggcctgctggcaattcggggtgtgaggccatgaggcccaggatcgannnnnnnnnngggaacacgagcgatgtggagacgggaaacgcattgctggaggcagccctccaaaaatatcaggtgtgtcaaggcctgctggcaattaggggtgtgaggccatgaggcccaggatcgagagtgtgctctgcaagatatccctgagcattttgaatggttgggtgggctgagagtaggcatggagctgggtgagtcgcttgtgaaggggcggttggcgtctcatttttggagagattcctgcaacgcgcggctgcataaggcgctgcgacaatgcctccctccactttgcgattctcaggatcccacagcagcagataagcttgccaagatccaaaaagacctcgacgagaccaagatcatcttgcacaagaccattgagagtgtactagacaggggcgaaaagctcgatcaggtggggagagatgcaagcatgcggttttcacttattgtgaagatagacaagccaacaaatgagcagacaagcgaggaattcagtgtccgtgcaccgctctcaatatgattcgtcaggagggcaaggtacctggatagagttgccaggctatgtaggggttgtttcctagattctcagcttctctcattcaactccccgcccccatcgagcagctggtggagaagagtaatgatcttggaatggcgagtcagctcttctacaagcaagctcggaaggcaaactcctgctgccgactcatgtgatcgctcctcatccgctctgtggctgtgcagtgcaaagcagccgcacatgcctgccgacttgcaatttattgccttgaaacccctcaagcattcctgcttggcgcacctcaccgaccatgccatttgactctgtagaccagcactctgcacccactgcggaatcgaaggagcaagagaattatctcccactaggttgcatgcggtgtacacagtggcaagctgagtgacatgctggcgaggcacaggggcacactnnnnnnnnnncaggttgcatgtggtatacacagtggcaagctgattgacatgctggcgaggcacaggggcacactgagctaggttctgaggtggcttcagaaaagggaatggtatgttgtagttgctggacgctgcaacttatcatgaatgtgtgccttgccactccatcacacccaactgctcggtcaggctggagagtacaccttggcattgggcgccatcagggaccagaggggatgcaatgcgattttggacgcatgggctgctgggatggccagttggatgagcagccctgttccaaatcccagggctggcttgatgtaggcgaagcgctcgaaccaagggttggtgaatccatgcatgtatttgagcttccctgccccgaagtcgatctgagagggtgggcaggggatgcatgtgagagattagatgggcagagaccaaccaatgcagcttggcagctcaggcagagacgagggaacgcatgggcactgaccgatgcagcctgcaacaagcctgctccttccaggaagcgatgccccagtcgaggcccgttttcccgccgagggcaacgtccaggagcttgcaatggcagccgcaacccacctcgtggaatgggtatgcggtgacggcggagggggcgcaggtcttcagggagtctcccttggcgatgaagttggctgccagcaggggtctgggcagggatgccatctcctcctgctcgtgcagcgcctgcagcgtcccggtctgcggggttgggtggggtggtggcctgatccccaggcaagggggtgctggagcttccaggggtgcctgcatgaaatacttccggctacggcctgtcattcatgcaggcatccaaccccgcccaccacgtctgctcgaaccgcgatgagccgacggcggatgaggcgggcattgatctggacggccgcctccagagtcgaggcttcgctggcccccgtcggcatagccaggccgctcctggcgtcctctgcggcgaggcggacagggcagagaggcgatggtatgttgcggtgtgggtgcgcctgccacagcctgagtcccaacttgagcccctgggcgggatacatcggacattcccttccccctgcatccaaccccctctccacccaccgggcgtcagccccggcacttgcaggatctggatcgtatttcccatggctcgttccagctggtgggccaccctaggcgccagccccagacgggcgtgcaagagctccacattcacggtgagcagggccggggcccgggccaccagcggcttaccccccagcgagttcaccagcaccgccaggaaggcctgcaccgcgtcgaggctggagacgggcgggccggggatcggcccgccgcccgccacctccctgatgcgctccaccgcctcgcggggcaggtggatcgtgtgcacgccctgctccgcggcaacaaagcgccagaaggcgcagggcagggacgcccactgcgccggcgtgagccgcgggtctaggcccgtgggtttccagccgggggggggcggcgggagggcgggacgcagggcgtcgtagctgcaggcctgggtggtgccagccaggggcgtgcccagtgtcccgcggtacaactcagacaggcggcggaggaggtggagctcgtgccggccgtctggatgggagggggggtggagagggggagtgcgctggtctgtctgtggtggtgagaggggtgtccagtgcttctgactggcatccctcccttcctgcccctgcatggaccaaagcagaggaagagatgtgatgcccccccctccccccatcacacacgcgcctgccaccaggtgggagacggtgatggagaggatgtccccattgctgcagctggtcaggcgcagcttgagcaggggcccaccggcggcgctgcccttccccgagatggggggctcggcgaagaagggtgccggggtggagaagagggaacatcgcgccatcgggcctggccaggtgggggggccgaaatcctggatcttgaggtgagctgggacctgcaaaggatgaatgctcttactaaagaagaagccgaggtggggcaccaatgccttgcataccggcagatatgaaggctgccagcaggcaccattgtcatgacgcatgcccccaagctcgttgcactctccgcaggcaccttggcgtgcgccaactcgattccagcattattgcagaggatggccgtctccctgtgtggctgcaaccaccctgtgccagtcaatctgcagggggtgacactccaggtaatgcaggggcttgtgcatgtgccgctgcgaggtgcctgccaacgccctacgaagcgatcccctggcatggctgagcgcccgaggccatgggagtctaccaacatgttgcaaccttgaggcctcatcaccttcctgcaaggtaagggagctctggtaggagcttggtctctatgcagccggccagcctgtcggggtcgatggctgtggatccctgggagccatccctgcagaagaaaagggaagtgctcacgctccaggccgccgtcagctggctgctggcattcgtctggagatggagtggttgtgagtgtgaatcaatggccaggtatcttgaggctggtctagatgctgtatctcataaatcagggcataaggccagcgatctccaccaaagcagtccagaagggcaccttcacgatattgtgagcgcgagtggcctcatggtccctcgcacgcaactcgcggcgatagacttctgtctgctccctccatgccacatgctcctccgcggtgnnnnnnnnnntacgatattgtgagcgcgggtggcgtcgtggtccctcacacgcagtacgcggcgatagacttctgtctgttccctccatgccacatgctcctccgcggtgatcggcaatttgtgtagtggtacggcactccgtgatgaggacgtcagacatgctcgaaacacatgcgcgtatggttgactttggcgacatctgcattgtaggacagcgcggcacttctcggcgccgagcacgatcgaggagtcgatagcttaattgggactggcatatatatctgctgcaaaatctcgctcggcgcacctcgcgtgtgccgcgcgagagagtcgatgccacatgcgaatttgagtgcagatccccaccacgccttggagggacgagttgcagcccgaatgagtatgactgcgttgctagatgcagaagatcgactttcgcatattnnnnnnnnnntgcgcgagagagtcgatgccacatgaagtgcgaattcgagtgcagatccccaccacgccttggaggggcgagttgcagcccgaatgagtatgagtgcgttactagatgcagaagatcgactttcgcatattttctatatcatcagggtttaatctcgaagctcatgtcggacaggatcatcttgcgaaatcgacggctggtattccagagtgctctcggcagtgacctcgtttgaccgtctgcttcctgggtgaaccaaagtgtcctgcccatccaccaagatcttccatcggtagcttaaacctagcaaattgttgagcagtgcgcgagtcgttgaggagcgtcagcgatctacggcagttgcacatggacacatcacatcgcgaaatcagcacacatacaatgaacccaaacacttgtgactcttgcagagtgcagcacggtcctgtgcatgcgctcatgttctaggaatgtcgatcgccagctctgaggcacgaactgccagctccgtgccagatctgactgcctcagtgcacataacctcgaataaattcccagttaccctgtttgatttccatctgtcgctggacgtcagcaagtannnnnnnnnngctcaaataaattcccggttaccctgtttggtttccatctgtcgctggacgtcagcaagtagtttgtcccgaaaggggcgcaggttcgaatcctgccgttgtcgtgcgccgtgacaacgtggccgagtggttaaggcgcaagcctgctattcattccagaccttttggagagccgcacaacatgcagcagggttcagacaggcggcccagctctgggcagggccgcatgcagcgccgcgccggactgcttcgtcagctccctcaccaccatggtggcgtagnnnnnnnnnntggttcagacaggcggcccggctctgggcagggccgcatgcagcgcagcgccggactgctttgtcagctccctcaccaccatggtggcgtaggaggagggagccaggctgaatgccagtcgcagggccaggagggcgcccccaggctctactccctgcccctccgccaggtccgtgtcctgtgcagagtggcgcagcagctcccactcgacgtcgcccggggaactcagcacgaggcggtacgcccccgtctgtcccgcgagggtgaaccccgcagtcccatgcgctgaggtctccaggctcaggccgtcctcggccagcaggcgggcatactcctagacacagtggcgcaggagtctttggagcaagccttgaatgtgtgcagcgttgaggtggtgnnnnnnnnnnatggcgcaggggcgaaggagtctttggagcacgccttgaatgtgtgcagcgttgaggtggtggccagagccggcacatggtaaggacggtcatacaatcatgcacccagcaccgctgaccctgctgctctgtcttactgcagccactgacctcgccggtggcattctcaggtagacggacgctgctgcctggcagcgggaggagcaggtcggacatggagtatgacctcgtgtccaggtcctctgctgaaattatgtgcaccgcctgcaaagggtggatgggtgggtatttgagtgtgtgtcaacgaccttcccagcgcatgtctgcacacaaggaagtgnnnnnnnnnncgtaattatgtgcaccgcctgcaaggggtggatgggtgggcatttgagtgtgtgtcaacgaccctcccagcgcatgtctgcacacaaggaagtggggaaaacgtgcaggccagagtagaatttctaccatgcccaacccaatgcctcaccatgttggcaggggcggccgcctcctgtgcgtttgctccgggctctgtgaactccactccattctcagaatggaggggcacctggtctgtgctgcccacaaactcttggctgccatcaggcccacccgcaccggtcttgctctgtgccaccaggtctccgaccagcagtgcactcctggactggcgcagccggaagctcgccactgagttccagaggtaagactggtaggcatgaatgtacatggtgcgcaggttccgcgggatggcttggactgctgtgaggtagttggtggcgccatgcttcagcagagcctgtgggatttggggagggaagtgaccgggtgtgatgaagcagtcagagtgcgcaggagtatgtgcacacaattgcctggtgacgctgcgtctgtagagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaagtaccctatccctgtaagaccacacccatgtgccaagcccatcagcacactgaaatagggtacctggagcacagctgtctcagcaactgcaaatccgggggtgcccctcagcgcgctcttgnnnnnnnnnntggaagatgacatggcagtagcttccagcaaccacaaagcatcattgaccaggaagctggcatcaaggacgatcctttttaactaggtattgcctnnnnnnnnnncggaagatgacatggcaatagcttccagcaaccaaaaagcatcattgaaccaggaagctggcatcgaggacgatcctttttaactaggtattgcctnnnnnnnnnnnnnnnnnnnnnnnnnnnnnnnnnnnnnnnnntgctgaaatagggcacctggagcacagctgtctcagcaactgcgaatccgggggtgcccctcagcgcgctcttgacctcttggaggctggtgggcaggacatccggaccggcccgaccaaggatgctggcgacagccctgtcccactgccctgccaacagagccctgccaatggcatgtgtcgggatggggccgctgccaaatcgctgcaggccaaagtagtttatgaagccagaggcagcgagggctgtgcacgccgccttgacgtcttcctctgcatcaggtgggagccccctgagaatgagctcaaatctagaatgggatgggaggaaaggttaggtgagccaggtttgctcggctggctgggcacgtggcatccaggggcaccctcgcaatcgatcggggtacagaactcgggatgtctcgtgttgcaatgcaacccaaacaagtgatctcacagcctctcaaccccagcctttaccaggcatgcacacacctgttgccccccagttgacccaggtgtagctcctcgtcagtgaaagaaaagtcacccacactgatgccccgcagctgtttggcagctgtggccaggcgcccagggtcgaccctgaaggcggtgacttcttggcaggtgcagcccctcttgtccttggtccccgcaatcccaaacaccttggcggaaacatgcagcttactgcctagcagagaaagcgcggcctggggggaagtgttggacgtgaattgggtgtggagggctgtgggcgtgagacctgtagggctgcctcaagtcaagcctttgccacactctgnnnnnnnnnngcgtgaattgggtggggagggctgtgggcatgagacctgtaggggtgcctcaagtcaagcctttgccacactctggtgctgttgacagcgtcggaacctcctccacttctgtcagtgtgggtaccttcacactacataaacccaaggccagcattcccatgcacatccccttcccgcacaccttccccacccacctgagactccatgttctccttgtacatggtaaacttcacataccgagcgtcaccgccagcccactcactgcgcctcctcttgatccccttgccaccccccagaccgagctcaatgctgccctcggctcctgtctcggtcgccagggtcggccaggccttgaaaattccgtgcaccgcagttcgttgcgccttatcctgaaaggggcccaggtgaatgcgctccgagggaggaacctgcgcttggggggggggcctcgcgctttgtactgggcttctgctgagatcagcgaccacctcgctgtnnnnnnnnnngattccgtgcacagcagttcgctgcgccttatcctgaaagggccccaggtgaatgcgctccgaggaaggaacctgcgcttggggggggggcctcacgctttgtactgggtttctgctgagatcagcgaccacctcgctgtcctgcacgaggtttggggcagaatgaaccaaggggagcagaacccacatccatgaacaccccattctgagcacaagatgccatgccaccactgaccgagccattcttgacgcgttctaagaagtcaaggaggtctggtgaagcgggtttgcccgtcgcagactccaacttctggatgagctcctgagcggaacacaggggcacctcacgagcctctgccgcctgttgcaaggagacagcgttaggtgatggcttgcgatgcggtttacttcccaggccagagaattgggcttttctgggcgctctgcccatgcttacagctgcatgcaaatacggctttgctaaatggttctggttctgctgacaggagatgccgtggacacccaactacatgctgaccttggggacggtggtgtcgaccagtcgcacgacgcctccatcctggcgaatctcattcacgcgaaaatcagagtacctgaggaatggatgcaataagcgacgggagctgaggggcccctgggcagagtgctgtcacaggatccaaatccgctacagcccgaattacctgtgcttgagggtggcggcgaagccctgagcatcattcgcgtatgcgacgatgcccacatcggcctccaacaccattaatgtgggagaagctgtccaggattcctcgttacacctcagtctcgtaaggcggcagccggcaatcgctggtccgaaggggttaccagcctggattctgggtttggcaccaacaagcgggctgtggggtatgcagcagacagtactcgaagactggtggaaaacagcgagtctcattcaaggtggaagtatctctgtatatacatggaaagcagcgtcgcgaggtccttccgcgaacttgcataggaattatgactaggccattctttccgacactctagtcagggtcatgtaactccactgggtgctcacacctcaggtcaatgccatgctgctcagaatcccagtcgggacttgatggctatcagcagatctggatgctttagcaggaggctctgaaggcggactgggtctcggaggagtgcctgtagcaatggtgggcacagtgaggttgtagggagtatgcggatatgacagtgcagtgggagtttggagcaatgacaatgaagatgtggcctcagcagggcgagaacatttggtaaggatttcagtagtctggatgctgcggacacaagtaccctcaacatgccacacacaggaaaaagactccttccaattcgaggctccaatcacactcaccatcgccgcctgggggtctccaagaagctcttcaggtccaggtgcgggtcccactccatgcaaaacgctgtcacgcggctcaaaagctgtcccttccggcaatggagacgtcctgggcatgattgcaggcggctgtggccgctcttctgcaccccgtactgccacagggtctcctgctgagccgggcgaggcggccctgctcctctccgaactgaagtgtctagtgtcctctggctgcccgcccgtccttgccacaggcaccacctccttggcagagcctttcgcgatggcatctgtgttcgccacatcagcgggtgcgccgcccttctttccctctccactgcccgccagctgccaggacaggtattcacggggcggggagggtggggccgccctgcaagccaggcggcccagggggcagggcgcgcctgcccggaaggtggtcacgccgtcttcggccccagcccccagcgcacacgtatctgccatggggcgcgtgtcgaccttgacgaggcgctgcgccgccgcctgggcagacaacgccgaggcggggacgacctgctttattcagggaagtgcgagagacaaggggtaacgtgaactggtcatgtgaagcaggtatgcagcgtcctgccttggaaatttaaaggtatccgtttttcccatgcagctcttcacaagatgcgagccaagagacggcatgagtacaatccccgacccttgagcccctttgcagtcatcgcacccgtgccgcaacattattccagaacaggacgaggaagggatcttgcacgaggaagccccctgaggcgtcctctggcctccatcccggcacatcggagtggggaggctgggcctgcacgcagatcatttcgggacatgtcaacacagagcctcatcggcaacttgcagctgcatctcagccaacggcatgccaccagtcgcccttggataggctcagagctgacgcaaacacatgaaggagatccagcagaataagccctacagagttgcagtgcaagaccacctcacaaaggtttatgaaaggcatttgcccaaccaggcattccaccctccacaaattcgcacctgcaaagccgcctccagggctgcatacttggcatgagcgggctgcatcggccactccctgtcctggtcatatgtctcacacagctcctggagaacaccccggtccagcagcaggccctccgccctatcagccgcccacttggctgccaggcccaggcgcgtacgggcgtgctcgccagcggcgctagcctcggcgaccgacgccgcatgccgcgccaccagcgcattccgtaagcccgcccgcccgtgctccgaggcggccaggcagcgcatcacgcgccgcgccagcgcccccgcatcggccccctcacgcagcgcggaggcatgagtcatcagcaccgccgccagcgccgccgcgtccccggcgcgggggccgtcgtcagtgcgctcggggggcctgtggccaaagccaaggccggggttgcacagcagcaggcaggcctccagagtggagagcaccagggccgcccgctccggtnnnnnnnnnngccgccgccagcgccgccgcggccccagcgcgggggccgtcgtcagtgcgctcgggtggcctgtggccaaagccaaggccggggctgcacagcggcaggcaggcctccagggtggagagcaccagggccgcccgctccggtgccagggtggcgggcatgcccgggtagtaggccaggcctgtggaagagggagggtgaaggagacgagactgggcaggaagacagaggccgccgcagatgcgtaccctgacggccagagcactgcacggcgccattccgaccatttccaaaggagcatatggcgagggacccagacccagggctgcacgttgcagcgcagggtggaccccttccccttggagcacacaccacccaactcgaggcccttacccacccaggatcgtggccaaccggcccaccaggcccgcgtccagcgctgctgccctgagcgcagggcggtggagcaggggcaccgccagttccagcaggccccgggctcggtgtagcagcgggccgggggctgtgccaggggcaagggcggccagcccgcccagacccctcgccagcgggcgcagcgcgacctcgcccaggttcgggtgcaggcaagaaagacgggcgagcagcttgcccagcgcggcgcgcagcaggcgcgactcgctggcggtgccgtgctccgccagcagagccagggaccgtgcgtgggctcgcagggcctgtgcatggggacaagggagggtggagtttgctcggaaggtgacgtcgagctcaggcatggagccaccgttgactgcagaccgtagcccgggccggaagtgcaacaagaggctggctgccccctaaagacgccaacccaatcccagtcagcgaacacacagcctcccagcccacctgagccagtcgggagcggagggtgcgctggcagggaggggcgctgggtgcgctgtgccccaccggcagccactcctcggggcagaggtcgcccaggaggcaggtggtcgtgaagagccacgccggcagcttcagtatttgggcaagagggggaagggggggagggtagttccaggtagcagtggggtccggatcaagctctgtgtgatctgagatgctcggtgcgggtactgaaaggcttgcccagctcctgcccgcatgccaaattgcnnnnnnnnnntatcggatcaagctctgtgtgatctgagatgcttggtgcgggtactgaaaggcctgcccagctcctgcccgcatgccaaattgcaacaggcgacgacgcccagcaactggcttcacccccaaccatttcccccacatgccccacccagctccaccccatcagaacggcacctgaggcgcaggctcgggcccactgtcggccgcgccggcctccggccagggctgcagcagtggtaggcctcctctctggctaccaggctccgagaacagggtgtccatgagcctcggcgtccatgcgttctcattcaggagccaggtgcgcagcgccaggacgatgccggcccgggcgcgccgcacgcgacccttcgcctgaccgcctaatgccgccgtggcgctgtgcaacccctcttcgaccctctcctctgtggcccccggcaacagcatcccgaggccctcctcgtcggtcgcaagagctgcgtgcgccgccaggagcgcgcacaacaggcccgggctctccagctcgcaccctgccaggcagggcagcacagcggcggcggccgtggccgcgccctcctgtaaggtcagcgcagcacaccgggcggcgcaccagccgccggggtcgcgcgccgccctccccaggccgccctcccacgctgcggcgcggcaggcctgcagcgcgcgcgtcgcggcgcccagggccgcggataacaggccggcgacgtccacccgctcgccggcctccgtcagcacgcggcgggaatgtttcatgtgcgtggtagaggggccgccgggcgctgacccgggcgcgcactgcaccgccaggcaccgcagcgcctggtccaggctcgcccagcctggaggctcagtcatgaggcggtcgaggctagtacgaggcgaggcaacatcggatgaggcgacgacggacagggctgctgactccaccagatttcgctgggagtcggtgccatcggccccatgccccgccaagtgcgcctccgcgtgacgcaggacttcgggcaggccccggtcccggaccgcgaccagcacccccagccgcaccgagnnnnnnnnnngcagcgcggcagcatggacgcacaggtaagcgcgagtcccagctcgacggcgccgggcnnnnnnnnnnctgcgcctccacgtgacgtaagacttcgggcaggccccggtcccgcaccgcgaccagcacccccagccgcaccgagagctccggcagcagggccgagcccggccccggcagggcctgcctctcaccaggcgcgctggtttcggggccacttgcacgttccgcacccttgtgatccacaccttccccggcagccagcagggcgtccagggagcaaccccagcgcgacagcatggacgcgcaggtagttagcgcgagtcccagctcgacggcgccgggcgatcgggcactgatcgcctgcgccagagcagcgccggccgcctcgccgctcagcgccatcgccagcgcggcggcagccggctggacggcggacagcgtgcgcagcgcgacgactgatccttccgtccccgccgacccgtgctctcctggaccttggtgccagtcgaccaagcgtcggacggcagcgtgcgccagaaccgcctggcccacacaggagtgcagggcaggaggctcccggtcggagcgcgagtggccgccgccggcgatgtcgatcccggcccccgccagcatggcgagggaggtcgggtcggagcccagcaggccgagcgtggcagggctgctggcgagctggctcaggaaggggcgcagggccagccccagcgtccgggacagctcgttcctggcctccagccccgccgacgcctcaccctgcgatattgacaggggtggggattgaaggtgatgagacaggctctctgtggcaccgcgcatcgaggtgggcaaccctcccgcgagaccacaccccaagcatccaagcaccccaagcgcttgcggccccggcaagggacatggctggacacacgcagcacatgctgagccctgcaagttccaggccagcccccttggacctcccacgccgcccagctgcccctcctccacccgggtcggtcnnnnnnnnnnnnnnnnnnnnnnnnnnnnnnnnnnnnnnnnnnnnnnnnnnnnnnnnnnnnnnnnnnnnnnnnnnnngtccccgacgcaccctgctcgccagcacggcctgcgcagccgccggcacgcgcagcaggacacagactgcgcggggcgtgcgccgggcctgcagcagtgtcaccacgccggccgccggcccctcgccggcgcgcagcgcttcggtgagaaagcgcagcgaggcggcggcctcgcccgtcgcccggcccagctccgccacgaaggcagtcgagtcggtcgtcacgggcgcgccctcgtccacgtcagggcgcgcttgccccatctccgccgccacgcggcccgccagcttggcggcggtcctcgtcagcgccgccgccgcgtcggcggcggcgagcagggtgaggcactgtgtggctaggctggcgaggaggcggggctggggggtgaggagccgggatgccaccgaagtccacagcgcgtcccggtcctgctgcgcagcctcccaccgcgcgtcgatgcgggcctccacgaccgcggcgtgcgccaagcgggcagaaacagtgggtcccgaggattctgaggcaagggtgggctcgagagccacggggctcgcgccttctctgtcgccggnnnnnnnnnncgggtcccgaggattctgaggcaagagtgggctcgagacccacggggctcgcgccttctctgtcgccggagactactgcgcccccctgcgcctggtctgacctccctggcccagggccagaccccgccggagcagggatggagaaccccgggggcccctctgcggagggatgcgctgctttcttggactggtgtttgtgccgagtggaggacttgtccccatcgcccaccgaggccnnnnnnnnnncatgcgccgctctcttgggctggtgtttgtgccgagtcgaggacttgtccccatcgcccaccgaggccgaggtcttgctaccggacctcgtcccgtcacgctcgctgcgcctccggctctccgattggtcgtgattggacttggacttgctccggtgcttccctcgccgagctcccgcttgcgactcgcggtctggggaggccccgctgcctggtccgtgcaacctgctggcagcatggtcaccttggtctcctgttcctctgtttccaggccgggcctccaccggccaccccggcgtcggatggtgggtcaccctgcctacagcggcaccggccgacctcgccgccatgatcaccacagggtcctcctcctctggtcgccacctcgtcggcgcggcagcggcggggcgggggaccgccgggcgcgtcgggtgccacatcctcacgccagggggaggggagtggcgggggggcagggggggggggggnnnnnnnnnncgcttcctcctcaggcagccactcgcgctcgcggggcgccggcaccgcgacccgggtggcctggggtgcaacccgcccggggccacggtgggcatcccctgcccgccgctgcttcctgcagccgaagcagnnnnnnnnnntgtgcaacccgcccggggccatggtgggcgtccccggcccgccgctgcttcctgcagccgaagcagagtcacaaaggggtctggtgagtggcaacgctggtgtcttgaacgacccaggagcttgggcctgcctacaatatcgtcagtggcgctgtcttcataccattcattcgtgacagctcccaaggtggcatctgcaaccagaattcttgcctggagcgggcctcgcttgggtctgcatgcgccgcctgcaagcttggctgcggcatggcgcggggccatcctgaaccggacctgtagtctgctgcctcctctgtagacatgaggcaacaatggcaaggcaggttggttgggctaggatacaaatgtgccatgcactttttcgctaaacagcctctcacattcggcatcacactggcacctcccttccacgaggcctcgcacgctgcaccagtgtannnnnnnnnnccgctaaacagcctttcgcactcggcatcacactggcacctccctcccacgaggcctcgcacgctgcaccagtgtacccaccctcccacctgggcagaagcgtatgggctcatgcctgcgcttgggtggcgagggatacccactcgccccgtctacttgggggatggtggcccgcgccgcgagcggagggggtgccagagctgtgagcggctcggcagcatcgttcacactgcgtagctcagccgatcgctcgtcccaaggagagccctctgaatcgtggacatcagcagtagcggcctggtcggtgtacggagtcaccgcccccggtcccgcctcacaggcgctcccattcccttcttcggcgccatcgggcggccagatgccgccagcccccgtctgcgcgggcacggggcactcccagcgccccagcagggcctcgcaggccaacacgccgccggcctccatgaggaccagggccacggccagagcgtgcacagcgtggcgctggggccaggcgccaggcccggagcccagcacctcggacaggatgaggaagacggcggggcggcgcagcatgcacagcgcggcgtcggaccccaggcaggccagggcgcagagcgcggccaggccgccggccgccaggtccagggtcgcggggggcgcccccgcctcctccccgggcagcagccggcaccagcgcagcgcgaggcacaggccgcggtcgagacatcccagggccgaggggacgagcgcgccccgcgccagcgcctcccgcaccgcttggccgtctgctggcgccgccagcacgccggtgatgtcgtcggcgagcgccagcgcctcgtcgaggcacgggcccacgccgacggggacctctgcctgcttgatcgtcatcgcatcgatcccgtcctgcagcgctgacaaatgagacacaagggcggcggccctggcctgcagcccacgggcagtctccagcaccgcagtgggggtgggttcaagccccggctccaggcggtgctgcagcgcctcgcccagggtcagcatttgaggcgaggcaggggcatgccggggcgccgtctggtccagcccaaagccatgcagcgtgagagggagcgtctggaagcgccccgtcagcactagcctggtacagatcatgtcctgcatgggggtgcaggcctgggtgaggtcctgataatgctcaagaacatcactggcctgaggggagcaagatggtgtgatgactgacaggcccgcaacattcatggcgcgcgaccccagactgcctgccgctcttggaagacgtcccgggccccaattttgcatgtgcctgttgggctcccgtccacacctacccaccttgagctggacctgcaccgcccccttcttgggctgttgcacgtgcccggaaagcgcttcgaagcgggcggcgtgggggttgcgtgcatccttgccccacatctggacgtaggcaggagtcactgaggagggcccagcagcagtgccccatgatccggcctggggcaccgccccgacagcgaccgaagtgatgcaggcggggccaggcaggatgatctgcgggcacgtggggtgggcgatgtgcatgggcgcagccatggcatgacccctcccagattggnnnnnnnnnntacgtgggatgggcgatgtgcatgggtgcagccatggcatgccccctcccagattggccttcaacgaccaccgcagcagtcatcgggcttcccgcacctcctcagtgtgctcttcaaatcttgatttggtgaggatgcctttccatatcacttcgctggagcctctgggaggctccgatcgggacatcgtcaggctcgggctcggtgcctggccttacttgcgtgcacgagcatacccacgtcctcggcggcaggtctcgcgaggtgcagtcacgaagcatgcacagagtgctcgggctgtcactcttgttgtgcattggttcgaacgatccgacttttgtgtttctttcatgaactgcaagcgacacaattgcgtgcagcgcgtgctttgcctttccctcgcccatagataccaggcatcgcttgcgatgaatcaattgtcgatgcacatgatagcgatgtcaaactcatcggtttccaccgtttagagggtagccacagcacctggcgctgctgtggagtccccactcatgacgagttccgactaagtgatcgacgggggacctgcaggacccccttcagatctgaaagggtgtgcgcatggatttccgtcagacaggattcagtggtagtgctgccaggcacggcgctgtgtctctgggaggaaggtctcggcgggaggaaactcgagcggagatcctggagcgcacgaggagggagagggaggagcggaggatcaacagacttcgtgccaatgctgccaccaccatccaggtgggttgggtgcgaggcatgcattgcacgcatgctctacaggtcagccaaaggacccatgcctgttgtcatcatatcactcactccccctgcccaggctggctggcgatcccgccgtgacctcatccgagccaaagagaggctgcgccgacgatggcaggggtgcctggaagcggagctgtcggcaccctgcgacaggtgagggcctggggaagcacatgggatgggcctgggcttgggcaagtgtgtnnnnnnnnnntactcactcccccttcccaggctggctggcgatgccgccgtgacctcatccgagccaaagagacgctgcgccgacgatggcaggggtgcttggaagcggagctgtcggcatcctgcgacaggtgagggcctggggaagcacctgggatgggcctgggcttgggcaagtgtgtgaaaggctcccgaacaggacacccgctgcctgggggcctgcacatcgatgcagggtccttacctcaatggccatcgattagttcaccccagcacctcctctttgcagctctctcatggcaactgatgcagccttcctgcgtgccttcctattctttgccgacgccaaggtcgcaggagacatccccctcctgcctcgcgccgcggaggcaacgagccggtccccggcgccgctccgcaccctgcagcgccgcaggctcgtcgcgctgacctgcgccggactctgcgcgcccgccggccccgactcgtcgacgtgcctctggcccctgctggcccggctcctggacagcccagaccggctcgcctgcgtctgtacagccctgctctccggcggcctggaacgggcagcctgcaccgcgctgcatgccgggatcgacgccacaggcaccgagtccctggacgcaggagtgcatggggtgctgagcctcgtcnnnnnnnnnncgcgtctgcacagccctgctccccggctgccttgaatgggcagcctgcaccgcgctgcatgccgggaccgacgccccaggcaccgagtccctggatgcaggagtgcatggggtgctgagcctcgtctgtgccctggaccctgccgaggtgcggggcgcgctgcgccgaccatcccccagcacacaggaggatggggccggccttcctcccttccctcccaccagcttctttgggctgctgagcacaccgcagccgtggctgggcttcccccgcacgcgcagcctccttcctgcactggcggcctttgccgcgcccggcttaggggcgggcctggagggcgcgggggcggatgcggcgacggagggcgtggacgccgcgctgagcctgctgggcaacctgacggagggtgcggcggggcgggcgggcgcgccgctcgacgccgcagacgccggcgctctcgcgcacgtgatctgccgcctggtggcgggcgtcgcggcgggcnnnnnnnnnnactgggacgctgccaggctcgcgcctggcgccggaggtggagcggcagcttgcgggtctggcgagccacgccttcctccaggccctggnnnnnnnnnnttaaccgggacgctgccaggctcgcgcctggcgccagaggtggagcggcagcttgcggatttggcgagccacgccttcctccaggccctggtcgggcctctgctgtctctggaggctcagtgcggggggatgcccggggcgctcgccctctgccggctcctggacgccctggccggggcggtgccaggcatgcgcgagcgcctgatgctcaagctctcggtcggcacacccttcctcgcccagctctggagcggctacctccagccgggcatgcaggcccacgggctcacaggtgtggactcacgcctgggactgcatggggcagagggtccttgcagtaccgccattgtctttgcatccgtgccctgctgtcttccgcggctttgtggctggtcgggttgccgatgccgnnnnnnnnnngctgcatggggcagagggtccttgcagtacggccattgtctttgcatccgtgcactgctgtcttccgcagctttgtggctggtcgggttgccgatgccgtccctgggactcacgcgcaagcccccctccgacccacccaggccagccgtggcgagcgcgaggactaggaccacgacacctgggggaagacccgggctggatgctcccgctgtccatgctctcctccacctgctccatcctcatctccacaggtgcgataactccacgtgaggacaggagctcagaggaagagaagggactgggatgttcagctaatcacccagatgtttctcaacgccgcaggcctgaaacaaagctcaccctcttgtcaaattactctctcccctccgctttccaggcgaggatggggatctgtacgacnnnnnnnnnntgaaatcctccctcccctcccatttccaggcgaggatggggatctgtacgacagcagcttcccccttcccctccctgacctggtgcaggccctgaagagggcggtgtggtgggtgctaggtggcggcgaggccgcacgcgcccaggcccagggcggtcccggcccggggctgcaggcgcaggtcgtggagacggcaggtaggctgctgggccagctgtgcgaccgcaacgggcgccgcgcctttgtcgcggcagaagccttccacgtccccgccagcttccccgtcgacgtgctgggcgacctgatggccgcggaccccgaggccgagggcggggatgccgcacggcgcccgcagctgggggacgggcggggccgcgccgccgcgctgtgggtgtgggcgccctgtctcatccccttccaccagcgcgtccaggccttccagcaggcggtggcgcaggcgagccgtgcagagagggggtggggggagggggttaaaccccttgccaggatgggaggggtcagacgctggtgggcttgcttctcgcttgggcctctggctgaagcaccccctctccttgcgtgtgcccagaattccagaggtcatgctggctttcccaccccaagcccttcaacccagaattccctttcannnnnnnnnntctcttgctgaaggaacccctctccttgcgtgtgccgagaattccagaggtcatgctccaagcccttcaacccagaattccctttcaaacctgtgatacctgccccacctgccaacccaggaccgggcgtcgtactatgaggcggaggagagctggcagctgcgcaccgggtcttacagccgggactttgtgcccgtgcggcgggggcaggtgctgaccgacgccttccaggccctggggggcgctggcggcacgctcaagggccgcgtccgcatccagttcatctcggacctcgggttccccgaggccggcgtcgacggcgggggtgcggggtggtgcttcacgcccctggcctggtgacggttggctggcaaccgctacaatgcgttggcggcgtccttgctgcgagtcatctcattccacgcatgcgtgtatccattcgatcgtttgcctcacccaccccatcccccggcccttctcccccttcaccctcaggcctgttcaaggagttcctggaggaggtcagcaaggagggtttcgaccctgggcgcggcctctttgcggtgaccagcgaccagcggctgtaccccgcccccggcgcggcggcccttgtccccgacgccccccgcctgctggccttcctgggtcaactgctgggcaaggcgctcctggagggcacgctggtggacctccccctggccaccttcttcctgcagaagatggcggggagggggtgcgagctgcgcgacctggcctccctggacccggagctggcggccaacctgggcaagctgcgtgcctatgacgccgccacgctggcgggactggagctgactttcaccgtcaccgacgtgctggcgggggaggcacgagaggtgggtgtgctttgggggtggggaggaagggagcaggggtnnnnnnnnnnggggcatgccccacgtgcgtgcttcccatcgctgccttcccatcacccagatgttcatgtccacagcctgtcaggtccagcctcagctgcttgnnnnnnnnnngtagagggtgcccaaggccacgcaggaccggcggagcagccgtctagggaagcaggaggggttgtgattcgcggtatgcacgcgcatttaggcatggcccacatgcctgcttcccattgctgccttcccatcacccaaatgttcatgtccccagcctgtcaggtccagcctcagctgcttgcatgcacaatccgtaccggatccctccacgacccctgcctctgctgcttccgcttgttcaccccctccttcccttcatacactgttggcccaattgtcaccacccttacccaaaccgcacctaacccacaggtggagctggtgcagggcggtgcgagccgcagtgtgacgcgggacaacgtgattgagtacgtgcaccgcatggccgacttcaagctcaatcggcagctggccggccccgtcggcgccttcctggggggcctgcactccatcatccccccgcactggctagcgcccttcagcgccgctgagctgcaggccctcatctccggcggcgagcaggggctggacctggccgaccttgccgcccacgcgcggtatggcggcgggtacgccgccgaccacccgagcatcttgctcctgtggcgggcgctggcggcgctcaccgccgccgaccaggccctgttcctgcgcttcgtcacctcctgccctcggcccccgttactagggttcaagtacctccagcccccactcagcatccaggcgaggcggtggggagggaggggggaggggggagtgatctcgggccccgggctggggaatcaagtgcacgcgccagatcgcttgaggtctgatcttgctgaacccgcctgcacctctttcatagtgtagggatcgtgcctcgaccctgtgagacacaagtatttcccatcacgccccgcccacctcatgcatcccctcttctcgaacctacacagatggcgggcgcggcgacggaggaggcgctgggccggctccccaccgcctcnnnnnnnnnngccgtgagacacaactatttcccatcatgccccgcccacctcatgcatcccctcctctcgaacctacacagatggctggcgcggcgacgggggaggcgctgggccggctccccaccgcctccacctgcatgaacctgctcaagctgccgccctacaccagcctggaagtcatgctggacaagctgcgatacgccatcaccgccggtgcaggtttcgacctcagttgacacatcctgttcatccctacccggagaattcctggcaggggtgccctgccttggccccagcctgttgactcagacctcgatctcgtcgcacccacgtgtgctgttgcccccacctgaggagagcgccagaatcggactcgggtgccagaaacaaggcagcgcgcgatgagggcagaacgagcctcccctaaagatcctcattctttcaaacctcgcacattcctgctcctcagaccgcgagggccgagggtcgtggtgggttgcagcctccggcgtgccaccttctcccgtacttcctcaccctccctcgccagcacatcagccggcccttctgtgtcgctcacccttcactggttccaacatgccgctgcgtccctgcaacccctccaccccggccttcagccccgtggcgctgtccgtgacagcccggggccagggccacagccaccacgccggggcccgggaccctcgccaggccctgcccccgaaagcccagggtcgcacccgtgcccttccaggcctgagcccctcccccggcacccaggcccccgcccctgacgaggaacaggcccccatccagaagcccaggggcatccagacggagctggcctacctgcgccaacgcacgcgcatcatcacccaccacttccccagcgccctgggcgtggacgacttcatgcagcgcatggagattgcgctgtacgcctttggcttcagcggcgacaacagcatcggtgggctcttgggggggtggggctgggtgtcctgtgggtatggtgtgcgcaagggaatgtacttttggcagtctcacgacccatccctcctacgtgtccccccctcccccttcccccccccaacgaacagccatggtgaacctgtgccgcgacgaggtgaccttgaccctgaagcagaagatcgaccaggtgtttggatcctccttcaacaccaacggcctgggcggggtgctgacctgcggcgtgagcggggtgcgcgcgggcttgtcccatgccccggtctccaagggctccggcaaggagcggtacgtcttcttctccttcccccacatctccatcgactcgcgcgggcggcagggcaccatctcccgccccggccgcccggggcagtcctgcgcctgcggcgcgctggacggcgcgctggccgacatccggcgcaccggcctggccgcggcctgcaaggtgccaggcgtgcacgaaccgttggacccggagatgaccatcctgaagcagcgcctggcgcggcgcctgcgctacgagggggtgggtgaggagggcgtgcaggcgctggacctggtggccatgacccaggtggcggagcgcaccatcaccgacgacctggagtacctgatctcccagaccgtggaccccgcgcgcgccgactacgccgtggtcaccggcgtgcagatccactcctggggcaccagcttcgacgacgacgcgcccaacctggagttcgtcgcaccctccaccatcgacgtggtgaccaacgggtacaagacccacgtcgacctgctggccctgccggcgctgaccccgcgtcagatcgcgctgctggcggaggggcccgagtccggcggcggcggcgggggcggcgcggggccggcccggccggggcgcccgccgtcggtctgcaacagcgcgggacacaccacgctgcgggagatcgacccgccctacatgtacgccagcgcggcgcagcgggaggaccgcatggcgcgcatcgccgcctacgcccaggcgctggggcccggcgccggcggcgagggcgacacctgctcctggccgggctggcagtcgcgcctgcgcgcccacgagccccaccgcgccgacgactcctccatccacatcgaccagggtgagggggactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgtccaaggttattgacatgaccctctgcagcctgaagaataagcagcgagcctccctccttttgtgccgactctaatacctaagatgggaagggtaccggctgcacgcaaccgtatcgttgaatgaatgagtccaatgccttgagcgcaccgatgtaagctgtgccggataggatggtggggggtctcgagctcagagcccatagctgctgcaggtgctagttggaactggatgtgctgcggctcgacacgccaagcattctgtactgtacagccaggcacatgccggcaagagtggcacaccgcactgtcacatgctcggtcctgcctgatcatccatcggcaactctgctgccttctgccagcaggcgttcaatgacacgtagggctgctcgcacgccgtcctccccgcgcagggtctgctccatctccctgcatcgctgtgccacgccggggtcacggaccaggcgctggatcgcatgggccagcgattcggcctcgtcatcaagccgaccctggtcggtgccccggtgtaccatgtctagcagcgaagcaatgcgtatgccgatgccagtccgggccacacagcacgcccagtcctcctgatcaaagtgcaggggagccacaagctgcggggtcccagcctgcatccagaagagtggcggagttggttgagtaggagggtgcacttgctccgttcccggcatttggaaagctctttgaacatcagtttgagcattcggcattccaggtagccggattcgtttattccctgcagcatgacacccccttttgacagcaccacgacccatttccacaccnnnnnnnnnngagctgcggggtcccggcctgcatccagaagagtggcggtcttggttgagtaggagagggtgcacctgtaccgttcccggcatttggaaagctctttgaacatcagtttgagctttcagcattccaggtagccgaattcgttgactccctgcagcatgacaccccctttgacagcaccacgacccatttccacaccttggcagcggcaagagtcgtccctgcccctcccacatgtaggatggcacagcagcttggcaagagatgactgtgcaagacaggatcgcgatggaggtggactttctgatggctgcacttcctcctatcttgggtcagtgatcccacctccaaaactctcgtgtcgagctctggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttgatgggggaccaggcaaccacacttcgggccctcgatgcagctggaaaccgtgaatgtcccaaggcccacacatggtggcnnnnnnnnnncctccctcccatcttgcgtcagtgatcccccttccaaaactctcgtgtcgagctctggcagacgcagctgggatcctaaaaggtgtatgccgatggtggattggcgtgccagcgctcccaccagctccagaaaggcctgctgctgatcaagatccagcattctggagctgcagcccagatcaacgagcaatggctttgatcctggnnnnnnnnnnnnnnnnnnnnnnnnncgtggtgagtgacctggaagactcggggcacaagaggctactaatacctgcacagcagtgacatacctgggagttgtatcggcatgctgtgtgtcagaaagcccagtgcattctcatacgtcagtgaaagccatgacgttggatgaaatggccatgtcacgcccccaacctcacccaggagcagcatgggggcagcagtccgatcaaattgacagggcgacgcaggcagattcaaggctgccgtcctccaaatgccccagtaatcggcaaagaggggccacatccattcatggatgtgtgcccggctgacgagatctccacaccccccccgccgcatgaaaggcaaccgggaagcctgcagactggagacaaattctggatcctcagccgccatggcatcccaaaagccagggggagctgaggaaggaggcgcacagggagaggctgcgacggatatgaggccaaatgcttctgccagatggaagccctccagggagaatagattgtagacaatgaggcctggctgtttgcagacactcaatccgattctcgcagctgctggcaccttggcaaagagggtctgacaagcgctgagacagcattgtcgctgagaagcatcctgctctgctctctgggttggggagatgcaggaatgagagggaatggccaggcgcgagtacactctgaggcaaggttttctgtagatccactgcttgctgccaaccttgtgtgggagcacgaagggatcactattggcccagaaatactgcaaatctgaactcaaatcaagattcctgatccagtcctgcaaaagggttgaggagaagactgtttgcctgcttagaaactgctttctaattcttttgctgctattctgcttaccctctcaccgtgtgagctgcatgtgttataaaaccgaccctgcaagatctaaaggtagggtcggtagatattgaatgtgccaagacgagcagaggctgagtatctccacgtgagccgaaggcaatgaagagtattccactctgcggttgaagtgctgccgtcatggcgctcaacgtcaggattcctttggggtctcgacatcagtttagagcaggatgtgtacatgtaaggagcaatctgacatgtctttgctttatatatatccaagatgccctctaggatccgatttcagcggggcttgtgttcttgggagtcgatgggtttcggagcacgcgccgcacaaccctnnnnnnnnnncggattcctttggggcctcgacatcggttcagagcaggatgtgtacatgtaaggcccaatctggcatgtctttgctttatatacatccaagatgccctctaagatccgattttagcggggcttgtgttcttgggagtcggtgggtttcggagcacgcgccgcacaaccctcctcgctgccccacttggcccttgacggggggactggttcaagcatcaatccaaggcaaatcaccttgaggagcgnnnnnnnnnnacccacttggccttcgacggggggaatgtttcaagcgtcaatccaaggcaaatcaccttgaggagcgcacagaaggtctcaataaacataaggatgctgaatagctcaagtatgcctgccccaccatgacgtcacttctatgcctgcagtgagtccttgtaatatcgatcgatctcgatgacgtagaatcagccgacttaccttctgcattgcgcttcttctgtttcgttacaaatgagtagcatggcaccacatcagaccgtggtcatggacaatgggggctgcacgatcaaggtcggtctagccggcgacctgtcctccctcaggtgattgcggaagtggcgcgaggactgggtgcagagcgccccctcactcccactccaggcgcaatatcccgctctgacctcacgcaggatgatcccgaattgcacagccaaggtcaagggggagcgccaggggtacatagccgacaccgtcctcgcctgcaaagatgtcctctcactggtggtcagaaggccgatcgaccgcggctacgttgtctcctgggatctgcagcgcgacatctggaccaggtgatgcctgtggtcttgtagttatcacaagttgatgtagtactcagttccatgggtttgaggtgcatctttggtccgtctgcacgnnnnnnnnnnttggtcttgtagttatcacaagttaatttagtactcagttccatgattttgaggtgcatctttggtccgtctgcacgcatgcaaatctctggtagacagctcctgtgacctaccacaccttgacctttcttggacattggaatgacatataccttctctcatcacactcccaccagagttttgaagcatgtcgttggagtcaacgcctccaccatccgccttgtgctaacagagccgctgtttaacctgcctgcattgcatnnnnnnnnnntgcctcaaccatccgccttgtgctgacggagccgctgtttaacctgcctgcattgcatgacacccttcttcaggtgactcaggagggataaagcctgaaggaattgctctgctttctctatcccagatgacattgccacggcactcccctcctccctctgacatgccctctccaaactgtaggtcctctttgaggagattggcgtccaagaggtgttcataggcccccctccggtgttcagtctcagatggcatgcccactgccacccaggctccttggccaacacagcaggtgagcgactggtccaccgtttactcctgcctgtcgagtcatgggctccatcgcaccagatgggatattcnnnnnnnnnncacctgcacaggctgtggactggtggtggatgcgggcttcagcttcacgcatgccgtgcccgtgtttgactggagggtgttgcagccggccgtgcggcgcatcgatctgggaggcaaggccctgaccaaccatatgaaggccctcgtgtcatacaggtaaggggtggggctttgacatgccgggcagattcagagcctcggccgtgtgcctggagtcccagaggggtgtnnnnnnnnnntctccgccattgggccagcagccatatggcaccctcaatcactcaagtccctcccannnnnnnnnncctttgccattgggccagcagccatttggcaccctcaatcactcaagtccctcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgacatgccgggcagattcagagccttggccgtgtgcctggagtcccagaggggtgttgggatctctcatgcattcacgggacggcttcctcgcaccggtgtgcatgcccagccaagatgtgttggcatgcatcccctaccccccaccctcccgccattgccttcaggagcatcaacatgatggaggagacgtacctgatggagctgatcaaggaacagctttgtttcgtctcccaggacccccagaccgacttggtggcctcgcgtggcaaggcctcccggcacaggagggtctatgtcctgcccgacggcgtgtctgacaagctgggtcacatgctggacgaggctgggggcgagaccatgcccatccaaaaggacacggtgaggggagtgctcggtggtgctggcattctgcctgctgggcaaatgcctgtgtgaccgagcgcgtcgctgccaatggtatactctccaatgcagtgcccatggcgctactgtgctttccnnnnnnnnnnttggtgctggcattctgcctgctgggcagctgcctgtgtggccgagcgcgtcgctgccagtggtatactctccagtgcagtgcccatggcgctactgtgctttcccacatggcggtgaccacccaaacaaccttgccgagcctcccttctcacctcaggcgctggtggtgaatagtgagcgtttcatggtgcccgaggcaatctttcacccatcaggtagcccaggccgctgtgtgtatgctgcctggcactgagcggcttcaatacgcttcattgtgtgattgaaagaggtcctctggagattgtgttaaatatacctagagtagcaaaatctctgccactcgggcttgctgagtaagaggcacaacgcaccgctttcaggcctcctnnnnnnnnnncgtgtggttgaaagaggtcctctggagattctattaagtatactcagagtagcagaatctctgccactcgagcttgctgagtaggaggcacaacgcaccgctttcaggcctcctccccatgcacccgcagggattggcttggagcaggcgggcttggcggagaccatcgccgcagcggtgcaggcggcccaccccaccctccatggcctgctctactccaacgtcctcctgacaggttcagatcgggagggtggctgctgtccaggatcacggagttcggctcgtacttgccattgcagcagagcagggacgccgaaatgatgcaccgctgtgaagcctgattcaccagctcgcatcacctcctcgcacgatcacacaccagggggaacgacgacgtgcccaggattcaaggagcgtctggagtccgaactgcggccccttgttcccgatgattaccaggtgggtgtgccgtgttttgtggtttctggaccacgtctggagtcgtagcagaggatcgggaggggagctggcgtgtgactggccggtcaaggcagctgggggggctcaggtttccgactctgagcgacactccccagccttgcctcgtccagcagcctcactcacccctgtgcagctgggaatattcctggcagatgatcctctcacatgcgcatggaagggggcagctctggccgctgccgacccagcctcctcggctcggttcatcacgcgtgcgcagtaccagcgatcaaccagaacaaccacaccgacccctgaacctcgtttggaagatctctgggcggatgacgagtgatgtgaaaccggcacctgcatgctgtgcacaccaccgagtgacgtcaccagaagtatacgatccaggcagaggtgtcccgagattataagggcgcgctgcgcatgcagatcttggtggctcctctgacttgaggattcggccgctccctgttgttccagcctgactgccacaggacccgatgaactagaatcacccccttgcccgtggcaacactagaacatgcccatcctgtcttgttttacatcagtcaacaactgtggtgtcataaaagctaggcgggactgatgtccaagtcctcatgcagagggtcccccatgagctcatcgtcagagtctatggtttccagctggaggctggcacgcagggcgggcctgtgcccattctcctccggccccgccacttccgccatgtcactggcgatgggtatccccgccccatcctccaggatctcctgcagggcgacctgcagtgtgcagagtgtgtgggcaggggctggagtgcaggccacattggggcctcggccgacatccagcaggcacacacagcgcgacaggcacccaggtgcaccccatgacccacccatccccataccccaccttgctgccctggcgccggtagaacaggacgtaggcggcgggggactggacctccgtggcaggcacacacctcaccgacccgtcatcaaacaggtaccacagattgtcgtcaggcatcttgcagtacgccgtgtagtgcccccctcccagcccgccgtaatggttactcacggcgtacagatcgtacttgtttgactctgggatggatccgtctgacgccgggcctaggatgtgctggccaaggtcgaggtcggtcaagggaaactcgaccttggtgtccagcttgtcccgtgatgcacgggagtaggagaagcgtttgaggtgaaccacgaggacctcgggcagtgaccacaggtccagcttcttgtttgcctggtgggcggtgtatgggtgggcaagggggtgatggatgggcctcgctgtgggggtgcaccgcggggctcctcagcgggaaggacactgttgggcacagcccgggcacgtggaagggcgtgtgaccagagcatgccgcagcgcgacctgtgcacacctgaacatgctgcttgcactttgagcagtaccagctgtcctctgcatccaattgctccatctggaggaaggcctgccagtggtgatgggttgcagaggggtgctttaacgcgcctcggatgtttgcaggggagggcaatgttactgttgctggagaccgagtgcctgtgaatgtggtccttcagggccaggttggcgatgccatgcnnnnnnnnnntgaatgtttgcaggggagggcaatgttactggtgctggagaccgggtgcctgtgaatgtgatccttcagggccaggttggcgatgccatgccctccctagcacccaactgcacggcatgcacagagcacggtcgccatctcatccacctcccatcaccaccagtacaagcacacctcgacacaggactggagccggagcggcggggctggcttgtgtgcagcttgctcggcctccagcaccgatctgtgctttgcaggggtatcccatcggcccttgccatactggcgagcagcagagctactccattctgtgggaaaaggtgggaatggcatcgctgcagctgcctcacgggtagggtactcgttgatgaagcgcatgacaagacgcacgtcaggtccactgagtgcatcttattcatccaagcattgatgcaacctattgctcaccagctaaaaaacagagcggatcctcggtggggagagcaggcggcacggcatcatccccaatgaggctgtatcgcactctgccctctgcattggcaagcttgagtgtgaaaatttgtgatgcgcatccatccaggccttctcctgccatgctgacctgcaggtggatttgttttgagtttgggaagggggaaagaggaatacagggaagcagcagaagcctgcctccaatgctgtctttatgtcaaaggtattggcaggcaagtgaaagcctatctnnnnnnnnnnatttgagtttgggaaggggaaagagggatacagggaagcagcagaagcctgccttcaatgctgtctttatgtcacaggtattggcaggcaagtgaaagcctatctccaaccaaaacagggcaagtacacctttgcggaatatcgtgtccagccctccacattccttcctacctcaggctcccgggcttgcgcggcaaacatgtcaaagggtgcgccctcgtcctctgccttgatgatgggcaccacctgcggtccagcatcggcagcatccccaccgtcgacttgcatttccatgtcaccgtcctggatgggctctgccactaactcggcatctggcactgggcattgaggttgcgggtgcattgagtaccggtctgccaagcagtgtcaggggacgacgatgctggcctccacatcccacttgttgtacaggatccatgcagcccccagcccacaacaccagcccccatcacaccagcttctgcgacagctgggtctgcaggctcctggcccacctccatgtccattgggactggcatgccggagctttgcgccttggaggacgcatcaggctctgaatggagctggaaaggtctgcatgcagggggagggacacatctggtgctcacacaataatgatttgggtatgagtcagagagccttgacacatacccaccagtctgggcaccggccaacaactagattctcccaacttcctacagaaatcagtgaccctcaccctccaccgcatccagcaactcgtctatgccatgcctgagtgaccgannnnnnnnnngtgggcaccggccaacaatcagattctcccaacttttaacagaaatcagtgtccctcaccctccaccgcatccactaactcgtctatgccatgcctgagtgaccgaaggagggcggcgctcagcacattgtccgagccctcaggtcctatcgtactgctttctatccgtgccagcttcaggccctcaagatcctcagtggacaggaagagcacagcgggcggcaggactgtggagtagtttatcctgcatgtggaacgagggggatcactcttgcagcatcccgggtccgccgactcgacagcagggccagacagctgtgagtacatgtatgagggaaaggcagcatctgccaatgagtttcccggcccatagtccaacactcggcacgcatttcgtcgataccacccaccccactggcatccttctggagcaccacaccaggccacacaacagacctgtggtgcaccaggacagcgcgcttccctgctgctggtcctgagtccacatcagcatacaggtaccccaacagctggggggcgcgggagcccgaggacagggagacggctggtcgggcgggcacgaggccagccagcttcctcccagcttctgtcagaagctccagctggccgccccccgccgcaggcgtccagcgcgcaagcaggagatgcggttgcgaggctggcgatgaaggtagccctgccttttctgtggaatgctgctggcacattgccgccagggcagcctgcaaacccctgcaagcattcatgagcagcggaagagttgaagcaggcaggatttgtttgtgcatcatccacagggtgactgcaaagagaaacaagcccgtgacgcccacgaccgtcgctgctcccccctgatagtgttctgccagggtccaccaggaacatcatccaggtgcaacatgagctcccttgtaaactcccctcgaccgtccacgtcacacaccatctcacccgacactgcctgtcttgggtaaagtgaccgaatactgcctgggctctgccccaccgtccatgnnnnnnnnnnaaccgttcacgtcacacgccatctcacccgacagtgcctgtcttgggtaaagtgaccgagtactgcctgggctctgccccaccgtccatgctcaggactgtgggatgagggagagacggaggtcagtgtgcagctgaggatggaaaatgagcggggcaggacagcactctccatccctccaaggcctatgcatgcagccctgatggaagccatggtcccaccccccagcacaaaccctggccagctgtgagattgtccggcacgtggaaacggcagcacagcccgccaatcatcctgctgctccccggcctcgagtctgaatcttcccactccataccagtacaggtggatcgttaaccgcccccccccacaaaacaaactaggctccgtacacattttcagcccctgcacccaggcggcagctgccccagcccacctgtgaccctgaagtcctgcgtcctgggccccggcaggggcagcgagaggtacatgaaggggtcgaacttcacggactggtggccgcactgcgggcacaccagcgtggatttgtacatgccctggaagtggtccacgatgaccgagtcgttgcgcgcacggtaggcgcgccaggcctctgccgccagctcggcgtcggggcggccgtcggcgtcgccctcctcgacgtagggcttgacgcggatgcggttcagatcctcgtgcaggccgtccagcaggaacgcgaggagctcctgcgagtcctgctgcgcatacccctggaactggggcgcaaacttggacagctgccacttgaagtgcttggggttgacgtgggaggcgccggggagccaaagcttgcccaccaggcccccgaaggcaagtgccagcttgccgcccaggcccagggggttgtcggcgttgcagtccttcttgtacacgcctgacaggaagacttcgagcacgggcactgccagtggacaaggggaagggtggaggtgggttcaagggggggacatgcaggcgcaggttgctgagtaggcttggaatgagggagcacaagaccacagggtggcgaatcggtttggagaagcccgtcatgcccaagcgggggcctcctcttcccgcacctgtgtgcgccaggcactggacgctggagttcatgaaacaggtgttgcccaggttgcccagcccggtcaggcctctgcgtcgagctgaaccctgcagtgcagagggggggagcagaacggtgtatcgagatgatgaagagcagacacggccagtcccaacacatgagtgcacgcaaatgtcagtgaatactagattcaggcagacaatgcaaaaagagacgctcaagaccacggtgtggcacnnnnnnnnnnaagacgatgaagagcagacacggccagtcccaacatatgagtgcactcaaatgccagtgaatattagattcaggcagacaatgcagaaagagacgctcaagaccacggtgtggcaccgtctcaccctcaggatgtggccttgcatgtggccaaagcctgccagccccccctccccccccaagtcaaaccccgccaggtataatgcttgccagtatcacgatgtcctctgcccaagagggggccttgccgccgctcctgctcaagggactgccagagaagaaagagggactggccccaaagcgagggctgggtaagggactgctccctgaggtgagcagcagcggcggggaggagggactggaggccatgggtcgcggcttgctgggtgtctttgtctgcgatggaagacgagggagctttggacggttcagcatcgaggaaaggaatggcttcggatctctggcttgcgcagctcacaccctgcctggcattaaggactagattgctcttcttcagacaccaggaagccctgccgtgcacactccgacgcaccacgccaaggacctcaggtttttgtcgaacaattaccgtctgctgatccagaattctgacgcccctgagtgtcttgaagtatgtgttggcctccaactgtcaagtggcattgcgatgctgggctcaggaaacattgtgatgagggcaccccctcctacccccatacaagatcaccaccctgctcagaactgataagtaggaaacgacatatcttgccaaccgagagccgggtggaccctgctacagacccagtgcagctcctcaccaggcgaggtggatctactgatgcatccagggcatcaaagtcatcagaggaccctccaaaggtcccagctgctcggtccaataaatttattactgtgcactgtcgcaggatggagagggtagagaaatggtctggtgccgtttgaatacaagctggcgatgtgacttgccaagcgcagaggcagggatggtgagtttgcagccataggctacccacacgaggcaaggtggctcgccgacccaaagccacgcaggtccacgtgatcaggcaatccatatcttgccccttcccaaccccaactcagacgctcacgtcccctccattcccgcacacaccagctcagagatagcaatgactgcgctcttcctctccagcccagcgctctcattagcctcccgcacaaccttgacgtgcagctgccccgggtccatctcgacacgcgacctattcaggccaacttgcatgtattctcgcacaatctcgggtccagcgacaccgtacctgcggaggaaggggcaggggacagggggcactcccattcagagagtgcagcacacatgggttgtgtgagtggcaatcggggctagggggggaccgtgcgcagaccactcgccgcacccgcaaggggcatctctgaggtgctgtttgggccctctcctcctcaccagcctttcaggagctcccaggtcggctcgcacaacgcccaaaagtgcttcttctccaccagtccggagcggagtgtggtgacccctgcagcctcctcctcgtccagggtggactgagcaggatgctggcactctgccagcaggtcgctgttgtcaatggggcccgggtttgggcccgggctgctcgggcggatgatggagacacgctgcctcgcctcattgtacgtgaagcctgtgtgctgacaccaggctgtgaaccacctgcgaacgattgtgtggaggcatggggagaggggccggggaggctcgccctgggattctcaggcacagcccatggagggaagcagcgctcactccccttgcctgcgccgcagcagccaccaaagcctcagtcaggcacggcaatgtgtgcattacctgtttcccacgaggaatgtcttcaatccaggcttcaccgaggcctcccgacacttggcctccgtggttttgatggcctcggcctgcttccccggctcgggcagggttgtccctccgccctggtcgacgatcggctctccctccatctcggattcctcctccgtgtgcatattcaaatcaatagcaccccgatcctttttttgttcttaaatcaggagctcagttcctgtctcggcggcgaatcctgttgacccagagccaggctgatctcgtgggctcgaaggctcaggtatgactccagctcggcatatcatgagacatcgaatgcttggaaagaggggttggggatgtgcaatgcgccatgcaatccttcagtgaccgcattctgctcgtggtttcgtcgagaaggcgcggcgcacaggatgatgggcacgatcactctgtgatgagcttgagtttacagagctcgatgatgcggtggagaacgccgcctgcagactcgagagcacaattggcagcatgcatgattcaggcatcgtgtacagggaatatattacgctggacttgcggagtgtgcaagacggggaagggcatgggcggcaagcacacttggacaagtcgccctcacatcaccggccctgcgccttccaaggtcatcacagggcagtttgcgacgcccggctacaccttcaaagttcctttggctccccagccttgcagccccaggagaggcagacgaggtcgaagaggttgaactggcacgtgcaggcgttgtgaggggggcactccgacagcccaaagtagccgcagaagctggagacttcagggttgacctcgtccttcttgacagggtaggagggcgcctcgtagatggagcaggggccgttgggattcttgagggacgcgcgcgccaggcggaagaagcctgcctcgccccagcctnnnnnnnnnnattgacctcgtccttcttgacggggtaggagggcgcctcatagatggagcaggggccgttgggattcttaagggacgcgcgcgcaaggcggaagaagcctgcctcgccccagcctnnnnnnnnnnggaaggtgggaggagctggtgtgcgctcatgttgctcaaagacggctgggagatcacgctcccagagggtggcttcgccacctggcgagacgcaggcccccattctccccttcaccgtcagacaccgaccctcctccgcatcacccctccgcccaccnnnnnnnnnngaaggtaggaggagttggtgtgcgctcatgtcggtcaaagacggctgggagatcacgctcccaaaaggtggcttcgccacctggcgagacgcaggcccctaccctccccttcaccgtcagacacccaccctcctccgcatcacccctccgcccaccttctccccaggagttcttcacgatccagtggccgctctcggcgctgccgtcgggtccatcctcgtacccaactgccagcacgccatggttgagctgggtgcagcacgtctcgtcccctgccacgcccgaggagtaaaactggagcgcagagttggcgcagatggccaccgacacgggcnnnnnnnnnnnnnnnnnnnnnnnnnnnnnnnnnnnnnnnnnnnnnnnnnnnnnnntggcaggggaggtcgaaagaccagtagccatagtccgcctccgtgtccagcccgccgttcttcaccacgtagtcaaaggcgtagtccatgagcccgccgccgcagcccagatccttggcgtggtcgcagctgaccagctgctgctccgacagggacaccagcttgccggtgcggatggcgttgatgccctcgatggagccagtggcactgcgagttgaaagaggaaagaaggaaggagttgggggggataattcacgatggctgcactgagagagatcgttgactcagcgagcccggggggcccatggcaatcaggcagggcttcatcaatggggcaggctctcaaatagtgtggggatgcagggccaacacaaaaaccagagggaggcaccacttctacagcaatggtggcttcgtcaggcagcctttgatccacattgcctgctcggcatgggtatcagaatattgccccaccaagtccatctgccgcagcnnnnnnnnnnaagcccggggggcccatggcaatcaggcatggcttcatcaatggggcaggctctcaaacagtgttgggatgcagggccaacacaataaccagagggaggcaccacttctacagcaatggtggctttgtcacgcagcctttgatccacactgcctgctcggcatgggtatcagagtattgccccaccaagtccatctgccgcagccctatgccaggctgggccttcaaaccctcccctgcacagggtcccttctcccatccccatcccatgccacacatcagcacccacggacctgaatgcccagcacgagccgcaggcatactggttcttcacgggggtgaccgcaccctccttcctccagtccacagaggacggcaggtcggtggcgttctcgtacatgaagcccagcctcttgctggtaagtctgcagggagggcagtgcacattgccaaaagggtaagccctgacggatcagacaccggagggaggctgcaagtccaaggcaaccctccttagacaccacagccctgttcgactcacctctcatctgtccgcagtgtctcgttgtaccccagaaagtgcttggagaattcctcagacgtcctgagtgataagacgaggggtgctcaatagcatgaggcaggtggccctgttcaagcagaggcatgcaccctagcccatgcnnnnnnnnnntagcactgacggttcagacactggagggatgctgcaagtcaagggcaaccctccttagacaccacagccctgtnnnnnnnnnnggacaagacgaggggtgctcatcagcatgagacaggtggccctgttaaagcagaggcatgcaccctggcccatgcaccccgcctgccagcagcccactcacaggtctgcgaactggttgatggccatggtgaaagacgcctgctgcgcattgtgagcggcgatggcggcggcattctgtgtgaacacctccagacggtgagcgcgatcgttgccagcgtacttcttgttgtagtgagttgcccagagctcgaacacgcccgctggatcagcctgttttgtggaaggggggggggcctggtcggaaagctccaggagggtcggtgcatcgcccggcccatcnnnnnnnnnnatttttgggaggggggggggctggtcggaaagttgcaggagggtcggtgcatcgcccggcccatctgcaagaggcatccacgcctcacacggcccgcggtcaaaccaagggctaccatctcgtcatcccgcgcgtctcaccaaggcgttctctgccgtgatgccgatacctgccactacattccgctcggtatgcagcgaggtctgatccagaacaggcctcgcgacggcacacagagccaggctcagcacaagtcccagcttccacatagagataaacttcgaatcgagaacaggcgggccagcacaatggtaccgtcaaccttcagactcagcacgatgtttacaaatatgtttgtgggtctgggtgggtgctgtcagagtatggacccggctggggtgtcgagtgcggcatccatccccgaaacgggaggaaaccagggcatggcaacgttgcaccagcaaagcagtttgagcaactcgcaggcaggctcacaagaggtacgtcagcgccctctccacgctgttatctgacctctccaaggcctccctggcccggtctgggtcaaagcccatggcctggagagcctggagagcttcctgggacacctccgtcctcggcacatctgctgcgcgcgtgagcggtggcccgggccgagtggcaggggcctggcgatcgccatgctgcggcgctccaggcgccacaaagctttggctcgtccctgtacccctgcagccgtccatccaggacaggaccaaggctagtccgcggcgcatcctcggcggcgcctgtcggagaggttgggaggtagactcagcattgggtggtagtatgaagatcagagaaagttgatgagaaagttttatagcggttttgcaatacttaaattgtggtgtgtggactggatcttattgcgatcaggatcatacgcgctgagacacattgccaaactcggcccatggggtgtccacagcgacaaccagccccaggtggtacgacagtgtgagctctgagactgctgcgtgnnnnnnnnnnacgctgagacacatggccaaactcggcccatggggtgtccacaacgacaaccagccccaggtggtgcgacagtgtgagctctgagactgctgcgtgtccagtcagcatctgcctgcatccgcccctgtccaccaacgcaccttccagctctgcaggttgaagatgttggcgtggtagaggatgccggccagcagcgcgcagccggctgccaggagggattgccggccctgcagcagcgccagctgcagtccggccgcatacacaaaggccttgtcgttcaggcgcagccccagcaagctgaagtcctgcaggaccggcaccgtggcccagtaggcgaccaggtcggtgaagacgagcgcgtacggggccgagaccagggctgtgccggtggcccagcgcgcggcggcctgaaaccccagcgccagcccgcagctcgccagccggcactccagggaccgcaccgggccctcctgccgttccaggaggcggaagcagtagagcaggcccacgcctatgcagagcgtgccggcgccggggaagctgagcatgcgtaggaggggggggaggtcagaccttggacccgcggcccccgacaacgctccggacaacatgctggtggccactgtcgtgaagaggaggcccttggtcaagggggccccacctgcggggtgatcgcccgggggcaagcgattgggtgattcgggaaccgggtcgttgcatccatgtcgcctcccctccccacccccccgccctcagtccccattcctcgcccttaaggctcacggaatcctgataagctccttgacgccatggcgccctctcgatacgtactctgccactaaaattaggcgcaagcgatggcgcagggatctgtcnnnnnnnnnnggcatgtcgcctccccttttcccccccccgccctcagtcctcattcctcgcccttaacgctcacggaatcctgataagctcctcgacgccatggtgccctctcgatacgtactctgccactaaaactaggcgcaagcgatggcgcagggatctgtcgcgcagctcacatatggtcgcaactgagtgtatacccagtggcctagacacccctcctgtgcaatgcttcgataacagatctcatattagaagaattccgacggtatatcgctgcagcaacgggtcttgatcacnnnnnnnnnngtcgataagggatctcataccagaagaattccgacgatatatcgctgcagcaacgggtcttgatcactgaggattggtacagggcacgggtcatgcctcctcatcgacgcgcggctacgatagccctagtgagatgtcactgtgtaagatcccacacactgcactctccgcctcatcccagcacagatttcctgccaagactccagagtcttgcagctctaccgtgcatgctcgcccctgtgctataaggccttgcagctcctcaaggcgcatggacgcaagctgcagcaaggcacacggagtttgggtaaaaacgtctagtgcaggcatcgagcatggaaaaggggttcttaagctgtccatcaacctcatctacattnnnnnnnnnngaaaacgtatggtgcaggcatcgagcatggaaaaggggtgcttaagctgtccatcaacctcatctacattcggtatgcatatcaaagagtttgcccaaagcacacctttcttgcttggcttgttaagatgctgggtagtttctgcaggatactttcctgtctggcaatggacacctgatgtgccaggcacttcctcttcagccgggcatcctccatcatcagcttgcgttgctccccggaggacatcatctgcatcgcgggggcagcggcggagtgtcacgacttgaacctttgctgttacttgatagaacgacgcggaggaaattctcacacaatttcaatagggttgcctgtctgtannnnnnnnnnattacttgatagaacgaagcagaggaaattcttacacaatttcaatagggttgcctgtctgtaattactatcttgacagcaccgccccaccattgttggacctctacaatacaccttggcccagtgaaccgtcgttccaagctctgcattgacctgccgcctcccaggcagctcttccagcatgctccttgtctcctcctctgcgaatgtgggatgaatccgatggtcatctgacatccatnnnnnnnnnnnnnnnnnnnnnnnnnnnnnnnnnnnnnnnnnnnnnnnnnnnnnnnnnnnnnnnnnnnnnnnnntcgtcagccaccacacatgggatacatctgtctctctacagcacccaaattgtctgtgcagactcgtatttcccctcaccaaaacgttgtagctccaaggcatcttctacccgtctcgcctcaaagcttggcatcagnnnnnnnnnnggctggacacagagctgttagaacaacccactggattgaaatctcatgtttcacctccagaattcgacactgattttggaggggatggacaannnnnnnnnnggcagacttgtatttccccccaccaagacgttgtagctccaaggcatcttgtacccgtctcgcctcaaagcttggcatcagcccagcatactcctgctgagctgccaccagctccctcagcagcctgaaccgtggaggtgagagggcgaggatgtgccaagcagcagcgctggttgttgatcaaccccgccgaggcaccctcagagcccgagctggtcgacagcccggcggtcctcccacccgccccccttacagtcaggacagatgcattccacgatctcctcaccgttttgaggtggcctggcgtcgcaccagatgctgtgcatgcagagccttgagctcgtccaagccctgtttccgcgctgccgagcagagctccagctgctccttctgcagcttcctcgcacattcttccgtcctctgactcgcctcggcgagctcctggagctgagcgtcgtgggcatgcccataggcttccatcagtcgggcgagtagaccgtccagctgcgatcgcacatctgctccctgctgcttcaggtgcctcgcaaaatcagcacattccccagcctggctctccagcaggctctggaagccggtctccagactctcgaggccctcctgggcagcggagagcacggcgtctgctctgcccagccctgtgtcccagtgcagtgctgcagagcaggccgcctcgctcagctctccaggagttgcgagggtgcttgtggcttgggtgtgacggaggccttcggccctgcaggcgtgagctgcagccatgccgagctgaacttcagacgagagcgtggccacgcttctctggcaggtggaaagccctctggagtcggcagtagagannnnnnnnnngcggaggccttcggccctgcaagcgtgagctgcaaccacgccgagctgaagttcagacgagagcgtggcgacgcttctctggcagttggaaagccctctggagtcggcagtagagatgaagttggcattagtggccagggctgattggaccagggcatccacagccctcaggacttctgcatccttgccagccaaggggtcggcaggcgtgacctgcagggcagggaccaggacacccacgtccatgtcacttgatcctgcaccgcagggaaatagtatatgtgtaattcaggtgagggatgattgcaggacaatctgnnnnnnnnnncgacctgcagggcagggaccagggcacccacgtccatgtcacttgattctgcaccgcagggaaatagtatatgtgtaggtcaggtgagggatgattgcaggacaatctgcttcaagttggtcaagccgccatatgacggtgaggaacgtattccacacatcgtcttaccaagggcagcaagatcgggaccttnnnnnnnnnngtatgacggtgaggaaaatattccacacatcctcttaccaagggcagcaagatcgggaccttgtttttattttggttgcataacatcagtcgccatcctctcgtgccctccctgctcaaaaaccatataaacgcgtcgctggatgtatgtttgctgataggcggatgtctcggggaatatgaatcaagggtctttcacgccataccgtcgaaggtcgcgttgacttgaggctgcnnnnnnnnnngatcttggttgcataacatcagtcgccatcttctcgtgccctccctgctcaaaaagcatataaacgcttcgctggatgtttgtttgctgataggcggatgtctcgggaaatatgaatcaagggtctttcacgccatgccgtcgaaggtcgcgttgacttgaggctgccgcgagacagatgccaatgcgggaaccacaacccgctgaactaggcttatcgaatccaactgggcagcaagaggcagcctacaaaggtacgacactcatgcggcggagtcaacgttccggaggttgccatgcctttccatgtccaacgcctctcgctgcggaatgcatctacgctcaaagtgtgacggtgcctttcaaaccgaccagcaacactccgaaccggcttctcgctgggtttgcgtggtctcgatcaggatgaggattccgacgctgcttcgcgcccgcgcccttgaggccgggggtgcattgttccagacgaatgggcattcgtctgtcaatcgcacggcgtccagcaccatctctacgctgagatatttcccctattgtcgagcgctggtggacgtgcgtctcatcgggggaaaccacacgtaccctgcctcgctcgaccatggctgataagggagggctgctggaggcccagcaagccctctcctccctcatcagcagcaagaggcgatccagcggagagaactggagccatgcctttgacatgatggcgtcctacctgcaggtgagagtgcctaaaggatagggattgtggcactaggatgtgaagctctccattgcactgtgcaacaagtccctgctcaatgtttcctatgcaagggaatcaaccacagtgcatttgatctgttcccgactcacaccttccattgacgcagcgtctcggactggacagggagctgcacaagctgagcgtcatccacattgcgggcaccaagggcaaggggtctacggcggccatggtggagaatatgcttcgccagtgtgggtacaccaccggcctgttcacatccccccacctcatggatgtccgtgagcgcattcgtatcaatgggtgagtgggcaagctcagatatggggtattataatgcctgcacgacgtcactgtatgtgtaccttgcgtgcaaggagatctaccttcccttgagataccctgctcctccgtgccttacaaacagtgaactggtggatgaggccacattcctacggaacttctggtcggcattcaacaatttctcagatggcagcacgccagaatcccctggcatgcctgcctacttccgtttcctcaccctgcttggtaagtgggacctgccttgggccacgagtgatattgttttggcaatttaatgagcaggatggcgttttgacgccccatgcactgtcctgaaacggatgcaccggtgaacaggggagtcctgcttgtgttgaaccttgtccgtcaatacctgcagtggtctacacccccatcatctgtcttgcaggcctgaagatattccttgagcaaaatgtggatgttgtgattttggaagtgggcattggcgggcgnnnnnnnnnnnnngggagaacgatcattcactgaagtggttgttgattggggaagctgttgatagccatnnnnnnnnnnaggagccctgcagtttgtggcgttagcccccttggattcgatcacatggacctcctcggacacaccctgcccgtgagctgacatctcatttggagtctgccaggagaacaatcattcattgaagtggtttgttgattggggaagctgttgatagccatactctgagcagttgcaatcctgcgtggttgccccaagcatccaaccacccagattccatgccctgccgctccctgcaggaaattgcgcgagagaaggctggcatcttcaaggcagggaggcctgccatcacggttcctcagccggcagatgcagccgctgcactggaggaaagggcggcggtcgcgggcgccagtctcagagtcgctccctccctggacacctatgctgatggcacgggaagccccctccacatcggcctgcccggggcacaccaacgagtgaatgccagtctggccattgcactggcacgtgcatgggaggagcagcgggctgctgcgagcccctccacgcccgtgtcggcgaggatcgagcagcttgcgaggtgccagctgccatcagagtacctgcgcggcctggccactgtgcactggccgggccgtggacaggcgagtcatccttcgagccagccagaatggctgtaaacgggggaagagcttgggttttcatttctgccggatgaacaaatcccaacacagcannnnnnnnnngcttcgagctagccagaatggctggaaaggggggaagagcttgggttttcacgtctgccggatgaacaaatcccaacacagcaccaatctcctggggtcgatttggggcgaatccgtgttccagaaccacaccgtgtgtcagcaccctggccgcgctcacgtcctgccccgctccctggacgcagattgttcacgaccccgagaccacggaggctgccccagactccgcccgcctctcgttttacctggacggagcgcacacagccgagagcacggccgtgtgtgccgactggtttgctgactgcgccgccgcttggaagacagatgctgccacgacccgacacattcttgtcttcaactgccaggaggtgacttaggggcgggtttgcaggctgaatggtggatagttctaccctctcagtctcactgtctgccagttgtcgagctgacaggccgacctggagcatggatagggcgcagggtggtgtgccaagaggcttccggtcagacccaaaccgctacattcgatgttgcgggcatcaaagcatgcttcctcccgtcccctcggcaggagcggtcccccgagaatctactgaccccgctggcgagagtgcttgcccagcgagccgtccccatccaccatgcattcttcgttcccccaaactcctcatacgggaagctgggagctcgtgagggtcccgccgagctgacctggcaatctcggctgcaggctgtctgggattccctgccacgaacacgtgcgatcgccctgactggagagcctggagccgcccctcctctcacgttgggcaaggcagctgctgccactttgccctctgcaagtaacggcaagagtgtgcttccgtgctctgctgtgctgccaaccctccaggtaagggtcaggtttggaagagcagatggagtgagatgctcggcttcaagtgtatcttcgcacttctgggttgccgtagcgagagatggccctatctgaagtcaagggaggcagcggtcccacttgcatctaagcatgcgagcccccaaatgcaatttgcctctcagcaagccatattacacccttgtgatgcacctcagtctacagtggacttgctgcggaagnnnnnnnnnngaagcatgcgagcccccagatgctatttgcccctcagccaaccatattacacccttgtgatgcgcctcagtctacagtggacttgctgcggaaggctgcgagggagtctcccactgtaagattcaaagttctggtcacaggttccctgtacatggtgggggatgttctgaagatgctgggcgtttgcgctcgatgattctgttgctagcacctctcctcacatagaagtgcaacaggtctggactcattgaggccgtgtatgcctccaagggtgccagtctaaattgcactatttaagcactgattgtcctgccatgccaagaggatgtttaaagtgtgaaggaggcatgtgaagaactgaacacgccatgccaacaaggccaacatgagcatgcagggctggagctgtcatgggagcagaagcaaatgttgttggccagggtattgcgtttcaaagccggtgaatgtacttatctccaccattccacggacagtagccagctcattcgacgaccagggtcttgaaggcagcagagatgtggccattggctttgaccccgggagattgcctcttcacgggggaggtcaccggagtggcacgcccagacaggtacgtgttgagcttgcctgtacgaagagtgggagactccaaagtgagcgctccgagtgacttgctgcagtcctatgccgctgcgttttaaagtcttcaagctcccaagccaggggcctgctaaacagccacatgttgtcagctggtggtaccatgatctcatccaatctccagaatcaccagccagcccgcctcccccctcctcctcacctgctgcggccaaaatgagccccaggaagaagggtgaggccttgaatgggcgcgacttgaactccgggtggaactgcatggtggttggcgggagggttgagcagcagcattgtcagctcaccgcctgcaccatcctcctgatcaagtctgcaggccggccccgtcagactccaggcgccacatggtgggcccggcctcgacccaagcgtgcgtcgtgcaggtgcccccgtcccgctctcacctgggcggcgacgtagtaggggtggtctcgaagctccagaatgcccatgcgtgacccggtctcgtcccggcccacgaacctcatccccgcctcctccagctgcggcacatactccgggttgatctcgtaccggtgccggtaccgctcgtccacccactgctccgcctggtacagcttggcggcaacgcagtcggtggtctccagcagcgtgcgccgcatgcccaggcgcatggtgccgcctttgtgcgtggtggagatctccggcatgaacacgacgacgggggcgggggaggcagggtcccactctgtactgttggcccccgccaggccgagcacgctgcgcgcgaactcgatgaccgcgacctgcatgcccaggcagatgccaaagtagggcacgccatgcgtgcgagcatactgggcggccgcgatcttgccctccgtcccgcgcccgccaaagccaccaggcaccaggatgcccttggccgacctgagcgtggcccaggcagctgcgcgatcgggcaggaagggggagggggaggggtcctatgcgcacgacgtgggtcagggtctgggttgggaaactacaatgtggggaggcagcgaggcatggaacaaggagaggggtcccacacagggcagcctctccccaaagccgtggctgccatgccaacacagatgaaggaaagttttctggagcctgcccctcccaacccaccagataagcaaggcagcgggactgaccttggtgtgctgcctcatcgtggggcgagtcggccgtgacgggctcgaggtcaccagactccagaatctccaggtccagcttcacgctagctgccaggcaggcatgctgcagcgccttggtgaccgacaggtacgcgtccatcagctcgacgtacttgcccaccagcacgatcttgaccgcctgggcctgcatttggggaggcaaggtgaggctggacacgtgcatcaggttttgccgatttggtcacgtatcctggtgggcagagtctgcatcaggtgaccccttggcctcctggccttgctcaccaacacagggtgcatcgcccacctcagcccatcctgccccgcattgcaatctgagcacagactcgatgcaggcaccccccaccctcgctgccgcacctccctcaagctgtcccacttgtcggcgatgccggtcttccagcgctgcatgtcgatcttgggggcggaggcgccgaggccaaggacgctgcagatggtggtgtgggccccctggtcctgcagcatgaggggcaccctccagatgttggacacgtcgtgcatcgtcagcacctgctccggggccacgtggcagaaggaggcctgcagaggagggagggggtggcgatagggtggggccgagtgcaagatctcgtccggcgcacagcccaccacccctcgctgcctgcacgagcggcctggcgcaccagcttctcgcggaccgattggttaaggggctctgaagagcgacaggccagcagggaggggttcaggcccagggagcgcagggtggagacgctgtgctgggtgggcttggtcttctgttcgcccacggccccgatcacgggcaccaggctgacatgcaccacgcagaagttccctgggggagaatagagatggatgtcagtctacaggattgtggttcccagtcctctaggatgccatggcgggggggggttgcagggagggtagcaaggggatcgtagcgcagacacaggcatcaaacgcgatagaagagcccgctcctctcctcaaccatccatccaccgccatcagcgacccaagcgtccacaggctcattccaccggcgcacctgaccccacgcggaactggaactggnnnnnnnnnnggcgtccacaggctcattccaccggtgcacctgaccccacgcggaactggaactggcgcagcgcctcgatgaagggcatggactcgatgtcgcccaccgtcccgcccagctcgatcacgcagacctcggggatggagcccgtgccgtccactgggacgtgggccacgcgctcaatccagtcctggatctcgttggtgatgtgcggcacgacctgcaccgtcttccccaggtagtcgccgcgcctctccctctcgattaccgcctgacggggaaagggtaaaccgggtggatgctagtgggtgcatagacgcagcagcgggcgatggctgggcgcatggcgtggcagacattccctggcgcacggatgcaaaccgacgttctctgtcagagtgctgcccacacccttggtaagcggagagacacctgcaccatacctggtagaccttcccggtggtcaagttgttgttcctgctcagtgaaatgtccaggaatcgctcgtagttgcccagatccaggtcggcctggttggaaaatggggaacagtgttgccttctgcacagtgctgcgaggaagggagcaggccagccttggaaaatgccctcccagcgcagaggtgcacgctcaggcacacctcgccaccgtcgtcgaggacgaacacttcgccgtgctccaggggggacatcgtgccggcatccacattcaggtacgggtctgcggggtagagtacgggggcgtgacccggagcgcctgggtgagtcacaccgggtatgcaggacagtactcgacgacacagcctctgccctcggcaacccaaatttaagttaccaatcttcagggaggtgacgcgcagannnnnnnnnncgcccttggcaacccaaattaaacttaccaatcttcagggaggtgacgcgcagaccgcaggctttgaggagcactccaatggaggaggccgtcacacccttgcccaggccactcaccacccctcccgtcaccagaatgtacttcatcctgatgcacagcaactaccacaatctaagaattgatttcgcggagtagaggatgtctacaggctagcaagggctgcgagtcgtggttgagccccgggactggcctcgcgagggcgctaacgagtttgaaatgctttccacctattcgatgtggagtccactcagaccagtcaggacagcgaggtcttgcttggcccagaaggtcgcagttgctatgagaggggcatgcatgactcttctcttgatgccttgcaccctccgctgtcaagaccctcagcgtcatgtcaacctcccagctgctcctctgcaaacaagcctctcagcatcccatgcctgggtgtctttcccctggtgcctgcacagagatctcagcacctacaagcagctgctgcagcaaatttggctatagagccacatgcagttcctcgcaggcatgaattcaaggaagcagtagacttttgacgccacagtaccaagccagtcgagcctcaacagaggcctagcctacttgccacccttctttttctgcaaccaggattgggtgggattcagtaaaacctggaaacgaacatcaaaggcaactccctccctcctcgtcaggcttcactcacccagatgaacttggcgtcatcacacttcggctgcacgggcatggtggagcagtacgggacgtagtccagtccattgtaggcagcatcattcaacgtcttccggatctgatactcccaggcatcgtctgggatcttgacgtggccctgtgtggtcgagagcagagacagctcagttcagggcatgggccacacctggagattgaccagtcaacgcaggggagggagacctaccgccgccgaccagatgtcgctcccctgagtgtcgctcatggtgcgcaaggcgtcggacgatgatgaaaaactgaggccccagagcgtgccaggtttagaatgtcgcgggatcgagttgctcctgttcgtgtgcttctttctttcctgttggccaagctgacccaactggcaggcaaaggnnnnnnnnnngtcgagttgctcctattcgtgcgcttctttctttcctgttggcccagctgacccaactggcaggcaaaggtcgcattcacctcgcccctttggtccagcttgaacctctgaggcacccgctcttctgggcttacaagatatgtttgttcttgattccttatgtgcagggatgtccatacaggtgaatatctgacaggctatatggagggagcaatatccatggggttgcctgttgtgcctgagtcgagtgtgtcactctcacagaatcactgactccatggatgccattgcgacaccaacgttgccatttctatgcctctctctgtcttcaaatcccatcgtgttcttacaccaggcatgcacagtggctggttgagtcctgggctccgccaaggagtcgtccgtcagcctagtgggtccagctgctcaaagcaggaaggttgactcagattcctcccatgctttggctgggcgacaggtttcgacagggagatgggaccagtggggactcgcattggggatgagtagttctgagccccaccgttcatccctgtggtgaaagacctggccacaggccggcagagctttgatggcgaagaagcgccactcgggggatcgctggtgtttcgggaatgggtggaactttctgtgcgaggcttgttttcgtgcagcgagagtgtggacagaagggtctggctgttgtcaccctgagagagggaagagtgggaaaagggagactgtcagagggtaatcaagcttcctttatggcaaccacagactgatctcgggcaacaagtgagcaatacaagggatgtgaacaatgaggttgacgggttgaaggaacaacagcaaggtgacacgcgagcctgacgagacatgcaggtggtgcccagagccggacctggcttgtttctttggattccagaatctgaagtcgcagagcctccagctgttgatcctgatttgccagacgtgccttgagcgtctcaacttccttaaccttgtcctgtagaggtgatgcaaaggaagagggagtgtctcaaatggcacaaatcggccacctaaagtgctccgggtggcaattgcaatgcgtggcaaacgctctcgtgacccccccacacaccttgaagagatgctccagagctccacatgtctcctcaagatcggtgattcgactcaaggctgcgctcaactctgtcgtcaaaggatcaacgctctgggtaagcagaccctccgaatgctgtgagtgccctgcggagcgccaggcacagtaagaggtcgatgttggcttctctggtaacaggacttggacagcgaactcagagcggctgagtggaagcnnnnnnnnnnaaagcagaccctccgaacgctgtgagtggcctgcggagcgccaggcacagaaagaagtcgatggtggcgtctctggtaataggacttgtacagcgaactcagagcggctgagtggaagcagcatccaagcatgtcagctgtgagtcaaagctcgagtgcctgcacggatggcccctcctcacacgatgtgcatcccgtatgcaattctttcgtctcctgcaagctcaaactacatacctccaatgctgccggttgggggttcctccataatatgggcagacgaagagggttcctgtccaaaggactggtggaacccaggctgcccgctgtccctttgatcagccccggctggcgccctaggaggactggggctagtcttcacggggtcgactggcaggaatgcctcactcccaaaggtagcccaatcggcagactgggcattggccgtagatggcacgcgcacaggctggatttcctcaaagcctgtcgcccagtcgctgggttggcagcgatgctcaagcccagtgttggttgatgaaacgcttgcagaagatggggcaaaggctgttgctgcctgcattgctgcagcgcttgtaggagtggccgcaagagctgcagcttgtgctgcaagcggccctcttggtaagcttgtgtcactgacgacccgagcttgctgctgttgggactgagtagccgatgccgaaggggcccactgggaggcagctcggctgctgggtctggaatgggtggcactagcgggagcagatgcgtgctgctccacaaggccaagctcgacagccgacgacctcgataacgctgagatgcgctcttgcaccttttgacggatatttggtgtgcatgagttgccaatgggactgttttcagttgcgctgtctcaccagtgacagcagcgccggccattatcttgcactcacagagaacctgtccaccaatgtctgctcgcacctggcctatgtcccagcgnnnnnnnnnncgagttgccactgggactgttttcaggtgcgctgtctcaccagtgacagcagcgctggccattatcttgcactcacagagaacctatccaccaaagtctgctcgcacctggcctatgtcccagcgtcgagccacattgatggtcaacatgccttccaggagctcacggatagaagctggggtcccaggggggatttcgtacctcccattcaagatctggagtttggcctccccttcaaatggtagtctcccaaagcagaggaggtagaacaggcatcccagcgcccagatgtctactttggtgcctatgaactcacgtgcgtacaggtcccacatctgaccacaggagtagagggtggctaggttggtgagggtcgctttggtggagacaggtcagacacagtgatgggtaccgcatcaggcaagaggggccaaggatgcctccttgtaaaaaggaggatggatggccagacagcactacaagcggaccctcctccatggaccgacctatcccctacagtatacctccggggcacgatannnnnnnnnnaacaagcggaccctcctccatggtccaatctgtcccctacagtatacctccggggcacgataggctggggtggtattcctctggatttcgtcctccaagagggcaatgtcggcccccgtgcgacacgcctgcgaaaattcgatcatgcccacattgtcatgcatgaagactcatgcccaactttcaccagtgaacctcccacaccattgcatatttgcacagacccagaagacccccagttaccatctgacaagtggtggcgctcccgaaatcgcacaacacccactgtccgttgctgnnnnnnnnnnggtgaccctcccacaccattgcatatttgcaaagacccagaagacccccaaataccatctgacaagtggtggcgctcccaaaatcgcacaacacccactgtccgttgctgtgcagtagtacattctctgccttgatgtctctgtggagaggcattcattgaggtcaaggacatgtaaccggccatcccaggctgcccaacgttttctgcagggaccactcatctcaccacagcgtctgctcnnnnnnnnnncggagaggcattcattgaggtcagggacatgtacccggcaatccccggctgcccaacgttttctgcaaggaccactcatctcaccacagcgtctgctcacctgtgcactgtcggcagctgaagggaatgcagcgcttcgacggcgacacacactggctggaagacggcaaggatgccctccaggtccattggccgcgacaaggattggagatgggttgccaggttatgctggcaaaactccagcagcacgaatgcttcctgattccctgggccaaactcggcggcaatgagggaaagtgctgccgggcattcacgcagctcgtccatgatcccaatctcgttgtagacagctgcaacggcgcctggatcccctctgtgggtaaaatacgggggtgctcgggagggtatggtggggaaatggacacaccccattgcaagaatcctctctgggtcccagcgccccaccccagcggcctactccagactcatacccgagacggnnnnnnnnnntcccccttgcaagaatcctctctgggtctcagcaccccacccccacggcctactccagactcatacccgagacggaagtgcttcagggccaatatcgttcgagacttcatttctgttacgcggtaaatgcttgcgaatcctccttctcctatgagactctcaaccttgatctgcagaccgtccaccgccaacgagcgtccacacaagtcaccaccgccatctctacgtttacccaaggctttcaagaggttcattgatcacgaaatcgcagctgaacgtcggtggacccccgaccttccttccggaaatgtgtgtgcaagaccnnnnnnnnnntaagaggttcattgatcacgagatcgcagctgaacgtcggtgcgcccccagccttccttccggaaatgtgtgtgcaagacctgcaaactcaatccttccggcaagatgccaacacgatgaagtctagcggcctatatggtctccgaaagacagtgtatacacgtgtggtgctttattctaaagggatccaactgatgccgaggagcttttaaccctgcagttccggcagccacgcagcaggcactgcacgaagcgggcaagccctacgaatgacaacaccagcagagggccgggagagtgtgtgccaatatatctcggcatacagcgataggcgtatactcttacatctgcgttcaacgcgctgcctgcgcctgtcttgtcattnnnnnnnnnnggacacgtgtggtgctttattctgtagggatccaactaatgccgaggagcttttaaccctgcagttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaatatatctcgtcatacagcgatacgcgtatactggtacatctgcgtccaacgcgctgcctgcgcctgtcttgtcattgtacaaaggaacagtcctcctgtcatgactgaccaccatcccgacgggctcgagagcgccattcggatatttaaagggctggacttgtccagcgttcccaacaaatgtatcgtgcaaatacaagttgccgagaagtgcgttcgaattttccggaacgcagcctccacaggaccgcagaacttggccctgctgcgagaaactggagtgctgggtgcattggcgaatgtgcttgccatgcggctcgacaccactgaaagctatccgcttgctaccctgcagctcctgagcatgcagacgtttgcaaatgctgcagcatcctctcctgcagccgtgcacctgtgctggactctcctattggaggcaggattgcttagcgcgctgagcaacttcacaggtatgagctccttgcgccatgcactgggtactccagtgatggagatgtatggaatctactccactgctcatcatccctgactctccgtctgtcctggcaggaccggtgctcgatgccctctgttattttctgttcttatgctgccagaggtggaaggagccccatctccccaagccggatgtggcttggatcatcaagaagatcctcacattgctaccccagctggtgggtggtgtgcactggatgtggcagcaactgttgactctgcattcatgccctccatcctgaagctcgccagcatttccgcaggaccatgcatgggacaacctacccctcctcattgggtatgcggtgtacgagagtggcctggcggaggagttgctacagacctcgactgctgaactcccctgtacgtgcatgatattggacattctctgccaagaagccgcatcagtgccaaacaggttggtggcggaagcagagcactccagggagcacacggggttggtggtggcaagcctttgacaagcccagcttgctgacgccattcttctcgcatattgcagtgaagtgggaacctcggttgccacaaaccatcttcgagcgatgcaacatctgggaaagctagcccgtggtattgcagaaaagcgcgaaaccctgacgagcgacaactcgctcatgcttgtcagaggagtcttggcgcttggcagggcgatcatggcaagagatgaccagggccggggcctgtcagtccacaaggcccctcttgctgaggctttgctgcaggcaggctttgtggagctccttctatgtttcttggacatggtgccggcccctcgcaaagaccaggcgccagccggagaactagcagcgcaacatactctggacatcaagactgatgtcttggcaggnnnnnnnnnnacagggtatcttgtggcaaggagcggtgcccgtgtgtctgttgagttccccctgtcgccatcttttcccagcagtttcctcatagaaggggagttctgtggtccttgcctgaactggaaaccccgtcagcgtcaggagcagcctactttggtttttgtatgtagcattcccaaaccaatcctccgcatgtnnnnnnnnnnatcaggagcaactactttggttttagcacgtagcattcccaaaccaatcctccgcatgtgttctatcctcctttgcagctttggctaattcactgtatcgacggaaggctgtccaagaagctgtgcttgactctgggaagctaattctgatactgacacagtgtcaatctgatcacgatgcacccatggcccgggagtgggcacttctggctgtgcgaaacatatgcgaaggcaatcttcgagcccaggtgagggtacagatgaagaggtcgcaccgggactggaaccaatgccatgtcgcaggtctttaccctgcgtatgccccttgccagcacccatgtgacctctctgcagaacgacgtggggagcttgagaaaggtccaggcatcagaagggtctacccaagtcctgggaggcgttcagattgtcagcgaccaggcacttgggaagaaagtcttgaaggcagtctcttgaaattgcttccggcacttctnnnnnnnnnnnnnnnnnnnnnnnnnnaaaccctgcaaggcttcagtgtgacgtggcacgagagagcgcgagatcgtcggtccgaagaagcaggggcatttgcatggtaagaaggcctcggggtaagcagcgataaactgtccacgcacatacaaccttgctttacagtacctaccactccatcgcctcggggacgaaggacgatgcaggacgtcctcgacgatccggacaaagtcttccagctattgcaccccctgggccggggatcatatggagcggtatacaaggccagggtaataagcacgggcgaagttgtggcagtgaaggtcatcccgctggccgcagacgacgagatcgagagcatccagagggagattgccatgctccgggactgcaagcacccaaacatcgtcaagtactatgtgagtggttgcacggcatgcagatctcagcctgatgctaggtcaacgaatacaggtcctcaccgtctaaacactctccggaacggcgcagggaagcgtcaagacgccggactcactctggattgtcatggagtactgcgccggggggtctgtcagcgatataatgcacgtgaactcgtccagtctctccgaggcgttgatcaagtacattaccggagaaacgctgaccggtctggcgtacctccactctgtgggcaaggtgggtggccccttttcccgaggttgtgtgcatggatttcttaacttgatgccaccgcaagcttacacctagccgtgtgtccttctcacaggtacaccgagacatcaagtgtggcaacatcctcctgactgaaaacggggaggtgaagctggccgatttcggcgtcgcggcccagctcactaataccatgagcaagcgcaatactttcattgggaccccacactggatggctcccgaagtcatccagataagccagtatgatggcaaggtgggtggagggttggttgtccaaggggaccctggcgggccactgttggctgctctgcaaactgcaatgatgggggcgcagagcgaccccctccctccccttcccaggtcgatgtctgggcgctgggcatcacggtgatagagatggccgagcaggctccaccccggtggaagataaatcctaaccgcgttattttcatgatagtcaaggatcctgcgccgcgtttgtcggattctgagcgctggagtctgacgttccaagatttcattgctcagtgtctccaaaaggtgagtgaggatatgagcaatccctgtaggttttcaagcggagttcatatccaagagcctgcatgagtgatccttctggggcatggaaagccaggaaagcctcactcgcccccgttcccgatcactccaggacgttctcttgcggccgaccgccaaatttctgcagcagcacaggttcatctctgtggacagagccagtgtcttgcagctactcataccaatgatacagaggacacgtgcatacatgagcgagcttgcagctgcggctgctgctgtgtccggggataccattggcgctggaggtaaggctcttcacgggtgaccacttttctaaaaacgacggatccatgacacgcactgattgtggactgtcccctcaatttcccacacagggaccattgcgatgcatgcctcacctgccaggaggcaggccgaggcagacacattggcggctgcatataccacgacagtgcttgcagacaagaatatccatagcagtcccggggagaatttcggcgcaggcacctttctgcgacatgacttgttccagggaacctcggcggcaatgcagtcttcccctgctcctgtgcagagaggtgcgcagacatggggaattcacaggtgtcatctctgaccaatccccttcactggcataccatgaggtgggaggtgcaacccgacacccgagtctctgctgccgaacctcggatcgttgacgctcaaataaacgtgcaggtgaccttgctcacacaagtggtgactactcggctgcactgagtgccatgtcggacttcgacaaccttgacctcctgccatcagtacaccctccttgggtgaatgcgcatggaaaggtgagtgctgagccttcacacatctcagcgcctggtgctcgctgcaggaataaagatacctgcaacattaccccaccctgcgcagtcggatgtacaaaggttgaaggagcgactgcataccatatacactggaggatcggtcgtacccctccccttcctgcgagcaagcgatgcgttcccttcagcactcctgatgaagtcttgggagtctgaggatcaggaacctcaggtatttgccgtcaggactttgggtggctccaaggggagtcgggagccttgcgacagtatacggtatgacttactgcatatgcatgcattcagtctgccaaggaagtgagggaactccccaggctgagttggtctcgcaatgcattgcaggaaccctgggaattcgttctgcgaggtatgcttacagacaagggcgagacagagcttccctctgctatccggcagaggattgtgcagagcaacgtgctcctcaactttgtcaagtcgatcgcgtaccacgaaactctgctgaaagatcaagtggagctgcccatccgcttgagggatcacctcaagacccgttcagaagaaatgaagacctttcttcgtacaattttgtgtatttagttttaagtaaatatgtcctaacactcaaacaagtggacaagccgggccgactcgatggcagggtgtggccaggtgcccatgcactttatggcaattcaccttgttgcaccggcaaggagatgtgcgagcctcgaaagggctcgatatgtgaatagctggtaaccttttcatgcagtttcccttgtatatctcaggaggcacgtctggtttaggagtgaaagatctgtgtgtgagggatcctgagacaggctctgcatcaacttgtaaatgtaacaataacccatgactttagtcactgacacgacacctacacatataaagcagtacatactgtcggtgggacgctattcctgcccagaaggataaaactctctctggcacaattgtagtacaccttctatatggagcagcttcgtaaagcgtcagagtttccaaacctttccggacctaaacacaatannnnnnnnnnactattcctgcccagaaggatgactctctctggcacaattgcaatacaccttcttttggagcagcttcgtaaagcgtcagaggttccaaacctttccggacctaaacacaataatgcatcgcatccacagcacctcgagtatgtaatctgtagggtgctctgggaatggaagtatataaaaggaagcattcgagactcaaagcagggatactgatggcataaacagtcctattcagctcatgctcgtacatggnnnnnnnnnntgcagggatactgatggcataagcagtcctattcagctcatgctcatacatggcgtgagtctgcgaatgcccgagtgcgtgaaaatcaggaatacacgagctttcgatgcaattggcttggtcattcggcaacaccgttacacgggtggagctgccctaacccccaccgatagtgctcttacataatgggattaggctaacactttctcaagttccaaaacaagatcgttcttatcatccattctcgagacatgcctagtgtgaatctgcagactttgtgcattgtagaggaccgacaattgtgttgaaatctgatcagatatccctatgccagcattctgcttggagctgacaatagaggattttgatcgttagatgtaattatcaagctttgcttttcgagattcactcagacggccgataggcagtacttgaactgactgtccaaagtaaaaggtatcgtcatcgtcaccacaagatatattcaaataaaatgtgggactctgaactcaaataatcatgtctgacgttgttacttcatagaggcttggctttgtattttcatcacatccacagcaatannnnnnnnnnatggcttggtcattcggcaacaccgttgcacgggtggagctgcccttaacccccaccgaaagtgctcttacataaatggattaggctaacacttcatcaggttcgaaacaagatcgttcctatcatccagtctcgggacatgcctagtgtgaatctgcagactttgtgcatcgaagaggaccgacaattgtgttagaattagatcggatatccgtatgccagcattctgcttggagttgacaatggagggttttgatcgttagatgtaattaccaagctttgcttttcgagattcacacagatggccgataggcagtacttaaactaattgtccaaagtaaaaggtatcctcatcgtcaccacaagatatattcaaatggaatgtgggtctctgaactcaaataattatgtctcacgttgttacttcacagaggcttgactttgtattttcatcacatccacagcaatatcctttcgcgatcttcttaccatgtagttgtctcgtattggccatg

SEQ ID NO: 22038 - DNA, 61 bp, Chlorella protothecoides
gagccaacgagggctgagcacgcaaggccctcccccccaagacgcaccttctcccgcatct

SEQ ID NO: 22039 - DNA, 79 bp, Chlorella protothecoides
gcgccttgcgcgatgcattgcgctgctgggctcagaagcatggccaccgtccagcattcctgttcgcaccttgacctcg

SEQ ID NO: 22040 - DNA, 185 bp, Chlorella protothecoides
acagcttgggtctggagaaatctctgtcatccttatcatacaaccctctccccctccaaccaacacccatgcagagataaaacgccatcagctctgttcttcaggtacaatacgcagctcggaccgccctaccaggtcctcatagatacgaatttcatcaatttctcaattcgtaacaaggtgag

SEQ ID NO: 22041 - DNA, 79 bp, Chlorella protothecoides
gtagctgcaacaaagttgagtgccgttactacaggcgaggaattgccgcaaatattacgaggcaaaagcaacacttctt

SEQ ID NO: 22042 - DNA, 61 bp, Chlorella protothecoides
agattggcacgttaccttgaagaagggcacaccctgacgatagaataactgtgcgattgac

SEQ ID NO: 22043 - DNA, 61 bp, Chlorella protothecoides
ccaaggtttgctgggctggcaggggaggggtgtcgatggggaggctgtgctggcgttggcc

SEQ ID NO: 22044 - DNA, 75 bp, Chlorella protothecoides
cttggtggagggaggaggcgacttggtggagggaggtggtggtgacttggtggagggaggaggcgacttggtgga

SEQ ID NO: 22045 - DNA, 66 bp, Chlorella protothecoides
gtgaatgcaccccaccctcgtttgcgcagcgatgcaaaagcttgccgttcatcgctctgcaaccgc

SEQ ID NO: 22046 - DNA, 78 bp, Chlorella protothecoides
ccaccagtacctggatgctttgcatcttgatgcctccaaagatgtcgtccctcttcttcttccgccccatcctggcaa

SEQ ID NO: 22047 - DNA, 181 bp, Chlorella protothecoides
ctgacggggccctggccagttatggatcccaaaaatacaacggcaaaacgaccacttttaccaccaccctcaaggcggccatattatctttggtgtcgtacgcccaagttgtgcccctcaaaagtacaggcggtagcaccaatgtcctgaccctgaactggtgatcatgcagactgatgtt

SEQ ID NO: 22048 - DNA, 64 bp, Chlorella protothecoides
tctgcaaagctgggcaagcgagggggtgtgtaagtgctctacgacctcatcgccctactgggac

SEQ ID NO: 22049 - DNA, 67 bp, Chlorella protothecoides
gtggtccaaaggccggtcggatttggcacgggttgtcgacaggaggcaccagggcagccagatgtcg

SEQ ID NO: 22050 - DNA, 79 bp, Chlorella protothecoides
gacgtgagcgattgcccgcgttctttaattctgacgaaaatctgtattgtcgacttacacaagttgcagcaattttcat

SEQ ID NO: 22051 - DNA, 111 bp, Chlorella protothecoides
tcgtggacaacttcagctcgtcgtcgctcctgagcgtcggccgacgagcaagccacctggggcaagtgtcctggaagctcaggatgcccactggatccaggtgcggcgtgg

SEQ ID NO: 22052 - DNA, 77 bp, Chlorella protothecoides
tgctaccgcaactgtgagtgctgctgccggccgggggggaacggctctgggtgggtcagggcgcatcccgcctgaca

SEQ ID NO: 22053 - DNA, 152 bp, Chlorella protothecoides
ttccgcacgtgctcgactcctcgcagtctgggagcccatgtgtatctcatgacggtcgacgacgcagacgccatttgcaggtggatagcgtctgagggtgtgtacaccacagcctgtgcttgcaaggatgaatcaccatcagccaagcacgg

SEQ ID NO: 22054 - DNA, 76 bp, Chlorella protothecoides
ctctgcacccttccaccacacagacgacccagagttcaaggactataccgacatcaaggagctgcccacgcaccgc

SEQ ID NO: 22055 - DNA, 145 bp, Chlorella protothecoides
gctggctacacatgcgccgggaatgagcacagcagaggcttcattgttgggcagtttctatatgttggtgggaacctgtgtcccaattcaaggcaaatgcctggatccaagatacgactgcttgagtgtgcacaaggcaagcagc

SEQ ID NO: 22056 - DNA, 119 bp, Chlorella protothecoides
gtcgtcaccgaatgaagccatgagatatttgaagccctgcacaagctggcactgcgcatgcctgcgcctcgcaggaggcaaggggttcgagcagcaactccagtaaaagtacactttgg

SEQ ID NO: 22057 - DNA, 103 bp, Chlorella protothecoides
cgccgtggtgaggaggctggcggcactggtttggaggatgggtagggggacaggagggtgcctttgaaatgaatgaggcaaggctgtctttgcatggaaggcc

SEQ ID NO: 22058 - DNA, 61 bp, Chlorella protothecoides
cgtctcccccacaaaatcgcacacaggcgcaccctcagccacaccggccccgaggatatgt

SEQ ID NO: 22059 - DNA, 127 bp, Chlorella protothecoides
ctggtgctgagccagacaagcgtgaaagtggcaacatgaagcaacgcccacttcctctcatccctgcaaatcccagatggctgtggtgacgggagtgggcagagtggtgttgctggagctcaagggc

SEQ ID NO: 22060 - DNA, 459 bp, Chlorella protothecoides
gcaagtgtctgcgtggtgtcgggacggcgccgcatgggttggtggtccagccagtgcctgggatctggtggatgcactgggtcctcaagcaatgcactgtcagtgacctttcttcggagccccacctgccccgctgcatggatcccttgtcatgcggagcagagcagcactgaaggaccgtgacttcaagggccgaattgcggcaacatgctcggcatcgttgccagcaggcccgtcgccgcctcacccctccgctcaccccccacccgccccaggtggcggtactggcgttctgggcgccgccgctgccccagggagcgaccggcccgagcacggcggcggcggccgcggcggccgacgcctacgccgccgtcctggcggagctggtgagcatgggcgacgtggtccctggtctgcgcgtgcccgggaccgaggccgccgagctcggggcgtgtgagc

SEQ ID NO: 22061 - DNA, 61 bp, Chlorella protothecoides
ccaggacgccaagcggccgcgctccgccgtccccccccagctcgtgttccagcatgcgggg

SEQ ID NO: 22062 - DNA, 72 bp, Chlorella protothecoides
cctgggcctggtgagtttcttgttgttgtttgttttttggggggggtccttttggcattcacatttcaaggg

SEQ ID NO: 22063 - DNA, 78 bp, Chlorella protothecoides
cgacatctggagtggcgcccgcgtggcgcagggtgagcgaggggggggtgagagttggtataggctgggacaatcatg

SEQ ID NO: 22064 - DNA, 76 bp, Chlorella protothecoides
acaatatttttgtggcgcatgataggctgtatcaagcgcacaaaatacttgttggcgccaggtcgcatcaaccccg

SEQ ID NO: 22065 - DNA, 1505 bp, Chlorella protothecoides
ccgtctgtcttctgagcctcacggtggcaagcaaggtatgtagtggtggctttgcgagtgataccaccgaaaagggatggtgttttgcaggttcgcacgcccacccttcgcaaacccgcaacccgccttacaaacattcaagggggcatgcatgtccaagttctactctctaccatccgtcgtataagtgcgcctactgatttattgtgtagctggggtgaaggtcctcatcgtgttgcgataaccccctccggaagatgggtgactcccgcaggcagcttccagtccggatcgcgttactctccgcttactgttcccccatgctcacatcatagatacgggccgcatgttcatgtcctaactgccaacagcgcgggggcgttctgtaggtgaaccttggacgggatggtggaacggcatgcgacgtcgggcagctgcatgttgcagggtgagggaaagacatgcgctgcaagccatcataaccttatctatcgcgctgctcaacgtcacagggagcaaggctacagcaagcaaggttccgtcaggacgggtaccctccactctcttgggttgtctgtcgatgccatcaacatgagccccttcaaaatcgtcaaggctcgatccactgagattcttgtgggtgtggagtgcctcaaggcagggcagaaggcctgcacagcagattcgagaggcaatatcggcacgggcaacaagggcaaagataatttcggcagaaacaatgtgggcgaccacaacattggtatgctagggggtgggataaggtgattgtgggaaatcaggacccggcaatatacgagcaataaagtgtccaccagccttcctcagtcgtatcaacggtcctgcgcttccacaggaaactacaacaagggcaactacaactggggtgacaacaacgcggggtccagactccgctgcaacaatgcagtgggtatccggatggtactgaacttctgcagcctgtcagaactcaggaagtatgcgttcaagatttaccatcctccatcacctccacccaagcgcatctcgccaccacccaccaagaaaatgtcgccgccgcctccctcgcctagaaggaagtcgcctctcccacccgtaaggaagtcgcctcccccactcacgaagcagtcgccacctccgaccaccttgcagtcgccacctccaccaagcacaggggtccctcccagcccgccaccgtcctctcctcctcccagcccgccgccgtcctctcctcctcccagcccgccgctgtcttctcccccacccagcccccctcccagtccgccaccatcacctcctcctagtcctccaccacccgccctacccgaagttagcttctctttaaaccctggatacaccatcaagttcacagtcactatcataaattacacatctggtacaatccgtgcctacctcagtgaccagctgaagtacacatggacatggtcggactcccatacatcggtatatgacacccaggatgccta

SEQ ID NO: 22066 - DNA, 213 bp, Chlorella protothecoides
ggcatgcagatgatggcctcgcagccctgggaaggaggacaggggggaagagggagtctgggagagggctgggtcaggaggtcgggggcttagggcaggaccagcagagaccgaaaagacttggggctagaagcacgcggccagggaatgggagtcatgatgacccagggccgcatggggcaagcgtgtgatccagggcatgggtgccttcat

SEQ ID NO: 22067 - DNA, 64 bp, Chlorella protothecoides
cgagcctggagctgagacagacctcagcaatgctggtcagtatgtaaagcccgaaccaatgcag

SEQ ID NO: 22068 - DNA, 1073 bp, Chlorella protothecoides
caaaccccacccccccgcttcccaatacaaacattccaagccaacataccgtccccgctgacctcgacgctgtccatgcgctcataccccaggctctcgtagtcgacatcgttgaccaggccggcggcgcggactgcctcgggggggctggccgccctgaccagggtcctcgaccccgcgtagcaccccggttcgaggcccggcacaaagggcagcggcagctctgcggggggggagggcgagcgcgggcggaggggtgcaccctgcgcgcgcgagcggggcgcacgcccggtgaaggggtaggggttggggtgcccaaggttgtacgccatcgccaggtccatctcccggctggatgggatcggcagccccgccgggtcccacagggcaggcccggcctcgcgccccggcgagggcgggacgcactcggcctcctcgccccagtatcctgaggggggccgggggcgggggcggtcagcaggcggcggcacaagcccggactccagcggccacctgcgcgccacacccagcccggcgcctgcggggagcgccctcccactgctgcggcaccgcgcactcaccatcgccgtattcgcttgggtgggcgtagtcggcgtcgaggccggtccgaaagggcgcccccccctccggcactggtgtggacacgatcgtcattggggccaaaggtccgtgctgccacgggagcagcgtcacgcccaaccccaggaccccgacccacgccgggtccggcgctcccgggaggggaaccgcggcgacctcctcgggctgggcctctgcgcgcacatgggagggcggggggcggtgtggtgagccgcggccggcgcgatggcaggggtggggctggccggcgcgacggggccgggacgcccatgcacagcccgaggtcccctggcccgcgcccacccccggtcacccgcggacccacccggcaacccacccggctgccccggggcaggtaccgtgtcagcaacgggcggggcgggctccacgaccctcggactcaccgccccggccggcgcgccacgcggaccccccgccgaccccgcccgccg

SEQ ID NO: 22069 - DNA, 61 bp, Chlorella protothecoides
ggcaatcgggcggtccgcgaccatgggaacgcatgtatccaaaccaatagcactcgcacca

SEQ ID NO: 22070 - DNA, 427 bp, Chlorella protothecoides
  modified_base (125)..(365): a, c, t, g, unknown or other
ttgaagtttaacaaggcgtggaaatggtaaagcgagatgcttcatcccttgggtttgggtcgttttccggatgaccaggcggcgtccttccgcctgagctaaaggatcttacagagtgccggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcagcttcaagcgcccaaacacccctctcaccccccccagccactcacaggtagaccagg

SEQ ID NO: 22071 - DNA, 76 bp, Chlorella protothecoides
gatctctgagcctgtcagggatgggccatcgtcttcctctgagtgttcctcagacccgacgaggtgggagctcctg

SEQ ID NO: 22072 - DNA, 71 bp, Chlorella protothecoides
cgatgcagtggccagaatggagatgttcagggtgagtttaaatgtcttcgggatcagccccatcccatgcg

SEQ ID NO: 22073 - DNA, 61 bp, Chlorella protothecoides
ccctggagctggcaaggtcggagagcctccgcagatcggcgcggggggtggtccctccagc

SEQ ID NO: 22074 - DNA, 75 bp, Chlorella protothecoides
gggtccctgtgggtttttgtgggttttgttttctactgctcaacagtgtgggtgtgttgggggagcagggcgtgc

SEQ ID NO: 22075 - DNA, 61 bp, Chlorella protothecoides
ctcgtcgtccgcgccctggaagtcgccagccttcagaagggactgcagcttggtgtagtcc

SEQ ID NO: 22076 - DNA, 77 bp, Chlorella protothecoides
gggggagaatggcacaccctatgccttaccttccggggctacaatacgcctggaagtccagctagacatctccccat

SEQ ID NO: 22077 - DNA, 61 bp, Chlorella protothecoides
cgagtaccggaagtcgcagtgcattctcacaccctcatggcctccacaaccactagcggaa

SEQ ID NO: 22078 - DNA, 91 bp, Chlorella protothecoides
cagcaccaccgcgtcctcaacatctatccaataaccctagcagctaagcttctcaaagccctgacctctcatgtaacatgcaacctgtcaa

SEQ ID NO: 22079 - DNA, 64 bp, Chlorella protothecoides
ccctccccccccatcacaatccctcccaccccactctccacccacccacctggtcgtcgggcag

SEQ ID NO: 22080 - DNA, 69 bp, Chlorella protothecoides
tgtgctcagagccgtcttggggtggatggcaagggccgccttggggtggatggcgaggggcatctcggg

SEQ ID NO: 22081 - DNA, 99 bp, Chlorella protothecoides
gtagatgagctgcgcgggtgtggaaagggggaggggatggaggcgtgagctatgcatcgtccggtccccgtgccggcgcactggacagttgggtaccct

SEQ ID NO: 22082 - DNA, 80 bp, Chlorella protothecoides
ctgggtccagctcagctgctgctgctgctgctgctgtggggtcttggtacgcgtctgcatggatctcgggggaactggga

SEQ ID NO: 22083 - DNA, 61 bp, Chlorella protothecoides
gtgggtgggcgtgacatcatgtctgcagggtgtcgcgtcttgcaagggctaccagactgac

SEQ ID NO: 22084 - DNA, 76 bp, Chlorella protothecoides
ttccaggtcaccacctgccgacagcttcatccttataatcccacataccacgtgtcgaccttgagcatttctcaca

SEQ ID NO: 22085 - DNA, 119 bp, Chlorella protothecoides
atctcagtcaagtggagggctaccgcgttcatttgttgattactccagtcgactccacatccgtatgtctggttcgattatacgaggacctcggatccggatcgatcgatcctaaacga

SEQ ID NO: 22086 - DNA, 138 bp, Chlorella protothecoides
gcattcaggttggggaggtgtatggcctggaagaaggcgacattgaatggaaaaggcattccagtacgctctatgttgtctatcggttgaatggcccttcaacctgcacgcaacagcaatagggaggacgtgcagcgt

SEQ ID NO: 22087 - DNA, 62 bp, Chlorella protothecoides
tgctaggcacagcatcaggctgcaactgatccacggcagcaacatcctgccgcttgagattc

SEQ ID NO: 22088 - DNA, 71 bp, Chlorella protothecoides
agggcaagtaccagagaatacaggctgagattaatgtgacagtacgccattgcctcgcgaaacgggagtcg

SEQ ID NO: 22089 - DNA, 74 bp, Chlorella protothecoides
gcacagacacgagtccatgccccttcagctttcccatcttatccgcccaagatccggcaacctacctggatggc

SEQ ID NO: 22090 - DNA, 61 bp, Chlorella protothecoides
accagagagcaccaggcatcatcgaacggcgcccgaaggcaccatggccctggacctcggc

SEQ ID NO: 22091 - DNA, 4640 bp, Chlorella protothecoides
cgggcaggtgctgggcggcgcgctggccacgggcgcggcgcaggccctggtcgcggccgccggcctggccgcgcggcacgacgtccgcgaggttgtcgtggagctggtgcgccccggggtcaagcactttgtcgtgtcggtgctgggcgccgaggggcgcgaccccgtggcgctgccaatcacccaggtgggccactacgacctgctggaggagatggtgcgcgccgacctggcactccacgccttcaccgccgtgcggcaggtcggtgggtgggggggtctggggggcgacgtctcactgtacactggcgctgtgagcggcggggtacgctgcacctggacaccctgatcagagcgggaagtggagggccagaccggctcagggtcggcccatgaggctggagggtgtggttgaccgagggtcgccagggactggggcggacgtcacggccgaggccctgggtccccgggccgccctgacgcacaggaaagttcacgctcgtgctgctgccaccctccttccttcctctttccgtcacgcgacacacccctcaccctctcaaccctctcgatctcactccacagggcgccgacccgggggagatcggggaggtggtgtcggcgctgcggagggaggcggccgtggacccctgctacctgggcggccccgcgcgccccacccaggagctgcgccactccacgcccgcggtggatctggcggacgaggtgcaggcgcgcgtgcgcgcagctgccctgaagctgtacgccgagctgggcctgcacggcccagcccagttccgcggctgggtgaccacgcccggagggggtggggaggaggaggaggaggtggaggtgcacgtccccgcccccgccgagctggaggcggtgcggagggccggcgccgacgcgcaggcgcggcggcctcgggcctttggcgacctgctggagtttgatggcctggtgcgagcggagccggcgcagcgtgcccccgcgcccgagtccatcaccccgctgcgcatcgtggggtccacggccatgcaggcggcggcggccaacccggagctggcgcgcgcgatgttgcgcgaggagttgaccgaggaccggccctcccgcgcgcgctacggcgcctggcaggggctggagctggacgaccgcgtggccgtggggggcgaggcggcggaggaggggccgtgcgaggaggacgccgtggcggggctggccacggaggagcccctgccgcccgtcgtcgagcgcctggtgccgccgagcgagctggacgccctgcccgccctctgcgcgccttcgggcgacggcgccggcgcgcatcgcatcggcttcagccggctgacgctgggcctggacctgtccggcgcgcgctcgatctggctgcagcaagccgcggcggcggggctggccccgggccgcctggtatgcgcaggactggcccagggcgagctggaccctgctgcgctggcgggcggcgcggagggggggacggtcggcgccctcgcagcaggcgccgccacccgcggcgggcaggtcgcggcggcagctggccagggcggcgacgacgacggtgcctcgccgggcgcctgcgtgcccgccgccgcaccctggccgccgcaggactgggcggcgcagctgcggggcctgggctccttcctggagaacctggaggtggacgatggggaggggttcgaggccgccatggcggccgccggcgtggaggtgccggccgcgccggggtctgcgccggcgctcccggactcctacgacgcgctgctggacgagcgggaggggtgggacgagcgcgagaccatctggggcggggacagcgtctgggtgtcggggcgggaggggtccctgctcccccgccccgaggacgcggggccgggcgacgccggcgccggcgaggcatggagcggtgagggcggccaccaggccacgccgccggaccccgctccagccgcgcgcactcccctctgggtcctgtttggcggggacggcgcgggcggcgaggccagcctgcgctcgggcctggaggccgccgcggcgctggggcagacgggggagtacgatgtgcgctccttcttcctggagccctgcaacgcgggggagcaggcggagggccggcgctccgcgctcctgcagcgccgcctccagatgctcaagctgggggcggacgacgacgagctgctgcgggagatggggcccctgcatcccacccgcatcaagtgagctggggctggtgtttgatgggggggagtcgtcttgctggggtttccagggtccgtaagggagggcaatcttgctccatgagtgtctgacaggggcctggaaggcaagggacagctgtcgtgttgctcatgcatccattgttggacctcgtcagtccacctcacgatcacgaccacacgttcctccacacacagcatgccgccaaaatcagagctggtggcactgcagcgcggcgtctgggagctgaccggcacgggcctcctgcgccagacccccgccgagctccagcacgcctgcgaggtgggggaggtgctttactggccatgtggcacttgtactgctgctcctgtggttgcatggccactgcccgccagggtcactgtcaggagtgagtgccgtgcagtccaggccgccggccagcaccgctcttttgaccctccttcgccagctctgttccgacctggcaggccatgacagtctgcctggcccgtttctctgttccccacaccccccacccaccatcacctctcgcaatcccctcgtcaccgtgtcctccccaccgcctcacaccaaaacaacagagggcgctggcgcagtacaacacgccgtggagccagaggggccccgaccggctcgtccccggccaggccgcggcctcgcaggccgcgcaggagctggtgctgggtggctgggcggcgcccgacgaggcggcggccatctggggcgcggggctggaggccggggagcggacgccccagccaagctaccgcttcctggaccgctgggcggccgccgcccacgaggccggggccgtggtggtgctggcctgccaggcccagcctgttgccctggggccgattcagcgggtgctggagggcaagggcgtgccgtgcacgctttccagctccgccaccctggaggcggtcacggaccgcgccgtcatgatgcgccaggtcagcgtctgtttgagcgatgggacggtggtcgatggcaggggtttcagagatgtgaatggcaggatgggggtgcatactctggatgaacgaggaaacaggtggatggccttgcggttcaggaatgagcagggatctgtctctgcatgcccccccgcacccctgagagcacttgcccaaaccccccaccccatgcccactcctccaaactcacagctggccgacctggagccgcacggcgtgtctgcggcgccctggcacaagatgtccctggcggagctgagcgccaaggtggagggcgaagcggaggccgacgcgctgtttgaccagctgcgcggattcctgggcgcgggcgaggcggacctggtgctgcgccccgcctgtaccacgcgcggcccagagctgggccaggtcaccatcacctgcggtgctgacctggcgatcgtggccgccgcgctttcccagggccgcgaggccatcgaggcgggggagctggggcagggcgacggggtgcgtctgccgcagccgccgcccagccacgtgctgctggagccggacgtggcggtggaggacctgatcctgatgcgggagccggagggtgggagtggcgatgggagcggcggacacggagcctggagtcgtgggagcgtgtcggcgcggctggcgctgccggaggggtgggaggaggcggagcgctcccttcccccgccggaccctgcccagcccggcgcgcggcgccaccccgccgcgcgcttcgtgcactggccgccgggcgagccgtcctgggtggccgtgcgcgcttgcctggtgggcggcgcggggcacatggtctgcctgggccccacggccgacgtgctggaggtggcgccacgccccgcgggcctcccgcgtgccacgcgcgaggccctgacccacgtctcgcgcctcgcggcgaaggaggcgcgcgccgcagcgcgcgccctgggcaacgccgctgcggaggttgcggatctggaggacggggcggacgcggaggccgctgacgtggaggcttccagcgacgaggaggaggaggccgcgaccgtggtaggctgctaccagttcacgccgccgcccgagcgctgggtgtcgggcgaggcggcggcgcaggcgcggctgcgcctgcagctggtggcggggcggctgggcctgtccggcgccgcctccatggaggcctttgtgcacacggccacgggggaggtggtggtcacggaggtggacccgctgccagacctgtcgctgggggggctgctgatgaagcaggctgctgcgggggtgccccaacccctcactcccgcccaggtctggcgggaggtggtccgcgccgcgcagcagggcggcgggggggcggggggcgcgggcagcgcgacccagggcgaggccgactacggcttcttcgacgtggccgacatggcaggtgggtgggtgggt

SEQ ID NO: 22092 - DNA, 61 bp, Chlorella protothecoides
gttgcgaactctggtccacgtccttgcttgactatttccctgaaggtgtcccttagtacga

SEQ ID NO: 22093 - DNA, 149 bp, Chlorella protothecoides
cggtggcggcgcaggcaggtcagctccctgacccgctgcatctccagcttaccattgagcgtccgaccctccgccgtggcccctcgcagctgccacgctgcgattggggacgatcggagtttatcacctgccgcccccgcctcagccag

SEQ ID NO: 22094 - DNA, 79 bp, Chlorella protothecoides
cgaggagtgggaggtgcattttgaccaggtccggggcctcgtgtgtgtactgggtatgggagggagtctgggtgttgct

SEQ ID NO: 22095 - DNA, 61 bp, Chlorella protothecoides
agatgccagcatcgatacgtcggtcgaaggccaaggacccagttctgtgcacaagcaaaca

SEQ ID NO: 22096 - DNA, 67 bp, Chlorella protothecoides
ggatgactgcgaggtgaacgccgtgaagatggttttatttctggcaacgagcttggttggggatgtg

SEQ ID NO: 22097 - DNA, 73 bp, Chlorella protothecoides
ttggcctgaaggaggtgagcatctggggcctgtgtgtttgaatggcagagaagctcggcagtggcatgtcact

SEQ ID NO: 22098 - DNA, 9177 bp, Chlorella protothecoides
  modified_base (168)..(202): a, c, t, g, unknown or other
  modified_base (1029)..(1091): a, c, t, g, unknown or other
  modified_base (6591)..(6653): a, c, t, g, unknown or other
gggggcgggggcgggcgcggggcggggcgtgctgccgcgggggcggcgccatacccgctgctggaggcctgtgcggccggcggggggggcgggggtgaggccggcccggcccagaagcccgtgctgccgaagccagaggcggggaccgggggcggcgggggcgcgctnnnnnnnnnnnnnnnnnnnnnnnnnnnnnnnnnnntgtcgcgctcgaggctgggcggggactcgtccccatggacagggactgcaggcgggaggtggccctgcgtgggtgagggagcagcgctgagcgatcggcggcaggctgtgaggtgagacggagctgccgtcccgatcccaggcaggctgagaaagcccacctcaagcatcattgggccccagacccttcccgcctcacacccacccttggacgagagggttgtggaatggctcaggctccgaggtgggggggggaggcgggggcacaggctgcggcgcaggcccccccgcagtcaccgcagggagggggcgaggggatggggaaggccgcaaccctggcttgtgggccccatcaggggtccagcccggaggcttggtgaagaggggggggtcagagccgaagcagatggacatgtcctgagcagagggcgttggggcgtggtgtgaatgtacttcatggccgcgagcactttggagaacacatgccagcccagctcccaatgaggaggtgctgctcaaagccagcgattaacgaaaagcacgccactcccatgctggcatgcgagacccggcctgctgcacgccatcagccagcccagcctgccgacccacctctgccaggattcgaagatttgaccctgggtacagccagttttctaggtacagggaagccacagagccggatgggtcgaccaccgaatgccctggcttgatcatcatgtcgggggtcggcacgacatacacgatggggggtgccagggggaactgctccggcagccagacagccaccgggatattgtacttgaccgtctgtgcttgagggggggnnnnnnnnnnnnnnnnnnnnnnnnnnnnnnnnnnnnnnnnnnnnnnnnnnnnnnnnnnnnnnngggatggaagtttgccaccaggcccacgaccacggcatccaacatcattctaaaggcacacaaatcactccacgtaatccgtccaccagagccgacctggtagtacatggggattgtgccttctagtaggagcaaactctgggtcctgaacagagggacaatgtgcaaggagtgacggcctgtaggcctgcattgaacgctagaatgctcatgaccacgacgcatgcctggcaaacagcccagcaattttttatccagcttgacatcaggcaacaccaatcccaaatgctccatccatgcaccacgggtaggggcacttgatccaaagaagtagatgtgcattcccttcaacacgcccctcccagtgtgatgagtgtaatcgtccactttgaccttcagcgagggtatctcctgcacacccacacacaagtgagggacatgtgccattgggcctcccaagcgtgaccaatctcaagcgagctcgctgagcgaagcctcccgctgcaggaaaggtgctcccaaggaacaggcaagacagagccataccaggagcatccaggacatgcaccatgtcctcctgaaatccattcaagacaggggtggagtctcccctcgcgcaccgtcaggacctcctgaacttgctgccggactgcaaacttgaagtcgtcgccatagggcaacgcgttggcacccgtcctccccaatgcctcggagagcaagtacagggagcctggtgccatggctcgccgctatgactgtccaagcttgaacctggaggcactgtctacgttttcattgtatctggcgcaccaagctcgggtggcctcctcgaggcgcagcgtcccggaagctgaaggcttccctcgccctctaagaacgcaaggctactctttcctgtgagagtcaaagatcaagcaaattatgatcgtatcgttgcgatgaaatccggtgttgcttgagacaccaggtgctcacataccctcgacacatgcgaccgactgggcgcgcgatcgcgcaccatgaaaccattcctcgcatcattcagccccaccaccttcgatagacaacatacaattactttatccagagttttcacgattttacacccgcgttgtcgagggcatggctgtctattcgggacatccagtctgctgcgttcctcccactctttggaagcgttctccctgacaagcgcagcggccaggatgcccgcagcggaaatttagaataaggatcatggcgtcatgtccctcccccggatcgcacacctccacctcggagtcaggggaggctggcgctcagagtgcggtgtcgcaccgcggctccggtcagcgctctccaccccctgccagcgatttaaaccccgcgaggcccctggctggcatgcacctgacctcgagtgagctgaaagctcatgctacctgcttggcggccctggcccgtgccggccatggcacccgcaccgtggacgacgtgctgggctgggtgaaggctgagctggaggccaggggccctgggctggcttcggaggagggctcggcgccgacctcctcctccgccctctctcaagaaggccccgaggagccgaccaggcccagtgtcgccccgccccagggcccagcccccgcccagctcttcgccaaggccacacactccagccacctcaactacagcgacatcctgcaggcctttgccgccacagcatcaggtgggaacaccccccccccccaccttgctttgtggtggtatggtgggcactgtctccatggcgcggggtggtcgccccggacctgcgtcccctttgcttcggaccagggtgctgtgcatcccagagccagtggcaggctgctgtgtcccagcatggagccctgtgcgagggcagatgttcctcctcttcactccatgatcaccgagtgaacccctctgccacatcctcgcaggtctggacccagagtccctggccgactacctgcacaacctggcggtgctgtgccatgaggcgccggacaacgagctcgtcgtgcggcccagcgtgcacagcgccgacccgtacggggcatccggccgcgctgcgcctgcccaggcacgcgggcctgccccccccagccgtggccacccactgtcctcgatgctaggatcgcagcctggggtgccgcctggccccatgtaccagccccgccccccgggccagcccctgcctccccgccccccggctcatgcctcactcctggacgacggcttccggggacacattgtgcagcccctgcgctcatcctccgaccccctgcgcctactcagcgctctggaggagctggaaaggagggaatcggggcacgggcccctcgcgctgggcggcggcctgcacctgggggagctgccttgggaggaggcgccgccggccctcccaagcctggccgcccacctgctcccgtcggagggccaggggctgctgaagacgtcgtcggcgcccgagcacatgctgcgtggggcgctggccgctgacagccaaggcaagcgagttgatggggtgctgggtgtcgtgggggtactctcgagggggtgcacagtgtaggatgcacgcttgccaccatgtctggcgcaaccgctcatcttacgaccaactcacacctctgacgctgcagccccaaccctggccgaggagtgggagggcctgggtgcgagtgccggtctggaccggcgtgggagctcgtcctccatattctccgccccgcctgccgcccgggagcagggcgccaccgccaagccgtccgggctgtggccgggggccaggacctttgtgcagcgtcgggcctcgcgcctctccacacactgcatgccggcagaggagcagtgaagggccggtgctggacgaggcaggccaggggtgtccatgcggcaaccccctagtacggcgcttgtattattccttatcaaccccatgctggcccgagaatcggcaggtttggtcaccaaaagtactcctcaacacacggagttcctccatctttgtcctgtccgtgatagtccacctattgctttccaatattacgcttccaggcttttcatctgtagctgattcaataaagcttcctgaatctgggaggagtacttacctgagaagctaccaaggggaagcatgccgcggacgtccggactccgcgatatgacaaccttccttcgtttgactcccgatgcaccgtccctagatcagaagccagagcatcgacttggaacaagcgaggcctgcccaacatttatttctcgggtctgaatctaacaaagacccatgtcggtgctccaggatctggtcatgcagaaaggtgcgagacaccgtgctttgaccggggctgcgggcaccatccggaaagcatacgcaggcaccaaatgcagactaatgtcagcataatagcctcatctagttctccatatcattacatatctactcctatccccgtgcgatgtggcacaggcgcgcagagctgcaggctggtagtgcagcaggaggacacggcggtcctcgccaccgtgagccagctgggagggcgtgatgctgggcatgcaccacctgtggccgtacagaccaggtataattcgtaatttggacgtggggcctcgggggatgggcatattttcagtgatgcatcgatcgtgcttctggagggtataggcgaccggaagcagcgtgtgcaacatcatggcctccacaggcccatccatctggatgacatttcgactctcggcccctgatcaggttctctgaacccgacaagtgcgcatgggaggcactcgtggaggccttcgtggcgctgaagatgcaggaagggtatgtcatcagccaacattatgccacatcccctcgcatccatggtgagagcagggtggggtgggcagccacttggcaaaacccatgtcccgaccttggtgcaggggatgtggttaccttctcaatttcattgcatgtttgcccatgcagatatcctctgagcctttgtgatggcgagcatggcatttccaactcccagactttccacacggcttttcccaaccagaattatcactttcgctgtctgggggctcgctgccctcgctggactccatgccttccacctgcgagcgcgagaatgggagcttcctgagcgacgtttctccctttgatgccagccccagcgatgactcggctgcaggcttcctcccagcggtgcgttgcccttgtggcaagggtggccttggggcctgggtctgtgccagctgggatggcgttccctgcatgaaccggtctcccctcacgaccctccctgcaggacatgtctgggaggctcgatcacaagaagggatgcacagacatccgatccatagcccagtacttccggtaccccatcagcgatgctgcccagatgatggacatctgtccaaccgtcctgaagaagatctgtcgacggcacggcatcaacagatggccgcaacgcaaggtgcggggtggtggggcttggtcccagtggagactgtgctgggctgcggcttagtctggtgtggaacgcagcacccatggttgagccgtccagcctgacccagcccctgagcacccctctccacatccccacagctgaagagcatcgagaagcgggtgcaggagctggcggcccgggcgcctgaggcaggtgtggaccgagcgagcctgcaggccaagattgcggagctgcaggaggagatgcatgccctcacctgtggccagctcagtctgccaagccattgtgcttggtgatgccggcgggggcaggtccccatggtagctgaaaccccaggagatgtgctcactccttgtatgtgattgctttggaggactctgcaacacgtggagtcagcacacagacacgctgagaggggcgtcaagattgcagagggagtcccgccctcctcatgcctccaggatgtcgtcccagcgccagtcctggaagaccttgccggggacgaacagtgtgcgtgccagggcctccacgccctccggatcgggtgccagggtcggcacaggcagcctgggccccaggcccggtaccgcggccggcgacgccgtgccctccaccccggcgtcggccatgaccgccgccagcacgtcgcgctggccggggtccagcaggtcggcctcgcgctggagcgcgcccagcgccgccgccaggtgcagggccacccgcgaccctggctccaggcgggacaggtccacctggtacagcacggcaaaggcgacccgcgccgcggcccgcagctgctcctgcgtccgacctggcagcggggtgtgggggtgagatggggtgggtggggtaattactgggtcgggattcatgatgagcaggaaactcgccgggcagagcgtgtgcatggccaggtgctcgggagtgagcagggagattgaccacacgacagcggagtatcatgaatggcacgctccgcagtcaggctttgatcctgcaggctggtttagtagaccgccatgtcaagccccccnnnnnnnnnnnnnnnnnnnnnnnnnnnnnnnnnnnnnnnnnnnnnnnnnnnnnnnnnnnnnnnacacacacacaaatctcttcagtatccacctccaccgccatgcccaatgcctgccttcattccatcctgactacccctcccagttccgcacacaacacccaaaccctcgcacgcccccgccagccccccgcaccgcagctcgcgcgctggtggatggtggcgaggaggagcaataccctctgcagtacccactccagctggcgcagcgtggccgacgcgacgaggcgggccacgccgtgcagcagcgccagctcagtgcgctccccgccccggcccgcggcccggtccagctcggcagccagctccgtctgcaccgccgcgtcctcggggaaggcggccagcacctccgccgccgccgacatggccgccagcaggacggcgggcgggggcgaggggtctggactccctccctcccactcctcgccgtcctgctggctcacggagcgcgccgcctccccctgcgccgcccgcggtcgggcgctcatcagcgccaccaggagtgggatgagccggcgctgcgcctgcggtgagcgacgaaccggggcggctgcgctgtcagccagacgctcgtccctgctcgtgcccctcaccctcgcaggtcacggcacaggaaggagacgggaggtccctcgactgcgatgcccatgtccacccggcaccacccggcctcgccgcgccacacacgagcgagcccagcacccgagccccctgccgctcgcacctgccggccaggcagcgtcggggccacggccccagccagcaaggccatgcacacgcatccctctgccgaccccgaccccacgccttccgcgagcgtctccagcactgcgttctacgcgacggagtgggggcgggatggtcgggacgttccagcgtaggcatgcgcttgcttcgagcgtcggcgcgaaaccccgccgcccctggcatgccgtggcagtcagaaggtgccagcacacactgagcagtctttccagggtccagtcacctcccctcaccaaagatccccggtgatccatggcgatcactggtgaaacgccccctccttccacccacatctccacctgggagccctgcagccacccaaagaccagcgcagtcccatgctccctacctgaacagacaaggcctccgcgcaggcaaagcgcacggccttggcggtggcgtgcgggtgctgcagggcccaggccgcccccccgcccgccgtcaggcggcggagcagcgcccccgccgcgccccgcccgcagtacggcagtacgcctgacagcaggagggggagcagcgccgccctgcccgccacggcggccagcggggactgcggcgccaggtcgcgcgccgcggccgccacgcggggtgtgggctgcgggcggccgccatcgcaccatgaggggaacccgactgttgtgatgggggccggggaagagagtggggatatgtacggcacaagcacatgcgggaaaacagtctgggtaccaggaatgcatgggatttccggcgtttgcaggctcgttgcgctgtggaatgcagacccctggagccaggcgggggccacgccagcgttgctgcttcccgcatgctccgggaatccatcacagcacccacacatgcacagacaaccacatgcccccatcgccacacctgcggtgtacaccaggggctcgactgcggcggcggaggctgcctcccccagacccaggcacacggccttgagcaccgccgcaaagcgctggcgcagtcccttggtctccgggacgggtgccacgagacgcgccgcgccgacgacagcaggcacgacggtcagcacgaggcagtccaccgccggccactcgtgagccgcgccggcgccgccagaggcgcaccacgcctcgagcgcggcggcgaggaccgggcccgaggcatggccgttgcctgacgccgcaccgtcacgctcctccccgtctcgctgcggcctgcccgcccacggggggatggtggcggccgccagccgctgcaccgccggcagcaggcccagcagcatctgcagcagtgccatggcctttgagaggggaggggcgggtgggggaaggggggagagtgaagggggtgtggcgcacagctgatgcagcggtgcttcagggtcagcgactcgagaaggagggtggggaatcctcgatcatggcatcgaaggcccagacctcgaccccctgccctgctgcctcatgcacctctcctttcgcccttcccacccctgccgcatcctcacccgccagacggcggccccggagggcgcgcgaaggacggcggaccccgccgccacgctttcctcgggcgtgccggccaggaagggcgcgcgcgccagccccgcccccagcgcctccagcgcgggtgccgccaggtccagcagcacacccccgccgttctccgagcccgtgtccccgcccgccgcccagtccgccagcgcgggcacgagctcgtcctgcgcggcggcggccacctccgcgccggggtcgagcacgaggtgcagggcaagatcgcgcaggacgagctc

SEQ ID NO: 22099 - DNA, 61 bp, Chlorella protothecoides
acgtcctgccgacattatgaagctgtgtgcacctgccagccctcccaccctcctcataggc

SEQ ID NO: 22100 - DNA, 61 bp, Chlorella protothecoides
atcggctgcgacccctgattgcgcgagcactatcatccgtctttgtcgactatctgcaacc

SEQ ID NO: 22101 - DNA, 264 bp, Chlorella protothecoides
agagggggtggggggggactgtgtggggggcatggctgctgggccagtacaggtcaggcgaccaggcctagggcgacacgaacgcttcaaggtgccgggggtggtgtggcggcagggagaggggcaatcagaacccctcaggtgcagcacatgcaatcctttgcggttgcaagccgactgcaagaccatgcatagacaatacgagacccgtgcggggcctgccaggagcgccagaggagcacggtatgtgatcgatccccccct

SEQ ID NO: 22102 - DNA, 80 bp, Chlorella protothecoides
aggagcacggtatgtgatcgatccccccctgcccccacccacacaatccgcaccaggccgtgctgggtggcccagaccac

SEQ ID NO: 22103 - DNA, 61 bp, Chlorella protothecoides
catacagctgcatatgcgagctataatgaagcatgcagctcaagaaatcacatcgcgacat

SEQ ID NO: 22104 - DNA, 135 bp, Chlorella protothecoides
tgcctgctgagatctcacattctacagtagagctgtaaagcttctcatcacatgttgctgctgccaaggccctggatctgccatacaccgcgttctcctagcagaatgcatcacccccacccccggctctcctgg

SEQ ID NO: 22105 - DNA, 106 bp, Chlorella protothecoides
ggatcgcgtcctcgcctgttggagtggaggaaagaggcggagggggggagtaccgtcaggcaccgttgcttgtgttggtggagcacagagtcggcacgaaccgctc

SEQ ID NO: 22106 - DNA, 107 bp, Chlorella protothecoides
tttatgttgaaggattttggaggctggaaggttttagtgggagtgcggtcctgtcgcgtggatttatgctgtcgccgagggctcaaaagacacttcccgccacactc

SEQ ID NO: 22107 - DNA, 62 bp, Chlorella protothecoides
cccgccgcttggcccccgacatggagtggaattccttggatgagcaggatgtcacgttggcg

SEQ ID NO: 22108 - DNA, 153 bp, Chlorella protothecoides
agccaacaccaaccagagcaccctcttggcaccgatgtattcatgtgcgacgtccttgtagcagggagttacaatacagtgcctgttcagaacctgacattttgatagccttgccccattttgccagtgccctcgagtcctctactctccaga

SEQ ID NO: 22109 - DNA, 115 bp, Chlorella protothecoides
gggatgtcgtgccagctgggccaacggccgacagcctggggggcgcaggcaagccccgcgccgtcacgcgcaggctctccgtggcgcagcccccgcatgcatctagcaagcaccc

SEQ ID NO: 22110 - DNA, 61 bp, Chlorella protothecoides
tcacagtatacacaaaagcatggcagggcgtgtatccgcggcagatgactctgagctttga

SEQ ID NO: 22111 - DNA, 61 bp, Chlorella protothecoides
ctgcaccggtgcgggcacctgtagcggcctcactcttacaagcgccacccagatggattcc

SEQ ID NO: 22112 - DNA, 77 bp, Chlorella protothecoides
caagtcggtcagcatgacgaatctcgtgacaacctccttgtacagctttgctgcgaagatcctgtgcctacctcgtc

SEQ ID NO: 22113 - DNA, 61 bp, Chlorella protothecoides
gacatggcagggaagcagctcgacgtcaccaccccagcgcgcgatgggggtgatcgcgaag

SEQ ID NO: 22114 - DNA, 137 bp, Chlorella protothecoides
cgcgggctatatctcggtgatgccttgcatcagaagagcattgccgaggttttggagtagtatggaggctctccgtcttgagagttcagatgaggctgtgctgggaatgccccccaaaacattcacgcctcccttgg

SEQ ID NO: 22115 - DNA, 162 bp, Chlorella protothecoides
cagtcatgcgaggcacggaggccgaccgggcatggcacctccacgcaccatccatggctaatgtcgatttgcggtcgcttcagactacaatgtgtacatgaatctggggtccaaacgtactgcagaagatagcgtgccagggccccgggaccacctggatca

SEQ ID NO: 22116 - DNA, 71 bp, Chlorella protothecoides
tcacaaccgtgtcatggactatgcaggcctaccgaatccatgccatctcggtattctgcaaccattcagcg

SEQ ID NO: 22117 - DNA, 78 bp, Chlorella protothecoides
atagtccttgctcaccccacttctctcaccgctgcaggctagtcctttagtattgctcctcactgaacactggcaaga

SEQ ID NO: 22118 - DNA, 61 bp, Chlorella protothecoides
gcgcagttgacaaagaccagcacctcgcccatgtatgcacactgcgagggcagagcgtgga

SEQ ID NO: 22119 - DNA, 88 bp, Chlorella protothecoides
tcaaaaacaggtgctggaagcgggagcggggggtgccgggcaggaaagcgtcgcacagggcctccagctcacgcaccgcgccgaggtc

SEQ ID NO: 22120 - DNA, 99 bp, Chlorella protothecoides
ccggtgagtccccgtgccaggcagtatctctgctttaaggtgcaacctccgttgatgttatgacctgcccaatgtcgggacagttgcgctctcacttcc

SEQ ID NO: 22121 - DNA, 160 bp, Chlorella protothecoides
catggagtcggtggtcaccaccttgacaaaaggaaacccgctgttgatggccacggtggaggccagggctgcaaaggtatgggagaaattggagggggacaagcatgacggtaccctgcccacaacgcaacgtgcatgccagtgacaaacggccagagtc

SEQ ID NO: 22122 - DNA, 78 bp, Chlorella protothecoides
gcactgggaagggtgagtgggtgggtggcgcgagggggtcattcatgactgccccttgctcccccatgcatccggctg

SEQ ID NO: 22123 - DNA, 171 bp, Chlorella protothecoides
ggggggggggggggggggggggagggtgacggtccaggagtggcctgctctcatggaaatttgccattcaaactctgagggcctgcgcgcctgcacggagtgtcttattttggaccccgacccttacgccttgcaacccgaacatcatgcagcactatgccagagacgagg

SEQ ID NO: 22124 - DNA, 70 bp, Chlorella protothecoides
gcttggacgtggcagaggaaatagcccccttaactcgtttggggtggtacggagcccatcgagcctgagt

SEQ ID NO: 22125 - DNA, 115 bp, Chlorella protothecoides
cagtggagcacacggagtattgtaccatgttgcagccagccaacaacgtatgtgttgagacacttctctcacgagggcatgagctagctgagaacagcccgtctcagccactatg

SEQ ID NO: 22126 - DNA, 14783 bp, Chlorella protothecoides
ccccctccccccccccaccttgatggaggcggcctcggcggcgacccgcgcctccttgttctccagcaagctgtgcagcgcaatcaccgctcgcaccagggacgcgacgtagacgctgagcagcgcgtcgttgacctggccggagaggccgcgggccaggctgccgccgcccaggctgggcagcagcgtgagcacatcctgcaggccggccaggatgtcgtggtgcaggggcaggcgcccctccaccaccgccgccaggtattgctgcacctccgccagccgcgccgctagcgtgcgcaggcccgtcaccatgccgtcgacgcgggaggaaagcgtggaggccgtcgcatcgcgcacgtcgcgcagcaggtgctccacgcctgggcggggacgagagggagggagggactcgggagtgcgaggggtaggactgacggggcaaagggagctgggcagcgttgcagggtgtggagggggcttgatcacagatggccagggcaggggtgcattggagcagggggggtggatgagatgttccagctccaattgcgtccgtggcagggcgccagcctgagagttcggaggccttccaaggggcccccccaacacacatatacacttgcgggccgggcctcaacagctaagccttccagcggccctttgcacctcctgcatcaccgaccataacccccccccccctcaagcagacatcttaccaatctcttcggcgtccgtggctccaacctcagtgggcaggttgacaaacacccggcggctcttctgcgtgccatcctcccgaacctcctccacgctctcgtaggcatgcacgggcaggcccatggccttgggctggaaagggggagcatgagggggtggggttgagtgtgaggaggcatattcaggaggattgtgtacctgctcttgcctggtgcaccctaccacctcgatctgtgggagcaggcccggccccctgttcttggtgacccaagcttgtcatctggagcagcgtgaagccagcagcgacatgcgcagatccagaacgctgccccgcacctgcacttccgtgatgacgagcaccgggttgtcgcagtacgacgcaaagagggcgtggatgtccaggtcagactcgcgcagcctggggccggtgtggtaccagccaatgatgcgctcacgcgctgcgcaggaggggcatggggcgctgagctgcgggcgcagtctggggtgcgaggcagcgcggatgcatggcgtgcacaccatgctcagacgctctccacacaccatgcacactctgagaacaaacacacacccatccctggtgcccacccctcgacgcaccattgaccttcttgaacatgcggaacatgttttccaggtagttgtgatccagaaaccagatggagggatcccgctcatcctcctcaaagggcactgtggccgggaagggcagggcacaggctcacgtcagtgatctgcaccccatctctgcagggtatctggaccactcccgagccttgcctcacctgcaaagctgttggtagcatctatccggcccttgtatgtctcgcccagcagcacgcccaccacccgcttcttggtgtccttggccactcggttgtagtgatccacaacggacaggaggacgagcgggtggatcaccacctggtccgcctgagtagccaccatgtcaggccaagtttgggcccgatgaagcgtggcctggggggccgtacaaccggccgatgaatcggtcaccctccgatcacttcactgtgcaggggctcaaggatgcggtatccagagtgcagatcagatgggctggtgcatgccccacgccaggtgatagactgatgaatcgatcctgctcaccactgcctgttcccagtggaagcctccgcgcgccctcaattcgccagtgatgcacccccactccggcaggggtggccgacatgttttgaccctgtaccacatttgttactgagccccaacttcgcgcgtaagcctgtctgggtgcccgattcaccccttggttccagttccagagtacctaaccctgctgtttgattggatatctggccggtccgggcctggaaaacgtttgtcggggggccaccacaccactatcatggccctgctggctctggccacccgcacaggcctccggcgatcggtgagcagggtgaaccctgcgtgtacgggcgatgtgcaacaatttctgctcccagcgagcgcggtgtcaacctcactgcctccacctctgcagatgccggaggttcgggccctggcccagggagcgcacctgcgattcttcgcggaggctgccgcccagcgtgagtgatgccctttataaactttgcttggatgcaagtggtacttgacatcagaaacttcggacgcacaaccaacagcacgccttctccgtccgcccccacagagagggaggaggaccccatcctgaccctgttccgggagaaccagcggcaattccgggagttcctcaagggactccaggtaccacttggggggaggggtagagtcatggtttgggtgtggcatctttgcacgcaggtcatgcgtgcttgcccctgtgaaccacggaggtgcaccagttgactgccactcaccccgacttcacaccaaccccacccctcaccctcccccctcatgcagggcatccccttccccctgtctggtgagaagaccgcggtggcgcagtacaaggaccgcgtggaggcgctgcgctccgaggtcggcgcccgcaccgtggaagacgcggtgcgcgaagagctggcagcggccgccgcgcgccagcccgcctcgctggcggagctgacggcggcgctcagcgcctcctccgaccccgccgccgttgccgcgcacgatgcgctggtggcctgggcccaggacgtgtcggactggctggaggactttgaggaccggcgcggcgacgacctgcccgacgcggcggccaccgccgcggtggaggccgagctggcctcgggccgcctgctctccggccccgacgcccgctccgacgtgcaccccgccgagtccgagttctggaccaaggctgcggagtgggaggccgggctggagcgcgtaggcgcgctgctggccgccctgccggaggtgcccatcaccgacgcgcgcgtggcggagttggtgaccggcgagtaccaggccctggtggaccaggcgcgcaccgtggtggccgacgagctggccaaggccgacgacctcaccggcgcaggcaccggcgggctgccggaggagatcaagcccaagctggcttgatgctgggggtgatggtggaagagggtcggtgggtggatcgccgaggctggcatgcaggcgcgcgtcggtcttgtgcgtggtctaaatcctggtgctcacggtacactgaggcatgctgcttcggagcgcgcgtcgagtggtcctgtgcctgccttctgctacggcccaggcgtgtgcgccctgaatgtgatcacatgcgcagtcggggcagaggttgaaaggggtgcaggggaggagaaaacgaaggcacaggaggacttgggggacacgtcatgggactgagccagcggatgcagtgccagcaccctgactcggagagcagcacgggaaggccctgggcaaccagggcgtcgtagtgttgagctgagacgcttgcccgctcctcgaggcggctgcgtcgtcagtagtcgtcgtcctcggcccccctggcggccaggcgggggtgcaactggtccccgccctccgtgccgggcatgccgccgctgagcatgctcagcatctgctgccgggcgctcagctcgccacgcagcaccgtgccgtacccgccccgcccggagtcgtagtccatgcggtactcgtcccgcacctgggaagaggggccaggtgaggaggggagtgggaaatggggagtaggtgtgggacagtcgccgaggcgtgcgacaactttgcatgcaccgccacatatgtgcaggggccccctaccatgtgcggccccagggaccctctgccctcaccgaccctgccatcgacgtggcatgcacgcacctgccccccgctgcgcccccggccaaactgacggccgtcccggaagccccagtcaaagtcgatgcggatgggccggtcgtccagcatggtcccgttcaggtacttgatgcagtcctccgcgtcggcgcggatgtagtagatgacgaagcagaagccgcagggggtcatcttctgacggtccaggcccatgatgatgcgcttgatgtcccccgtcttgctgaaaacctgggcatgggcatgggggtgcagggagcaaagggtgcgaggctgaatgggagagagggctgggccactccccgtctaggagtccgtagaggtgttcaagatgcaacgtgtgtcagaggcaacccgattctggagtcgctcttccaattgaagctgtgtgcccctgtttgtgccgtgataccctccccacacacctcgtatatttgctcctcggtggtgaagaacgacaggttgccgacgtacaccgtggtgctttggcgcagcacctcctcaaactcctcctgagtgccgttgaagcggcgatcccggtactgggcctggggtgggtgcagacgcttgagaaggtccgccatcccgagcccaggcctgggagccgccctctatttgtactgctttcaacactgatatatatgcagtcgctacgtgattatgttcaggtgtcgagaagtagattttgatggccgattgttaaacgggatgtactttgtgacgggccgggtgaagtgccgtcgagcgtagccttgagatggcgcgctcagagattatgataccaccagcccttctcattacttcaccaactgaaaccacttcatgttactcctgaatacttaattgcgtcgaagtgaagggctctcaccggcccttagtgtaattgggaatggaaaggccagcctcggcgattgcacatgtcacgaccgctctgtgttcaacatggggctgtatgtttccggggatcaaagcgatccgggtttcagagaaaatatagcgaggccggaattcgctgattgtggcacctggaacactgatacattattgctttgcaatcctgcaggcatacagccagcatcttcaaatcttcagagtccccacctcacgcggttgaacaatgctgatagatgcattaaggcagcgatccagtgcacagggcaagttccttggaggctccgtgtcccggtttaaaagtgaagaagttacacgtctccacgtctgtgccgcctggaggggggcgcgctcgattgaaatgttgcactcgatcgacgtactcctcgagctccatggctaaggacccgagaatgtgactgtgttgtttgcattcctgtgcttatcgatacaaggagctctcctagggcaccggatcccctcgccccacccagctccggcgacatggtggccacgagcgtggccaacctggccgcgctgccccttcccaccctgatcgggggcatcctggtcgtggctctggctgccgcggttttcgtgagggctaccgcaaacctgcgccgcgggaactccccccccgtggaggagggcgtgccctttgtcggtggcctgctcaagttcagcaaggtacgtccgtgatctcgcccctcccgcggcgtttgggatgttgtcagtgtcgtgtgcaggatgtgccgtgcgccgggctgcatgcatgcagcgtgctggattgccccggctcccctgacgtgcatccccaccccagcagcgagctggttcccctcctcactcctgcttttcctgcctccttgacacatgcaaccccttcccccccctcccagggcccctggcacctgatgaagagcatgcactccaagtatggcgaggtgttcaccgtccccctggcgcacaagcgcatgaccttcctgctgggcccccacgcctcgccccacttcttcaacgccacggacgagcgcatgagccagacggaggtgtacagcttcaatgtccccacctttggcgagggcgtggtgttcgatgtggaccagcgcgtgcgctccgagcagttccgcttcgtggccgatgcgctgcgcagctccaagctgaagacctacgtccccgccttccggcaggaggcggaggacttcttcgccgcctggggcgacaccggcgtggtcaacctggccgaggtgttcggggagctcatcatcctcaccgcctcccgcaccctgatggggcgggaagtgcgcgagtccatgttcaagcgcgtggccgacctcttccacgacctggacgacggcatgcggcccctctccgtcctcttcccctacctgcccaccgcctaccaccgcaagcgcgacgcggcgcgcgccgcgctctccgacatcttcaagtccatcatcgccgcgcgcagggccagcggcgtctccgaggacgacgtcctccaggtgcagcaggctcatgggcctggggagggtgggtccagatgcccgtgcgcaaggggcaggcggtggtcactcgaggaggggcacggaagacatcccggaggcctaccgggggctttaatccctcaccacgcagggctccagactccaactccaggagctgggtctcagtgccccgccatgcccgcctgcctgcactggccacactcaccagcagcagggccacacaatgattctcaggcagggttgatcccccctcatgctaacaaccccccctgcccctcccctctcccatccaaaggccttgattgactcccggtacaagaaggtgtacgacgggcgtgcgacgacggatcaggagatcgtgggcctgctcatcgccctcctgtttgcggggcagcacacctcctccatcacatccacctggacggggttgtacatgatggcgggcgaccagaagtactacaaggtgcgggcaggtggcagggtgctgggggagtggaatggagggtcggaccctcagcgtgttgcagggcaggcctgagggcacgcactgctcaccagccatttcccgagcccagtgtgtgcgtggaactttgttggccgccaccgctcacaaccctcgcctggccccagcctcggacccccattcccccttgcgcaccatccaacaggcggcggaggaggagcagcggcgtgtgatcgcggagcacggcaccgacatcacctttgacgtgctgaacgagctggacaccctgcacaactgcatccaggaggcactgcgcctgcagccgcccctggtcctgctcatgcgctacgccaaggagccgttcgaggtgaccacctccgacggccgctcctacgtcgtgccaaaggtgcgctggctttgggccagaggtgttgcagcctcgggcagatcgcgatggccaagccaggagccagcggcagttcagagggtgactcatccccccgtcctatgcccctcgcaatcccgtgctccgccacacatcgcacgctccctcccctttctctgcgcctccacagggggacattgtggccacctcccctagcttcagccaccgtctgaagcacgtgttcaaggacgccgacagcttccaaccagagcgattcagaggtccggattccttcgtgggggggtcttattcagccgtcctgtgccgatgtttgatgaggggagaagcattcgcagggcgtggtctggcagaagggacctccagctgtgcatccccctggatctgtcctcatgccgtctgcctggcctttgccatgcacgccgcaagcccactccctcccaacacaccccacccctgcagcgccgcgcgaggaggacaaggccgcccccttctcctacatagggttcggcgggggcaggcatggctgcatgggctcccagttcgcttacctccagatcaagaccatctggtccgtcctgctgcggaacttcacctttgagctggtggacgagttcccggagcccgactgggactccatggtcatcggccccaagcccaccagggtgcgatacacgcgcaggagattgtagggcgggcgaggggccgccgaacccgggctgcaaatgcccctgtcgtgtctgcacatgctctgtgccgacctgatgactggtgggggcccagatgtggcgtttgatgtgctgtcaatctgggcacccatgggagcacgtgaccccaaccgggaacggaatcgcaaaagataagctgctgcgacgcggaaggcaccccggtcctgatgagcgtcatggcatagctgtcgagtccaggaccgtatcctaggtaccctaaaaatacaagcatgatgagctcggtgatcaccgccggaaatcgggttgcgtgccagccgggcagcagcggatgcaggttgccgacacagggacggagatcgattcgtcgacatccccgcgtcgcggcccaggcctccgatcaaccctgcaaagggtgggttggatgcttcttaagtaggtcgcatggtgccctcctcgtgctctttctccgccccttgactccatgtgtatcgccccggacttgccaggtgggaagacctccccttcgtacgaccatgtgttggcgtgtgcctagccggcctcctggcgctaggctccaccgaccctgccgcagcagactcggtgcaaggcggcgcacttgaccagtttttggctgagagctccaccagcatcaagggtgtgaaggggttgtgcgagggggagtgctgctccacctcgatgatgaaccatactcttgcccacccggagaagtccaaagacaatcatgctcgcgaccttggtttgttgctcctcaaagtctccggtcgcctgccacagatgccagtcgagatccatgaacccatcatccctacaggtatcaaggccgctcctgcccccactacgagccccagtccgagtttttcgctccccacacccacacccaaggcaccgatcagtgctgtcaagagcacggtgtccaagaccattgctccaatcaaggaagctggcaagaaggtgtgaccgtgtgtttatgggggatgccatctttgacccttgctgcctgatgcagtggatgtgttgtattaccgaggactggatcgtctaacaagcaatgagcttcttactgtcatccctcacgctctcttccaggccgcaaagacggtatcccaggcagcgccctcccctccttccaagccatcggctcctttcaagttttctggctccatcaacaagggcacccaggtgtgacagcgttcagtagaggaagccttgtgcctggtatggcgcacgtttgctatcgtccctccttccaccgcgttcgatgtgagggagctattctcaactgtgatgttgcctatcatcacagggggatcttccggagggcatcgcccttcccacacccaagggagccagcagtggcggggggttcccctcgctgccttcgctgcctggcctgacgtctgggcaggagaaggggaagtcggaggcaagagctgaccagggggtggcatcaaagctcgcgtccaagattcagcccctgaagggcagccggctgcagtcgggggttgaggacgcggccggcaaggcggccgacgcggtgaaggatgctgtgccgtctctgcccaccctacagtccagggccaagcaggcggcgccttccctgccatcgctgcagtccaaggcaaagcaggcgttgccatccctgcccactctgcagtccaaggctaaggaagccgtgccttctctgcccactctgcagtccaaggccaaggacgcggtgccttccctctcaaccttacagtctaaggccaagcaggcggtgacgagcaacacgccatcgtcaggcgacggacccttcagcttcctgagcaagaagccgcagctgccagacgccgtgaagaaggcggcgagcgagaccaaggctgccctgcccacgctgaagtccaaggcgagcggcgccgtgaaccaggtcaaggatgcggccccctccggagcggggccctttgacttcctgaccgccaagccgcagctgcccaaggaggcgggcaaggcggcggacggcgtggcgtcggcggccaagtcgctggcgagcaaggccgccgacgctgggcagaagagcaccggccaggggtcgagcttcctggacgccctgaccaccaagccgcagctccccgcccaggcgcagaaggcggtggagggcgtgaaggcggcggcgcccaagctgccgagcgcgccccagcccggcggcgggggcgggctgggcatgctcttcacctccaagcccaagctgcagcagcgggtgcagagcggggtggcgaagacccaggccgcggccaagtcggccctgcccggcgccccctcctcggccaaggacgccgtccgggcggcgacgggtgcggccgcgggcctgggcgccgggctggcctcccaggctggcaaggtgggcgacgccatctccgcgccctcgctgcccagcctgcccgacgcaggggccgcgtccaaggcgctgtccgacgccggcagcgcggcgtccggcgcgctgagctccgccaggtcggcgctgacccctctgtcgcccggcagccccctgccccagagcgtgcagagcgcggcgggggccgtggccaagcaggccaaggccgccggctcaggtcagggggtgagcctgggtcagcgctccacgcaggcgggcgcggtggtggccgtggaggtggcggccgtcgcactggccaccgccatcgtcggcggggtgacgtcggggggcaaggccagcatgccccgccccaagaccaagtctgggacacgcattttcaggggttgagtgacggacaccgagcgagaggcatggacatgtgcgctttgaacgaagaatgtaaggatgagtgtggaggggggacggcccgaacgcatgcagggggggtcagatcaggaggaaaccctcatgagctggccggggatgtcgggtggtcgctgcatgcacgagcacacccgatcgaccccagtcttcaatcttgcgatcagatgcaatccgccttgaggttgcagcctgccctgaatctcgggactccaccgctgagagccgctcgcccgcacctgaagcggtccagggaactccggaccatggccgccaagcgcgtgctggtccccatcggcaatgggtccgaggacattgagtcggtcacgctcgtcgacgtcctgcgacgggcgggggccgaggtaacgctggcctcggtcgagtccgggctggaggtgacttttgcccggaaggtcaaggtgctggcggatgccctgatcggggacctgtctggtcagacattcgacctggtagcccttcctgtgagtggcggcagcgggggtatcgggcgtgcagcttgtctcaccggcaggtatctgtcgagaccaccatgcattgacctgtgtagcactctgtactggccagtaacgcctgaggcatgcagatcccaccctttccctgggcgaggtcataatcactctgcgcaagtccacgacaggggggtatgcctggcgcagagcgcctgcgagactcggcggagctgctcgtcatcatgcgcaagcagaaggaggagggccgactgctggcagcagtctgtgccagtccctccgtagttctgcaccaccatggtaggtggaggcacacggaagctgcacaagggtgcctgcaggtgggaacctgctgtactgcacataggggtgagccacacatcttccgagacccgtgcagggctgattggggatgcgcccgccacagcccacccgggcttctcgggtgccctgtccaaccaggaggcagttcagcagcgagtggtgagatcgggtacggtcatcacgagcaggggtcccgggacgacgctggagtttgccctccggcttgttgccgagttgtacgacgaaaagaaggctctggatgtggcgggtcccatggttgttgctgcaggctgggagaaggccctagagtagatgtatagacatggagagagcatgtggaagtctacttcccccagtgtagtgtgagctgtaaactctacagagcccatcagcgcagttcaagtgactttctggaggaaagcccgcctgattcgtcgcgtgagatcttgaagaacaatgagactcgaaatcaactatccactcagcagcccgtaacagccggactcaagcggcatccaaatctcacacatccatcaactacaccgacctcactctgtaagcgcgaccatctgacctcgtttcactttgcagcccaggtccatagggggcggtgggtcctcaaagtggttggcggaatcgagctgcatggatgccggcaggcacgctgtggaggagttttctactcccaccaatacttcggcgtctcgcgaagatggagtgcgggtgtccgcaacggtacgtaggtcttcctctccctggcggaagttgggtgtcggagctattgaagtcgacttcatgcgttccctcccattccctctgagcagccattctttactccaagagcattccaaagcaccctagagtctcctgggaccttacaacgacacgggtccctggatccgcaaggtacgccctgattgagcagctggtcttgcaggcagccggccagatctaacccaagccatcactgtccggcacccgcttgcacgactgctcagatgggagcagaaggggctcggtgggctgggccgagacggacgtggcgaggcagtgccaggagctccaacaccagctgaccaacgccctggcagcactggagaagcgcaagatccaagccgagatgctgcagtcggagatggactgcctcaagtatgacaacgcctctctggaggagcagcttggctctgccagggcagaaattgcaagcctcaaaagcctgaaccaggacatggccgtggagattgaaaatcacaggatgctgcgtagggtgagctggcactggatgggggccatcctggggctaccactttgtcgggaaagttatatcggtcttcttgccaatgtgtattcggcattgattgcatcctttgccttcctcgacagggtctggatggcgacgtcttgcagctgcgcaaggcagcggccaccctgcaagcccagctggagccgaaggccacccaacagagtcgacgtggaagggagaaagatgaggctctcctcccggcagcagcagcttcagagggccaagacacggcacccacgaaaggcgttggggaagtgggaggtgcttcagccacctctcattcttctgctggagccgatcaggtatgtagatggagggttatcagtccacaagaggcatgaaaatgagtgtgttaccctacctccaggcctaaagtacctcaagcaaaggagtccccgcatgtttcgtcatacgtagctgaacggagctttgatacactatttttgcacccagtactgacccggcatcacctattcatcctctcaggaagctcagcgcgacctgcagcaggtggaggaggccaggatcgcagctgaaagaagagaggcggagtgcagggagcagctctcctccgtgcaagaggtgaggtgctccgctcatgtgtcaagtttgtggaggcttgggccccttcctgtgtcaagtttggggagccttggaccccttcctgtctgctgcttgaggtgacagcgcattgtcaaggccaggcagagcaagatctgtgacccttcccttctgtcgtcccctcggcaggatctcatgcagtgccaagcgacgcttgcactgcgcacccagcatctcgagaaggccaagaaggatctatcggccgcggcacaggatcacaatgccatggcatccaagctggctgaggccactgcttgtatccaggcactggaagcaggtatgcactgcagggttggagcgagcagagaaacccgtttgctgagggtacatgtttccatctctagatgttgtttggcactgtggcttccagtccttcgatgcacccttcccctgcccttgcagaggcatcgtccagcgccgcgcagctggagactctgcagtctctgctggatgcatcatcggttgcagcacaagccgcggcagccgatgccaccagcaagctctctgctctgcagaacgagctggagcgggccacagctgggctggccgcgtcacaggctgaactggttgacgccagggctgggctggccacttcgcatgttgaagtggccgatgccagggctgagttggtcacggcaaaggctgagctggccaacgccacatgtgagcttacaatgtcaaaggctgagttggtcgaagccggcgtcaggcttgaagcccagggggaccaacgcgctgcgctgtcggccagccacctgtccgccaccgtgcgactggccgaggccgacagccgggcgatgcggatggaggctcgggcggcggaggctgcggcggctcgggacgccgcggcagagtcggagcggatctcccgcgagcgggcccggtcgctggcagtggcgctggagacgatgcgctgtcaggcctgggcctgggttgaggaacgcgccgcgctggaagagagcgtggaggagctgcgcgccgagctggccgcagaacgcgaggagcgggaggagcggctggtggccgctcgcacggccggcgctgcgtgccacgcggcgctggcgtcgcacctgcgcgaggagggcggggaggccgcggagcagctggttctgcagtgcggcgacctggccgcccggctggggcgggagagcgccgcgctgcgcgtggcgcgcgccgaggcggagcgtgccgccgcgatgctggagctggagagcgcggcgcgcctggaggc

SEQ ID NO: 22127 - DNA, 61 bp, Chlorella protothecoides
agggagagtcctcagggctgggtgagggagtgtcctcagggctgggtgagggagagtcctc

SEQ ID NO: 22128 - DNA, 80 bp, Chlorella protothecoides
cgtcatgtgtcggtgcttgtcctggaggactgcgctgccggggtgtatcatgtgcaccaaccgagtcgaagagcatctct

SEQ ID NO: 22129 - DNA, 61 bp, Chlorella protothecoides
agctgtcatcaagaaggtctgaaaggcgggcagggcaaagccacccagaggcctggggcat

SEQ ID NO: 22130 - DNA, 144 bp, Chlorella protothecoides
cagactgaaccgccgggaagcggccaagctatttgctcagcttctgggtgagtggtctggaagatgcttgccctgctcaactgtacgtacgggccgactgcggccacaaccttcgtcatgcacttgcattctcaccttgaaccg

SEQ ID NO: 22131 - DNA, 61 bp, Chlorella protothecoides
aaactcatcgatgcagcagatgccgcgatccgagagcaccagggctccgctctccagcacc

SEQ ID NO: 22132 - DNA, 123 bp, Chlorella protothecoides
aaggagcacgattgtcgcgatcaggacggacagggatgaacccatcgcagtaaaacctacagatatgtcaccgcgcgatagactaccctctgaatacctgtacgagatcggcgatgccactgc

SEQ ID NO: 22133 - DNA, 61 bp, Chlorella protothecoides
cccctctccagcggggtggaagcggcaggggcgacctcgcctggcctcggcttccagacga

SEQ ID NO: 22134 - DNA, 145 bp, Chlorella protothecoides
ccagcctccagtcatgtggctgtacctgcaagaataattcgaaaaattcagcgagcgaatcctcatgatactatctactgagaagaagtatcaatgaatcacatcccaggaaaacatcaagacctatacccttgacacaccaccc

SEQ ID NO: 22135 - DNA, 94 bp, Chlorella protothecoides
tcgcgggtggcgctggcgcgcgcctgggatgtggagtggggagggaaccggacgtagggttccagtgttgcatgtcttggagggagggaaaact

SEQ ID NO: 22136 - DNA, 64 bp, Chlorella protothecoides
gcacctcagatccctgccgtagagcctgccgccgccgccgccaaagccccctcgtcgggcgggg

SEQ ID NO: 22137 - DNA, 67 bp, Chlorella protothecoides
gtgagaccatggtcacagaaggttcagggggtgatgctcctcttgaatctgggagttgcctgttctc

SEQ ID NO: 22138 - DNA, 75 bp, Chlorella protothecoides
ttgagtggcgctcctggttgggggggacacatgatgggaggctctggagaatcccttgatgatacatcaggctcc

SEQ ID NO: 22139 - DNA, 148 bp, Chlorella protothecoides
ggcagacatcacacagcgggtgcaagggcaaccgaatgttcaatcatcctgccaccatggacacaagtagaccacaactgccacaaactacgagctgtaactcaacattgctcccccgacacacctcaaatggatcgcgaacagccgt

SEQ ID NO: 22140 - DNA, 78 bp, Chlorella protothecoides
gctccaatcggtcctcaccagggacactcggggcttggaggtttccagcggggggctggtcgcggcccttgtcctctg

SEQ ID NO: 22141 - DNA, 68 bp, Chlorella protothecoides
tgaaacttgcgttgcatggcgcacaccatggagggctgagcgacacggccggagccatcgcgcaggca

SEQ ID NO: 22142 - DNA, 162 bp, Chlorella protothecoides
gctgctcacgtgccctctgcgagatgcgtcacctctcccattacgcacccgagtgcctggcaggtgaagctgaggggttcttaggttcgacatgtcgactgaatacatcttcgacgaccagaacatccttgaaagatgcctcaagtccagatgcagcttgcg

SEQ ID NO: 22143 - DNA, 61 bp, Chlorella protothecoides
cagaaacccctcagacctacccgatgactctccagacctcagtctggtgatggcgttcgtc

SEQ ID NO: 22144 - DNA, 67 bp, Chlorella protothecoides
ccacacggtacatagtcatgagcaagacccccaaaatgtatattcccgccacccaatggaaagcccc

SEQ ID NO: 22145 - DNA, 106 bp, Chlorella protothecoides
tgccaaactttgttggatgttcacaagctggaggactatgtggggacaagagattcagtgtaggcccttggacaacaaacatatgtaaaaccaggcacctgttgct

SEQ ID NO: 22146 - DNA, 63 bp, Chlorella protothecoides
acctcctctgacagggcctgaccaggcgcaccaccgccctcctgccctccccttgtgcccgcc

SEQ ID NO: 22147 - DNA, 61 bp, Chlorella protothecoides
tcgacatccaagtcctggcccgcccaaccacctgccggaatcactcacccgtcggaactgg

SEQ ID NO: 22148 - DNA, 64 bp, Chlorella protothecoides
aactcagatcaagcgctgccctcgtgcacgaccgcacgactggacgggctgtccctttgcgcac

SEQ ID NO: 22149 - DNA, 62 bp, Chlorella protothecoides
gtgcaagcagatgctctgtctcacacacacctcatcgattgctcacttgcaaatggcatctg

SEQ ID NO: 22150 - DNA, 61 bp, Chlorella protothecoides
tgaccgtgcaccgcctggagggcctgcagcacctccacatccccgccggccagcgctacgc

SEQ ID NO: 22151 - DNA, 72 bp, Chlorella protothecoides
tggccgtgtaacttttggggccggcatatcatattcctcatgacacgagtgctgtcccgcaggttcactgcc

SEQ ID NO: 22152 - DNA, 10880 bp, Chlorella protothecoides
ccaccccccctccccctccaccaccaccacgccgacagggtcacgtcgtggcaatgaccggagacggggttaacgatgcccctgcgctgcggcgggccgacattgggatcgccatgggctccggcaccgccgtcgccaagcacgcagccgacatggtgagggcagaggggggccacatggcagtagtgccctccagggttggcgtcacaaaggcaggtcgctgcctcctcgtaagcgcagtgagctctgcatggactgcattcccagtccttgaggcctttccacacgccctaccacatgacctctgacaccccttcacacctcctcacaatctaccaggtcctggcagacgacaactttgccaccatcgtgtcggcagtggcggcggggcgggccatctttgccaacaccaagcagttcatccggtacatgatctcctccaatatcggggaggtggtggccatcttctcggccgccctggtcggcatcccggagtgcctcaatccggtccaggtgcatgttggggggggtaaggtttccgaagtcaggcagagtttatgccaggtggtctcgtgggtccagtgggtggggaatgattctgatgatgcgagtcaggcaggcaaattaacatgactcacaggaaggctatttgcgcagaatacacctgcacccagggctgttggatggggatttcgcatgaggctctgacactgcgtggaagctccccggaatatgcaagccaggtgcatccactctgtctcccgctcacaagcgcactcagacctctctcatatctccctcacccgccagctgctctgggtgaacctggtgacagatggactgccggccacggccattggcttcaacaagccagacccactgatcatgcagcagcgacccagaagggccagccaagggatcgttgacagctggctcttcaccaggtgggtgggtgcaagtgtatggtgggagggggtcatcttttctgtgtgcaatgagcgggtggctgtttatatgaaactggcgacgacgtcgggcgattcaaagccagccatgctgtgcatgatttggcagggcagtgcagtagccctcggacagtgtccatgaataccttgtgctccccccaaagggcgtcttcccccatctggttcactacctcttacctcactgccttccccaggtacctggtggtcggcgcctatgtgggcattgccacggtgtccggcttcgtctggtggttcatggcatatgaggtgagccattcgcgaatgtttgtgggctttgcagcgctgctgccccagatttctgctatggttttcgacattcttagggttgccatgcggaggacacatgtatctcccctgtgcacaagactggggctgctcttgcactggcatgtgagagccccagccgcagccacactcagggggggtcctgttcagttcctctcgcatcagcagattcatcccacccaacaatcatgcagggcggcccccagctgtcctgggctgcgctccgcgacttccagcactgcgagggaaacgcctgcgatgtgttcaggtcgcgcaacccctccacggtgtccatgagcgtgctggtggtggtggagatgttcaatgccctgaatgcgctgtcaggtgagccaggggcatgcttggcaggggtgtggaaggaggattcgtccgcgcagccactcactccgatcggcccaggcgtgtatctccctggtcaggcaacgcactgcatacatcatccccctgccaaatgatgacatggctggaccccaccaaatgtgcagagaacgcgagcctgctgtccattcctgcatggagcaacccctggctggcggccgccatcggcgtttccatggcgctgcacctcctcatcctgtacattcccgtcctggcagccctcttcaggtgcgcgcggcggcgtggggcttgtgatttggttggcagggtggtgagacgcaggtctgccgactggtgggcataggtggtgggtcccacaaacatgcacagtcccatgtgattgcctgcattccagctgtccagtgtgcaatatttgctgtggaggctgctctgcgcatgacaacccactttccccgaccgttccctcgatgagtgcaccacttcaaccacccaccccaccttcccagcgtcgtgccgctggcctgggcggagtggaagatggtgctcctcctctctgcccccgtgattttggtggacgaggtcctgaagcttatctcccgaacgtgaggtggagatgttgtggatcttgctggggctgggggagtgcagcctgctcatccatactactctttcgattcctacaggcactgtcttcccaatggacgcaacctgctgatgttgtttctcccactcaaccctccttgttcccctcgtatataccccctcaacttgatgcagctggttcagcgagatggcgacctccagtttcggaccgtcaggcggcgggagcgtgcggacggggtggcggctgtcccttccctggctgcggagagcaacggggggcgctgtcaagtacagccccatcctggctcgggcggggggggtggacctgaccaggaagaggtcagacgagtttggcgccacccgagtggcatcgatgccatgacctggcgtggccatggcggacggcaggctgtatgagtttgtgtgtgctgatctggcgcacatgccatctgtcccaagagcatctgatgacgtaacatccgccctgcgagcctgggttcagagcggctgcgggaggtgaagaggatgtacatattcgaggcagtggcaggtggaggcgcccttcacaggcatacttggcatgcgaaggttgccttgacgacagaattgcggcagcctgcctcgcccccgcactacccagggctgcaggaggggcactgccaggccgcggggtcggggtcggcctcggccaggccggcgcagcgccagtggtgccacctcccgcatgcgtcgcagctcagcatgcgctcgccgtcgtcgtcccgcgtgccgcagctgcaggccaccacccagtcctcgtggccaccttttgggttggaggaggggggtttggtgggccgagggagctgtgcagacccggaggatggcagaggcctcgtccagcgacattccacacagcgggtaaggagcaggctcgcgatcgccaccacccaaagggcacaatcccgccatgcccgcctcccccaccccatcccacgcaccctgacgccaccaggcggggttcctgtccagccccttgccgcccatccagaggaggcgcaggccccccgcctcggcactgcacgccgtctctgggagcagcgtggccaggcgggtggcgtcggtggccgccggcactgccttccaccctgacgccccgggcgagggcagcaggatgaggggcacgtagttctggaaggccacgtaggcctcgccgagggccgccgtgaaggccagcgcggtgccgcccaggtcgacgtaagccggcaggtccagggccagggggggcggcgccagcgggagttggcgcatggctgtcgctggcgtaggcggggaagtgtgcgaggggtggtggttgttgggcgcgcagcttgcagccacgggcgaggccgtccccttgcgcggcgagggcctgtgtggaaaagtgtgttctgtcattgagccagcggagactgaggagaacaaggtaaggaggagggcaggttccccagcgagcaccccatcgtcatcacgagtctgtgcctgaagcccgctggcaggccatagagcgcatgccgcctgggacaccacacctacctggtccggctgtgtgccagctggaagttgggggggagctgggtggagagggccacacgcagcatgccactcgggggcggcgcccacgcgggcctcacatccctcacaaacagcttgcagtctcgcagcacctgaggagaggtgggaaggggggaagatcatgctgtggcatgcgtagctcaggaatggcacagagtggcgtcggcactcaaacgcccctggcacggcatgctctgtcgcatgggagcgtgcaagggcgacagctccacccccctgccacctccgatgagattccggcggaaaggggctttcagcgttcagttccgcggtgaccatccttggatgaagggcatgctgccctcccatactccacccacatcccagtcttcctcacctggactgcggctgggaggcctgccagtttgggctggcgcgctgcgtccccgccgtgcaagacagttgcacgtccgtcatgcgccggccgctgcgctgcagaccccgcactgcccgagactctcgccgccgcgggccccctgccggtcagcaccgcctcgtagaggtacctcagatctcggagcacctgggcccgagccacacccctgtcgctggaccccgcgggggagcagccgccggggacgagaggcagctgttcaccagccggtgaaacgacggcccaggtgtggccctctcccaacacgctgggctgacaccgtgcaccgtccttctggctgccctccgcaagaccatggccaggggccgccgcagcaggcaccctaggagctgcagcgggcctggccgtcgctggcggggcaccgccggcgtccgccgccggcacgccggtggggtggcggaaggggaccagccacgtgccgaggccctctgcagccggtgcttggccctgttcagcgctgcccgtgccgccgtcggccatcgcatcgtcgtgcgaagagcaggctgcgcctccacactcggcgcaaggcgcgcggaaggccagctgcccacttgtgtggcccctggccggcgccccgccgcgcccgcccctcgcccgcccagccccaggaggacttgaggcccttaacagctgcggctcggctttgccctcagctctctcaaaccccagccgtcccacccgtaggtccgccagcgccgctttccagcaatgggagcagcccgggggcccgccgctgcagcgcttgcaccccagatgctgctcaaaggccgccaagcagcccagggcctcctgtacacggtgttggcgaggatgagggcgggaacaggcgtcgacactccatctcctcctttgcaggtagggtccgagttgtgtccatcaaacaaggcaacccatctcctcctccatcttctctgcatcgcccaaacaccctccgccacccaccatgctctgcagggctcgcgctcggcaggtggcgcaccctcccggggcctgcctgcacctcccgcagcccagggcaatcttgggcccgccagcagcacgcttggcaggtgggccctcggcttcggccggctcggcctcacccagccctgatcctggatgggattcggcctggctcgcagcgcacctagcctgcgccggcctcctcgtggtcgagccgctggcgctctgggtgggagtctttccagccaccctgggcttggcgacatgcgaccaggcgatgtcctccagtcccatccactcgatcgcgcccgaatggtactgcacctggtactccggggctctgcagggggattgggagttcaggcatcgtgccaggccccggcgccgtgtcggccgcacgcatcgcctcaccatgcgccgcgccccggccccgcaaccctcccgtccccaacaaagaaagagcacctggctgcgccatccggctgcctgaagcccagcacgcacacgttgtagtaggtgcggcgggacttgatgtagacgcggatgtgagatcccggcggcggcccaagggggccccgggccatgccaccggcggcctgccggccggctcctggaaccacggcttccccggccccctttttgcgcgccacctcccccgcaggcgcaccccgcttcccctgcgtcgtggcggtcggccggcccttcccaccccgcgccggcgccgccgccgccagtgcggaggccacggccgcagccctcgccgccgcgacagcgcgctcgtcgaagaaggcgcgagcgtcgccggcggaggagctcagccgcagcatgcgctgcaggagagggcccagcgtcgccggcgaagcccgcacgccaacctcaggctcctccatgggcagctgggaatggtgttttgggggggagtgggggaggaagctggtgcatgacatgcccatcagccctggaagacatgccctacttgtgccatggacatcggctgggtaggggccccatctgccggaccccatcttctcccttctgtcttaccccatatcgctggacgatacccacgactgcgtcgtccacgccgtgaaagtcatctaccagagagcggagcggggcagcgtgcacagcacgcgctgcctctgcccactgcaagccatcacagaggtgtgaggaagttgagcgccataccacgccgcatgatcctggcagcaagtaccaagttccccatggcagtaaggtctcgaccagggttgaaaagcataggcccactgtgaggattggacggtgaagccctacgcccacatgacagatgctcagccttgctgctcccaacccagcccaaaatattcgcacctgttccctggtgatgttgtaggccccacgcccaaagtcaaagccaaactgcccgtaccaggtggagaggtgagcagctgtgtgcagcaccctcaggtccatgccaccctgtgtggaaaagcatgtgcggagttcttaacacctaaacctctccttaacggtgcagagtcgggtgcggcaggtgtggtgcttgcacccactgtatccaccagacatgcagaccccgtgccctggcctcgatctcctatgccaggtgccgggccagctggcgcagacaccggccctgctttctcccgcagttcccgcagcaggcaacgcaccttgttggagacgtcctctgtggaaatggcggtggctgcgaggcgggcgcacagctgcgtccagagcagcatgaccgtcctcccagagatccggggcccagagccggccgcccctccctgcccctccacgccattgacccgcaggaggtgaccgtacccattcccatgcaccatacctagcagagtggagaggggtgtgggcacaaggactgagtgatccggatgtgggtcatattgcgtgcctggaccaggccttcagaaggtgaggctcccgtgtcagtcaaacaggcagcccgaggcctgcccgcctgctgcctgagcggtagctccagagcccccatcccatcccatcaagcatgcaaagcagcattcgctcccttcccgcataccatgcagtacgtggcgggggcactcaaacaccgaggcaggggccgtgtagctctgcgcggcgggatcatcgggcggcggggaggccagcgccgtctgagccagggccagcgcacggccgcgagcgctggctgccgcgatggccgccagggaggtggggtctgccagtgatccaggcccggtctgcgcagggcgagggggcagattatttcagtgaagactgcccggcatggggcagtgccaggcgccgcgacctgggtcccctcccattctgcacacccttggacccccaccatcccacctctgctggtatgatgaagtggtagcgtgcgggactcactgggtgaccaccccagcctggtgcaggggatgcaagagggcccctgagcaggtttcagctcatcgcagatgggcgcaggcagggtaacagccctcccatccctgctcctcaatttgaaacggtatacggtggcaccatcacatctacaccgactccagggctcacccaagatgcggcactggtcgcaggcgggcgtgctgggagtcacttcctctcggaagacctgcagggtgggaccctcgggcagggccaacagccatcctgacacgcccttcatcttggtcagggtcacgggcgacccgttctgcttcagccattgcgtgacagtggcctcgaagcctgcgagggtctccggtgggctcactgcccccgccatctctcaaggccaggtgtgccgacaccgagcctccatggccttcggcgaacggctcagcaggcacgactgacgagttgagggttctgtgggtccgtcgggcaccgtggcagttgtgtgtacgttcctgagcgggcgacattctacattacgagatacggatggtcgccgcagtagcagcagctcaggggttggaaggatcccccacaacttcataccctattcgagagtatacgatatgttttggcagtagcacatcaaacaagactctcgtaggtgtgttttcctctgcgcagggagtgtgtatttcttcatcaggttttacaaatgacacttttggataccttgccagtttgccctggcaatactcctgtcagcatgcagatcatgcacaggactatttccagcatcaagatccggcccttgcagtacatggaccatgcgtgatgctcctaatccaggactgtgcccctgcttctgggttctattacacagctggccctgacacatctcgaccaggtacttgggatcaaggactgggactgcaggttactcagattcctgacgacaacaccagtcgaccgaccttgatatcgatatatacataagatacagaagggaatcatactcaaaatcaggtgttgggagctttctggaatctcagcccgacactcgccagagaaggtacgtgaagtgcaccattgggtacgaggggatcagctcgcgtctattcccaacatacaagtcgaatcgatctttgagttacaggtcattatcaagagcaagccggtccttgaacgacgtgggcccccacttcccgccgctgcgcaagtgcctgcctgtgcgccgccggctgtgtcaatgcgcacgtaatccaatcggagcccggcagctgcttcgacttcggcctgcgatcgagtggtgtcgattcaggggcgtggagctcgacacatgcgcttggtacatatgaagtcgcaaatgtgatcgtccaggccgagcatggcagcgagacagctgccaggccggctgctcatgcctcggtcgggtcgacaatgtcatggctgtcagactcatggccaccaggactggtcggtctcagaattcaaataccagaagtgtctgagaggcttgccgacctcatgttcctgcccattgaggaatggcggtgcacaatggttgtgtctgtaagatagaactgccgctgttccatgggcacgggcaatgtcgactggggcctgtttgccatgctggcctgcccccccgggcatagtcaccagcatggcggcatgaagttgggccgattacagttgcatggcagcgccaattcgaggtgcaaaagagaatacatatgcagggagtgaggggtagggaggggaaggggggcactgatagggggctcggcaccctagcgcaacacagcagcgggcgagtctgctccctgccaacaaaggctgggcacacgaacccctgctgagatcgaggtggcggtgaattcaccactgcatcacctctcacagtgtttgtaacgagccgtccaggtggcggcaggagcggggggggcggggagaactgacggggttgcgggggtggggtcctcagggattcacggggcgcctgacagggccaccgtggagctcctcccacttggcaagttcagactgtgatggcgggggagatcggagggttggtgctgcgaacagtcacaggggcagggtgaaagaggggcgcagggtgaaagggatggccctcatcccccgcaaatgggggggtgcttcccaatcattgatgcactgcttgccattgcgacaggcttccccttgcagtaatcatccagttttgtcccacacccttcacggcgccaggccatggcggcagcagggcctgcgtgctctggcgccccctcccgcacacgcttgctttcccctcccgtcctccccccatctcagccctccctgtccatgagccccccccagcccccccccacacctgcaacatgagttcggtgatgcgggccagctcggcacaggagggccgcagcgtgggctcctgctgccagcactttgtgatgagccagcgcaggggctccgggcatcccgggtccagggcggggcgctccttgttgatggcgacgcggacgatgatctggaagaggttggatgtctcgcgccaaggctgtcgcctggtgtagcactcgttcaggatgacccccagcgcgtacacgtccaccttctcgttgatggcgtcagagttgagctgctccggtgccatgtagatgggcgtgccgttgtcgttggtcacctgggacaggtaggacttggtggggtccttgacgcgggagatgccaaagtcggccagcttggcgcggccgtcggcgtccagcaggatgttctggggcttgaggtcgcggtgcaccacggcggggtggaggtaggcgaggccgcaggcgacgtcgtgcgcgacctgcaggatctccaggtaccccaggcgccgcttgtggcggtcgtggatgcgctgcgccaggttcccgccctccatcagctccatgatcaggcacagcgactccgggcgggcggtggacgcgcccagcacgcgcacgaggcgctcgctgtcgaacttggaggccagctccacctcgcggcgcagcgcggcgtgcagcgccgtccccgccaccgcgtcggcgcccacaggcggcagcttcttcaccgccacgcgccgcccgcgccacaccgcctcgtgcaccaccccgaacccgcccgtgcccagacagcggcccaggtgcggctccacctccgccgcgtagtccacgtccaggttggggccgtcgctggcgccggaccaggcgtggcccaggctgccggcgccgggcgcgggcacgcccagcaggccgccgcccgcgccgccg

SEQ ID NO: 22153 - DNA, 132 bp, Chlorella protothecoides
catccaaaggtacatgctgaccacgatgctgggcctgtgcctgcccgcgccaaccagctgccggtcagagtacagggagctgtacacgcactccgcccccgaggcgggcagccgcgagggcctggtggagct

SEQ ID NO: 22154 - DNA, 144 bp, Chlorella protothecoides
ctgggtgccggcgacctgcttctcgcgcttcgcgccgatgcccacctggagggcagtgtacccctcgcgatcatccgtctttgcttggacgacctgcaggcggaaggtgaagaagatggagcgtctgcttcccattcgctccgc

SEQ ID NO: 22155 - DNA, 61 bp, Chlorella protothecoides
agcaatcaccagtactgcagaacccctaccaccccgccgcttcccggcaagacaccggcac

SEQ ID NO: 22156 - DNA, 61 bp, Chlorella protothecoides
ctttggggcagattgtgcttggtttgcgacttggtttctagcatcagtgcctggcggctga

SEQ ID NO: 22157 - DNA, 119 bp, Chlorella protothecoides
cattcatgggcagggtcatccacccattcttcaaagcaccacaggtctgctgcattcaacagggcatctacacggaacacaagtgtgaacccctttactgtccccacctgcagccaccc

SEQ ID NO: 22158 - DNA, 62 bp, Chlorella protothecoides
cgccgacggtgcgcaactcggagatgaccgcaacgacgtcgtccacggtcgaacgcagcgca

SEQ ID NO: 22159 - DNA, 86 bp, Chlorella protothecoides
acagacagcgcactggttggagaagcgcagggtgactcgatgcgacaggcctacatctggaatcgaactcaccgtagcctgaacca

SEQ ID NO: 22160 - DNA, 61 bp, Chlorella protothecoides
gtcgcagcagtcaccccagaaagtgcaatctcagcacactccaagcatcgtccgaggctac

SEQ ID NO: 22161 - DNA, 288 bp, Chlorella protothecoides
ggcggtggtgaggggcttggtgggggtggtaaaggagtgggactaggcgtaggagaaaggctgcttggcgtcgaaggaggaatctcggagggtgggggtggcgacgccttagatgagggtggtggcgacgtcttagatgggggcggtggagacttcttggaggggggcggtggagacttcttggcgggtgggggcgacttcttagttgagggtggtggcgacgccttagatgagggcggtggcggaatcttagatggcggcggtggtgacttcctagatgagggtggt

SEQ ID NO: 22162 - DNA, 6165 bp, Chlorella protothecoides
  modified_base (702)..(711): a, c, t, g, unknown or other
  modified_base (1182)..(1191): a, c, t, g, unknown or other
  modified_base (3565)..(3574): a, c, t, g, unknown or other
tggccgcgctgatccgggcagacacggcggtggctttcaacgtctccctggcctcggtgtcggtgtcgacggccgagctggccagccggcgcacgctgcgcgcggtggtcagcgcgtcgctggacgtggccgtgcccgacaacgccaccgcgccggagatcgcggcagcgctggaggtgcagcgtctgagcgccgacgcgcccatcgcctggctggccgacgacccggactccttcttcgcgcgcaccacgcagacgctggcggtgacggtgacggcgggcggcgcggccacgcaggaggtgcgccccgacgcccacctgcccccgctcctcgtctggccgctggccgggccggggctggcatgcctgggcgtgggcctggccctcctcctccccctcctcccgcgcggggagggctggggccggcgcctgaggagcacgctgtccccgcgccgggcagcccgctccatcgcctgaggctggaaggggagaaaggggccgtggcgcgcggagggatacgcctggcgagaagagctgcaggggaaaagtgtgcggcccgcccgctggccatcgcatccctcatcacccaggcgcccggcgcacggtggttgtacctcgatggcaggccacggctgccgctcgcctgaatcccaatcccctgttccttgagggagggcgagtgcagctccccacagcgtgcctnnnnnnnnnntggtggttgtacctcgatggcaagccacggctgccgctcgcctgaatcctaatcccctgttccttgaggaagggcgagtgcagctccccacagcgtgcctggtgtcatcaaagagaccggcacgccctgtaccagtttgctggagtgagcaccagcatctcccggccccagcagcggcgctgctggggcttacacctctgcaagataggcacccacatgcaggacgccatgcccagggcctatgcccctctgcaggacaactgtgcgattacatccgctcctgagaacatcgttcttgacaaaggattttgggcacaggaggtgactgagaagggtgcagattcaaaggagcttcaatggatctcaagacatgtatgaagggggcggaagcctgaaggtttgagggattcagaggacagatggggttcatgtcggcatcatgcgtcaaagcatgggaggtacgaaaatctnnnnnnnnnngaaggacagatggggttcatgaaagggccgcatgggtttctgagtcggcatcttgcgtcaaagcatgggaggtacgaaaatctgacggctgacggtcccttcgactagggagggtcagccacgcggggcggtagggcttcacagaggctccttcttcagggcaccattggcggcggcgcgctggtcggcggcggcctggcgagaaacggtgcgcgtggcgtcgcgctcgatgatctccagggacacggggcccatgacgcgggaccagagggcatggcgggtaaacatgatgggcacgcgctccacgggaacacccttggtctcggggatgaggaagtatgcgaagagggtcatgatcaccacccagcctgtgtggtggatttcagggggggggtttcaggtttcgcccggtgctgcacagtgcagtcggtgcccagaagcctgtgtcccgtcggtgtcacgtagcacagacccagctccatccacgcaacgaccctgctcaccggcaaagaagatgaacacgccccacttcatggcgcagagcatggacaggaaggactgcccgatcacaaaggtgaagaggaagttggcggccacggcgatagccatgccggcggggcgggtctccagggtatggatctcggagggcacgagccagcccatggggccccaggaccaggcaaaggaggagatgaagacgcagatgaccaccagcacgcccacggtggtgccggtgggcagctggccatcctcgtacttgccgaactgggtggcgaggacgatacccacgatgagctgggagacaaacatctgcacgccggcctccagcaggaagaagcggcgcccaaacctgtcgaccaggaggacggcgaccatggtggaggcgcagttgatgcagttgatgatgatggtgttgagcagggatgtcttgcggcttgtccccaaggagttgaacagcacgggaacgtagaacatgatggcgttgatgcctgagggggagttgaagggaaggggctcgtgggaaggctgtcaggggcttgtgctacaagccaccagcagagctgactcatcccaccctccaccactgcatgccatcattgtgaatccaccccgcccccaagcccaccagtgaactgctggaagaactggatgatgatgtcgatgatgagctggggggagttggcgcggtggaacatgaaggagtaggactggcgcagggtgacacggctggcctcctccgtggcctcgatcatgtcctccagctcggcctcgacgtcctccacaccgcgcaggcgttgcagcacggcgcgccccctcgccaccttgccccgctccaccagcgagttgggcgactcaggcaggactaaggagccgacgcccagcacgatggcaaaggcgccggccagacccagggacacacgccaacccgccgcaaagttctgggtgccgtagttgaccaggccggcgaccaggatgccaaaggtgacggcaaactggaataggatgttcaggccgccgcggtactgagctggggccacctccgacaggtacatgggcacggcggggttggcaaagcccacgccaaagccgaggatgcagcggccggcgaagagcatgcccaggttgacggcgcccgcctgcaggccggcgcccacgatgaagaggcagggggagaagaacatggtgggcttgcggccgtacttgcggcacacggtggcggccaccagggaggagaacatgcccgccaggaacatggtggaggtgaaggtctgcaggacctggttgtcgtacctgtgggtgggtgagtataacacatggttcagcaagaggctcacacgagtacactgcgtgccacatgtctgtgcagtccaagccaacacacttggcaagactcacttgcagtaggggctggtatcggtgatgccctcgacggtgcgagcatacacctcggggaagaacttctcctggaaggaagccatcgccgtaacgcctccggtgacaccctgtgaccaaggggtgggatagtgaggaaatgagaaagtgcgcgtcgatccaatcatgaggcccacgctgacatgtgcgatgccctaacaaaatgtaaattataagaattgaaggactcacgatatcgtatcctgcggtgggaagggcaaaggagtagagtttaggatgtgcatgcccaggaggcgtccgcgcggagtccgcagtccgatggcgacccaaacgcccgacggtgcaatgtaattaaagaaacattatatgtgcttaccgaagaggagaccaccacaggcggccataatggccaccgagataacatagccggtcaggcggccattgtactggtcgacatttgcgccagcaacgctggccatgnnnnnnnnnncaggatgcagcggccgaggaagagcatggccaggttgacggcgccgccctgcagaccggcgccaataatgaagaggcaggcggcaaggaacatggtgggcttgcggccatacttgcggcacacggtggcggccaccagggaggagaacatgcccgccaggaacatggtggaggtgaaggtctgcaggacctggttgtcgtacctgggttgagatcgagttggagtcatggctgaaggagcatggagctggtttgggcagagaaaccagggggggggcccaccccttcaggcacaccctcagtacccacttgcagtacgggctcgtgtctgagactcccagctgtgtgcgctcgtagatctcggggaagaatttctcttggaaggaagccatggagtggacgccccccgtcacaccctgcgcatggagcgaggagggtccagggattgcgatgctgatcatgcatcagaggctgggccgatatgagacacgcaggcagggcaggtgggcatcccatggagtatccatccacgctcacgatgtcatagcctgtgggggagcgaacagccgagatgagcatgggaggagggaggagcgggggatggtgcgtgcgggatctgtgcaggtgcagcttgcaaccctgcagctgacggtgcacttgcgatgccatcactgctgccacactcctgcgatgcagtccaggtcgcccaaacgtcatgccacactcaccgaagagaagaccaccacatgccgccatgatggcgacggaaataacgaagcctgtcaagcgaccattatagtggtcagcattcgcgccgacagttgctgtcagcccgccacctgccatgatgaagccttcagctcacacttgatcgtgaaagaatgaaacctgtgacctcggaaatcttatgcatgtctgaaagccgtggacatgtcggattttaacttgtagcatcgccagggtgttgatggaacggaaaggatttaggccgcgtcagcggcggcacagcggtttccgagcaaacgcgaaccgcgcatcggttcaatgtactgcgaccatctcgcgcactccttgggccagggactcgttttcgatcttaagtacatgaattcaacatataataatccgtcgctggacagtgagaggcttgccggcgaggtagggtttcggaagctgtcaaatccccgaccacatgggcatcggcttgaactgctccgcgcacgcatcggatcggctccagtctgactccccgagcgcagatgacaaattgatacaacataagatgattgtacccagcacagcaggcatcatacctgcaaactgtacatgacgaggatccctttccctaagggttggtctcgattgcgctcctcaaccttcctggactcgctcggtatcaggagccaatatgtgcttctgcaaaatctacaacctagtatccctgctctgggtgaggcacagaagtgatctgctctttatctagcagagggcgaagggaccatggcccacagcttgcagttgacgggggatggtggttggagatcagcctgcagttttcctaagcatagaatgttcctcctctttcagactgcaaaatagatgttacatgtgcattgtcatttggcgtagaggtcgaatccactctgagcacagcggacgaccaccttcaattgcttcgggagggcccctccccactcatcccatgtccaggaagcaattttccctttacatgcacatcttgcggcatgcctcgacataatggctctggttcttcttccaatatgcagcaagagtctggagggggcaccgtgatttggcatcacctgagaggaagttcaaggcctgcacggaaatgatgagagccgccgtaaagcttcaacattggggctgggacaatggctgacatgcagattcccacataaactcttgcgagtgttttggatcagaatgatattgagtgggaagtcagcgggggtattcctgtagcagggcttatgcttgtgacggcagctggcagtcgtgtcctttccgggaggtccagcacccatgcatcacatccggaaaaaaggggtgggcgagagattgcaaacgacgcggaacttggcttttttgacccatcctcttgaagtctgcaagctctaaagatctagcggcgaccccattaatggacatagaacttcggcgaaggtcagtgcgattctaaggcgtcgcatatgcgggcccctatactgctttttacgcttatcgtactgagtcttagtgtgacgtccaacgtaagtcccaaggatgtttgtgatgccgaggaattgcgctgtacggggtgctctacaggaccgtctgcccaacgaaagcaattgtacgaaaggggcgcccgcacaccgtctccaactcccccagggcgcgtgcactgccgggttcttctcactcccggcagtcacgtgagtttggcgagcggagctgggttcgttcgtcccagcttccttcgactgactgtgctggccgcctgctggagcggcggatgctgcagcgtgaagctgtgttgtatctcgtccggactgtgtataccgacccctccacccatcgttcccatca

SEQ ID NO: 22163 - DNA, 87 bp, Chlorella protothecoides
gacttcaaccttccgattccgagcattatcattctcgttcgttgaccgatgggcggccaggcggcatcagaccaatcaatctcctct

SEQ ID NO: 22164 - DNA, 61 bp, Chlorella protothecoides
cagaggcatgaacagggcaggctgcagaggtgactactctcacagtccccatctgaggaag

SEQ ID NO: 22165 - DNA, 235 bp, Chlorella protothecoides
gatcaagatcaagctccaggcgagagagggattgtcgggggcctgaggcttgtgattgctgcttgagggatggggtgcactgggattggaccccggtcggcaaagtgttacaggaaggggcgagcggcggtgcgacttgattgttccgaccgccacacagcaccacacagacgcgcgcatcaacatactactcgtctgtttcccgtcctgcgcagcatctggagaagctggacga

SEQ ID NO: 22166 - DNA, 77 bp, Chlorella protothecoides
ttgctgcaccaaccagtgataatgtaatgcagtgctttgaactctacatctggtcaaggtgaagctttagtggcact

SEQ ID NO: 22167 - DNA, 942 bp, Chlorella protothecoides
  modified_base (522)..(588): a, c, t, g, unknown or other
aagtgcatggcagtggtaaactcttgccttgagctcgccctagaatgtcgaattcaatcctccatgcagatgaggtgctcagcgtatcaaggcgctcgagacgccatccacaggcgttgtctcagatgctcaacaaggtcatgcagtagctgtagagttcaagtgagtctatcccacttgaaaatgtgacgattacatcacccgacgtcacgcagaattgagtggtttcccatggcacctcatatttcagagaaccaggagatctgcagcggcattgcaggggaggcattgcatcgctactttgttgtccacatcaattggctttcggaatgggttgaaatatctgcatgtaagagagatttcctgggaccatgtgaggaccgcatcgaggattgtcttgaacattcactttctatctctttcacagggaggccactgcggtcgtttgtccatgctctgcggcaagacagcggataaagttggacaggccaagaaactcttgcatgcatgactgcccggagnnnnnnnnnnnnnnnnnnnnnnnnnnnnnnnnnnnnnnnnnnnnnnnnnnnnnnnnnnnnnnnnnnnttttctaatgacaaccaagccttttcttgaaggttgagtgccttataagctcaagagacaccagcaggtttgcttctagtgtacagaataggcgcatgttgccatacagcttgcttagcttttggtacaagttggggctcggtatagcacatattgaagtcgtgcctgccctcacgcagggcctatcaggagcacctcgtctgcattcagactgacactgaatagcctggtcgtctggcttctatgggttttaagtgatgctaatgagagaatcgaattatcccccatcccgggtttctcctctcatggcaataccgccttaagttttttcgttacttgagcctgcaccctctc

SEQ ID NO: 22168 - DNA, 119 bp, Chlorella protothecoides
tggcggtagatgataatgctgtctgtcttcctctgcctcagcgtcttgatgacgaacttgtgctggcagcccgtcttgatggacatctcccggacctcgttggtaggctgcagccgctg

SEQ ID NO: 22169 - DNA, 413 bp, Chlorella protothecoides
ttccaggcggcccagggtacacatagtgggtccttggcaatttatactataaactatgtgactaaatttccaatgactgcagatgaattgctgtcgttgaataaatgttccatcgagggttttcagaacatcgtgtacaatcatcaaagggaacatgtttaggaggtcgtgttggaaggtactgcctatggtaagcttggacttcggggctcacgtgctcgtagccactttcataatgaatgcctggttccctataaacaggaccagtcaagacggcaggcactgccaattgcacagaaatgtctcgtatcgtcttctgggaggtgtgagcttacgttgcagtcgcttcgctatgtgaacaccttcatctattaacacgataactgttgattatcgttggtagacatttgtcc

SEQ ID NO: 22170 - DNA, 62 bp, Chlorella protothecoides
tgcttggtgcgagccattgttcttgatgtgtttttatgttgaaggattttggaggctggaag

SEQ ID NO: 22171 - DNA, 182 bp, Chlorella protothecoides
ctggaggcaggcactctgctagagtcattcgggcggggaccaccaggattgcaacatcacatgtgaaagcacgatcacggacccatagtctgcatgtgatttgcctgcggcaaaccatgactgtttaggccagaatcagcaccccttggccaccccccaccccggggctccctgcaggcttt

SEQ ID NO: 22172 - DNA, 103 bp, Chlorella protothecoides
ggcgccccggagagcagggcaaaccctgcctctcccggcctatcgcaccagcacagagacaatcccatccacccttgacactgaatcgccccacctgcttggc

SEQ ID NO: 22173 - DNA, 66 bp, Chlorella protothecoides
tgcgtcgtctccttgtcctcagccagccccaggatcagcagcgccgccgcctccaggcacctgtgt

SEQ ID NO: 22174 - DNA, 63 bp, Chlorella protothecoides
tggggggagggggggacgccttcttgggggaaaggggagacgccttcttggggggagggggag

SEQ ID NO: 22175 - DNA, 85 bp, Chlorella protothecoides
attggaaagtgcatggaggaggtctgctgcagccaggtttccctcagtatttgttatgtacggatgcctgcccacgttcgatgac

SEQ ID NO: 22176 - DNA, 74 bp, Chlorella protothecoides
agatgtggcacaagtcctcaaggtgtaggaccaaagtcctgtcatgatacatcatgctgtgtacaactcatgca

SEQ ID NO: 22177 - DNA, 61 bp, Chlorella protothecoides
tttgcaggcgagtgggacctggagattgccactcgcatcaagcctcaggagaacacctcct

SEQ ID NO: 22178 - DNA, 707 bp, Chlorella protothecoides
  modified_base (406)..(546): a, c, t, g, unknown or other
ggggaagggggcgggcgggcgggcggcgacactccgggccaaactgcaggtcactggccgctcacagcacccatttgaccgccccccccttctcacaggcgtggaggcggcctgtaagtatgccgaggagatgcagtacacccctgcggataccataaggaagctcgccacccggcggcagctggaagccttgattgaatacgtgagtgcagacctcggggcggagacaggccgggtcgcctggggctcctgacctcgtggctgtctgcctgcaatccagggtatcttgcacgctccccgctcccggagggttcctgagacagacctgcattggccccatccctcccccggcccccacccgtcgccatgcagtatttctccgacaccaccctcgacgcgctggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagcttctgcgagggtgagggcgctgatcagggcatggtgagccctgggggtgcctgacctttttccctcccccgcctgcatgcggccatacgccgtgcacccccggcatctgatgcaagtaggcccagttttcactcatcactgcatgtcgagatatt

SEQ ID NO: 22179 - DNA, 186 bp, Chlorella protothecoides
caggtgcgtgctggatgccatgtttgatgacaacttcaggataaaggctgaattcctacacgacagagcggcactccagaaacgcttccagtgagcatggcgctgcaactttgatgatgggaaggcatgcatgctattcccgaggctgtgcttgaggcagggagcggtcgcgtggtcgtatgtgtt

SEQ ID NO: 22180 - DNA, 79 bp, Chlorella protothecoides
agcagatccccacaacacgatgcacagattccagttctccagccacccacgcgcctggaatcgcaggttgtctgtcttg

SEQ ID NO: 22181 - DNA, 61 bp, Chlorella protothecoides
tgctctggaagaatttctccctcttcctcttccggtgggcagtatacacgatctgcgcaca

SEQ ID NO: 22182 - DNA, 65 bp, Chlorella protothecoides
ctgtccgtagctgccggggtttcccgccaaaagaccatcggcgctccaagactcctatgacgaat

SEQ ID NO: 22183 - DNA, 61 bp, Chlorella protothecoides
gcaccgccccaagcgcccaggtccaaggccacccgccgccatcccggggacaccgtgcgag

SEQ ID NO: 22184 - DNA, 64 bp, Chlorella protothecoides
cccgccgccatcccggggacaccgtgcgaggagccagacatggcagccccaccaccagagacgc

SEQ ID NO: 22185 - DNA, 123 bp, Chlorella protothecoides
cagaatcacaccacagaccaccagctgtcttctcgccaaacaagaccccgcagtatgctgggcaatccaccaagtcactgccgccgaatggcaggtatcgccctctggtctccaccgtcagcg

SEQ ID NO: 22186 - DNA, 76 bp, Chlorella protothecoides
ggtatcgccctctggtctccaccgtcagcgatagctcccgcacatggcaacgcacgctagtctccgctcccatctt

SEQ ID NO: 22187 - DNA, 76 bp, Chlorella protothecoides
cgtcaagcggtggcatgttcgaggcccccaatgccccattactactccctcatgcccaccctgccctctgaccacc

SEQ ID NO: 22188 - DNA, 79 bp, Chlorella protothecoides
ggtgtgcgtatgttggagggggttgtcgggaggatggaggttgggagggaaaggagggaagttgggcgcacgaggggcg

SEQ ID NO: 22189 - DNA, 61 bp, Chlorella protothecoides
ggtggagtcgggagagtggtggcttgaaggtggggggtgttggaatcgggggatagaagtg

SEQ ID NO: 22190 - DNA, 11406 bp, Chlorella protothecoides
  modified_base (10041)..(10087): a, c, t, g, unknown or other
ggggggcgggggcggggttgtgcctggcgcagggcatgagggggcacgcctgtcgtccgtcctgcgtgtgctgcggggcacttgccgcgccacccatgccttggagatggcaggggcgcagtgcaaagggacggggaccccgacccacgaccccgggtggcccccgcgccaggctctcgagcagcatcttggcgccagccacgagtacctggagtgctggaggcggtcaaacagcccgacgcggcacgagttctacctccgccccaagccaggtgtgagcgctgggcggcgtggcaggcaggctgggcaggctttgatcccgcggccaacgtggggaagggttgccaatcgctagggaagggtcgcatgggggagtgttgtcaacaaaggctctctgccagccggggtccccgcctcgcagcatacgactgcatgaccagacatcaccgccacctcccccaaacacagcccccaccctccacatgcacgcagcctactttgatggcaagggcgtgtttgtccccggggacctgctccacccgccgccccgccacctcgcccgcctgctggtcaccagcttctggggcttccccttcgtctaccactgctccaggtccgcccgcgcccggcgatggcaggcgggccggctgcccctcgacggcgaggaggttgagtacgaggcggcggcgaagatcagcgctccggggcaggcggggcaggggtcgtgcgggggccggctcggcgcgccgcccacccccggcgcgtgcgacgcgcggcaggcgacaccgacctcgacgcctggcgggcggggccgcagcgcggccggccaggccaggtgcgcaatgaccgcggtccccgactccgtggaggtcgtgaccatcctcagcgacgacgagagcgcgagctcaggagatgaaatccatggtgggggagtggcggcggcggagggagaggatggcggcggagaggtgggggaggaggaggcgggcggcacggcagaggctgcgggagaggaggagtttggcaaggtggcggtgggagatgaggaggtcgccggggaggcggcggcggaagctgcattggttgccagagatgcggtggcggacgaggagggcggcaatgtggcggaggcggcagaggacggtgagagtgagtcgttagaggaaggggagctcgtcgaggcggcatggcaggaaggagaaatcagcgctgcagcatcagacaggtgggaggtctgcgacgtggcggaggaggaggacgaggacagcggcgacgcgatggaggcgcaggaagcagagagcagcggggcgatggaggcgcaggaagcagagagcagcggagcgatggaggcgcaggaaggggagggcagcggggcgatggaggaggaagaaggggagggcagcggcgcagatgtcatcacactggagggcgacggcgcggcggaggagggtcggggcgacagcgcgcccggccctgcggcggagaagtggtcgggagagagccccgctgcctccggcgcaggccgccaacccacgccgaatgacgcgcagacccagggcttctgggcgggagcgaatggggcctcctgggaccctgccgcccctgcacagcctcacgctgatatccaggcgcccgagcccccacgttcgggggaaaacagcgccgacggcagccacccaggcacggcgctgtcgggggagcggagcgctgttggtgacgaggcgcccgcccacccggcccacgatgcagcgctgctgctcccatggctgcggggaacggggaatgggtcccctctttcaccggccacccccgggagtagccggggggggggcggcgacgctggcatgccgcctcccgagccggtgggggcggacgcgcagctcgcaccatccctcacctcgctcctgcgggagagcacgctcggggcgccccaaagccgacccgcttcgcgagccggcatggcgcggccgcgctcggcgtccccactgcatccccctggtgcacccaggttctaccacaggtcggacgagggttttggggggagagatgaagagttcaatccgggagggagtgccttgggattggcgccatgcggaccctcccgtgctgcgcatgatccggcaccgactatggggctcagggctgagggcgagggctcatgcagccctctgcccaacagtgatatcttattgaccatggagaacagcgggcccgggggcacctgaccacgctcactctgcccctgcagccggacatatgtgcccctgaccgaggaagaactgaatgggtggcacgactccgacgatgaaaccgatgacgaggagtgggaggtgagtgcttaccgaacctgctacggtggaaattaagagtgaaggcccctttggcatgcagactctggttggcgtacttggtctcccccgcccctcaatgttcctccattccgctggcctttctcaccaggctaggacacggcagaccttggccaccagcacggagctcgatgcggatgagcaggagtttgcgctgctctggaacgtctggctgcgagtacacaagctgtaccgggatgccgacatggcagacacctgccgcgctttcttcgcgcactatgtggacctccaggcagacacccccatgcggcgctgcttcgtctcgcacctgctcatgctctggtcttaccgcctcctgtccccggaagacgtgcagcgggtgctgcggctgcctgtgttgagcccggcactggggccatcacagcccctccttgcagcacagtctgcacccagcttggttcagcagtgaataacatgcatacatcatgcctatgtcattattcctcaccggtcgtggtgaggccttttttccccagtcccaccgctgttcacccaacccacagagagattccatgctgtgcatgtcgtgtcgtgctccctcgccaggaagagggcgccaagtcccggcctgtctcagaatagggcccagtaacgcatgcatgcagggaagagcgatgaaataatcacaaaataacgagtttctttcacccttagccaccggccgcgttttcgtgtcacaggggcccacacgtcgcgtactccctgcacctcgccgcgagtctgccccgttccacacatgctgcgccgcaatgcgcggctgcgcaaggagtacctgtaccgaaaaagtctagagggaaaagagaaggaacagtatgagaagaagcgtctcatcagacaggctctcgccggtgggtgtgcggcgttttgttcttggttatttgttgggggggtgggccctggcaggcgtgacctgcgaggcccatcaatagtggacggcatgcaggcctgaagggaatactcgtagtcttcgaccaggaccatgatcctactcccgtcccagtggagcgttgagcccagcgtgcaccctcgcccatgcccctgtcccgccccctaccccgcctgcagacggcaagcccatccccagcgagctccgcaaggaggaggccactctgcgccatgacgtggcgcttgaggacgacaacaccgccgtgccgcggagccacgtggatgacgagtatgcgcgcgccggcgaacgcgacccccggccgctcatcaccacctcgcgcgacccctcttcccgcctcgtccagttcgccaaggagctgaagctggtgttccccaactccatccgcatcaaccgcggagggaacgtgagccaaaggatgaggggggggggtactggaatggggcaggacggcacgtgggccggtcatggaatgcgggggttgggaaaggctctggagcaggggccgccccaaactgttttctgcacctgcctgcccggcagccgctagggttatgagggtggggggagggtcatgcgatcttgtgcggagttctggagcgggaggcaaaggctcgatgcacggcgttggggtcagcaaggccgcgcaacacagagttcactgggccggcgggtgacccagcggccactgatcccatgcagctccagcgctgcatccatccccccaccctcgccctcctcgacaggtgattgcggacctggtggactcgtgccggaaccacgactacaccgacctcattgtggtgcacgaacaccgcggcgagccggacggcttggtggtctgccacctgccctacggccccaccgcctactttggcctcttcaacacggtgaggagagtggtttggagggggggagggggagagggggggcctgatgggcacattcaaagcttgggaggccgatacccttggctgatattactttacgaggaagggaggatcatgagctggttgccagcactgctgcagtccaaaggtcgtgtctgggcgggcacatcttgacagattatatgcagtcgaacactccacaaggccttgctgcccctggcagtcgatcacctgctgcatgtgtgctcacatcatccttcgccacccctcccccgcccctctcgaacccaggtcttgaggcatgacatcggcgacaagaagacggtggggacggtatcggaggcgtaccctcacttgatcctagacaatttttcctcccgcctgggaagccgggtgtccaacatcctcaagcacctcttccctgtgcccaagctcgacaccaagcgagtcatcacatttgccaaccaggtagacggggaggggttggggttggcgacgtggagaagaccggctaatgggagcatgcacatggccatcccagcctcagtggtacaattactctgagagcacaatgtttccatctagatgggacagcagtccaccacatgcctgtcttggtgtccacccaacggccaactcccaagccctgtacagcgctcaacatcccccaattggtccctccaaaccccccgacctaacaggccgactacatcagcttcaggcatcatgtgtacacccagccggcaggcccttccagcctcgaattgaaggaggtgggtccccgctttgaggccaagctcttccaaatatccctgggcaccgtggaccagccgcatgccgagaaggagtgggcactgcgcagctacaccaactccgcaaagcgacaaaagctggccgaggccactgaggaggaggcatgacgttggcttgtccagccggctggaggctcgggttgatgagtcaacagatacagccgcgcgatgccctcatggcgggttaacttctgagtgtcattattttcaggacccctcctggtccagcatgccatctggacttggcctcacctgcatggcttcctgtccgcgcgcctgccacgtcgacaccggatgcatctcggactgctgacaatatacatagatcgtgcgaggtttggttacttcacctttcggggacacagtgccctgtatttctaatccgaggtggcttgcgggcgtcctggggaggcgatggttgggtggagctacctccacctcgtcctcggcttcgatgccgctgtgtacaccatccacacctggctggacgctcgacagctacgggtaatggggaattgccgtgaatttctcacatgcccagatgccatgtactcccgcccgtccgtccggatctctggatccgtggtgctggggctcaagccaatgcttatggaatccctgcccctcctaagatccatcaattacacagcttaaaaagcacctttgaatcatgttccaacatgatcgaccatctataaatgttttcttttatttcacatgccccccctttccccctcacctataggccctgcgccgggcccacccccccaaagagctggcgcacctgtacccggccccgcaggactacgccagcaagcaggcgtacagcctggacagcctctgcttcggcatggcgcgcggcgcctttgactccgccctctccgcagcgctgctcctttccggcttcctgccctggtcctggaacgcggtgggccacctcctcggcggtgcccaccggcccatcgcacaggccgtgctctggacgctgctgaccagcggtctgaacgccacgctgggcctgccctggtccctggcgcggacctttggcctggaagcccggcacggcttcaacaagaccagccccgccacgtttgcaatggatgccctcaagtccctgggcctgggcctggccctggggccaccgctgatcgccgccgtggctttcatcctggagagggctgggccctgggtggcgctgcacctctgggccttcctcctggccatgagcatggtattgatggcgctgtaccccagcgtcatcgcgccccttttcaacagcttcacgcccctgccgcagggccagctcaggtgtggttgtgttaaggggggtaaaaggggtgtgggtggaggaggttggcgggttgtgggctgggtggcatagaaatctggattgattgagtggttcagggcaccgccggagacatctggccatagcatcgggggcaaggacctcgtccttgtcactcagccaggcggcggccttgtccacccgttcctacccactcgatcaacccccaccaacaaaagggaggagatcgaggcgctggcggcctcgctccacttccccctgaccaagctctttgtcatcgacggctccaagcgctccgcccactccaacgcctacatgtacggcttctggaggaacaagcgcatcgtgctctacgacaccctcatcgagcagtccagcgtgccccaggcaggtggctgggctgaggtggctgggcgcggctgcctaccgctgggcatacgccaggagtccaggaccgaaacacgctcgcccccacgcttaaacccatccccgccgccctttcctccgcgcctcacacgcaggtggtggccgtgctggcccacgagctggggcactgggcgttggggcacacgccgcgcctcctcgcggcggcccaggtccagattctgggccagctggcgctattcaccgcgctgcgggccagccccaccctggcctccagctttgggtttgaccctgtgacctcgccccccttcatcgcctttgtgctcttccagtacttatcggggcccctggacgaggtgagggggggaagagggccaggggggaagctttgggagtgggggaaagaagggaaattgaagacttcccgggagccgggcgcccggcgactgtgcgagtcaggggtgggatgcattctgtctctcagcaagcaacagggcaaattgcaataggaacctgttgcctgtgccgtaccttaagccactcaccccatgcactgcacgaggcggcaccatgcactcccacgcctgtcctccccatcccacaacaggcgttgggctgcctgaacaactacgtgacgcggcgtttcgaattccaggctgacgcgtttggcgtcgcgcagggccgcgccgaggacctcaaggccgcgctgctggtcttggacaaggagaacaagtcgccgccgcacactgacccgctttactcggcctaccactacagccacccgcccctgctggagcggctgagggccatcgacgccgccgtggcgcggggcggcagctgcgctgcggaggccaagaagaaggaatgattttcacccgccagctgcataggactgcaaggggtctggcggccaagggcaccaaggctggcgatccctggtcaagggaacgctggctgcaggccccttcaaaagagccctgctgtgcacggcagaacatgacatcgagaagactgcagaataaatcatcctcgaccatatgtacgccaaaggttgtgctgatgtgctgtactggggcagccccacatggccaccacaaacgccgattgacgggtgtggcaagaaaggtttcatgatgcaaggcaaggcaccatgtttaacaggtgagcttatcaaacatctggcgctcatcccacagctcccggctgtgacgagctggcaatgcactgcgcactgcttcaccatggaaaagtctgtgtactgtttcgtgaaggttcctggctgcctagcgcccatcagagacgggacaagtcctcggccctccagaacgaggaagacgcaaggccgacggaggccagccccaagcagagcatggcaggcgtgccgaggacgcacactgcagagtttgtggagcccaggaccgtctggtggaggtggagggaggtcggatggagtcagcatgcaccaagcagggtgggggcaggtatgcctgcccctgggcaccccctcggccgtggcaagggcccacccgaaggtcaattcaattacaaacctagcagccatgcgctgtggtgagtcttccaacgcacatgctccacccaagaatgccaaaaccccaagtcggaccaggaaggctgctgccaggtgcaggccagcgggaatcccagccatgctcagcatgcctccatcctgcagcgctgcagtgcacgatagcaaggccgccgcggggaggaccaggctgaaaccaaggctgttgagtgctgcctggacgaagaaggagatgttccagcatgaggatgggggggtcagagtgccgccgtttcgcaggaaggggagccagctgcatatgggaagggtgtagaggttttggctggctgtgtggggagagggtgcctgttctcgcctcgcacttgagcacccttccttccaactgcaggcatgtgcattatgagtgcagagggatgttattcaatgtccagagtcatgccagattcgcaataagatctcgcaagtacacccttcacctgacaaaaaaggccagggactgagcggccgcctggccagtgcccagggccaggatcacgccccaggcatcctgcttggtcaaagtgctgtgctggcctgctgcataggcattaagcctgcccagcccaagcctgggtggaaaggcatggaaaggtggagtgtgaggcaggttagaaggcagccctgctaataatgcagtgccacacctatcacatcaaagccatgcagttgctcgcaagcaaacaacactccagaatttccacctgaaacccttggcttgcaggaggcgggcggccccttggagcacgacagctgtcagcagcagactcagggaggcgaggttgccagggtcggtcgatgtgaagcctgaggggtggttcgaggtttccttgattcttcaacattttgagcaaaacatttttcaaacgtccttctaatgtcagagtgatggctccttcccaattggcctcttgcaattatgctgggccccttcacctctaagcaggatgctgatggcaatcagtatggtgatccagtagaaggccctgcgtcaggcatgcaggtggcgatgcagcacgtcagcactcgttgctgtattgcattgccctgcatgtcgcatgcgtttaaaactcaccctaccaggccaagaaggatgagcagcgagctgcgcgagaggacaagactagacacggcaaggatgggtccggttcctatcaagaatgggcccaggatgcccacaacggtcatcgaaccggctgttctccataagtaattaaggattagatctggagagctgctccgttccgaaaacaatgaagctttgacctgccgagcttcgagctttctagcccatcccaacatcatgggcgtggacggggtctggtccaagcagggccccatcctgcccccgaacagtgcctgatcacaccccaaaccattgttcgggagcagctggagcaccccaggacgcccagcactgccccttcctgcaccgaggcgcggggatctcccgtcacgcgctgagttcgacggggtcccgtccgcgggccctggactccccacaatggacgaacttgtccagatagatgctcagcatctccaggaggtgtgaatggcgcctggtgtgcggccctgcggtctggtgtcggagtcccccacgcatcgcccttctgctcttgggcggggacaggccctcgccgggcctgaccggtctcccgccctcgatacatgcttggagttaagcattgcattacctttccatgtgatcgtgaagattgtcgggccggggcctcacttatgcacacacactgccccccccccccctgggcnnnnnnnnnnnnnnnnnnnnnnnnnnnnnnnnnnnnnnnnnnnnnnntgctgaatcggttgacggatcggcgagtggccgtggacaaggaggccctgatcctgggcgagcccaaaaaaggcatgaatgacattttccggcactgccgcggcttcgagcgggcctactcgctcatgctccaggtgggtgggtttggtgggtgggttgttgggttgttgggggggggcctgggggcggggcatgagtggggatacctagggaagtggcagtgtttatccatcctcccccccccctcccctctctccaaatgtcgacatccccctcaccatcaacacaacaggaggccaacacgtcgttcaagatccgaggcgtggtggagggcttgctcccggacaccctgcgccgcatcccgatcgagaagcggttcaaccgcgcgtacgtgcgcgagatctgccgcgaggcggacgggtcccagccgcacctggtctcccccgagcgcggcatccggcgcctggtggcggaggccatgctgctgaccaacgaccacgtgcaccgcttcgtggacgaggtgcatggcgtgctacaggacacggtgcgcgaggcagcgcggcgctccgtgctggccgaggccggcctgggcgccacgcccggcatggagttcctgcgcctcaagggcttcgagaacgcagtggtggtggccgccgaccgcgcgctggaggagtggaaggcagaggcccacaaggtggccagcaccatggtggccatggagtgcgactacgtgaccccctccttcttccgcgagctggagcgggagtggcaggaggcgcagcacggcggcgcagggggcgacggcgaggagggcgcagggggtggggccgggccgggcgcgccggcgatccgggatgcgggcgacgacgacgacgacgactcggaggacggcgtggccgatggcgaggcggggcgcgggtccgcgaccccgggctcggccccaccacccgtctccaccgcccccgacctgaagggcggctggctggacaagcggtcgggggacagctcctcgctcaacgccctccccgtcgactcctggaagtggcagcggcgctggttcgtgctggcgggggccgcgggcgtgctggcctacttccgcaacccggaggaggcggcggggcgcaccgcccagccccgcgtcaccatcccgctcaaggcctgcgtggtggacgacttcgccgccgcgccgcgcgccggcggcgccgacgcgctgctcatccgcatcgcgcaccgcgacccggcgcagcccgtggccaaggcccaccactcggtggtcctgcgcgccgccgacgccgcggacaagaccgagtggctggcgc

SEQ ID NO: 22191 - DNA, 61 bp, Chlorella protothecoides
caaggccaagaccgccaaagtgtacatcgagcatctttacaaagttcagagtcagcaccac

SEQ ID NO: 22192 - DNA, 64 bp, Chlorella protothecoides
aagggatacacaggagcagggtattgggagtcgatcaacgtggctccggatgctccattcagtc

SEQ ID NO: 22193 - DNA, 61 bp, Chlorella protothecoides
ttgatgaatgggtaacagctggcttgagggtgttggaaaggacgcgctgagggcttgcctt

SEQ ID NO: 22194 - DNA, 64 bp, Chlorella protothecoides
ataatctgcagctctgggttttcaatctgtctgcttacgagtgtgaggacttgaggatggtcat

SEQ ID NO: 22195 - DNA, 20225 bp, Chlorella protothecoides
  modified_base (359)..(368): a, c, t, g, unknown or other
  modified_base (1501)..(1510): a, c, t, g, unknown or other
  modified_base (2125)..(2134): a, c, t, g, unknown or other
  modified_base (3650)..(3659): a, c, t, g, unknown or other
  modified_base (3958)..(3967): a, c, t, g, unknown or other
  modified_base (4735)..(4744): a, c, t, g, unknown or other
  modified_base (4801)..(4810): a, c, t, g, unknown or other
  modified_base (5063)..(5072): a, c, t, g, unknown or other
  modified_base (5424)..(5433): a, c, t, g, unknown or other
  modified_base (5932)..(5941): a, c, t, g, unknown or other
  modified_base (6363)..(6372): a, c, t, g, unknown or other
  modified_base (6807)..(6816): a, c, t, g, unknown or other
  modified_base (7279)..(7288): a, c, t, g, unknown or other
  modified_base (7901)..(7910): a, c, t, g, unknown or other
  modified_base (8203)..(8212): a, c, t, g, unknown or other
  modified_base (9676)..(9734): a, c, t, g, unknown or other
  modified_base (9898)..(9907): a, c, t, g, unknown or other
  modified_base (10000)..(10009): a, c, t, g, unknown or other
  modified_base (10660)..(10669): a, c, t, g, unknown or other
  modified_base (12960)..(12969): a, c, t, g, unknown or other
  modified_base (13572)..(13581): a, c, t, g, unknown or other
  modified_base (13968)..(13977): a, c, t, g, unknown or other
  modified_base (14642)..(14651): a, c, t, g, unknown or other
  modified_base (15657)..(15666): a, c, t, g, unknown or other
  modified_base (16378)..(16387): a, c, t, g, unknown or other
  modified_base (18038)..(18047): a, c, t, g, unknown or other
  modified_base (18519)..(18528): a, c, t, g, unknown or other
  modified_base (19938)..(19947): a, c, t, g, unknown or other
ttacgagtgtgaggacttgaggatggtcattccatcgatgagcctgctcagtgcagagtttcatcgacgaacaagggtttcaactttaaacagtgatcttagagtccagtcataagaaacatatgaatttcctcttctttcaaaaagctactcaaccgagtttgttgcaggaaccttgtcgagtgaaaccattgcttttgttgcatggggacatcctgcaatctaagccccgccctcgacatcgcgccctgacgcacatatagatgccaacgcataccgaccccacgatctcacgcatcacgaatcagtacatgtgagagcagtacaattcctaattatcattgccctgcccaacatcnnnnnnnnnngcatcacgaattagtacatgtgagagcagtgcagttcctaattatcattgccctgcccaacatctcccttgtgagcgaccggttccagtccgacggatcacttaccgggagtaggctccgccacttcttatcaccttgagtgtgctgcattgattgaatgtcgaagaatgaccgcctaaagtcccatcccatacacgtcgaggaggtgcagctggttgtcgagagttcgcatcaatctgctcaggcgacacctccggcacagaaaggcagacgaggtattctagttgcggctgcagcaaaagcgaagcacaccacttccgagccaggcgttacctctggaggacgtcgcaagcactcgggtgcggagcctgactcctcaaagacaactgcagtgccccccaaagcacagcagacacttccagcctgtgccaagagcaaaggacagggccttggctcaggcagcaagcaacatcatgcgaagaaggcagctggcaagaagtcccaagcggcagccgttgccgcacaggtgcaacagggcgtctcgaaatccgagccaaaagtgctgtccctcccgaggcctccaaccctccctcccccccgagcaccgagtatcaagaagtacagcccggcagatttgcagcagggcctgaagagagggacgctcttccgtgccgtgatccgctacaatgcctcggatacctcccaggccttcgccaccctgccgggcctctctcacgacatccttatcaaggtgcggcgatggaggttgtcatcatcgggatgtatcccaagcacttcaccaaactgcaactctctaatttccccacgctggtattagggtgcgattgcccagggccattccatggagggcgatgaggtggcgctgctcattctgccattccaggactggtatgtgaggtctgagcctgccagaggcgcaggaagggctggaggacctgcgagcgcgggcgccactagggaaggcactccagccaaagcagcaggacagcctggtgccaagactctggcggcgccaagcggcagcggcgctgttgttccagtcccgcagccaggcgcatcgtccccccatggctccaagaagcatccagaggcagagggccccaagcaagcannnnnnnnnnggcatcgtccccgcatggctccaaggatcatccagaggcagagggccccaagcaagcagccctgccatccactccgcttggcactgacggcgtacaccagctggcatcccagcttgacaagtccctggtcctggaaccaggtaggcgggggcatatgttttggatgcatcagcggcatcgcgatggggtgtgcaacatatccgcagcatcacgtctttggatcctgcatcgaagtctggatgtcaggcccagcacgctgactcagcctgactcatatgtcccccgccagctcccagcgcggcatccccccaggctctcctgggccacttgcagctgctgctcagccgcaatcccagtgcgagggccacgggggccgtggtgggcatcctgcagccatcccctcgccgagaacgcgtggtgggcatgctcctggccgatcccaggacgagacagctctgcctcgtccccaaatcgccctgcctgcccaggatgagtgtggatgcctcccgcctccccgattcgatcaaaagggtgcggatcagggggcagttttgtggagcctgcgttgcatgacgctgcatgggcaccgtgtacggatgcgggtgtacagagaannnnnnnnnntctcgtccccaagtcgccctgcctgcccaggatgagcgtggatgcctcccgcctccctgcttcgatcaaaagggtgcggattagggggcaattttgtggagcctgcattgcatgacgctgcatagacaccgtgtacggatgcgggtgtacagagaatctgggaaggaacgacaaaatgctcctggctgcaccctccattccccaccccgtgtggactcaatgccacacactctttgataatctcctcctctctcctctccaaggccatggctgctgcaactggcacccagcaccttctggtgtcgggtcgtgtcctccagtggaaggatggcatggagtgcccgacggccgaggtgagttgatgcctgattcagccccgggctcagcgtggaactcttgccgtatgggcaaggagatgacgctcgctttgtgtaggtgctgtactaccaaaagcgcctgattgcgtgtctgccagggaactccatgctggtgtgtgattgcgcctgcatcatgatcctcacacacatattgcattcttcctttccaggtgcgaggcagcctggggcaggctggcgacctcctcagtgagactgctgcctgtctggccagcgaaggcatcacccagggtgactcgttcgacagcaaggtatactggtcctgggtgtgcctctggaagttggaacgaacggtttgagatggtaccgcctggcttcgagtgtccactcccagtctaagcctgtatagccggcgtcagagagtgcatgctccatgcgcggtcttttcgtcaccccatgcatgtgctcgccatgatctcctcctgcccacactatatggctgcaggtgatggcctgcctgccccagactccctggcgcatcggcgaagaagaatgcgtggggcgtcgggacctgcggtccgcccgcaccttctccatagaccctcccactgccagggatctggatgacgccctgtccattcaggaactggggggtggcagctaccgcgtgggcgtccacatcgcagacgtgtcccactttgtcaggtgggtgggtttgtgagtgggtgtggatgggaatcttgatgccagtggggcttgggctagaagaaggaaaggtgagagccaagcaggactggtccatcctgtagcctccttggtgactcatgcgtcagccgtcgaccatccatctgtctcaggcatgcgactgagctggatgaggaggccctgacccgctctacaagtgtctacatggtgcacaatgtcattcccatgctgccacgactcctttgcgaggagctgtgcaggtgggtggcggctgggtgcggggcctcgctgtgatgttgtgcaggtcgttgttgagcgaggcgtgtgatgacaaatgcattcttgagtagggtgcagagaggaatgcgagtttttcaagtgaatgctgatgtgtcttgcatttttgtatgaattcagtgatccccagacataggaaagcccaattgtgcccccccctccatgcagcttgaacgcgnnnnnnnnnngattgcattcttgagtaaggtgcagagaggaatgcgagcttttcaagggagtgctgacgtgtcctgcatttttgtatgagtttggtgacccccagacataggaaagcccaaccgtgcccccccctccatgcagcttgaacgcgggggtggatcgcctcgccttttctatcgtctgggacatgggcgcagacggcagcattcggtgagacatgttccagacaccagtgctgcacagtctgagaccgtgttttggaagggaagcccctccaatgccatagggaagccctttaaggcagcgnnnnnnnnnnaacggcagcattcggtgagacatgtcccggacaccagtgctacacagtctgagaccgtgttttgaaagggaagcccctcaaatgccatagggaagccctttaaggcagcgctctcccacccctgcgcaggagcacatggatcgggaggagcatcatccactcctgcgccaagctttcctacctgcacgtccaagaggtcttggaggggagggagccagcagactgcccaggcctgacccccgtggttctgaccccggggcacacatgggaggaggtgaggcactgtggaggggggtttgtgggagggaattcggcattgcgaccctgggagctgaggctgagtgccagcagtgctgaagtggcaccgcttgctgctcagtttcccgaccgtattcttgatcgttcctcgccgctcccgccctcattccgtagattaagagggactgcctggccctccacgccttggccaaggccctgagggccgcgcgctttcagcgaggagccctgcggctcgacaataccaagctttcctttgccttggatgaggctgggaaccccgtggactttatcgccgagatccaggcaagactgtccgcatcccacctgatggcgtgtgcaggacaggccctgcattcttgcatgcctggcgccctggccggctccatgctgcgaggtgcgattggtgctgccttgggtgcctggaacccccccaaagcctccccttgcgtcaacctgcagacggatgccaaccggctggtggaggagttnnnnnnnnnntgcgtgcgatgctgggccagagcaacaacgatgcgccctctgcatgttggggcacannnnnnnnnntgcagccaacaagatcgccgatgtcttcccagacaggtggggatgctcggggccggggccggggccggtgcatgcgatgctgggccagagcaagaacgatgcgccctctgcatgttggggcacagcccatctgatgcgaggatgcaccgactccttgtgaagggatccatcgcctgcattgccccgctccgggcacgtgacaagcccaggaagccggcgccactgctccgacgcaccgcagggcgctgctgcnnnnnnnnnnaagggtgcactgactccttgtgaagggatccatggcctgcattgccccgctctgggcacgtgacaagcccaggaagccggcgcacctgctccgacgcaccgcagggcgctgctgcgccgacatccggcgccgagcccgttcaagctcacgcagctggctgggcagctggaagccctgaatgtcaccctggacgtcagaacagcaggtgccgggcatggctgctgctgttgtcatgaagaggaggcgtcccgaggactgctgatacatccgacattcagcactggggatttttgcccccgtgccgccttccaggaaatgtcgcctgcaccctcagtggcctgctgcgtgcagnnnnnnnnnngcgaggactgctgatgcatacgacattcagcactgggggttttgcccccgcgccgccttccaggaaatgtcacctgcaccctcagtggcctgctgcgtgcagagccgatgctctggcgccccccccgctgcagctgggatcaccagaggctgccttcccttgcccccgcaggatccctgcaagcatcactggagcggctgcgtgccacgcacagcgatgcaaaccttgtcagcgccgtcacgcagatggtcaccaagcccatgatggtgagggtggaggggtgcgtggtcatcggcagatgatgcgtggaatgagccccagtgtgtgcgcagtgtttggcgccgcgtctggtctcggccgagggcaagagtatggcgtggtgctcccaggcatgtggcccacagacttcccaggtcgcactcctccacgccccttccaaccccttttgagccaccccgcacccacaaatccactgagcagacggcagcctacttctgcnnnnnnnnnngcccaggtcgcactcctccatgccccttccaacccctttcgagccaccccgcacccacaattccactgagcagacggcagcctacttctgcacgggcacgtcagaggacgcctccggctgggggcactacgcgctggcagccccgcggtacacccacttcacctcgcccatccggcggtacccagacgtggccgtgcaccggcagctggccgccgccctggaggtggaggcgggcgccgagccggccgtggcgctgcagcgctgggggtcagtcggcggggaggggtgtgaggtttgcccacgacttatttgggggagggggaaaggctcaggtcggcgaatgtgggacgggggtgcgtatgatcctttccgcaggcacgtgccgcgcggtgtcgccccatcacttcgcatcaccccccccnnnnnnnnnnggacttgtttgggggagggggaagggctcaggtcggcgaatgtgggactggggtgtgcctgatcctgtccgcaggcacgtgccgcgcggcgtcgccccatcacttcgcatcaccccccccctggcttccctccgcgcagctgcccggaggcggaggagctggagcgcatcgcgctgcactgtaacgagaggaagtcggctgccaaggcggtacaggacggcgtcctgcacctgcacctcctgcagatgctggagcggaagccgcatgcctgctgggcaggtgtgtgccgggggggccctggcgacgcgggccgggatccgtgtggcgagaaatcgcaggtgggaaccggtcatgccacagctgcgctcacacctgcgctgccacccccatcttcgcacccccctccacgctcccgccttgaatccacagtggtgnnnnnnnnnnagtggcgagaagtcgcaggtgggaaccgggcatgccgcagctgcgctcacacctgcgctgccagctccatcttcgcaccccctcccacgctcccgccttgaatccacagtggtggtgggtgtgggcggcccgcgctacctggacgtgtacattcccctgattggcaaggagctgagggtgcaggtgtcggacctggtcgcaccggggccgtccccacggaacgtggtcggtgcctgggacaagcaagacatgtgaggcagggaggggggttgcctgggactgtataggggttgcctgggactgtatagcaccaggcaagggtgccaggtgccgctgtcccgccctgctgtgccgtgcggtcatcgctcctggcagtgtgctgctgacattgacaaggacgaggtgctgcaccgacgcccatgaactccctcccccccacaccctccctggatcaaacccttcnnnnnnnnnntctgtcccgccctgccgtgccgtgcggtcatcgcttctggcagtgtcctgctggcgttgacaaggacgaggtgctgcatcgacgcccatgaaccccctctcccccacaccctccctggatcaaacccttctaggcggctcacgctgtcggcggggcagcaagaggctgaagctgagtgggccaaggcactgcggccggccgtggtcgctccaggcgtggagtccgcgtgcctcccgctcacgcttagactgctgagtcagctgcccctgatcgtcaccagcaagacccgcggggatgggagccctgcatacctgatcgccacggcgtaccttgccggccctgcagtgactcagcccacgccaatgctggatcaggcatgacgggtcaaccttttatgtaacagaatctatcgctggaggggggccaagaccattctggaccggtcaaccagtctcagcatctggcctgtccctggctgctgctggtcgctccaaatcccacgagacatggcgggcacaccgtcattgacaaatcttgcctcggagacactcggatgttcacacacatacaatcacagactttgcatgcatgtagagattcggtgcttgagcannnnnnnnnnaagacactcgaatgttcacacacatacaatcatagacttggcatgcatgtagagattcggtgcttgagcatgacaaagactcggtaagaaggaaagcgaccagctcgtagcccccacgagctccacacgttggacccctccctgcctgcatgccgcacgtactctccaaggacggcacaagcatatttttcaatgtctacggacacgataggaatgagcaggggtgagccctgacgggcatgtgcgggctggacagcggcggtgcatgggcggtgtcggagggttggcttccnnnnnnnnnncgcacgggtgagccctgacggcatgtgcgggctggacgccggcgatgcatgggcggtgtcggagggttggcttccgagtggcggtgcggcgcggtcctggggagacctggaggaggccgacccggggcctggcctcactcccctccacacccacccccaggtctcccacacctcgagccctgctcatcatgggttttgcagcgtcccacataacgtgggccccccagctggccggcctgctgagcgaggggtgcctggtgtgcctggacaaccggggggtgggcgccagcgatgcgccgcagcacccctccgcctactccacgaccctcatggccgaggactgcatggcggtgctggaagcgctgggctgggacagcgtgcacgtcgtgggccacagcatgggggccatggtcgccgccaagctggcagcggcctggccccatgctacagcctccctcacgctcatctctgggacggggggcggctggcaggccattcccttatccttccgctccctctggctgggcctgcagctgtggatggcgagcagcgtggcaaagcgcgcagccctggacgtgaagttccactactccccccggaccctgaagcagaaggacgcgcgggctgacgtctcgaggtggggtctgcagtgctgtgtatgtgggatgggttgctgagagcaattacaaatgtgactgggcagactagtctgtgtcagcctggtcgagggggaggaggggagattgactggcaccggttagtgcgggaatggccctgcagagctttgatcagcaacctcctcgtcacccagcttcatgcacttcccaccgccccacaggcatgagctgctgctggaggagtatctggctgcagcatcccagggtgacggatcccagccagcccacggaatgacggtatgttgccgaggctacatagtcctgatcctgtggacagatgtgcctgcacaagtgtatgcaacaacatcacgaaacttccagcaagtgtatgtggcccccctggtcgatcccacacccaaactcaatagaaatccagcaacgaatcctggcaggctgtcccaccccttccatccactgaacaaatccccctcattcagggccagctgcaggccgtctggaggcacagcctcagcaagaaggagtgtcgggccatccgcagtgcgggcatgccctgcctggtcatccacggcagggacgacattgtggccgccccccggcacggcgccaagctggcgcggcggctgcgcgcccctttcctgctcctcgacggcgcccactttgtgtttcgggagcaggccaccgtggtcaatggcgtgctccagaacctgctgcagggcgcctccttcgtgcaggcggcggcagcgagcgtgtcggggtcgcagacgcacgtgcccaccgcggcgctggtggcggagctggaggcgtggcgggtccagcagggcagggnnnnnnnnnnnnnnnnnnnnnnnnnnnnnnnnnnnnnnnnnnnnnnnnnnnnnnnnnnngtcgccttgctgtgatgctgactggggttcttttccctcgtgaaccactgccatcgaatgatggggcatgacaacacgcctcaatgcaccaagcaagatggttgaaaaacactgacaagaatgagaataggggtgcatgcagtgcagacatgccaacgtgcagnnnnnnnnnntgcccaaagagcggcatgccggcgtcagctcagtcgcgtcctccgccgacagcctgctccacccccgccatgtgagttctgcgcaggcctgcnnnnnnnnnncgggaaaacactgacaagaatgagaatagggatgcatgcagtgcagacatgccaacgtgcagcagtctctcgacggcccaggcttccaacattcgggcagccagcctctccacatcatccatagcagcgaatgcggtcggtggcgcccttcgccgcgctctggggcgagccaaaccttccgcccttggacagatactgcagatgacaaaggcagaggactggatagaatgaggcgaggggttctgggacactcccagatcaggcccaatacacatccgcatgccagtcacctgctcatcgcaggcatggcaccaggggactccggcgaacctgctggtggtagtcctctgcgatgtagtagtcggtggcaggctccagagtggtcaccaccttgttccccaccacacgccggaaggttcccgcctttagcttcccattgacttcctggatggcctgcacatgggtggggcaacgcggacccactcgatcgccacgaccaaaaatgaccagggcttgggacagcgatgcgcattgcacgttcccaagcatgcctcgctcttcacggcaaacacgccatcctccacctggggcccggcccacacccctccctccgccgcacgttctcagccgcctgcttctgggcgtcgtcgnnnnnnnnnntgcattgcgcgttcccaagcgtgcctcactcttcacggcaaacatgccttcctccacctggggcccggccgccacccctccctccgctgcaccttctcagccgcctgcttctgggcgtcgtcgtaatagtagatgacagagcggtactgggtccccacatccccaccctggcggttgagggtggtggggtccacatgctcaaagaagcagtccagcagcttggggtaggacgtggagctgtcgtagtagacctgcacggcctcagcatgccctgtgcgccccgagcacaccgcctcgtagctgggggagggcacctcaccccctgtgtacccggagctggtgtgggtcacccccgggacgcgctggaaggccagctccaggccccagaagcagccgcctgggggaggggaggcatgggggagagctcaagcacgagctttgtcaggcaggctcagccactctggcagccacagcatgcccaagatgtgcatcgcagcacaaaatgatgcgtgcctcctctgccagacctgcaaaggtggctatgctctgcccagccggggcctgcgctggggcgagctccgtggcgccctttccggccgacatgctggcgtcacgacccttaaactggatgtagaagagggcagcaagcgtgaggctcaggagatgagcgaggtgcatggggggtgtctggggaccgacaggcagatcacttcccggtctggcctacactcagggcatgctccccctgacaacccgcttgcatgcgagcttgctcacgagattgaatgggaagccttgaaacatgtacgcctggccgggtcgctgcgatatctgccgaccggctcctgcaccgaatctgtggacagcgctgttcaccgagcgatgtgctgcgggggagcggctgagactgacgaatccggcgccaatgctgagaatggccatcttacgactgattctgagaggttggtgcgagggcggcaggctgtgggacggtgttgtggtcgcgatcgcagcacgaagctggggctgccgccctgtgccgtgggcaggagcgctctgctgggcacatgcggtggtgatcatttacgtgacaggcactgatccctctttgaaactttgactaacagattgacagatggtgaaacaggtgtgctgggtggcctcaatcatacatacgaccaccacggcgccttatcctttccgtgcatcaggaaatctctggtgcgcctggcggcgggtgttcctgtggtggtctcgcatcagtgcttacaggcctcgtctcctggactccagatgtcggtcgtaaacggattcaagcgatccgtgcacactgttgcatctcacgtgctgctttattgaaatgtaacagggggagctgcaggcatgagctgggcttggcggcagcctgtgcacacagtcagcacatactcagtggacaaaatctcagtgcagcagctgccggtcctcattctctggatcagatagtgttggcctgcgtctgttagtggatcacatggggaattttggtgaggtgaaggctgggagcagtcgcacaagggctgcggggggttcacatgcaagggtggccccctggccccagcaaaactcacctggaggaagacgggggcggtggaggggctgaacgagatgggtgccccccctgccacaagcttggccttgacctggtcaggtgtgaggtctgggttctggccgaggatgatggccacagcgccagtcacatggggtgccgcctggctcgtccccgacagcaccgcagacgcagtgttggaggcgatgcctgcggaggtaatgtcggagccgggcgcaaagatgtcaacacctgcgtggtcggtgggggacgggaagggcggtgggatggcgcacaattgtccgccaggagaccaaggcaacgtgacggcctgggctgcaacttcggatggtgcagggccagaggagctgtgcccaggaaagcaggctgcattcactctcgtgctgtggaagttccccctcacccccctcctccgccttacaggtcccgatgttggaaaaggcggagatgatgtccatgtcatcgctgctggcgacggtgatggcgccggggagggaggcggggctctgggaacaggcgtcgccgccgtagtcgttccctgcgctggtcacgacagggatgcccgcctgcagggatggtgcagaaggaggcgtgtggagtaggaagtgtcggatgcaccaccattcgcccttcccctgcctcccacccccaagcccatccacccaccgcgatgacgtcggcnnnnnnnnnnggggatgcccgcctgcaggggtggtgcaggaggaggcgtgtggagtaggaagtgttggatgcaccaccattcgcccttcctctgcctcccactccccagcccatccacccaccgcgatgacgtcggcggctgcatcgttgatgacgggggaaaaggcccccccgaggctcatcgacaccaccgccggccagccgttggcggccacgtgctgcttgacccaggccagccccgccacgacgttgctgtaggaccccgcgccgttgtcgcccagcaccttgactgggtggatgatggcctgcttggccacgccgtagcgggtgcccatggcggtgccggagacgtgagtgccgtgcccctgcccatcgctggtgtcggccccgcccgcagagttcacgccctcgcctgaggcaggaggtgtgagggtcggatgggcgttgtgggatggagagggtgctcatgtgttcaccaccagcagccagggtgggccagggccaggggagcaccacacacctcctcttcccactcccccagcatccggcaaacccctcgcaccgacgcggccgacaaagtcttcgtgggtggaaagcaggcccgtgtccagcnnnnnnnnnntcagcagccaggggcagccaggggcaggggagcgccacacaccccactccccactcccacagcatccggcaaacccctcgcaccgacacggccgacaaagtcctcgtgggtggaaagcaggcccgtgtccagcacgtagatgtggaccccggcgccgccccccacggggtcaaacacgccgttgaggggcagggcgccctggtcgatgcggtccagtctgcgagggcggaggagagggcccacggcctgcgttaggcagacaggcgcccggacaggaggggagcccaggcccggcatcctggtcagcatcctccactcgtcatcagcaggaggccaggagacggcatctccgtgcccacctcccccaacccgatgtcgggcccaccnnnnnnnnnncctgcaagggcggaggagggggcccatggcctgcgtcaggcagacaggcgcccggacaggagggagcccaggcccggcatcctggtcagcatcctccctcgtcatcagcaggagtccaggagacggcatctccgtgttcacctcccccaacccgatgtcgggcccacccaacctcccagcgccctaggtatcccccctcctctgaaaagaatggcccaggcactgcgcacccccaggggatggggtcgctctgcgcggtcagcacctcgttcgccacgagcttgccctcttccaagctttccacctcgggcgtggccgccctgagcagcgcccggcgcaccgtgccctccagctccttgcgtggtgcggggttttcccccgcctcgccggcctccgtcagcaggtcgacgtcggtgatgccggtgatgcggtcgcgctcgatgtagcggactacgctccccacagcctgccgcatcttgttcaggtcaaactggtgtggagaggggagagtggtggtgttgggggggtggggacggggaggcaaaggtgggggtttcgtcaggcgaggtgatcgacgcggccgcctctgaaacccagggagccaatgcccccgcaccgcatgctggattcaaagcgcgatgtgtccgcggatgcctgggcacacnnnnnnnnnngcggggaggcaaaggtgggggtgtcgtcaggcgaggtgatcaccgcggccgcctctgaaacccagggagccactgcccccgcaccgcatgctggattcaaaccgcgatgtgtccgcggatgcctgggcacactgctttccgatctccaaccacaacatgcgcgcccttcaccctcctctccagccgctctcctcccccaacctcggagttgagcgtgacgctggtgaagggccagctgagaggggagtccgagtcgatctcggcgttcaggatctgggcctgcagcccggcattgcaactccccctgaactccgccacattcccgctggcggtgccagccagggtgttgcagatcctggccacgtcgccggaggtggcggtgggcttgagggccagcaggaagtcgtagctgtcagggaacgcccccgtgttgatgaccagctcgccggagggaccgtagagggggaccaggtcgctggcggagttgatcgcgacgtcggagggggaggcggggatgcctgtggttgccgactcagtctggacctcctgctcctcggggaacaggttggcctcggcgatcgccagggcaaagccctggcctgcaaaacagaggtgggggggaggtggggtgggctgcttggcaatgggtcgagactggcgctgcaggtagtagagtgtagtaggggaagaggctgccagagtgcggagggcaggtggcagctgcgacccggtggtctgccatggcaggccggagggtcgggagtagaaccaggccgcttcccacctccccacctgagatgtcgacaaaggaaatggtgtcccaggtgttgctggtgcaggaatagcctggaacatccgtggcggctgtgacattcacctagagaaatgggagggaaactggtcactccaaggcaacaattcatgctttgtcacgatcagcatggttcagacgtagtgcaacctagtcaggcctgtgggctctcaccagggctctgaaccagccgcnnnnnnnnnngaattcatgcttcgtcacgatcaacatgcttcagacgtagtgcaacctagtcaggcctggggctctcaccagggctctgaaccagccgctgtcgtcggggcccagcaccacaaacgtggtggggttgaagcggctgttcagggaggctggcctgcggatttacggaagggaggatcgaagtcgtggtggggctggagcaagtgtcaagccctctccgagtcacgataggctgtatgtctcaagtgctcaggccgcatgacatgcagcggcttgtgctgtgctcacctggaggaccggagcgtacgcctatcacggaactggatggcggccccaaacatgacgctccccttgatccacagctcgagcaggccatccccggcaaaggggacggtggcacccaggctgtactctccccagggtgcaacggtggcggtcaggagacctcggggaatgctgttgtcgctgtcgttgcggttctccaccacattcatggggacggggaatcgagccccctgtccaaactgctgccagccagaagccagcttggtgttaaagacagtgtccccagaatcagtgatctgtatattggttgatggcgagggcgcagcgtgatgagcaggctttggagaatgaaatgggataccacctggtccggagcaggtctcggctgcgatcccatggtacttccccccactcccccaacagcactgannnnnnnnnntttggtggcgagggcgccgtgtgatgagcaggctttggagaatcaactaggacaacacctggtccggagcaggtgtcggcagcgatcccatgatacttccccccactcccccaacagcactgaacaatcagctcccgcacctcattcaggagggctgtcgcgtcgacagccgagtacaggacgcatgacaagcatggaagctcctcctcggcatggacgaggccggcacacaacaggcacagggccgctgcccagctccggctgagcattctgccagtcaggtacgggggtacggtgtgtccgccacaggacgcctccttctgggaacagaggttcgaggagataatgaccgcctctacaatagctcagggctcctggctctgtgcatgggcggcttcgtacgttcgcgccgttgtctgtcaggtaacaaactttgaaccttcccgatgcgaactcccgacatgatggcgggagaaccaccatcgtatacagggtgtacgaagagtgacctggccggtaaagctttgattctgtgcaataaatgtatgaacacgagcctccgatgcaatacaagtagtgctgcatcatataccaatggactgcgcccgatgcgatgcacatgaagccagctgatcggcacaaaagcacacgatggtacagggtgtgccttcccttgtgtacatggttgaagcacaccttcaggacttgaagtagagaacataggttcccttgtcctcccattgcatctcatcaagggcgtgctgggcagtttgggaccccctgcagggcaataggaagaaaacgattgttggcatgcagtcgccacagcatgcatggccaggcggcatgatccccattggtatgggttggcaatttcatgatcttatgaccgcttccacatacctccaatccgtttccgccacattgaaatgtcattccccgccaggcatctcggagaatgcagaacaccgaatgactgcatgcacctcgttatcaagctgcccgccctcccactcacccatccgccagggccttgaggagggcgggcagctcggcagcggggcactgcagccagcgccccgctgcctcggcctccagggagcggtaggaggcgcagaggacggccagcgcctcggccctgcccgccgccaggcgctgcgccagcacgcagcgcagccgcctgggcgccccggcgccgcgggacagcagggcagtccagtcgcggcggctcagtgcgcacagcatgcccagcgcgcagcgcacctcggggctgcgcagcacggcctccggcagggcagcgaggctggtcgcggtgggcatgccccccgtcccgcgaggatccagcgcagcgtggcatagcgtgagcaccgcggccgccgtcgcccaggactgcgcgtcgacgtgtgcagaggccgcggtaggggcgggtgaggacgaggcggccgccgccctggggtacagggagtgcacgagggtgtgggcgcacttgagcgtctcgcccaggtcccgggcctcgacgcagatgtccagggacagctcgtacacctgatgatgtcgcagtgcggcgcatgctcagcgaatgttgggcgttggcttgtgcagcatggacatggcatgccttcacaaccttcccccgcgctcccacctggcnnnnnnnnnngtgctcagcggatgttgggcgttagcttgtgcagcatgggcatggcatgccttcacatgtcacaaccttcccccgcgctcccacctggccatgcaacacaagtattccgcccacctggcgcatcaggtccccactctcatgcagggaggtcatggtctctctcaaagatcgggccaggggcaccaggtcgctccaggggcttcgccctgcttgttaggagcatggggaggtgtctcatgatggctgaaccctcacaaacccctgacgagcattactgcgcgatcgcgcattacctgggggtacagggagctccttcttcccatcgagaccgaactggacgacctggaaatccagcaccttgcgctgcaggcgatcgtatgcatcccggcatgcctccaggctcccgtcccccaccagcagcgtcggtcgaggtggggcagccctggggagggcatggcaggcagggtggggnnnnnnnnnntcacgcacccagcccaactactccaccacccgatcgtgcctgcggatctgactcgggggggccatccccccacccccctgcgcacgagctgcgcgaccctgttctaccgcctcgacatacgtcgcccgctccccaggggaggtgtcgtgttgccgatttgtgtcaggcgctatcgtcaggcttcccaccctgcttgcttgataatgatcggtcccacgaatgtccattctcacaccgcgccctgcccggatcctggccccagcctccgggttgctcctgcaagtccaggattggttcacagcaggagcaggatgccgcagggtcactccgcctcctccacccagtccgggttgggcctgagcaccaccaccccctccagcacgctggtcaggggcaggtacttggtggtgcccagctccgcgcgctcgcccgcggagagcagaacgggcgtggtgtgggtctggaagccggtgacggtcttgggccgccccgcggcggccaccacgtccaccgccgcaccgacgcgcacggggacggagagctgcttgccctcctcgtccagcgtcatgagcatgcgcgggtgcagggccgggaccagggcgtaaaggaggtagtgctggcgcccgcccaggcacgccttcatgtccagccccgcaaacagcaccgtcaggatgcccgccagcgcgggggctgcagggtgggaagcgtgttccgtcagcaaacacatggtgaggagtgaagtgggggtctcctctgtgggtgtactgggccagtcccgaggtgcacaagcctccagaggggtacgaggtcagagcagcccttcccctcgtgccatgcagccagtgtctttctgaaaaggcactccctcctcacaatcacacccgacggaaccgcatgcgtcgggtagaaccccatcagaacttgacactcatgcccacacgagcacacccaactccccccccaccctcctcacccgagagcagggcacggtcggcgtggtaggggtccagggtgagcaggcccttgcccatgtgggtcaggccctgggccaggcgcacggtgtacagcagcgtgggctccttgtggtagtaggaggagagcgcgcgcaggatgccggccaggcgcgcgttgttggtgccggcgcccacgaagcccagggcaagcaccgccgagccggccacgtcggcatccgcgtcgtggctcagccgagacagcgtgtccatcacacccacctcggggttggacacgttgagcagggccagggccagcggcacgcctcgcctgcgaggggggggttgggtgtttcgcacgggtttgtgcgagccccctccagggcacatgggcactcgggagaccagccctgcccctccggaaacagcacgcagccccacctgacgctgggctcgccgnnnnnnnnnngggttgtttcgcacgggtttgtgtgagccccctccggggcacatgggcactcgggggaccagccctgcccctccggaaacaaaacgcagccccacctgacgctgggctcgccgtactgcaggaggtgctccagcgcgcggtaggccatggccgtgcccagctcctcgcccgaggccaccatcgccacgcccagcacggcgatcgtgctctgcagcgcgggcggggccttggcgcccgccgccgcggcggtggcaggcgcggcaccgccgccggccccc

SEQ ID NO: 22196 - DNA, 79 bp, Chlorella protothecoides
cctactcccggtaagtgatccgtcggactggaaccggtcgctcacaagggagatgttgggcagggcaatgataattagg

SEQ ID NO: 22197 - DNA, 74 bp, Chlorella protothecoides
atcccaagcagacaggcacatccacttccacccagcgcaccagaccccgcccctccccctctctccacacctct

SEQ ID NO: 22198 - DNA, 162 bp, Chlorella protothecoides
gctccaaaggatggtcgggtggacattaccgtcgtcgccaccacagtggggtataccccctcttttgtgggattccgcgtttactcgtccaacctctcccttcctgccggaggtattaacaacagtcctacctctactgtcacctctgctacccttcttggc

SEQ ID NO: 22199 - DNA, 68 bp, Chlorella protothecoides
tccagctcggcgtcgctggcgagttccaggacggcaaagaggtcggggtccatgtagtgttcatgaga

SEQ ID NO: 22200 - DNA, 66 bp, Chlorella protothecoides
gaggtcggggtccatgtagtgttcatgagagggcctgctgggggaggacggtgcggctcggagggc

SEQ ID NO: 22201 - DNA, 64 bp, Chlorella protothecoides
tgagaatgcaccacgtccaacagcttttggtggccccctgcttccccttccattcccctcgccc

SEQ ID NO: 22202 - DNA, 75 bp, Chlorella protothecoides
cgtgcctccctgtgggtctgaacatcaagtgcgaggccatgacctggggtgactacagcgacggcagggtgatcg

SEQ ID NO: 22203 - DNA, 61 bp, Chlorella protothecoides
gggagtgggaggggtggactggaatcaccgtcgtccgtgcagagcctgggtgcaaaaagcg

SEQ ID NO: 22204 - DNA, 1775 bp, Chlorella protothecoides
  modified_base (590)..(700): a, c, t, g, unknown or other
cagggcgcccccagaagtgttggcgtctgcaggggagtggaagtggagaattgtgatcactggggaatgagaccctagtcggcaataacgggaacatggatgtaaacatcccacgcaaccactcacatgacacaaacaacaggtccgaggcatctgaccctgtaggggagaaaggaacgtagcgatcctgtgagccctgccacgttgctcatgcagacgcttccatccctgggtcatgcaggtgccctcccacacagacctggcgattgcacgatcattcattcaaggacaatcccccaccctctcacctgtgacctccaggatggcttcacagttctgctgcctgtacgagttctggagtcgaaacaccttgctcatgcacttccggaacagatttacgttggcagcacaggtgggtggacgcctgcaaatgggacgaaccgagcagggatcagcaatgaattaaggaggtgtcaagctgattcattgaagggatacctccatcagattgtgggttacacaaaaaaccacaactcatcctgaaaatcgtaagccaacggctgaccacatctaaacctcgctcactttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtggggacgccttcccgaggacctgcagtgcaagagacacccaggaggtgctgttaatgtcagataccagtttgacactcaccccactcagccggccccatgattgagggcaccagggatgagcagactgcggctggagctttatggcttgcctggaaacagatggcccaggaagtccacccggcctatgcatgttcaagcccatcgcacaccaccacacacccgagtagatgtcagccgcttcctgtggcgtgaggtggtcgcagtacacggccggcaggcagactggggtgacgatgggtgtatatcggtaggccagagtgaggcgggtccccagctgctcccgcacccactccaggctgggggagtccgtccccgatgcagccttgtcaagatgaccaccctcctccaacgccccctcgtccagcttgagggtcgtgcggcaatacatgggccggatgtcggcggccttggtgctgaagggggatgggggcaggtgccagctcacagactgctttggcctgggttcagggaagtgctccagttgcccgccatctcgacgctgaggtccagtgatgaaggtccctcgcttctgcatgtttgtgatgaaccctgcatgcaaaagtgacaagttgagtggcggagctgccaccatggccctcttgaatggccaccaaacccggatgtagcgagaggtgccccccagcgcagcacacatcaggacacccagcacctcctcccgcgcaccggctctgctgagcatgtgccgcacgctacgctgtcgcaggtcactctggtgctctgcaacgaggagggctgcaaagagccggtcggtggggtcgaggtcgatgcctccaaacaacatgttcaggctcttggcaatctcacgggaggccggttctctggagtcgtggaggacaaggtgcggcttgtcatgggagaactcactgacttgcgtgtgaaaccgggatgagcatggatccaccatcttgacatcaggcagcttgcaaatggcgcccccaagtgcaagtgcccaaggctccccacagcccatctcacgaagtgtccagc

SEQ ID NO: 22205 - DNA, 65 bp, Chlorella protothecoides
tacttgaccgtggcatcccctgttgctgtgtctcactactgagtgccagccggtcgaatgtgcga

SEQ ID NO: 22206 - DNA, 80 bp, Chlorella protothecoides
ggcttgcgacagtcaacacaactcacaaggtcgcgcacgactcgtaatggaacgaggacgtccattaaattcacattgtg

SEQ ID NO: 22207 - DNA, 72 bp, Chlorella protothecoides
catctggcatggcacccaccaaatcggagtatatcatggcctggcgctggagctggtggctgtgttcgggct

SEQ ID NO: 22208 - DNA, 61 bp, Chlorella protothecoides
gcaggtgcctcctccctcgaggctgtccacatccgctcccgacaatgtgtgggaagacctt

SEQ ID NO: 22209 - DNA, 76 bp, Chlorella protothecoides
ttcctcacattcacatcattggtgccatgcatgctgtcgatccacgcagggcggccatgcgcatagtcgcgcagga

SEQ ID NO: 22210 - DNA, 73 bp, Chlorella protothecoides
gaaatgcatgtatgtttgctgcgccgtattgcgccgtattccttccagaacccaaggccgagcccagtgagac

SEQ ID NO: 22211 - DNA, 95 bp, Chlorella protothecoides
catcaccatccagcggactggcccggccggtgcggataccgcacaggcttcaggcccccctgcagccccacaacgagtgctggggcatgtgagca

SEQ ID NO: 22212 - DNA, 61 bp, Chlorella protothecoides
cccacacgcacaaagacacaccttgatgtcacggtggatgatgccgtgggcgtgcaggtac

SEQ ID NO: 22213 - DNA, 79 bp, Chlorella protothecoides
cgtcacaacatgaaccataagatgacaatgtactacaacgacatgttccacaccctggtgaacgtgagtgacacagtgt

SEQ ID NO: 22214 - DNA, 78 bp, Chlorella protothecoides
cattgcatgttatcggatacttcagaggtcattattcgccacattgccttcgcgtgcatcatctgtcgggtcacggct

SEQ ID NO: 22215 - DNA, 67 bp, Chlorella protothecoides
catgggggatgagtagttctgagccccaccgttcatccctgtggtgaaagacctggccacaggccgg

SEQ ID NO: 22216 - DNA, 61 bp, Chlorella protothecoides
atgcacagtggtatcgccacctgcagctcccgcaaaacagccctgacatgccttcccacct

SEQ ID NO: 22217 - DNA, 64 bp, Chlorella protothecoides
gttgtgggggccagcccgcccccacaacacttgcacttgccaggatgcagtgctctcctcccac

SEQ ID NO: 22218 - DNA, 76 bp, Chlorella protothecoides
cacaaacagcatgtcagagccacccgcctcaatcaggctggccccaactatgagcccctgcaggcctcaccaggat

SEQ ID NO: 22219 - DNA, 77 bp, Chlorella protothecoides
agggacaggtcctcgctggcgctgccgtcccgcagcgtcgactgcgtaccggcctgagccgcgattcgcggtgaccg

SEQ ID NO: 22220 - DNA, 140 bp, Chlorella protothecoides
gctgctgctgacagcgagcatttccattttacgtaatctcttcacagtgattcgattcatgctgacaatgacttgaacaaacgtacagaataccctggtggttctcattagagtgccatacagcgttccatttacatgca

SEQ ID NO: 22221 - DNA, 79 bp, Chlorella protothecoides
tcaagatctcacatccaacaacgacgacatcgccagctagtcacacaagaatacttctatctctcggcaaatgcaccaa

SEQ ID NO: 22222 - DNA, 91 bp, Chlorella protothecoides
catcgattgggacagtgggttgcatgacggcgccaatgccttcagcctgaacaagtcccaaacaaacacttgtacttctacacagccccag

SEQ ID NO: 22223 - DNA, 72 bp, Chlorella protothecoides
agagagtatcacaactccttccacgatataccccatcggtgcatgcacttctcctgatgtagtcatccctac

SEQ ID NO: 22224 - DNA, 90 bp, Chlorella protothecoides
gaggaagcgccgccaccgcagccgcagccgtggccgagacgacgactcccccgcgcggaggcaccgccaccgcagccgcagccgtggcga

SEQ ID NO: 22225 - DNA, 105 bp, Chlorella protothecoides
gggatcagccagctgggcagggcactggtccgcgcatgccaagagccacggcagcggcccgggccctcctacccacctgcgctctcctacccacctgcgcgtcgc

SEQ ID NO: 22226 - DNA, 71 bp, Chlorella protothecoides
actccgaaatttcgagctgacatggcagtagcccatcggggccaggcacacccagcgcacagtgagaatgg

SEQ ID NO: 22227 - DNA, 80 bp, Chlorella protothecoides
tctcgaacggctcacggctgattcttcttcctccacccagcaatctgagatgccatgcagccgccaaggactggagacga

SEQ ID NO: 22228 - DNA, 2159 bp, Chlorella protothecoides
gccaggaggcgcgcggcctccgcgggcgcagcctccgggtcgcgtcggatgcggtcctcggcggctagcaggcccgccaggaaggcgcggccctgctcgcgcagggggcgcaggtcggcgcgcgccagcggccaccagacgtccagctcgtcgtgcacggcgcgcagcgcgcgcagcgcggccttgcgcacgcggcgctgcctgtcgcccagcgcagtcagcaggctggccagggcgggggggccctctgggaggacctgggaggcggggccctccacggaagcgactgctccgacaaaaaaacctgaccaccggctcagcgcggcctcacgagcctcgggaccggcgcccgtcgtcatctgggaacggaggaacgctgacgcccagggcgccgcctccgccattttctggatgaagagatcttcaagacaaaccatgttctctcccgacatgcaagcaaacagctctcccgcaccctggcgtcaggaaggagtgggaggggttacgacatgaggggccatgagagaggagccgccggggacctctcgaccaggcagtgatctggtactcctcagccaacaccgcgggccctcgccaaccgacggcaaggccctgcgcgggcacccgcctctccaccccccgccccagcacccaccagctgctggatgcactcggccggcgcagcctgcagcgcgccctcgatgaccacgcgctcggccggcagcaccaccccgcgttcgaggcagtgctgcaggacgatgcgggcgagctgcgcaggccagtcgtcgttggcgggctccagcaacctttcgtacaccaggcaggtcgcaagactggcggccgcgtcctccgcggcgcacggctccgcattggcccgccccggtacgcacgcccagaaggcctgcagggcctgcatgcaggccgcggggtcgtccatgccgcgcgttttgagccaggtcttggcctcaccaatccagtacaaggcccgaccagcctcggtcgtctcctcgcacggctttgtgggctcgccgagcccggccagcagcgggtgcgttgcccgtgggaggcaaaggaagacctcgcgggcggcggtgacgatggggagcatgtgcttgttcggccacagcgtgcccagcatggccgcgacgacggccgggctggcatccaatcggccaacaagaggcagggcctggcaggccacccggaccagcgccccgcgctgactctttggcatgcccttctctaggagctgtggcggcggaaggaatcgggagggggtcggttcaggtctgagtttctgcgctgcaatgctgcggagtgcgctgcgcatcaatcggcgctcgagcgccgccagcgtccccccgcccccgtccctgccaggccacccgtccccgcatctgccagccggccacccagcccctgccctaccttgctgacggagcgtttcaggcatgccagcagctcggcctcggcctcgcccgcccgctcggccagcacgccgacgctcagcgccgcctcgacgaccacggggtcgtcgtcggccagccgccgcgccgccgcgcgcagcaggaagtcgcgcaggtcgccttccgggtgggcggcggcgcgggtcatggcgtccagcttgcgcagcgcctgcgcggggttttgagggtgcagatggtgcagatggtgatggctttattccgtacggagagggtgcatcgcggagcggcgcgtgggatccaggtccggcaggagcctgctgccccagcagcccctgcctgcccgcgacagcccctccctctgcctcagcggccgccaatctgcctcgctccactctgcaggcaccctcccactctgtccatttccaaacccacgccagcgcaccgcaacgcgcagcgccggcgcgggggcgtccacagcgagctgcagcgacagcccctccccaccctccacctcctccagtggcgcgcgcttggttcccgggaaggcgtccaggagcagcgccgccacggccggcccggcaccgccgccggcctcgctcacgcgggccgccagcgccgcgtccagcgccgtcgggtagcgcaggtccagcacgcggagggcgcgctggagcacgcgccgtgctgcgggcccctctcccgccgcgccgtccagcacgcagcgcgcggcggccg

SEQ ID NO: 22229 - DNA, 12754 bp, Chlorella protothecoides
gggggggggggggggctcgcgcagtcatgctttctgaatggcaatctgtgggcgccccggcaaagtcgtgcctagcacacagcccacccaacagacagacttgcaacgggtgtcgccagggctggcgcaaggcctggctcgcccctatgcgcacagccttcacccccgctctaatctctccatcccccctcacccccgcatcctcgtcacgacccccacccccctgccatccccctcccaggcctgcgccacctggcgagcctgccccgactgcgccggctcaacctagggcgatgcgccgcactgcgcgacgcccacctggcccacctcctgcgcctgccctgcctccagtccctgagcctgcaccgctgccccggcgtgggcgacgccgggctggccctgctggcagcccacccgacgctggcggtggtgctggcgcccaacgccacgtgtgacgccggctgcgccgcgctggcgcgcgcgccggcgctgatgcgcgtcgtgttgcacgactgcccccgtctgggcaccgccggggtgcaggccctcctgcatgcgccgggggttcgccaggtggtcatctcccgctgtccgcacgtggatcagagacagctgaccggctactcactttgcactgtgagtgggttcatgtgtggcgtgtcttgtgtgggggggggcaggttgtcgttgtgcaggggaggaaggaatgggggaaggaggtgtgtggagggattgggggagagggcggagccgggagcgtgtggggtccgaccacgcagcagagtgggaggatcgagcgctgtgcaggcccactgcaatccctgctcatcacatgcacccgacccctctcgacgccttgcagcagctgacccggcgcggctcgcctcagcccaaataagcatgcccactgtccgatgacccctgcccctcagggccagtcggtgccggctagcatcccagaatccccttgccaggctcggcaatgtgccctgcccaggcgtagatcgtgtagagcgcccattctgacctgtaccattcccaccgcgcgtgacccttgcacccagcacttcccgggcgccgccgggctgaaccaccggcccgggcgccccataaaatcctgaggcagagggatgagggccccgtcctcatccctgagcccccccagctcccactcatcctcttctcacctccctggcccgattccggaggccagaggcactgtagcgcccccttcttgcccccatcttcaacccccccatttagttttgctcctcacatcccctgtaaggcactcgccagctggtcatgccgcagcggccagcgcgatcaggttgaagctcagggagtcgctggaggaaaggtacacccggcgcaccacggccgctgtgtcggcgagcagcccgtcccggctggaggcgccgtggtccaccggcccctcccggcgcctgcgtgggcgggttgaaagatgggatagcatgggggggttgcagcgagctcatgccgtgcctgctccgcacccaggcctgtcatggacaacgacaggccatgccggctgcgggcccagatcgagcgctgccagaccggcccgccactccccgcaacaaaccccggccccacccatccagctcgtagaggcggcccccatgctctacgaacgtcacgaagtgcaagtcgatgtcggccgtcgcttccggggcggcggtgctgccggcctgggcggcggcctgcgcggggaaagcgcgcgggggagagggtgctgatgagtcacctgcacggctgcaggccatcccctcctgtgccccaagcgaggttcccctgtgccgcagcaatgcctggtcagtctcctccaccgccttgacagtcttgcagaagggagggtacacatccctcctcctgcccccacaccgcatggctggaggtgatgtcgacgctggcatccggggggtcctcgaggtaggctgcccgctccgcgggtgtctttgccgctgtggcctccctaaatcgcgccaggaaggagcctggcgctgcagagatttgggtggagggtgatgtgtggattgctcgagcagcttctttcatgcatcagggcgacaggacaagtggcagaccaccaacaagcatccttgaagagggactgatttcactctttccaagtatcggcagcatcgtcgtctttccaggcgcgggctggttggtgatcaccattgcaaggccggctttggctcagcaactcccctgttccattcaggcttgatcacactcaaccacgaataaaagcaacctggaattgcagactcaccgagagccacatcctcggtgttgttcaggagggcgtgcagcacggcgattgtgccgcatgcgttccctatcgtctgcttcgtgtaccacaacgattgcagcgcgaaatcatctggcgcagcgggaaatgtggcatcctgtgcgcagtcaggatcacaacgggcagcgggcactgcttcaggccgacttgtgcacacctggatgtgcacaggcggcaggcttccacatcccaaaccacgcctcttgcctgcctcagaggctgctccgcgagaggagggcgctgcctccatgggaaacaggaggatgacggcaaggacggggcgcgggaccatggcgagcagatcctgggcggggtgatggtgagctgcattgagtgggtgccatctgccgatcccagggcgctcacggacatccaacgggagatgtgtgccccaggccccatccccccgccatctcccaccgggtccaggccccagacatcggtgaactggaagttggacacgtctgctcctagatttgctgcaaaggatgtgagcacctccgggttgctctcgaggggaacaaagtgcttctttgccatcgccacgaagtgatctatggacgtcggggcttgtcagcgatggtagcctcgttgctgctcagggtattctggggaatcaagtttaaaaccgaagaccttggaatacatggatataacctggataccccataatgggccgatgccggatctcggcacccttgtgggcgccaaaggtgccgcgtctgtggcgcccaccaagaccataaacacacccccttgtgacgaacagtttcaccgattacataagccgccccccaataacggcaataaaggccggaaaagatgcctaggataaggaatgttacactgtgtgctgcaagcgctccactggagactaagggaaagaccagtacgcgcggccaggggattatgcgcctaacctgtctgccaaggtctgtcccatgacttcctggggtgtgagctccatggtgccatcggcaagcttccgcatgacgacttcccctttctctcgagcaaagtcttcgattgtgcctgccgcatgggtcatcagcgatgttgagaggtgagacagcagaagaggggcatgcgctcgcagctgagcaagcaaggctggagctgatagacgctgatgctacaagcaagagacaggagccaggcaggtgctcctcaccctggcaccctggcacacccacctccttgcccaaaccagccaaggtggtctgcgatcagatggcgagagctgcagcccgggcactcaacgatgaccaccccggtctcatagctctgtctactgaaagccttggcagctcgggtgtcgcacttcccacatgtgaagagcatgaccagatccttccggggagatgtggagggcttccccgcctcaccaccatcccctgacccggatggtacccgcgtttgtgcagctgcatcatcgccatgcttgccactcgtggtggcgatagagctcgcggtctgactcaggccgtagagcccaccccgagtccacgcactggaagcttcgggcctggacagcaggtccgcaaatcccctgccaacgagggaatcggggtgagcccaaaatttttagggggcaatcttataaaaataaacaccgcactgctgtgtacctggactgcgagcccagaagttgacggcctacatgggcaagttgtctaagtgccatgatggaagcggcgaggcagcagatcgcaaggataccctcctttcaatgttcaaagtatgtttgcaatggtgccccctctgggcagagaaatcggctatggcagcatgagttcgagtgagattgttttgtagtaccttcgtcggcaagcacgcatgacgtcaaccattctcgtccaaaatccttgtgaaggggggggtcgcattgtgtttcgggtacatgatgcttgtttgcagtttctagtccccagaaaatggtcttatcggggtggggcacctgcattgttttgaccagtgcggtggtcgtgtgcatttacaccctcgtcacgcaatcccgatggcagcctgccctcttccccgcgagcgagtgcggcgtggtgagggcctggcttcagtccaggacccatcacgcacattacgcctcggaatctgctgctctaaacctgcagcagggcgctgggagcccccgcaacgacgagatctctcatgtcgccgatgacgtgatggtcatgttgggatgggttcccggcatgcagtttgcgcgattcggtgagacccattggcaaaatgcggatgttttggagcatggtccctgatgtatagctgctgggattggtgccatgccggaaattggtgcaaggtgtgccgaggtgacccggcatgcaatggacaggacccctgttcctgaatcctaccacagagcccgcacttacagtggaggacgtgctccaaggaagctccaggtaccttcccgcctttctcctggtggtgcctgggaatgggacgctggcaaggtgagagatttaatggagggggttctgtgtatcattctgggaggggggggggttgactcgaagtgcttgtgtgatgttgggtgtggtgtgttcaccctgcattaatgcggcctgtgcgcctcggagcactcgcaagctccggctctggagtgtcaatgcatctgcacatgccgacataaggggctcagggcaccctcgccccatgtcaccaggcgtgaccccggccagcccatcctctccgtcgacgcgaccgcacctgtcccccctcacctagcctctgggatcaacatggccctgggtctgctcgaaagtgccctgggccgcagactgcacaccttccacctcagcacggccgagttcggggggtgcggcaccggccgcgcgccctgcgccctgtgggaggccgccactggccgcgtctgggtgggcgccggggtggcgaggtcctgggcgcagggccacggcgtcgctcagctggtcgccgccgtgggtgctaggctggcgggcctggtggaaggcgtggccaaggaggtgcgggggtgagggaggactggcggcgggggacggcgctgacgctctttggcccctgcgtcaggtgcgtccggcaagctgtggcgccggagctcgcacgctcacctgcccgacctcacgccctcgaccccacagccggactcgctgaagatgctgattcccagcgccaagcctgctgaggcgccgccctcccctgccgccgcgctggggtcgctgctggcgggggccgccgccactgcgctcacggccgtcctctcctccatgggccccccgctctggttctgcatagcctgcccgctcttcctcggcatggctgcgccctgggtcttcaacctgggcttcaccgcggcggccgaggcggtgtgccgccacatggcgctgcccgacgaggagtgcatggatctctggtgtgcagcgggtgggggagaggggcaggtgcagggggcgaggcatttggacgcatgcccagacagacaaactgcctcagcagtccacagcacactacaacgtgaccaaacatctcacacgctcgcaggtgggcggcctttgtcctggcgatgctgctctccctggccagcgccatacccatagtgtacatttgcaggctgccccagtgcggcaaatctgtgctgtgatgcacagggcctatagcttctgttgtatttatggattactgtcttgaaccggagcagaggcccctgcatcaggcctgactgtcctgcgatacttattgtgtggcacccccgtccacatactgccttgccattgccgcccgaagcctgccagtgccccctcgcccatgctctctccccggtgctgtcaccttgtcgcccataccttgtcaggctcccaactttacatacaaacaatgcactcagggctccgtggttgtacatgcgaacattcagattgctgcaaacgagagctggaggaatctgcaggcattaatgcagaggttgggtcagcgaatcatctcagcatcttgcgcggggcgggggccgagggcgcgacgggagcgactcctggcttcgaagctgaaacctgtagagggtccccatcgtcaggagtctggaaggggtgtttgagctcgagaagcaggttcctcccttaggtcttgccccctcgggtctcgtccttcagtctcgtcagccacgtcatgtagatacccgcagcgttccacaccatgggcaccatgttgaaggccatcaagaaggccttggctccggcaggaacaaagtccaaggcgccgtccacaggatcggcgggtccgccggccagcactgccgctccccctccccacccaccggtgcccgagtccacaccgagccctgagcccgtccagcaagtggctcctcgtgatctgccgccccctgaggcacccctttccgaccaggaggccaataagcttccagatccaggaacggagggtgccgaggcagccctgctggggtcccacggcagcaaccccgccctgcaccacctcggcctggacccggatgagaagctggactactcccactcccacaccctggaggatggggaagggcacgactccccccgcccgtacgaggatggggccgaccacggggctgcccctgatgctgaggtggacggccaagctggcgagcacgacggccatgcgccggcggaggagtacccgggccttgtctacctctgctccagcgccgaccccgactgtgacgacaccatgtctgtggtctccggtaggtggcggcgcggtgatgttttggtggggaaaggtgccatggttcatggatacgctgtgacgctccctaacaccacgtcgccttcccacacccccttcgtgagatcgaagatggaaaacttccttatcccatgctttcttctccccgcacaacaatgcagatgccatgacagaggaggagctggctgaggagctgaatgagctgacgcgtgcgctgtcggccatggaggtggagggcccgcagcgcgccgcatcagaggccatgagtgccgcgtccgagggggacgtgggtgagtcatgaagggctggttcgtgcgacatgcctggtgcagagcctgctgtgtgtcgattgtgcagcatgcattgggtgggggcgaagggcatgcacgggcgccgcgcagtgaagaagctatgtggatggcggcggagcccgcccgggcctttccccgacccatggaacctccactcctgccgccacccgccacagagcccgtgaccaagatggtgagcctgtacaacacgctggcggtgaagctgatggacgccaagaactacgacaacgcgctgaccctgctgcgcaaggcgaggcggggaggaaggggtgggcggatcctgtgggtgtgtatgggtggttcttccgggggcgcacacatttgctcaggcaagccaggcacgacagcccctccttccccgcgccagcagtcagcatgaagacatgccctcctcccacccccctcgcgcaggccgaggccttgggcgaggacgacgggcggtggggccccgaggaggcacgcgctcgcccccgcctgcgctgcatcaccttcaacaacctgggctgcctgttccggcggcgcaacgcgcccgccgaggcgctgcagtacctggctcgcgcgctggagcagggacggctgggcggcgacgcccgcagcgcggcctccacccacctcaacgtctgcgcggcctacgctgggctgcgccgcgaccgcgaggcgctgggccacgcggagcgtgccgcgctgctgctccagcgcgagctcttcgtccccgccgcgtccagctttgcggagggcctggcggggctggcggcgcggctggccgccgaccggcgccacacgcagcgcaccgcggcctcggtgctggccatggcctaccacaacgcggcgctggcgcacgagcggctggggtcgcaggcggaggcgcgggtggcgctggcacgcgcgcgcgcggtggccgaccgctgcctgggccaccgctcgcacaccgccgcctcgctgcaccgcgccgagaaggccttcctcgccaggcaccagaggcctgtgccggcgcccaaggggggcaagaagccggacaaggtgagcggctactgatgtggaggaaggttgagggaggggggggcggggtggggccggctggaggccgcctcgcaggggcttttaaaaggtgtgaaggggccaggcaactgggagccgggcgacagcaggaaggtcgtcagagcagggtatcagtccccaactcgcatggcgcaggcggcgcccaaggggcgcgtgcccagcgtgaccaccgtgaagtctgggctgcacggctcggccagcaaggggatgctcaagccgccacgcacctctgggagcaagatgtggatgctgtgaggtgtccggagctcttggtcaggaggacgaaggtgccctgctcccagtctggcacctcgtagaatgtgtgcgaggaacacatcagctgtcactgtaaccgcgccgtggcccgaggctgccagccttgccatcgcttgaaggccaggctcgaagctcaatagagtgagaactacgcgctccagatcccggagtttgctgggatggtgaagaatgaggtatctgctgcttacagggggttcgaggcgtttcaaccacaagatcccccggattctttgaatggtgaatcttgctgcgcctgcttcgcgacccctttccaacgcgtgagccgagggagacattacatgttggaggtctggagccacatgaaggaggccgccagtctaaaacaatgcaaaattatcggtagggctgagaagtcgcggctgtatctcctcggcgaaagttctcacagagacccgtgagctgcagggcgcggtccccgcgttcgtaaagttcgtgagaattgcgagtgaaagatccacacttggcccctccaaagtgccttgcacccttccattggctaagatcgaggtaggacgcgttgccatgggcccgaaattcctgccatgcggtgcgggcctgcgaaccccgggccagctaccccgcagcgtcggagttgacaccccctccccaccactccgcagatgctgctgttgaacctgatgtccaccgtggtccccgatgtccccataaaccggggcgtctccgccgcgaccacgggcatcctgctcctggacgtgctccccctgctcaccacgctgcctgcactgtccatccttcgcgtccacgcccacgcccggcgctggggcgacgtggcggccttcggcctgggctttgcgctggccaccacctaccacgtggcgcacatgatgcccggcggcatcggcgccgccactttgctgggtgtgccgggcaccacctggcgcacgctggacatcctgtgggcgcaggctctgctggcgcgcgcgctgggccacgtgctgggcgtgcgcagcaggccgctggcgctcctcctaaacgccggcttccccgcgctggtgctaggggtgggccgctggcggggcggcatcacgctgggtaccgcctcccagctccttgccctggtcatgctgtgtgcgctggggctgaagctggcgctcgagggcagcgccagcctgccacgcttcggcgccgcgcggggcaaggccgccgtggtctgcgtcgtgctgggcctgacctgcttcccgctgccggagctcttcccgcagctctactggctcttccactccctctggcatctcttcatggccgcaggcatggtggagatctacctccagctgtttcccgtggagggcatgaagccgcccatctggctgccacaggccctggtgaccctgcactgacggggttcgggccgaggcctcaggaccccccccccttccatcccttgcctcatggcttcactcatcccttcgctcccagctgcacagaactgcatgtcgatttcattcgtccagcctccgctccgctgtgcgcaccctccatcacttggtcccccataccctggggcgacgtcgccccctcatcattcgagcttgcctgaccctccttctgccctgtcgcaggggtgcttgcccatcatgactccatcgcctctctcctccaataatattgacagtctgagcacttttgatgcctgtaatgtgttgttctggatctcgatgcgaggggcaccgggttgcgatggcccgggcgggccatggccacatcgttccggggtcgagggacggcaacgggtcgggttataagagcgatggaggctcaggaggaagtcacaacctactccccgcgataagaatcttgaccatcttctccaaagcaatcaacaggtgagttaagaaatgtagagcgcagctccctcgttcgtcgagtcccaaacatctgtccgtgccgaaacatccacgccacacgccaccccgaacacaggctcccgacaccatggtcgactgcccaaagtgcgcgaacggctgcaagtgcggcgatcactgcgagtgcgaggctggatgtacctgctgcggcaaatgcgagaagtcagttccggggctcggcccgggggccggggaagggggtttgaggccctggatggtcgctgtgatcggaactgttgtgtgaatgtgcccctgctgaacctgtctcaatattctgcacatgactttccgcggtttgtaggtgtaagggcgagtgcacctgcaccaagggcgagtgcgagtgcaaggtacgggcagccctgacgggttgcggtgtcatgaatgggatcccgaacgttgcgccgcgcgggcagcacctgctcccgtccatcccgcacatcactcacatgctgttcacgcacttaacaggactgctcgtgctgcaaggcctgaggaggaaaagggatgccgcgctctccaccacatcggtgtcaccatgattgaaccctgctgcatgctccatgtacctctttggtcccactgtaccatgattgccgtgctcgacgtgtaaaagaggtttgtgtgacagaacaggctagtctggctgtgcgggggacctgttgatgaggggcacactgcccaaccttgcatgcccccaggaaaaaaaactggaagattgtgcttacggcgtgcctcctcgcctttctcgatgacctccccgccatgacggtttgcgctaatcatcgcagtccatggcggtcacactcgggagggtggcgcaggcatgctctccagcaggcccgccgtgcccgggcggcaggggcggggctccctcgccggccaagctttgtgactcactccccagggccctcacagtcctgtgctcggcgtcctggagctgctccggagtgcctcgcaccaggtcgctgggcgccaggcttccttggagcagcgcctgggtcagcagggggcggcaggcctcgctctgcggaaaagggggggggggatggggaggggtgctctgaatgaaaggggtttgggaaggggtgcttggtgtgaaggaggggcgggactgggtcagggacctctgtctgtctgatgctgcactcggggctggggctggactccagacgacggatcttggacggcgcagccagatggccgggctcacggaacacagtgacctggggtggcttgcgctgcacggcccggtgcagcctgcctgctgctgacatgtgtggcgccacgcgagttcggcgcagcatctccccacacacatgtcgccatgaagagacccacctgcggggacagcacgtcccagagggtccgcagggcacagaggtaggcgtcccccacggccccgtccgcctccttccggtccagccacagctgctgctccaatccggcggcgacgtcgaggggcgcccgccgcggcgcgagcgcatgcgccaggacggccactgcttcgtccctggtggggtcgcctggagggcgagcatgggagcaaggggggtaggtgtgtgggatctggtgggggctgagatctggagtaagtgcaccgggcgccctgcggcccccagacagacgcaccgcaacgcaggcaaggagccccccccaacataacaaacaccctgcccgctcaccagtggacgccgggcccgggtggggggcgctcgccgcctcctcggtccgcggcggcgcccccgacgtgcctgcctgggctgccgggatgtcggcggcgactgccttgccccgagcctgccccgacccgggagtggcggtctgcacgcgctgctgcatggtgtgctgcatggtctgcctcctggccagcgcctcgtccttggggaggctgggggccccagtctccacccgccagccgttcaccaggcccctggtgggtgggggtggatgggagggtgaggggcaggcagtcggcggtgtgtcagcaggctggactcggtacttgtcacaattgcagccccttctcaccaggaatcccctgggctccggtacccagggggcacggggacttgccggccgctgaaccccccccc

SEQ ID NO: 22230 - DNA, 61 bp, Chlorella protothecoides
ggttccaagctgcccacgctgtgcctggccgacggcgaggaccctgcctcgggcgaggccg

SEQ ID NO: 22231 - DNA, 77 bp, Chlorella protothecoides
gggtgcaggacaggggctgatggatgactttgcgattggtcaccagggttgcctcagggaggagtcggtcgtgcgtg

SEQ ID NO: 22232 - DNA, 75 bp, Chlorella protothecoides
cgtcgggtgcgatgtaccacattaaatcttcatctaaattgccttctcattgcattagcagtcctacaatggatc

SEQ ID NO: 22233 - DNA, 218 bp, Chlorella protothecoides
cgctcaagcgtcgtcgagagccgccacacctggcgcatggagtgcattgtgcaagggtgagcggggcctagagagactgggcgaggcatggggagggggggttctagtcgtcaagtcatcccagccacgctgcccactctgtcaaaccacaacggctagcgggtggcttccccctcattcagaactctgccccagccatctcagcgtccccccccccc

SEQ ID NO: 22234 - DNA, 61 bp, Chlorella protothecoides
cctccacccccctcacctccacccccctatcctcgcaggccgcttctcccggtatgccagc

SEQ ID NO: 22235 - DNA, 61 bp, Chlorella protothecoides
ccgagtgaagccctcttccatgccaaggagggcctttcatgaccataccaggtatctgcgt

SEQ ID NO: 22236 - DNA, 67 bp, Chlorella protothecoides
gtcgcttgctatcagccaatggcggagtgggccttccccgctggatgcctcgtggagctggcacacc

SEQ ID NO: 22237 - DNA, 110 bp, Chlorella protothecoides
cgtgctgcgcatgggttgtgcgtgaaagggcgcctggagattgaccttagaagaggaagctctgtcctaccaacaggaaagtgtcaagccaggggctgggtatgcaggcc

SEQ ID NO: 22238 - DNA, 409 bp, Chlorella protothecoides
  modified_base (236)..(245): a, c, t, g, unknown or other
ggcatcctggagggcggcgggcttcttgacttgggccggccccctgccgctttttgcctaggccacggcgctttacccggcgccatctgccagcaatcgcggcccgcctctttgccacccgattacgctccccacatgcccagcacaaccgatgtgcgctggatgcattccatcgcccctgtgcacgacactctaccgttcctctgcctacttcggatgacaatctgcctcgtgcnnnnnnnnnnacatcgtctaggtaaggccatgcgaagtcgcaaaatcggatgtgcccggcgttggaccctcggagcccgttcaagcgatacatttcgttttcatctcttattcaaaattgggtcgactcggctggcgtcagggccggggatctatatcgtccgggatggccaag

SEQ ID NO: 22239 - DNA, 61 bp, Chlorella protothecoides
gacccttggcaaggtgggtacggcgggtggttgtgccattctgcagagtccagagacctgt

SEQ ID NO: 22240 - DNA, 74 bp, Chlorella protothecoides
ttccatgctgctgcatcgcatggcactggcggctgcatgaaataaagggtgctagaggaaggctcagcgacatg

SEQ ID NO: 22241 - DNA, 73 bp, Chlorella protothecoides
ttgcgtggtgggtggctgctcttgccttgactcctgcacgaataagccatgcaagcacagcatgaagggctgg

SEQ ID NO: 22242 - DNA, 63 bp, Chlorella protothecoides
aaatattgcgtgtggaggctttcaaccctttaaaatgtccatgtatacaccttgactccgccg

SEQ ID NO: 22243 - DNA, 150 bp, Chlorella protothecoides
aatgtccatgtatacaccttgactccgccgtggtgaagagggcgagtgcaaagatgagcaccgtcgcgcatgcgccgttgctcagctgtacacgcattcttgctaactccctataccagacagcccgcagtaactaaataggggtaaaac

SEQ ID NO: 22244 - DNA, 107 bp, Chlorella protothecoides
tgggtgttgccccagggtggctggtgtgattgtttgggctgggaaaagtcgataagattggagtggggaagcatcgcgaccaagaatgcccccattttggtccaggg

SEQ ID NO: 22245 - DNA, 61 bp, Chlorella protothecoides
tccaatgggcttgcttgtcgcgtctgcaggtgcctgcccctctgctgaggcaaagcaaggg

SEQ ID NO: 22246 - DNA, 74 bp, Chlorella protothecoides
ggtgtcggagtgcatgtgtggccaaccaaaaaacgctgtattgctcatgcatgtttgcatatggatgaatgttg

SEQ ID NO: 22247 - DNA, 221 bp, Chlorella protothecoides
cggtcaccatctccaaaaggtgggccatagacattgccgcgggggtacccgcgtcctctgggttggtgggcgcgggcgtcgcggcaggcgccgggtttgcgttaaccggcatgttggtgctggccgcgtagttgcggccccgggtatccactgttgtgtgctgggggctcggggccccggcgatctagatccgaactgtttccgaaaccaaaatgttgtgg

SEQ ID NO: 22248 - DNA, 80 bp, Chlorella protothecoides
cgcggtctgaggttatcacggccacctcgaccagcggttaccatacacaagctcctgcacagtgtaccccatggagcttt

SEQ ID NO: 22249 - DNA, 61 bp, Chlorella protothecoides
tttgtcctccgaggaaaaattggtgaagataccctatccgttattagattgcaggctgttg

SEQ ID NO: 22250 - DNA, 73 bp, Chlorella protothecoides
catgcgcttggcacctgctgctcacatagccgtcagtacaaatagctgcttctgaccaccccacctccactct

SEQ ID NO: 22251 - DNA, 61 bp, Chlorella protothecoides
ccattgccgctccctgtttcccacatctgcaccccccctgcctgtaggaaggtgtcaatct

SEQ ID NO: 22252 - DNA, 463 bp, Chlorella protothecoides
  modified_base (121)..(288): a, c, t, g, unknown or other
gcagttgcgagggggagtcaaatgcatgcacggaggtggtgccggtgtgtggaggtgctgagacaagcgtgctggtgttggaccttcccgccctgccagtggtctgtcgccctctggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattctggcaggatactgccatgccctttgctaattcagtggtccgttggcgtggctcttccgtatcaccacgcgctgtgtggaatggaaacggttatgttcagaaatgtccttgaagtatggatgaacaaatcataggcaagtactcctagaagcatggagggcctgcatctcat

SEQ ID NO: 22253 - DNA, 75 bp, Chlorella protothecoides
tcctagaagcatggagggcctgcatctcatcccccccccccctcgcctcctctgccagggtatgcgtgtgaggtg

SEQ ID NO: 22254 - DNA, 61 bp, Chlorella protothecoides
attgggacccaggcaagtctcgcagatgatgggaaagtccttgcgctcccacccatctgcc

SEQ ID NO: 22255 - DNA, 77 bp, Chlorella protothecoides
tgcagctcctggctgccatgtccccagcgcacgccacacatgctcccttgatcccaggcctgacatctctgaggagg

SEQ ID NO: 22256 - DNA, 65 bp, Chlorella protothecoides
cacgcacatggctccgagcatgtgctcagggccccatccccaggtcgggttcgagacccagccaa

SEQ ID NO: 22257 - DNA, 76 bp, Chlorella protothecoides
atccagctttatctcggcagagataatattacgcttaaggtcgatttagaacggccctcccatccccgcgtgaagc

SEQ ID NO: 22258 - DNA, 70 bp, Chlorella protothecoides
ggggcaagcccgcctgccgcaggctgtcctgctgcacgagtctcaccaggctgctggtctgggtgagggg

SEQ ID NO: 22259 - DNA, 65 bp, Chlorella protothecoides
gggttcggcaccaggagattattgatgaggccagacaaatctaatcagcatcctatcgtcgtccg

SEQ ID NO: 22260 - DNA, 73 bp, Chlorella protothecoides
agaagtcgctggagcggcggcgcaggggtgggtggttttgggaggaaggggaccttcctgggtgatgcgttct

SEQ ID NO: 22261 - DNA, 61 bp, Chlorella protothecoides
gtatttttcaaacatggagtgtcacccatggcctccgtaccatgtcctcccatcggcaacg

SEQ ID NO: 22262 - DNA, 74 bp, Chlorella protothecoides
gttgcttgcttctccctcataaccctgccgcatgcctggcgcctccttgcgtgtcagcatgtacaggcagcctc

SEQ ID NO: 22263 - DNA, 76 bp, Chlorella protothecoides
atcagcaatgcttggcaggatcctcccacactcccgaccagcatgatgactgttcaggcggatggagaggaggaaa

SEQ ID NO: 22264 - DNA, 354 bp, Chlorella protothecoides
ggactactacctccgtgacatggcaccagagtttggccatacgatgaggcgtgcgagtggctgtgggccttccttggtgtcagcactttcgtcgtacacagggcatgcaccctgcatggcctagacgtcgcaccccgccgtgaccaccgatcgcatcaccaccgacctctcctcactaaaccgttgccgttagagactgcagcggaaactgtgctggctattgagatgaaggctcacccggcccggttcacgtgcctgctcactgtgtcggcgagatcgaggatgcccagcgtctccctggcgcttcgtgcgcagactcagagtgggcgaacaggtacccttaccatcgcccgt

SEQ ID NO: 22265 - DNA, 76 bp, Chlorella protothecoides
ctggctattgagatgaaggctcacccggcccggttcacgtgcctgctcactgtgtcggcgagatcgaggatgccca

SEQ ID NO: 22266 - DNA, 482 bp, Chlorella protothecoides
atgtttcgtatctcccaacgacattttcaagttaaaacctccatggcaggttcatgttgtgtctatgaagcccgtcccttgccgccttcatgtccctcctacgttaacggggacccgctcgacgtgtcgagcccatgccacccctacagggaccatatgcaacgggtttaaggctctcgttcacatggtacaattatacaaccatcaagtgattccgacgacagacatccaagccccatgaaggcgagcggacggccaaaaaagattcggctacttgacagctgccaagtgcgttaccgtacgcaactacccactcacccaccaaccacccacacgtgccgcgctcccacaacacaactcaccccataccaccacccccctacacaaaatttgcaggcgggaccgcccgccagaggattccaagatacacatgtatgtgggcatcgaccccaggcggaccaagatgttcacggctatcgatg

SEQ ID NO: 22267 - DNA, 89 bp, Chlorella protothecoides
ttcgcgcaaggcttaccagacagcaccaccctcctcatgtttattctggggaagaatggcagggctgaagatggaatgcgggccgctgt

SEQ ID NO: 22268 - DNA, 80 bp, Chlorella protothecoides
cactttcctgtgagtggcctgaaacggaggaggtccagcacatccaccccaggtccttgcaagcttgcgtatagacagat

SEQ ID NO: 22269 - DNA, 75 bp, Chlorella protothecoides
ggatgagggggccaagcgcgactgagacaccaccttgtttgtgctgaggaacgtgcctgcactccagcctgtgac

SEQ ID NO: 22270 - DNA, 164 bp, Chlorella protothecoides
cccatcgtcccagctctcagcagccattctatattgtggagagatcttctaatcgatgccatggaccccaagatgcatggcacaagatttcttgatatagcgtatgcttgggtttccccctacgtggcagggatccaagcgcgcgcaacctccttcgaaatttg

SEQ ID NO: 22271 - DNA, 68 bp, Chlorella protothecoides
attctgatacattcaacaataaatatatacaagaaattatgacggtcaaccctgccccaccgccagta

SEQ ID NO: 22272 - DNA, 68 bp, Chlorella protothecoides
cccacccggatgtggcttcattgaaggtgggaatgcgttgcttgacagattgtttaacatatggctgg

SEQ ID NO: 22273 - DNA, 61 bp, Chlorella protothecoides
agtttcgccccagcacctcctcacaagaataccccgtcagcgcagagaacctgccaagaaa

SEQ ID NO: 22274 - DNA, 80 bp, Chlorella protothecoides
ggcccccgcccatgcggcagttgacctcgatcaggcgcgcgccgcgggaggtgtacttgcactccacgtggaacacgccc

SEQ ID NO: 22275 - DNA, 5843 bp, Chlorella protothecoides
  modified_base (1661)..(1858): a, c, t, g, unknown or other
  modified_base (1986)..(2190): a, c, t, g, unknown or other
  modified_base (2509)..(2518): a, c, t, g, unknown or other
  modified_base (3606)..(3615): a, c, t, g, unknown or other
  modified_base (3763)..(3772): a, c, t, g, unknown or other
  modified_base (3870)..(3879): a, c, t, g, unknown or other
  modified_base (4373)..(4382): a, c, t, g, unknown or other
  modified_base (4593)..(4602): a, c, t, g, unknown or other
  modified_base (4840)..(4849): a, c, t, g, unknown or other
gcccgcggcgacggcctgggcggccccggcgccggcgggcagggtggcggcatgatgcgcccgcgcggcaccgcgggggcgggcgtcgtcatgtggaccaaggctgaggacgagctgctgctggccaccgtgcacgagtttggcctgaactggacgctggtgtcggaggtgctgagcctcagcctgggcctacagggcatccaccgccccgggtcgctgtgcaagcagcgcttccggcacctcacagtgagcggatacttgtttgtgtgtgtttgtgtggggggggtgtttagggtggaaagtaccattgtggtgctgcctctgtgactctgcgtgcctcccgggcctcaatcgccatgcagttgccggttgtcattggtgtcggccggggagtgcatggagtggttccctccgccaccagcgtccctcaccaccagtccgctttaccccccaccccacctccaccctgcaggcccaggaagggcaggactactcggaggagagggcgctggccgctctcaaccagcagctgtccaagcagcaggtgggtggctctgccatggactggacagcgtcggagggtatgcacgcatggccatgccttgcgtggctgtgcgagcatcgatgccctcccctcgacctgcacctttcaccctctgcttgctcccactcaccctcgttgtgcgccatccaaccccccctccccaccaccccatgaacacccacacaggcgcgggagctgctggtgcagtgcctgcctgtgcgcgacgacgtgctgatgcggctgctggaggccctggcccagattgggggcggggccaagtcgcggcgcgcggcggaggagaagcgtgccgaggcagtgcgcactcgacgccaggagacgcacgcctcgcacgcctcggtcatgggccacgtgctggcgcagaccgcggggcggcgcctgacgccgctggagctgtcctccgcggtgaacaacgcctacctgaaccaggccaagcagcaggccgcgctggcggagcaggccgcacaggtagagagggggggagggggagagagggaggggaggggcgcgagtgtcgggtgtcgaggcggcctcagcatggatccgtttggggctgcgccccgacgcatgcccaccggaggttgtgcattccccccatgcaacatcccctgattcaactccccccccccaaaaacataatcgaacaccatcaggcgcaagccgcggcggcaatgccctcgtcctccatggggtcgggggcctctgggccggcgccggcagcgtcgctggcccagcagcagcattcggcgatgcagcagcagcaggcggcgatgcagcagcagcagatgcaggcgatgcaggcgcagcagctggggcaggcggggcaggggcacgcaacccctcacccgggatcctcggcgcccagccccgcgccccagaacggcagcctgtcccccgcgccgccgggcgtggggctccccaatgcagggggcggggctcccgtcgccgcgccgggccccggcggcggcgcgccggccgtggggccgggggcggcgggcggcgcgcccaagctgaaccaaccgccgcagatcacgctgcagcagctgaaccacatcctggccaccaacaagctgcccaacggacagccgctgagcagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggcggtccaggggccacccccggtgcccccggccccggccccggccccggccccggcccgggcatattcccggggtcgggcgggcagcaggggccggggacgccggcgtcggcgggggccatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaccaccaggcccaggcggcggccgcggcggccgccgcggcggccgccgggcatgcgggccagcagcagcatgggccgccggcggtgccgctgccgccgggcgtggccgggcaggggggcatgggctgagggacggggcgcgctgggcggaggctgtgcgccgcgccgccacagggaaggccgcgtgcggtcaccggcatgccgaccagttctggcaaagccagggcgcgctcggtcccagccccgccgacccctccccaaagccccccctcccctgtctgcccgacccagcctttctatggaggggggacaggggnnnnnnnnnngcggggcgcgctggacggaggctgtgcgccgcgccgccacagggagggccacgtgcggtcaccggcatgccgacccgtactggcaaagccagggtgcgctcggtcccagccccgccggtccctccccgaagccccccctcccctgtctgcccgtcccagcctttctatggaggggggacagggacaatacccatgcccggtcccccccttgccagagacgagtgcaactaacttggcaatttgtgaaactctgtgaccaaacgtgcttgaacaggaggggaatgcatgcccagcaatagtcactggcagcgacgctgcggcagcggagccgagctcctgcctggcgccagtttgcgccaccaaacagcagcttcagccagctcgctgaactctcgccgacagaatctcatcataatctacagctggcacgccggtaggggccaatttcagaccagcacgcatgggcaggacaggaatcgagtcccggcagcgcctcatctcgaggcacattcattctactacaggcacgcctccgtgcgtcctccgccacaaaacccccatgacccgcacgtcaggggctggagccctccttgccgcgctttcccagccagcgcgccaccacaggggtgagtgccacggtgggcgggaagcggacgggggagagcgccttgtgcgccgcgtacgcgatggccacggtgccgacgcgctcggaggtggcgccgggggccagccccacccgcgtcagcagcgcgccgacgtccacccccgcgctgacggcgaggtagcaggcgccgaaggagaccagcgcgaaggagatggaggtgaggaggtaggcgctgccgtactgcttgagcagcgccttggcctcgtccgcgcgggagggagcgtcgggcctgcgctcgcgggaggtcagggccttccacagcccggcctccagcccatacttttcggtggtggccgacgggtccacgggctgcgcagggagggcattcgtgggggcgctggcaagaatgaggccggctggtgtgatgtactcttgggatgcacacccttgcgcctgcgagcagcgcaacacccttcccagtttnnnnnnnnnngtacttttcggtggtggccgccgggtccacgggctgcgcagggaggacattcgtggaggcgctggcaagaatgaggccggctggtgtgatgcactcttgggacgcacatccttgcgtctgcgagcagcgcaacacccttcccagtttnnnnnnnnnntggagatgaaccatgggtgaacctcagacttcgtccagggccatgcaattgcagtgcaagggcgaggggcagacgtccagcgacctgtccaggcatgnnnnnnnnnncaccctctccttccacaccactacccacctcctcggtgtccgtcttgtccttcacggcacgcaggacgggcgacttcgagctgtgcctgcgtggggagggagatgaaccatgggtgaaccctagacttcgttcagggccatgcattcgcggtgcaagggcgagaggcagacgtccagcgacctgtccaggcatgcagccccgcctcagcgacactcaccggaatgcaccgtgacaataaaccgacctatgacgcctcgaacatagaatcttgcctcccatggaccccatgccgcaaggcacgatacatgctgagcggcttcctgtgaccgtcgggaacgacatcgggaatgtcagcttgggagtgactaggtacactatatgctatgcttgtgtaacagatacagcgaatgggcccatctggatgtaccgctgggagactcgcatgtatgttgtgtggagaggggcccgacatgcaagatgcatgtccgcgctnnnnnnnnnngtgggagactcgcatttatgttgcgtggagagaggcccgacatgcaagatgcatgtccgcgctcgatgatccgtttttcccattccgcacgataaaggtgttgagtgttcctcgagccagggatgaggcgtgctcatatctctatcgatacaatctatgagcaccattagactgcgattaatgcagaggcaggacacttgttcgtagcagnnnnnnnnnncgctcatatctctatcgatacgacctatgagcaccattagactgcgattgatgcagaggcaggacacttgttcgtagcaggtctcccctaaactcttaaccatgtcccgatcacttcaggaacacactttggcatagtggtgtgctccccccatatgacgataaccaatgcagtactgatattgtctctcttcggatgtattcaagccgcacaatgcggggtgggcatccgcacggtnnnnnnnnnnattgtgctccccccagatgacgataaccaatgcagtaatgataatgtttctcttcggatgtattcaagtcgcacaatgcggggtgggcatccgcacggtggccgacctgacgcaggccatgtaccctcacctgctggacagcgatgcgtgcgtgcgcctgctgcaccgcaacggcagcgccgggtgctccacccccggcaacagcgcggtggaggggaacctctggcgcttgagtgatcgagacatggaggctggttcaggccagcacattccacgtgaggagaaatagatgggtgcttcagtgctccagacggcaagccagtggggcctcgctggctgccatcgaagaccccacgccgcacctcatcgccactccaagtacatgcgttgcaggagggagcgtggctgtcctcccggcggcggcactggaggacttcttggccagtttgtcggcagatgccgcctgggcgagccactgggcaggggccctggtcctcgcccacgcccccggcacccacctgccctccaaccctctgcctgccagcggcgcgctgcggccgggttccgaggccgaggccccttcccacgcctggaacccggccggcaccggctcggtgctgcgtgccctccccatccccctcttcagcctgaacgccagcgccagcgagcgggtggcggcgaccctctcacgtgcccccagcacgggcgccggcccctcccccgccgcgcgcatggacgtgcgcatggccgtgccggccggcgcgacctccgaggcctgcctggcggcgcgcacctgcctgcccctcggcggccacaccgtgtgggcgcgggtggggccccggggttcccgccccgcgccggttctggtggcggccgtgcaggacgaggccagcctgttccatgccagggggggagccggcgcgcacgccggcgcgtcgggcctgatcgccaccctggcggccgcccgcgcgctcggccgccagggtggcgatca

SEQ ID NO: 22276 - DNA, 69 bp, Chlorella protothecoides
ccaggctcctaggagctccactggaccatcaagagaagtgttcagcgggtgtacccacgctcacctctc

SEQ ID NO: 22277 - DNA, 281 bp, Chlorella protothecoides
ttcgccatacgtggaatcaggcttcacaaactgacgaagcagtattacgtgtaaaggaggtgaatactgatcccaagcagatccttaacccggcccacaaatataaaatatactgccgtaacatgcaacactgatcggaatgatgccaactttctggaccgtgcgtcggttcctctggtgttcaaaacttcccatgtcaccaccctgcaaaactcgaatgaaaaggaatcggaattgttgggtacagttttaaatgaagatttcaagacaccaaggaaatt

SEQ ID NO: 22278 - DNA, 61 bp, Chlorella protothecoides
cttccacactgccggtgcgaggttctgctaaatcaccggctctggcgatccagtgccctgt

SEQ ID NO: 22279 - DNA, 75 bp, Chlorella protothecoides
gatgagttcaactttcattacaccgtgcacgagaagccccacatccagaacgacaccttcacgagtgagtgggtg

SEQ ID NO: 22280 - DNA, 61 bp, Chlorella protothecoides
ccgcatgcaaattgacacccctcatccattaccccccttctgcaggagtctgcttccagga

SEQ ID NO: 22281 - DNA, 122 bp, Chlorella protothecoides
acaccggcgctgcacgcgcattcccagcttcccagactcccattcccattcttgtggcatccccaataccccccgcccatcgcagaccgagaacccacccaggcgcaggacgcggcgctgca

SEQ ID NO: 22282 - DNA, 113 bp, Chlorella protothecoides
tgcaggcgaccaaccggctggggtcccgctgcgtcttgcatcccgaatctctacctggcgtgtcctggatgcatgcccatgtgtttaccgccgtcccttcccattctcacttt

SEQ ID NO: 22283 - DNA, 64 bp, Chlorella protothecoides
taagaaacacaagaaggacaagcgatgacagggggtgctgaaaggagagccacctacgctgctg

SEQ ID NO: 22284 - DNA, 74 bp, Chlorella protothecoides
accttcttcctggggtacagggatagggccagcgcgatccgattgcgccagtagctccaggtgaaccaccacgc

SEQ ID NO: 22285 - DNA, 68 bp, Chlorella protothecoides
tcacttctggtaatgccctattcccgatgtcgacctgacatctttcctaatcaggggatggtttcgga

SEQ ID NO: 22286 - DNA, 62 bp, Chlorella protothecoides
tcaagcttacctagaattccaagacctttgacaggggagatgcgcccgccagcagctcagca

SEQ ID NO: 22287 - DNA, 61 bp, Chlorella protothecoides
cgtcgcaggaattccctactttcttcggtttgacatgaacctcgcgatggttctcgaggaa

SEQ ID NO: 22288 - DNA, 117 bp, Chlorella protothecoides
gaagatggtgcctcgtcagattatgttattgtgcgtacccatttgcatatcgaaacgctggggatgcttgaattggtaataggaattacccattgtgggtctgcagccccgacgctc

SEQ ID NO: 22289 - DNA, 131 bp, Chlorella protothecoides
ctggacctgtccaaccgccagctgatgcaaaggatcttccgatctccggactgggagacccgcatgcggagagtgggcccaggcaagagcgacagttgatcgacacttgtgggtggctggcctgcgcctgt

SEQ ID NO: 22290 - DNA, 79 bp, Chlorella protothecoides
tggggcacctcgggcagggacccaggcagccagtttccacggcctccagtgcatgcactgcatcgcccgcccgccgtac

SEQ ID NO: 22291 - DNA, 70 bp, Chlorella protothecoides
agctaccaacagccatgttcccaggcacccgcgcaagtcaacaagtggctcacttggtgaaggcgatggg

SEQ ID NO: 22292 - DNA, 425 bp, Chlorella protothecoides
  modified_base (157)..(228): a, c, t, g, unknown or other
ccccccgcccaccacaaaaacaaaatactgacttgagggcggtgaggtaggtgtaaagctggtccaggaggcggtcgcgcgagcggatgacctggcacaggataatggccttgggcacggtcttggacatgcggtcgtagatggcgcgcgcgtaggnnnnnnnnnnnnnnnnnnnnnnnnnnnnnnnnnnnnnnnnnnnnnnnnnnnnnnnnnnnnnnnnnnnnnnnncccgtgaaggcgcccaggcggtcgtaatacgcgtccaggtcctccacgctgcccacctccagcaccgcggcgatgcgtgacccgcccagccccgtcacgcggttgaaggcggtgcccacgcgcgcagcggagcggccgaacagcccgcgctcgggcgaggccgcgccctcgcgcccaggcgcggcggtgcccgcccg

SEQ ID NO: 22293 - DNA, 61 bp, Chlorella protothecoides
gcagaggaggggttcccccgttactccttcacccccaagaccacacgactcaccgatatgt

SEQ ID NO: 22294 - DNA, 80 bp, Chlorella protothecoides
aggtcggaaatattccatgcacacagcgaaccgccccgaaagagtcacagaaagctacgacggggacagcgaagtccccc

SEQ ID NO: 22295 - DNA, 82 bp, Chlorella protothecoides
gttgcaacaacgtgatggtgttctgaatcaaactactctagtatcaatataaatcaatgatccttccgcaggttcacctacg

SEQ ID NO: 22296 - DNA, 73 bp, Chlorella protothecoides
tgtgagacacttgaagtcggatttggaagaaaacactgaaataattcaacctcttgcatggagaatgtccacc

SEQ ID NO: 22297 - DNA, 96 bp, Chlorella protothecoides
gatgttgcctgccgcccagtcgggcatcgcccgcaatcgcgggccatgacgattcgcatcacccactgccatacttgagtccattcagccctcggc

SEQ ID NO: 22298 - DNA, 71 bp, Chlorella protothecoides
ccctgggctccgctcttcatcgctggatgcattccacatgtcagccactgtcctgcagatctatcgcttta

SEQ ID NO: 22299 - DNA, 8837 bp, Chlorella protothecoides
cccccccgcgccgcaactgccactaggaagctgctgcgtcgtgccctggtggatacgatccaggcgtcccccgcccccgacctggacgtgcagtgcgcctgtgacctctgtcccggggccctgccgcacgcggaggtgctggcgcgcatgcgcgactcccgcttctgcctggtgctggccggtgataagccctccagccggcgcggcagcgaggcagccctctccggctgcgtccccgtgctcgttggcccgccctggcacacagtggccctggccgacgacatcgaccacggcgcctccagcgtcttcatttccgttcgtcgtgcggactgggtggtggccaatgcctcgctgggcgtcccggacaaccaccccgatgtgctgaattcctggtacctggatgctcacctggtgccgagcagcgtgatccaggtggacagcctggccgaggttctgggggtgctgcgtggcatgccgcccgaggtgctggccgccaagcaggccgcgctggcgcggcaggcctaccggcagtactggctgccgcctccgggggagaccaggtcgcagctgggggagatcgtggtgaagaggctgtgcgaccatgcccagatgctcaaagacaagggtgtcatccccctgcaccccaccccgcaccggaggaggaccctgctcgccgactgacccctgcctatttttcacccgcttgtgcttgcccttggcgaggttactgacaaacattccgcttgtgcaggcccattgtccaggatgcctgctgccaaccctgttatattgaactcgtgctcatggaatacagcgagacctcccaggccagtatgtgttgttgataatggagtccatcgcctgaggctgtcggagtgtcccaggggtggattgcctgtgcccaccatcataagggagggtcaggatggcaccttatcccgccccaccttaatcgtcaactgactcgggtcctcaacttcctttcatggtgtcgtggaacccacgaatcattagaattgcataaaccaatccaagtggattactgcaggagattgtagcagggaaagtgtgttgcgtggccgtgaccagcaccgagagaatcagggtccccggtcacgagggcaaatggccagaacaagcacaggaacctgtttcacaacgttctttgagagctaaacaccactgcgaatgctggataagcttgctctcgtacaatgcttgattgccgttcccgtttcgtgtattgtcgccaaagaagaagggtcggaaatgcccacgtgggtgctcgacgaaaaccctctctgctgccctagttacaagggtttcatcaaacaccaatgaacacaaaagcatactccttattatactatattctgaaagaatagcgtctaatccatccagatttcagtcctcagtattgtctggagaccctctagactttgatatcccgacggcaactagggctggacctgaagagtcttgcggaatctctccaggcagcacaaacgtgcgcttgcaggtgggaactcgccatgtgatatggtaccgtgatgtcgggggaggtgacccaccctggttacgccccgtcgattcgggtgggattgggccggggttagggcttcctcgcgatcccgtccatgaggccccaacccgatgtcgtcaggccttcaccgcctgcggcacacatcctttgcagatatgggtcgttttatgactgcgtggagggagaagaggtacaactacatcctccttggcgattatgattacgtaagcagggcgacagatcggtcgggtgggtcacaggggagttgccctctggcccctcccttgggatctcagggaagtctgctgacaagcgacgtcacaacaggggcgtgtacaatgcctcagaaatgctccagattccctggtagcatcctgccattgccacgcatgcatgtccctacctcacccctccatatccccacacccacctgcacccggcatcacagaaatacctgtgcatgccggtgtggcccttcaaggcgggcaagcgcgacccccccaccttcttcgccaccgacgcgtggctcggcatcctcacagccatggtgatgggcctgcagcacgccatggcaatggtcggcggactcatcacgtgaggaaagggtggcgtttgtgtgtgtgtgtgttttgaaggggggggggggcccagggtgaagaccggcatgtgtttctggttgggtgatatggtccaggtcccacgcccagactgcctctggcctgcgtgcagcctggcggcctgaccagccaaaaaccaacccggaagactccaacacaccctaaccctaatcctcaatccccggacccctcagcccccccctgctcatctccgcatacgcggccaatgaccccacgctgagcaccacagacgtggacaccatcgcccaatacctcgtctccgccgccctcctggtcacctccatcatgaccgccatccaggtgggtggcgaaggttagctgggtgggtgtaggtggggctggcagtcgtgctgcgtgtgctgggcggcgatgtgtccaccaggctcccacgccacgtgccagcccctgccccccagtgcccatggtcccccagggagttccaacgcacaaatcccctcccacccccctccacacacggcacaggtgacgggcatcccgctgccctacggacggcagtggggcgcgggcatcctgtcggtgatgggcatctccttcaccacctaccccatcgccgtctccaccatcagcgcgttgatggccgacggacacaccttccgcgaggcctacggctacctgctgggcacgctggcctgcgtggggatcacgcccgtcgtcatctcattcttccccccccgcgtgctcaagcgcatcttcccccccatcgtctgtggcgtcaccatcgtgctcatcggcatcaacctgaccggcgcgggcatggccaactggggcggcggctccttctgcaacacctacgccgacgggctgtggatcccgcaggccggcccctgcaccgtgaccaacgccacctcgggggaggtcaccacgctgagcacctgctacaccaacgtgcccatcatgtgcagcgggaacggggacgtcatgctgccctttggctccggtccctacgtcggcctcggcttctccgtcttcgtcatgctggtcatcatcgagctgttcgggtcccccttcctgcgcaactgcgcggtcatcatctccctcctcttcggctacatgctggcgggcgtgacccgcgccgacggcaagcgcttcgtcaccggcaccaagatcgccaacgcgccggccatcaccttcctctgggtccacaccttcccgctgaacgtctacggccccgcggtcctgcccctcatcatcgtcttcaccatcaccagcatcgagacggtgggcgacgtggccgccaccgaggaggcatccttcctccagacctcgggccccgcgcacaacaagcgcacccgcggcgcgctgctcaacgacggcatctccggcatcttctctgcgctggccacctccttgcccctcaccacctttgcccagaacaacggcatcatcgccctcaccgccgtggcctcacgccaggcgggctgggcctgtgcgggctggctcttcatcttcggcctgatcgggaagtttggcggcgtcatcaccaccatccccaactgcgtgctgggggggatgaccaccttcctcttcgccaacgtcatcgcctcggggatcaagatcatgatcagccagcacttcacgcgccgcaaccgcttcgtcatcgcctgcgccctggcactgggcatcggggtcaccctggtgcccaactgggcccagaacaacctgtggaacaacccaaacctgagcgagggggtgcagggcgtgcgcgacgcgctcatcctcatcctggagaccggattcacgtgaggcggtgggggtgggggtagggtcttgatcgggcggcagggaggaggtcgatgaagggggaggagcgggccgcactgaggcagccacttgcgatctgctgggagttgaggggccgcttctgaaagcatgccagctctcgatcacccagtccccccctgccctgcaggctgggagctctgacggccatcgtcctcaacctcctgctccccgacgagaaggggcttaccgtgccggagcccgacacccccgacctctccgtccagggggccgagccgtcggtgcgctactccagcaaaccccagggcaaggacccgctgcagagccaggacaccagcatgcacatgaccaaggactacagcaccgacatgcagaaggtgtgtgtgtgcgaggggcttggtcagtcgttttgagcggaggggaggctcgagccagcgtcagaggggtgtgcgggaggggattgagcatgtaaacaccccccagcactggacccatgttcccaggaatgccctgtcatcagtccatctcatcagccctcctcccccaccgacaatcctcgcagcagaacgacagcgggtcagatacacccggcgcgaataacaaggcccctcttgtgtgactgcggcctcggtggagcactgagcaggggcattgtctttggcccaagaccaatgctccaaatgattaaaggcacagccacctggcagtccggggagtccaccggacatgctgccaccgcaagtcaatgacaaagccaaggccacggggggctttgtacacccgagttcacggcaagatggctccatgtgctcccaggccctcgaacatcccagttcgcacgttgatcgcatatatttagagctccactcgtggcaggtctccctgtgccatgccccagaacctggctgtggggatggccgggaggcaaccttccccccccctacatgccagtacatcccaccgcgcagccgtctgatgtgcggaccgctccccccaacccacctgaaatggagctccagccggcgtgtgcttgtaccctggacccccctcctcgtgcacacccctgtgcctcccccaaacctcaaaacctcccctttacgtagtttgccctctctccagtgccgtgtctcaggctgtcatgccatcgctgcttgcaaccctcccttccttcaatcatgcttggtaatatgcgcaagagcaacaacagcgggatgaggggtgaatgggtgtacgatgcgcatactgtcgatcaggccatgcactttggctcacagtgaggcagggtgaatggaagccgagagcggtctgctgctgggcatggcccacgggcatgctggctcatggccttggtgtcagtggtttaccgcctttggggtcagcggctcatcgcctggggatgcgcatctcatggcctagggtttcgcaggctccgctttcgccgccgcctcgacctttgccgcctcggccgccagcgccgccgcattgtccagctgcctccggcgcttgaccgcgcgcgcgcgcctgcagatgttctccacgatgatgcgccctgcgccggactggatctcccccggcgcggggcggtaggagaactggccgtacgcctcgcgcagcgcggcctgcttggcggccagcacctctggcggcagcgcgcgcagcgcggcctcgatccccgccacgctctccacctccagcacctgccccggccccagctccgcgtccatgtaccactcccgctcaagggtggggccgttgagcgccgtgcgcttggccgggtcggtgacgatccagggcaccgttcccttcacgtgcacgaacacgctgaaggcggcgtggtcgatggcgtcggccaggggtagggtgtgccagccggggccgacgtacacggggacgcagccggacaggatcacctccacctggcgccggctggtctgcgcgtcccccgccagcacggggcagaaggtggagcgcagcatgcgtctcagggtctcgtcgtggtcgagggcgccagggcagatgtcgcaggcgcaggacaggtccaggtccggcttgttcagggcggtcagggcctgcaccaccgcccgccgctggatcttgctgcgtggttgtgtgtgtgtggggagggggagcgtgtgaggtggctggcacgaggcatgggaaggggggttgaagtatggcaggcgcaccccggtgcaagagcagagcccagggggaagcgccgggggccaggggggaaaggggggcagtgcagtgtggactgccaggttggctggagatgctctgctgctgaggagggctgcgggcagggccattcatggccatgatcgtgccggggcagtcttcaactcgcagtgcctttgcaaacccctccaaaaaacaggagacagacacctcacagcccagggccacgcccaatgaaataatcccagccctccacgacaggaccctctgccctcacccccaaacgaatttctccgcgagggaggggtgcgagcacccgccgcggtagaagacaaagatgtcccgtttcgttttcaggacctccggcccctcgttgggaatggctgcgtggtggggtggggtgtccgagttgggcgcggcagcctggcggggcgtgcaggcccctgccggcccggaccgcagcagcctgcccagactgctgcggctgctggagagcagtctcccggcctcggccgtcaagcagctcccctgccggctgcagtacacccagccgcacctcgcactgtggtccctcccctcctggttaccgatgcatgccaccgccctccatctcacatgtcacaaaggggaggatgaggccctggtcgttgtgatgttgcaggcccttcttgcaaaaggacttgtgcgtggagaccagggagtagacggaggagctgcgcaagtttggggtggggggagatccttggcagggaggggaggcagtcatggctgcggcgggagtgcacggcagagctgtgaacaggtggctgggaggcatgggactgcacgggcccgagaggacccctgccggcccgagcgtcaggcgccccacggccaatagatcgccgtcccagctcaccacacccctcccctccgccaggcaccaggccccacccaccccgccccatgcccgcgcccgtcgcaggctcacttgcaggggcgcaggaggttgacggtggagttgggggtgccggggtaaaagggggtcaccacgatgtgcgcgccgttgtcggcgcgccactgcggccaggtgtgcaggtgctgcagcaccggctgcagctggaggtctgggatgggaatgatgctgcgcgtcctcctctccggcagtgtgttccacagccagcccaggcgccacgcctcgaagcagtgcgtgttcaggaagatctgagagtgtgagtgtgtgtggacgggggtgctgtgggcgtgggaaggggggagtgcgttggtgttcttgagggtctgctcgtgactccaggcagcaggggtggtggggaattcaggtagaggcagaaaggcgacgggcaggcagcatactcgggtctggcagccgacattcatgccgccatgcacacgtctgttagaggatccccggcgggccggcccacccttcctgcctgcccgacggccaggcagggtagccacaaaccggccgattacaaccataagcctctctgcctctggcaagcatgtgcatggtcccagccttcccacatcccttcttttatccttccctaacctcgcaccatgtcagcgccatgtcggtcgttggtctggtacccgctcattgcgatggcctgtgccacccagtagttgacggcgtgctgctgctcccagtgttgcagcggcccggaggcctgcagcttgttgtttggggcggcaaagggccagacggcggggtctgcaaagttgcaccggggcaggcccagatcctgcaccgggtccaggacgtagatggagcacgaggcatcggagtccggcgtgcctgtgatctgcgcttgagggctgggcgcgacgcgcggcagggccagatcctcgttgcaaaggagggccctcccgacccagaggaggaaggctggaggagatgacagggggatggggtgaggatgaggtggtggaggagagggcaatgagctggctagaaactgggtgcagttggtgggcaagctgtgacctgaaacaccgcagagccgcagccaaaggaaccaaatattcccagcacacccgaggcggccacacagacgagaacggttcggatcaacttggtggcgggggccatgtcaaggacaccgtgggcgaggggaggtatacggggtcagggctatcggacgtcgcgcttggagctgtgcacccttcaaaagcaatgcagatttaggaaacagccgtggaccacactggatgagggcctcaaggaggatgggtcctcggggctggctcccgagatccacaagcgaacttgtatcgccgagtgatccgcgatatcgctctcagcacagagattgatagagcatctttgagggtttccaacagccaactggacaaggaacgggtggttgtgcgcttagcgctggtagtagtgctgtattgcggtcaccggacagggcacgatgttgggggccccacccacgcgtcatcatcgctgcgcaggttaaccgaaattgcgggttttgaggaaaacggcgcgaaattttcgggaaaatcacattttcgagattcgactccgaaatttcgtgctgacattgcaggtgcccatggggctgggcccgcccagcgcagagtgaggatgacttgggcgggctaagtcagtgtgtacacaagcactcaagtaatctgaaaccaaccccaaagattggcaagcattgtgcaagtaccatgaagacatttcagaagcttgccgc

SEQ ID NO: 22300 - DNA, 73 bp, Chlorella protothecoides
ttgcatgccagccccggcagtccttaccattgaatactgatacccccccccaaaacacacacacacacacaca

SEQ ID NO: 22301 - DNA, 123 bp, Chlorella protothecoides
atgcatccaaacgctgtgctcccagcatttttgtaagacctgtaaccctagattgatgtcgacgagttgaatctcgtcctgatttcttctcctgttgacgagctgcccgggctgcaccaaaca

SEQ ID NO: 22302 - DNA, 73 bp, Chlorella protothecoides
gctgtggcctgcgctctggttccagcgcagaaggtacaccggtcccagcgcctggtaggtgggtgggggcagg

SEQ ID NO: 22303 - DNA, 61 bp, Chlorella protothecoides
ggcgccggagcctatgttgttcctgtccctaccccgcccgggggcgatgttgaatctatcc

SEQ ID NO: 22304 - DNA, 79 bp, Chlorella protothecoides
cccgaacttgaccccttcccacaactcttgcccttcgcgaatggtcattcctgcaggcagcagcaccgccccaggctcc

SEQ ID NO: 22305 - DNA, 98 bp, Chlorella protothecoides
ttccatcgcacacctcgcggtgggtaggctgaagaatgaagacttgcattcggcctgcattgcaattatgcgaagcccatgagcgaggaaaaggacac

SEQ ID NO: 22306 - DNA, 71 bp, Chlorella protothecoides
cagttccaggccatgcccctagagcatgtcacttgaataacacaagtagggcatgcaccgtctcgactgcg

SEQ ID NO: 22307 - DNA, 173 bp, Chlorella protothecoides
gcgttttgacagatctgggagcccaaattttgagcagctcggcatgccaatggtgatccttggcgtcgcacatgcatttcccaacatcacatggaaattgcctcatgtcacccatcacatgtaaaacaaatcagtagatggcataccagcttgaggtcgaatcaggtgggttg

SEQ ID NO: 22308 - DNA, 80 bp, Chlorella protothecoides
gatactcccatgctgtagcagcatgccatcaacgcgagtatagagagtggaagcctcatcagcacctcccatcagcgcgg

SEQ ID NO: 22309 - DNA, 72 bp, Chlorella protothecoides
gctccatcccagggtgccagcttcatctgatcgaggcattgcgtccattcatgagctacagtacccttgtcc

SEQ ID NO: 22310 - DNA, 69 bp, Chlorella protothecoides
gcgagggggcaggggctggggaacggcaggggcagggggctcgctgcaccacgtgttgtccccctagtc

SEQ ID NO: 22311 - DNA, 297 bp, Chlorella protothecoides
acacaagcggtgtccccttacgaatcgcatagatgactacctgcacggcggaagccgtaagtataggacctctatcatgcgcgagcatagcccttcctacaggtcccgaatccaaatcgagcccccatcggactcacttttgctgctctcagcagggcttgcgacattatgtggggtctcatccagaattcgaatcctggatggaagggtaaagtctcccatatgaaggagccctgtatttacaaccctcttcgtgcgggaattcatctatgcgactcgtgagaacgtcgcttgggt

SEQ ID NO: 22312 - DNA, 78 bp, Chlorella protothecoides
gcggcgtgcacgcgcttggcccaggcctcggcggggaacttggggtggggaggagagtgggattcggttgtggggggg

SEQ ID NO: 22313 - DNA, 61 bp, Chlorella protothecoides
gttgatgcggctcatgatgtcgtctatcttaaggtccttggttgagattcgcaccacctgc

SEQ ID NO: 22314 - DNA, 67 bp, Chlorella protothecoides
cttcatgcagggcacaacagaggggtcatatgctgcagcgtgctcctcaatatggatgggctgtggg

SEQ ID NO: 22315 - DNA, 61 bp, Chlorella protothecoides
acatgctgctcactcattcaccctgcatgtcgactcttgtctcgctatgtcttgagccaaa

SEQ ID NO: 22316 - DNA, 80 bp, Chlorella protothecoides
caatcggctgatcaggaaccgaatgacgaacccgatacaaattcatctcgctcacgttgcgagggcgatgatcttccccg

SEQ ID NO: 22317 - DNA, 61 bp, Chlorella protothecoides
caacctccgcacacctccctttcatctcacgactccaccaggcaaggagctggaggagcgg

SEQ ID NO: 22318 - DNA, 79 bp, Chlorella protothecoides
gccatattttgaggtcttttacgtgttcgaactttagagagctggtgtgaccatggtattttcgccacatgacatcccc

SEQ ID NO: 22319 - DNA, 141 bp, Chlorella protothecoides
ctcgaaaccgctcaccactacgcagaaccacgaatttttaatcacaagcagtacaagaggaaagccgtggggccttccattagggagtattcgggatccctgcttgttctgtggatccgcttgttacaatctgaaacatca

SEQ ID NO: 22320 - DNA, 138 bp, Chlorella protothecoides
acgaagccggcctcctgagagcgcccactgcgctcggagacggcaggtacgtgattggtgttggcatgtgtaagggggggaagggatcacttcaacaattcttaaatgggcaactgacagaataaaccactctgcatg

SEQ ID NO: 22321 - DNA, 66 bp, Chlorella protothecoides
tttgacggtcgcactcacaggcaggaagtcgttaccaccttctccagcgtggtcagatcggatcgt

SEQ ID NO: 22322 - DNA, 61 bp, Chlorella protothecoides
tgaactgtgttggggttggactgactgcggggtgtgttacttcggtcatgcaagaggttta

SEQ ID NO: 22323 - DNA, 78 bp, Chlorella protothecoides
ccatgcacagagcacatcggtggccgagggaagctgcgatgtgcccttgttttgggttttagtcggccgtggcgtgca

SEQ ID NO: 22324 - DNA, 150 bp, Chlorella protothecoides
tgtgatcatatttggtgtttgctcgctacacgaccacataatcctctcacactcaactcatcccccaggaggttgcaaaggcagttcacactgttgagaaggctatccctggaacgaaggagcacagggtgcgtttgaattgctagcaag

SEQ ID NO: 22325 - DNA, 62 bp, Chlorella protothecoides
aaaggtcgtggatggtcttcgacgagagaaattatgttcccaaggcgacgggtcgcgcacac

SEQ ID NO: 22326 - DNA, 67 bp, Chlorella protothecoides
gagccctgaggaggtgcccagccccagcccagaggactcaccctctccgagccccgaggagtctccc

SEQ ID NO: 22327 - DNA, 79 bp, Chlorella protothecoides
ttggcatctccggtccgtgactcgggagctgctcccccgatgcctcatcatgcaggcattgtcagcaagggctaccatg

SEQ ID NO: 22328 - DNA, 480 bp, Chlorella protothecoides
gccggcgccgggcagacccggagggcggcggccccgacggcggggcctggacgctggtgggcagcgacggagcgacgcaccgccacgcgcccgtggagctgggccccgagaccagcctgcgcgggacgctggtggtggagctgcacgccggccgcgcgctgctggccaccggcacggtccagctggcggagctgcaggacctggcggcgcggcaggacgtgtttgcccccgcccccgcccccggcggcgccggcttcctcaagtccctcttcccctgcctgcgccaccgcggcggcggccaggcctccatggcctgggtcaagctggtggacgaggcggggcgcaccgcgggccacgccgtgctctccccgcgtatcgtcacgcccgtggggccgcgcgggctggagggcccgatgggtccgccgcgcggcgccggggtcaagcccgcgccgcgccggcccgaggccggcgagggccccg

SEQ ID NO: 22329 - DNA, 118 bp, Chlorella protothecoides
gacttcggtggatcgtcttgtacttgaaggtccacagagctcttcggtcgtgactcgggtgacaacaaccatacgcgagtgaccgttaaaggcagcctctgctcagcatcttactcgc

SEQ ID NO: 22330 - DNA, 78 bp, Chlorella protothecoides
tagggatggaacagcattgatgtggacatgacaatccgtaggctggagaagctgagcattgctccatcgtcgacaagc

SEQ ID NO: 22331 - DNA, 973 bp, Chlorella protothecoides
cgggcgtgcctttttggccgggaacgctggcccccatcgccacggggatgggggcgccggcctcggcgccggcctcggctcagctgtcggcggggggcgttgggggtgggtcgccccaccacagcgtgcgctcgctgggcgatccgggccagctgcatggcctgccggggcggccgccctccttccccggcgtggcgccggcgccgggcgtcgcgtcaggcggcttgcccccctttgtgagcgcccatcctccggcggcgccctcctcccgcctgccgtcggtgggttccgtgaacgccagcgccgcgccgacggggacgaccacgggcacgtctgccacgagcgcgggcctgggctccatcccctcctggctcctgcacgctcagacggggacgatgaaggtggtggtgaccagcggcggcgcctttgcgcgcctcacctcggtcgagttcgactactccggcggcgagacgcggctggtcaccgtcccggtcggctgcgacctgtccacactgcgcgagaccctggcgcgcgtgacccgcacctcgggcgcctcggccgacaacggcgcggggcgcagcggcggcgaggccggcggcgccccgcaccgcgcccccgtgctcaagtacaagctgccgtcggacccctcggtctgggtggacatgctggacgacgaggacgtgcagatgatgttcgacgagtgggcggagttcacgggcgggcggcgcagcgcggcgcgcctgcacctctttttggagtggcagcgccgcggcacgggcgcctcggccggcgaggccggggtcacgctgtcgggctcgcgctcgctgcgcgtgtcggcgggcctgggccgcgtggagacggtgcgcgaggtggacgaggacgcgagctccgggtccatggcggccgaggcgctggcggtgcaggccgccatcgacagcgaggagggcgcggtggcggcggcggcggccgcgcg

SEQ ID NO: 22332 - DNA, 61 bp, Chlorella protothecoides
gactgaaggagtcaggatccctgtactccgtccaagcctcctccaccccatcttcctcatg

SEQ ID NO: 22333 - DNA, 113 bp, Chlorella protothecoides
gagtgaaagttggaggttgtcttcaaggtgcaagagtctcctagagcagacactctgctcctctgtcgtccaacgctggacctccaaccctcacccacccaccccttcctcca

SEQ ID NO: 22334 - DNA, 135 bp, Chlorella protothecoides
catgtgccggacctggaagtctacgcagaactgaagagcggaacactggccatgtctgtgcagaggatggcaggccgatctgtgccgaaggggggcctcgtgatggacctccctgcatagtttctgtttcattct

SEQ ID NO: 22335 - DNA, 80 bp, Chlorella protothecoides
caacgcccagatcgagatattctccgcggtgcggtccagtcaaggtttcaagtggtggggccaatggcactcagggagct

SEQ ID NO: 22336 - DNA, 384 bp, Chlorella protothecoides
caccatcaccatcacccagtggcagcaccagccccccagcatattccagccccccagcagggttacaaggccccagtcattgcatcttcgcctcccacgcgacccggcaagtggtgaagggaatcatattgacaccttgaacaactatgcttgtgtagtagcaagtattatgcatgggcgctgtttggctgatcactttgtcagagctccttgcactttgtgatttcaaacaagcagttgcaacagtgcattcccccactgtgtgctgtgagttccttgtcccttgacttcttgattccatcccgcttggtatgttgggcatccctgccatgtaaagcatagcatatcccgtggacttgatggctcaatcgttttactggaagg

SEQ ID NO: 22337 - DNA, 159 bp, Chlorella protothecoides
gggttggctggttgctctgtggctaggtctaaagtggtgagggagacgctctgggcatagcatgcagcaccgcaccgcagtgccaagcttgataccgggtctacagagggcggcatattgcttaacgaggccagtgacgtaggcctggcatgctcttga

SEQ ID NO: 22338 - DNA, 78 bp, Chlorella protothecoides
cagctatgtgtcctgccgtggcccctatcccttttctcggcacggagcctttctctgaccccagcaccatgccgcgac

SEQ ID NO: 22339 - DNA, 103 bp, Chlorella protothecoides
ccgtgtggcctgcttgcacagggcatgcttgccatggcaggagcaattcgaaccctcgggcatccctgcacactgcagtgggagcctaagctggctggctaca

SEQ ID NO: 22340 - DNA, 62 bp, Chlorella protothecoides
ctcacggccgctgctgcccctggattatgaagtatcgttcatacaatggtgccacctctgca

SEQ ID NO: 22341 - DNA, 74 bp, Chlorella protothecoides
ccggccccggatggtgagtatctcagaggaggggataaagtcacttctagcagggttcttgggatccacagcct

SEQ ID NO: 22342 - DNA, 87 bp, Chlorella protothecoides
aggaggatggttttgctgggcatactagtaagggggcgatctgctgcattatgcatacgttcatggcaggttctagggtctggctgc

SEQ ID NO: 22343 - DNA, 61 bp, Chlorella protothecoides
cacagccctcttcgtgccgcgcgattccccactccatccctccccacctccacacaacaca

SEQ ID NO: 22344 - DNA, 62 bp, Chlorella protothecoides
ttctagcagggttcttgggatccacagcctggaactggtagcattttctgctctgggcaaag

SEQ ID NO: 22345 - DNA, 61 bp, Chlorella protothecoides
tagctttaggctggtgggtcatttccgcaggaacctgtcttggtagcctggatggtcaagc

SEQ ID NO: 22346 - DNA, 71 bp, Chlorella protothecoides
aacctgtcttggtagcctggatggtcaagcctgcatgcatctggctgtccaaacagggcataccggctccc

SEQ ID NO: 22347 - DNA, 61 bp, Chlorella protothecoides
gagggcaggggcaaggtggggcatggcgggggggggagcgcagggcccggcaagtacagag

SEQ ID NO: 22348 - DNA, 110 bp, Chlorella protothecoides
ccaaggccggcaccagcaggaggcgcggcagggagccggtgccagtggcagacccatcacttgggatcacccccgaccaggtcacaacatccaaggagcctgacactgaa

SEQ ID NO: 22349 - DNA, 62 bp, Chlorella protothecoides
gccctacaggaccgcgccgccggcggcgcacgccgttcgggcgcaagtggaggagatgacgc

SEQ ID NO: 22350 - DNA, 70 bp, Chlorella protothecoides
gatcccaagccatcagccctgcctgaaccttggagggtatacccattcctgtcatgttacagtgacctgc

SEQ ID NO: 22351 - DNA, 61 bp, Chlorella protothecoides
gtttacctcatcacgatcatgatcaccgacgtgcttgctctgatacagacttgcactcaca

SEQ ID NO: 22352 - DNA, 248 bp, Chlorella protothecoides
cgtgcttgggacgagctcagcatgactccatgaccactccagccagaccagcacttcccggtgccagctataatttacagtttacgcgcatgccatcataccttcacgagggacacaagtagctctcatacgggtgcatttgggtgttggagaaggcggctattgggcaggagagtgaggtggtttcatgcatcccatggctcgcaccacatgccagacctccgagtgttcattcaggcgctcacagg

SEQ ID NO: 22353 - DNA, 174 bp, Chlorella protothecoides
accaagccgtgtatcgccaggtgacgagaggggtggaggcttgggtacgcaaagcagagaggatgcttcagaccggttctgcctgacaaacggagctaccctttctttgtgcagatggtgatgaagacctacaatgctgccaagacgtcctgaggctcctgtctgacgcgattt

SEQ ID NO: 22354 - DNA, 71 bp, Chlorella protothecoides
agttcagggccatgcccagtccttggcaaacctccccccctccctgagaaacagcaagataaggactcaca

SEQ ID NO: 22355 - DNA, 64 bp, Chlorella protothecoides
catccccctccatgtccagggacgaatgggtgagggtcatggcgctggccgtcgggccatacga

SEQ ID NO: 22356 - DNA, 62 bp, Chlorella protothecoides
ggggggggggggggggggggggggagggtgctgcacattgtggcacacgcctgacagggagc

SEQ ID NO: 22357 - DNA, 127 bp, Chlorella protothecoides
cgctggccgtgctcgacgtcggctcggaggtgtgcgggcgcggaccgtgcgcgccgcctgccgatccagcgtcgccgccctctctggctacctcccgcctgggcccctcgctccactccctcgccgt

SEQ ID NO: 22358 - DNA, 118 bp, Chlorella protothecoides
ataattccattcgctggcaccaggaactgtagattaaaatgtgccaagagcactggtggcattgagaactgtatatatgaattgagagtgcatcctcattgttttgttgctgctgtca

SEQ ID NO: 22359 - DNA, 16684 bp, Chlorella protothecoides
  modified_base (585)..(594): a, c, t, g, unknown or other
  modified_base (1967)..(1976): a, c, t, g, unknown or other
  modified_base (3189)..(3198): a, c, t, g, unknown or other
  modified_base (5326)..(5335): a, c, t, g, unknown or other
  modified_base (7084)..(7093): a, c, t, g, unknown or other
  modified_base (7769)..(7778): a, c, t, g, unknown or other
  modified_base (8700)..(8709): a, c, t, g, unknown or other
  modified_base (9191)..(9259): a, c, t, g, unknown or other
  modified_base (9526)..(9535): a, c, t, g, unknown or other
  modified_base (11609)..(11719): a, c, t, g, unknown or other
  modified_base (13123)..(13132): a, c, t, g, unknown or other
  modified_base (13471)..(13480): a, c, t, g, unknown or other
  modified_base (15449)..(15458): a, c, t, g, unknown or other
  modified_base (16010)..(16019): a, c, t, g, unknown or other
  modified_base (16114)..(16123): a, c, t, g, unknown or other
ccggcgcggcgcccgcgcagccccagccgccgccgccgccgggcacgccgtcgggtggcacgccccaggagctgcaccgcgtccccgcctgtgcggcctggttccgctggggcgcggtgcacgcgctggagcgcgccgagttccccgacctgctgggcgccggcgcgccgcccggcgcgggcgaggcctaccttgcgcaccgggacgccatggtgtcgcggtaccgcgaggacccgtcccgcgagctgtccttcaccgaggcgcggcgctggctggcgggggacgtgggcacgctgcgccgcctgcacgccttcctgcagtcgtggggcatcatcaatgcgcacgcccgcgtgcgtgcgcgccgcggccgcgaacccgcgccggggccggactccgtgctgcgcctggcgcccttggtcggggcggcagagggcgtggaggcggcgctgacggggccggtggcggggcgggtcgcgcccctcgccggccacgccaatggcgccctgcagcctgccatcgccacgggggtgcggggtggcttttgtgaaggggaggggggggtgggcgaatggttgcagacccctnnnnnnnnnnggccatcgccacgggggtgagggggtggctttcgtgaaggggagggggggtgggcgaatggttgcagacccctcaatcccttgggcgcgtgtgagatagggagatgagaggaggcaggggcgcagacggagggcgggcgcctggctgtggccatggtaaccatggcgatggtcggatgtgagctgaatccccccagcagtcgctgagacgtgccctgcctctcctcgggatcccacgcgagcccgcgccttggttccccacgccctgcccgtgctctatccccccatgcccacgcccgacccctccaccctgcacatcacccacaggcgcagtactattgcaatgccatgccctgggtcaactgcaccagcctgcggtaccactgcaccaaggtcccggacgtggacctgtgcccattggcgtacgcaggtgaatggttcaggatccctgaaattttatttttttttggggggggtagcgcttgatgtcctcggcacccacagacgtcctgctgtggccatgtcctttcgggcccgtgcacggcgagcccagggggggcgagcttcttggttgcaggtgccctcaggtgcttccccccccctcaaccaaaccacacccctttgcaaaagcagaggggcgatttcctcccggctgcacggccaaggactttgtgcgtttggaggaggacgctgcgcccccagacccctccggctggaccaatgaggagcagctcctgctcctccaaggtacgctgctgctcaggctgacagagcagttgtctgccaccggctgatgccttgctcaccatccctcaagacctttccttgcgtctgtgttttgccggccccgccaaaggcgcgccttgccgcgcagcttgcggatgaattcccgacatgcgccccagcggtccttcctaccacggccgtcctgccaccccgctgcagctgtcgagcgccacggggaggactgggccgccatcgccgaggcggtgggcaccaagaacgcgatgcagtgctgcacgcgcttcctccagatgcccatcgaggaggccatcgtggcggaggcggtggcctccgacggccgccagggctgggtgcgtggtggatggggggacagggttctggggcgagggcgggtgggtgtgagatgggcatgacgcgtgcatcgagcggtggggtgggaggcttgcggtgcatgatgttgtggagatgcggtggtcgatgcgacggatggagtgaggagggctggggcagcgcgggcctccacatcgcgagcctgtcgccggtgtgtgctgttgggctggcctcggaatctccactcccacacagccatgccctgcctgttcccatccaggtgacgatcccggagcccgnnnnnnnnnngcacatcgcaagtctgtcgccggtgtgtgctgttgggctgacctcggaatctccactcccacccagccatcccctgcccattcccatccaggtgacgatcccggagcccggcgaggaggacggggcggaccccggcgcgggcgcgctgctgccctttgccgacgccggcaacccggtcatggctcaggtggctttcctggccaccatggtggggcccagggtcgcggcagccgccgcccaacgcgcgctggaggtgctgggcgaggaggatgcggcgctgggggaggcggagcgagaggaggacggcgcgggggagtggccgaagcgggaggatgaggggaaggagggcgcggaggagccgattgccggcgagggccccatgaaggcggaggaggggtcagagacgcgggacggcatggggttgggggttggtgaatcgtcgccggcaccatctgtggcaggggacgcgccgatctccgcgccgcggctgagggcggccgcggccaccgcactggcggccgcggcggccaaggccaagctgctggcggacgcggaggagcgggagttgcagcgcctggtgctggcggcggtggacgcgcagtacaagaagatcaagatcaagctccaggcgagagaggggttgtcggaggcatgaggcttgtgattgcttgttgagggatggggtgcactgggactggatcccggtcggcaaagtgttacaggaaggggcaagcggcagtgcgacttgattgttccgaccgccacacagcaccccacagacgcgagcatcaacatactacttgaatgtttcccatcctgcgcagcatctggagaagctggacgagctcatggcgctggagcgcggccagctggagcatctgcgctccagcttcctgacctcgcacctcaccacgtctgctgctgcttctgtgcccgcgccggcccccggggcggcagaggttgccgcgccggccccggaggctccagcgcaagccgccgcctgagtgtggggactctgagcgccgaggccacagccttgaatgccttggcatggcgatcaatccgaggttaggctgacccttggctaagaggcgtggcagacagcccgccagggccgcaggtcagcacgccatgccaggcggcagcaactggaggccctgccctggcccacatgtggaccacctgctgccgccccgcgtctgcacgtttgaannnnnnnnnntggccccgccctggcacgcatgtggaccagctgctgccgccccgcgtctgcacgtttgaagaggtcccagcaaggttgagcatgcgtgagtgggccggtcaatgtcccaggcatgcagacgctgcaggcccagacccctgtgagcttcctcaccagggtcaggggtcaggaggatggtcagggggaaggcatgctccaggatctgcagtgcccggtcgcctggcccgcccacggcggccgtgcaggcgaccacggcatggggcccggccttgctggcaaggaacgcctgcgccggggagtagggtgattcttggtcaccatgagcaggaggaggcctggctcgggggtcgtgcccagtgctctcttcatacgtagtgccaggcaagagcgctcaccgcggcttcgacgaggctggcgctcagtctgcacagcaggcgctcccagctgcccgagtttaccgatgccgggccggtgggtaggaggccatccaccaggagcacgtccggcagagacgggaggaggtggagacccgccaggaacctgaccagctcatcgcctagggtgggagagaatcgatgagagccaccgctgggttcccagctctagaaagtggcatctcaaggccgatagagggttgtctattgcttggcggtgagcaatgcctcatgctccaaaggaagattggcaggcatggcaaggcactcaccgtgcccggctacagcccacggtaacgcttgcgccatcctataatatccaatacctgattccaagtacttcagggagatgcgggaccatgcagggtccgccttctggctcttgcatgccagcaaggggggcttgagctcgagagcgtgcctgttgttttattgaagactggtttgctgggggtaaaagtacgtacacatgtgatgcatcacatccagttccacagctgcaaacaccaaaaacacacttgttgcacagaaggaggacgttgcgatcattctgtgccgcgcgcaaggcgtactggaacagaacgctcgtctttgcgctgcccgagggtccggcgatgaggcaggacgagtggcaaacctccacccctccccgcgacggctccggcgatggcggcaaagtgggagctaagaagtcatgcaaattgatgggcatggccgcaaacctgctgcagtcatctggatcgcgcaggcggaacgggcaggctaaaaggcgaagatcagtattggatcccaaaattattcaattttgacacgctttctgcaaggtgctcaacggtgcctttaaagaaacgaagaaacgccatctactgggggaacccgcacaggttcgaatcctgtcggccgcgatctcgatctgcggctgtggccgagcggttaaggcggtagactagaatttcttaccttttggtggtttgggatggggaggctggcgctaggaaggtcattcaagcgttcctggacagctatgaagggcagctattgctaagaaacgacctttccagccctgactaagaaccaaatcgagcctaacagttctctcaagccgcaccttttgggcgatagtgcattcaccgagtcaaagtggacaagaatgtgctccagcggtacttcgcatgactttggagtacccaggtgacctccatcgaccaatgatcatccccctggctgggcccatcaatgtacctcttcttcttccggcaggtgctgcaaatgtatcgaggaatgtgcatctcaccatcatgcttgatttcctctcgctgtacgtttataggtagtcatctaatggggcacatggaatgattgagagtgcaggttccaccctgcctttttgttcattcaacattgtgaaatcgtatgttggcgatctttagtagaacaagtgcatcagccagtgtgaggcacttttgtaggggagctttgtgggtgttgaacgccagtctcgtggacgcctttggcttctgagcaacaagccagagtcttgccttgctcaggaagacatgtctcaggaaacagcagtctccggctcacattagagcaaggacttgggattgttgatgcctgatgcatcggttgaatgacatactttggtctgaagtagaccatactgggtgtgctgctgctgtgcatgagcagtnnnnnnnnnnaagcaaggacttgggatttttgatgcctgattcatcggttgaatgacataccttggtctgaagtagaccatgctgggtgtgctgctgctgtgcatgagcagtgttccgtcactagaagagagcgatcctccgggatccaggcgctcctcacgacgacctgttcctacacatcgccaagcatcttccggaagagtaaggcaaatcccaagaaattggagtcgcttgataccgtttgaaggccatcccagttgccctgacaatcgtctacgatcgcctgtgtgtccctctggcaccagcctctggcagcgagatagggagcaagcaccgcctcctggctcgccgactccctccgaacgccccgtgtagggcccagacctgttcagtcgcgacatactggatctgaatggtgcgtcggctaatgcaattgccgtgcctctcctgctccgctctccggctgaccccttcgccgagtttgtgatcctctcgtcccctcacagggccagatcttcaagcagtacctctccggcgagaaaatatactcgtgtagtaactgtcggtcccatgtggccgaccaccagaacatgatcagcaaggccttccagggagtgcatgggcgcgcctacctctttagcgacgtgtgagttactgattgcacagtcttgcgcacatgggcacataccgccgtcaccgttatccgcctgaagcgttcaccctggtcttgcatcgcagggtgaatgtgacgctgggaccccgcgaagaccggcagttcatcaccgggctccacaccgtggctgacatccagtgcacctcctgccacaccgtcctgggatggaagtatgtgagtcttgcagagtgggaaggatgcgtagctgaggcagggagtggtgcatggggcccggcatgatgatgcaggaggggcattgacaagtctggcatggagaaggctggtatgggcagactgccaagtccagggcatgctggagggattcttccattttgcaccaacttcactccctcgccaccatccacctgcttgccaggaggtttcctttgaggagtcccagaagtacaaggagggcaagttcattgtggagaagcagcaagtaatgaaggtatgtgcgcgtgactcatgttccagtgatgacatattctgttctgcaggcaatcgatgctgtacggcctgctgagggcaagtgccagagcatacagaaccttcccccactcctgtccattctgcaggagggagcctggtagcacattcgtaccgcctgggaactgcccatctgcatggctgcggtctcgcctggcacccaatgcagcgtgcacatggcactgcaggatctagccatgcaaaccccgaaccgaaaacccttgctcgtgcctggcccctgggaagcagcaattccttgctttgcgcactggatcaccgctgccttaccctaggccttatatcactgacccccctgtatgctggtgcgccgcccactatcaggctgcttctctgttgtgtggctgtactctattcaaaggaggcatgcgagggtggcgtctcagaagccacatcctcctggtcctctgacccctggggctcccattccttgtaacaatctcatgtaggatgacatggaggcacaccaagcgtgcgatccgaagcgctcagtcatggtctgagggagatcgggatgcccagcctcggattcgctgccacaaattcttgacagcactccaaaaggacattggcactcctgnnnnnnnnnnaatttgctgccacaaactcttggcagcactccaaaaggacattggcactcctggagatggctcgatctcactccctttggatgactgcacttctcctggagaagggctggctcccatggctgatggagagcctgcactacctcctctactagcccccaccgacagaggcccaggggccggcatgctttcaggtgccaacaagctgctgggcccaacgccttgtacagggggccatggggaggagggcttcgctcttcatcaaaggctattgcaagacaggaggaaggcgagcaggcggcacaccaatccccaacacctcgcatacctgtttgtcggaagatacgctctcgcagctgcgccatcgtcagctgtgtctccagttcttgcaacctctgcccaagggcctgctcctgttgcacgccgcttgcctgagttcggtcagtcaggggtcgacgttggatcaaaaacgatcaccgcgcagtccagagaaagccgggtgcacactcggggcctgtgcccaatcaccaagcattgcaaggcaagttcaggaaagcaagacacactcacggggctagttggcatgtcaggcctaggctgcgcagctccagcagcatgtcggtcctcccgtgctggccttttctgcaatataatgggcagtgtgcgaggttggcatcgnnnnnnnnnntgtcctcctgtgccggccttttctgcagtataatgggcagtgtgcgaggttggcatcggcactgcgaccatgggaatctgtgcatgcctcccacgccgccctcagtgccatccaacgggactcacatatgtgagggtggccccgaaaaccttctccatgtcctttcgtgcccaatatgcgattccagccaccactgtatagggttgagagttggtgatcatggcattggaaagtggctcggtctggcatgcctcaggggcagggtgaccaggctcgcctgccgcagggaggaggccgatcagcagctgccaggcgtgccagtcccacctgtacggggatttgatgagacgtacatcagggtgattcctgccaggggtgccctgaaacagtcagagagaacattcgaggcgacaaacgcaaagagaacacattcccttctgagtacctgccgatgaccgtgcggtgaacctccttctccgcaaagaggatgtctgcacttttccagcctccgtatttttcctctgtgtcgttgagttattgctgtcaagaattactgcaaaggttgcttcggcatcgctctccttcccggcactgctttataaagcaacctccactacactcaccatcgtatcgcctcacagcatccgaggtgtaccatctcgtcttaagacttgatgtgcaggcatctttgagtctgagccctgctacacgtgcgggagtgctcatcgtgaagcttaagaggagcagaaaacctgcatgcaactccagtgcttttgcgattcccagtcacggctatactctaaagttgagcgcttttatcctgcgtgctgtgcgcaaacagactcaatcaaacaacactggcgttccgagcctgaaacgcaagaatagtataccgaccgtcccgacactgcgcgcgctgagnnnnnnnnnngttcctgagtgctgtgcgcaaacagactatatcaaacaacactggcgttcggagcctgaaacgcaagaataatacaccgaccgtcccgacactgcgcgcgctgagagcagcaagcacgtgcggataaactccaagatctcaaccacggcatccgtcggacgcgcgtatcatttccagcatgggcaagcctcagatgccggcttactcgccagctcaacactcaaagagcagaatttgccatattgcgcgctccatggtgaccatgaatgcatgcagggctggcttgggcgcctccagggtgaacaccctgaggcagtctcggccgtgtcaggggatcgcgccttccgcccgccgcctgcggcacgtgtgcagagcaggaggacgagatgtggtggtattgggttcccgtggcaagattgctgcgcgcatcgtgcagcagctgctcagccaaggctatggggtgacggcaggtgggctggagnnnnnnnnnnnnnnnnnnnnnnnnnnnnnnnnnnnnnnnnnnnnnnnnnnnnnnnnnnnnnnnnnnnnnccggtcttccgtggccacagacagcaagatcctcctgtcctcatcctccagatgcggatgagggccggtcccaggacctgttggaattcgcctccaagtttgggctgctctccgcctcagagcgcaaggccctcaagctcgtggactttgacgccacggatgtggacagcgtcggccaggccctcgggggcaggtagggatacttatctggtgttgatgcacaatgtgagttcccggccatgctcagcatcgcatggcacccaatcnnnnnnnnnntggccctcgggggcaggtagggaggttatctggtgttgatgcacagtgtgagttcccagccatgctcagcatcgcatggcacccaatcgcatggccctggcaatcttcacgacccaatcctcgcccgccaccaccccctccgcgcaggggcagccagcgcgtggtactggtggccggcgactctgtgggcagcatgcgcatcgaggactcggtggccagcgcggccatcgacgccgtgctttcctccagcgcccgcgtgtcccagttcgtgctggtctcgcagctggccggcggcggcggcggcgggtggttcgggctgggcggcgggtcgcggggcgccaagctctcgtccctggagcaggccgtggtcgacagcgccgactccgcgctcctcctgcgcactggcaagtggagcgaggacggggggaactctgtgccgctggccacggggcgcggcggcctgccgcgcggcgcctccgtccctgtgggcatcgtggcgcagggggtggtggagagcctgggcctgaccagcggcgacggcgtggtggaggttggggccggcggcagcgaggaggaaggttctctcagggaccagattcagagggtgagggtggctggaggaggggtggggatgggagtctgggaattagatgtccaggaagccggagcagcaatccctgtcgtgagcagccggcatacttcgcacaagctgcaaccaacggcgctctggcgcgctgtctgtgcaggtgctcagcacatcgggggcagctgtgcccaagtcacgtgcctctaccgccaccagttctggtgagttggcagggccgcgtcttcagggtttcactacctgcggccgggtcctgcatctactgggttcttgcgagagctccaagcctgcttggccctctcatcatccctctttcccacccaaatcctgacccgtcgatcagaggaggagcaggggacgaagcagaagggactggggtggagcctgggaggcaagacggtgtcttctcgaggggagccggcgccctctgggaagcggtccagcaccgtctcagtgagggcaggtcgcggcgggacccagtccagcaaaggtcaggagtgggagtggttgcttgtgcgagggttgtgcgttcaatcaggggcccagcgaaatgagtttaccttgctgtgcctgggatgttgtggccgttgcctgccggcgcctgtgccaactccccaccaaaccgctgcacagggactggcaccgtgaagcaggagggatcaggggcgaggggctggttcaagaaggcggctgccagtgcgacggggccgagcggggcgcctgcctctggttcctctcgcgcagaggccaagaagctggtgaagaagctggcagacccaggtgtgggtagggagggttacctttggctcattggagtgaagtacatctgggatttgtgcgctaaactccttgtctggcctggtcatttctttaaattccgacaccatccaaaagtgactcgcaattcgtcccacatgctcgacgtagcgcagccgcgttcacctcctccacccctcccacgccggacaacatgcagaggaggagcaggtcaagggcgagggtggccctctctggggctttgggaggaaacggcagccaaaggtggtggacgcggggggactgggtccgggcgctcggcgggggaggcctgacgcgggcgggcgggcggctgccaaacccgaggcggaaccgtcccagggtggtttcctggatttcttcagcaagaagggctgagacgaatccgtgggaaggccgttcagaatggtggctcgggcccccctggggtgttgaactggcctccagatgagccgtcttggatgtcggggggtcccagcaccagttcattgaagcccagcatgtatggaatcatgaactgcgacgcgtcggtagcaaggattgggcgagcttctctcctcaatgtaacacaccagtcccaaggtgtcgacccgatgcaagcctatcacggagggttccctgccgtcctgtgccgacacagtccatgaacctggccagacccaccagacagccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgactcggagctctgcgctgctgaggggcagatcaaagcgcgcctgctgcccctggttcttcacgctgagagacatgaagtagctgttgttctgacccggggacaatcgcagggtcttgacaatctgtccctcgttcctgcaagggcggtagcgaggacaggtgtcgcagcatagcccagggctgcgatgcacgcagcacaaccctggtcgcgcaagcaagggccggcagctattcctccaacgcctccttccagctttccacgtcgctacacaactcacgccgacatcttgtttgggtcatggaagaaagaggcctccttgcccgcctctacgctctccaggatgcctgcgcactcgactgcactcaaggcaaagttctgcggagtgtaggtgtcgtcagcttagtcagagccaggctcttcgacaccaccttggatggagaaggaggcccctttgagtctcgagtcccatcagtcccctcacctccttcttctcccagtcgtagtcgcgctcgccgcgggcgttggcaaactcaaaaaggagggtgccgtccctggtgacggtgatcccactccccgtgccagtcctgccccaggtcggcttgatcactttcacgctaaatgctgccttgctcttgtaaacggtgtagttagtgaatatgatgaccttgcgcgggtcgggggcgtcgttggtaggccgggacacgaagggacgactgccgctgggagggctgtacgcagcggactgataggccgcggcgccggcctggcggaaccccgaggcctgacatgtggtctggaatgcatggcgaaatcttgtgcccgcagagcttcgagctgcagccagggcagaagagatcatggcggggcccctgcacgccactccttgggattgcagcgtgagtaggcgtacgctcgtcataaccctgtgccaaggaagatcacgagaccatccgcagcttgtcggggcggtgtatattcattttgctgatcatattggtttccctgctgtgcgtgccatgcttgcacaagttgtcacgacagctgaccgacaattcagtggctcgtcgtccctttcccctatcggccacagaatgggagtcgattgcaagcctggctcggagcacggaaaggttcgtgggggccttcagggcacctcactcaaaccaacgcttcagtcccagcttcgtcgcctcgcctgcacccttgcccttgggcttgccaaagagcttgccccggaactctgacaccagactgtccagcttcttctccgcagacatgccactcttgctcgccctgcgcgacgtggctgctcctgcctctgcgcgagggaggaaagaaaatccgacggcgatgagtcactcgcatgcactcggcaggcagtggctgggcaggttggcannnnnnnnnncggaggaaagaaaaaccgacggcgatgagttactcacgtgcgctcggcaggcagtggctgggcaggttggcatgccatccaatggaccccaccagccagacccactctcctctgtgtccctcagtcctgaacaaagctcccaaacatcagacttactggttcccatgacagtcttggcggcaacgaccgccttctgcttcattgggttggccctggccttgaggtccgcccctgctgcctttggcccacggtcggcagccctcgcaccggcctcccctccaacccagtgccccgctttcctcgcggtttggcccttccccgccgtgaccacgccgttgnnnnnnnnnnatccgcccctgctgcctttggcccatggccggcagccctcgcaccggcctcccctccgacccagtgccccgctttcctcgcggtctggcccttccccgccgtgaccacgccgttgctcggcgacgcggcccggcgcggcctgggctccgtccacgcctcgtcctcgcgcccatgccgtcctttcttcgcaccagcgccgggcgccgcatcctcctcgtgctcgccacccccctgcttcccggccttgcgctgtcgcagcagccgccgccgctgggaacgcagcaccgccttgcgctgcggctggacggcggcctccgggcccggctctggcgccgccaccgccgccgcccgcgctgccggggccgacggggcagctgcgcccgcgcccttcttcctttcccttggtgccgcgactgacgccgcgattggcgccggctggggcctctcggctggcgctctggtcttgcgcttccccttctcagccagctcgaccttctcgtgctggtcggggtcctgcttcgcgagggcggccgccgcccgccgctcccgcgccaccatgttgcgctccttcctcagctggcgccggctcttcggctcggcctccggggcgggcgccgccacgtcctcgcgggcggctccagggcccgcagcctccccggcgactggcccatcagcttgtggtccccccgccgctttggctgtctgggcctgggtggcacggtgctcgcgcgccttcaacgccttgacattgtcgatggcaaattccacgatgggccgacggtcctgcacgtgtggagttatagttgatgcgctcggcttgctcatgggacgggttaccacctcctggattttcgcgcacaccagccctccagtccctagacgacctgccagccgagtccctccacccctgcttttcaacagacccccatgcacataccttgtggaaggcggtggggttgttgttgagctggcgcaacgcgcacagcgcgtgctcgtgctccgtgaactccacgaacccaaagcccttggaccggggctcgccgtcggggccggggcgctccgcatccttcagtatcttgacctgcttcaccacggggacagccttggacgccctttctttcaccgccgccacaaacacgtcccgcagcttggcctcgttccaggccagcggaatgttgcgcacgctgagtcgggtgctggacacgacgaagttggggctcgccagcttagccttgcgctccactgtgcagcgtgggagaggggtttcgaggggagggagcccattggcgtgtgaaagatcagtccgccgtgctggtttctgccgggtgtcttactatgggaggagctgcgacggccatagggcacccccccacaccacgcatcacaccatctctcgccgtcccttcacctttaccaagcaagccaccgccccgctcccacctgctgcacgcttgcgcttggcctggtccccctccggcatgttctcccaggcgacgctgccctccgagatgatgccctccttggtgaggtacaggttgcgcttgtcccgcgcccgccagtcgtcctggctcttggccgaggcgtggcgcgcagcctgggcgtccagggccatgtcgatctccacggtgcgccctgccacgaccacagcagggcccttggactccctgcggggtgggcccagccggggtgttggtgggtgctgctgaggggggcgtgggagcccgtctgccccgggcagaacgtgcaggttgccgcatctttgggattacgacatggagtcaactgctttgggtccgcatgcctctgtctctggcaccgcacagcagcaatctgaccctccttccactccacaaggtcacagtgtccctcccaatgcacattactacaccccaaatctctctgaacagacctggcgtccgaagccgccgcagccgccgcctgtgcgccctcctccgtggcaaactccacnnnnnnnnnnagtccctcccaatgtataccactacaccccaaatctctgcaagcagacctggcgtccgcagccgccgcagccgccgtctgtgcgccctcctccgtggcaaactccacaaaggcggtgcctttggccttgcccgtgtcgcggtccatgaccaggcggcaggccttgagccggccaaacagctgcagcttggtccacacctgctccttgctggcgtccagcggcagcccacgcacaaacacggtgcggactagcgcggccgaggccccccgcgccgcggcctcgtccccggcgtccttgctcgatgatgatgccgcctcgccggcggccgcgcgctgcagcaggcctgcggcagagcgcagcggcgccgccgggcggctctgggccgccgcggccgccagcgaggccttgctgaagatgtcgtcggtggcggggcggggcgggcgggtaggatctggctttgccggctccgcctcgtcttcttctgctgtaggtccagaggtatcggtggccggggcggcggttgtcggcggcgctttaccatccttggtgccnnnnnnnnnntaccgtgaccgagggggccctgcgcgaggctttcgcccccgccggctttgtgtgggaggtgtctgtgccgcgctccgcgggcggccgtgcgcgcnnnnnnnnnntgctgctggtgttcaaggcggtgaaggccgccacgcaggccgtggcggcgctgcacgggcggcggctgggcggcggcgacggaggcgccggctcggcgcccgacgcccgcgcgctctgggcgcgccaggtgtcgggcgacggcctccacctaaagcgctggcgcgtggtggtccgcaacctgcccttcaccgtgaccgagggggcactgcgcgaggctttctcccccgccggcttcgtgtgggaggtgtcggtgccgcgctccgcgggcggccgtgcgcgcggctttgccttcgtcggcttccagtgccacatcgacgcagagcgcgccatccgcactgtcaacggcaccgccgtggccgggcgcaccgtggcggtggactgggcgctgagcaaggcccagttccagggcgaggccgaggcggccgccgccaaggcccaggcgcacgtcataggtccggcagttggagagtttctgctttgggggggggtcccgggaaggggagggggaggggaaagttgcaagtggttgcttgtgcactgtatcatcttgttcagagatg

SEQ ID NO: 22360 - DNA, 102 bp, Chlorella protothecoides
cctctgactccaagtgacgcagtgcccgttgtacaaatgagatgcatatacaggagacacggagattgggatggacagacgtaggaagactggtcacggcgg

SEQ ID NO: 22361 - DNA, 132 bp, Chlorella protothecoides
gcatgccccagacatctttggcgaggtgtggttccagcaggaggggtgcttgggatgcgggcttgcagcatgcccgcatcccattctcgtcgtcgactgagaaagtgctgtcgtcgtcgtcgaggcccaaat

SEQ ID NO: 22362 - DNA, 129 bp, Chlorella protothecoides
tctgggccacacgtgtgtcatgaacaaagccctgcaacagctcccatccatgctcaggaccctaccaccccccaaaaaacaacaagactcaatcctgcaccaacctccttacagaacctgggcgaggcc

SEQ ID NO: 22363 - DNA, 79 bp, Chlorella protothecoides
atggtcgccctgcaccgcctcacggtgcgcccccgggtgtttcccgcacgctggggctcggggcgagcgcccgggcagg

SEQ ID NO: 22364 - DNA, 242 bp, Chlorella protothecoides
gaatgaaggccgccggagtggcacatgaatgtaggaggagatgttacctgtaatctagggtaacctattcgcatcaagatgcggagatcttcctcggaaaccctcttgtcccactgcaagcgagtcattgcgcgaattgcttcgttctcggcctggggggagactgtggctaggcctgagaccctgctacaaggctgccatgcatacgcacattgcagacaagacacttcacctcacccgac

SEQ ID NO: 22365 - DNA, 68 bp, Chlorella protothecoides
tccacctcccagccctccaccatcccccccgccaacaaccccaccgccgtctccacctcccagccctc

SEQ ID NO: 22366 - DNA, 61 bp, Chlorella protothecoides
ggtgctcctcctgggcatggtcaccaaccttgggggctacttgggcctctgggcggttgtc

SEQ ID NO: 22367 - DNA, 84 bp, Chlorella protothecoides
agccactcatcgactgggagaagcgagattggaagtaccccccaggagggggagggacgaagagggcggcgcccgcgccggtca

SEQ ID NO: 22368 - DNA, 78 bp, Chlorella protothecoides
ttcgcatactattcagctccactcatacaaaccataatgtattccaaatcgcatcttatcttgacgtataccccgtgc

SEQ ID NO: 22369 - DNA, 1000 bp, Chlorella protothecoides
gaaggggtcgtggaggaacgcgtggcccagggcctggccagggacgggcacggcgccgccgtgcgcggaggcggggcgcaggtactgcgagtccgcggccgtggtggccgccgcctcggcgccgcccccgccgttcaggtccaggggcacgatgcggccggggccggccgccagcacgcccgtgtgcatgcccgcgccggcgtgctgctgcagcagcgagtcggcgcgctgctgcagcagcgactgctggtacacgttctgggcgcgggcgcgctccaggttggacacccgctcctgcggcggtgagatcagggagtgtgggaagcgggacgtcgaggagcggagagggggggggggtggccgatgcgtcagccaggttcccgagcgagatggcagcctgcctcgacgggatctgcggcagcgcagcggcggcctcccaagctcggtctcgggggcctgctcccgcccaagccggttgaccctcgcggctgggcccctctcccctcgtgccaatcccctcctcccgcaccccgccaccgccacgcacctccaggaacttgttcagctggcgcagctggttgttctccacgcgcagctgggtcagcacgcggatggcgtccgcgatgaccgacacgcggtccgtcttcaccccccgccccgtggggtcgcacagcctggccagctcctcaaagctgtgggggtggggacggtcggtggcaggcgggtggggtgtgggcgggccagcacctcggttcacaagccggggctccagcgcagcgaccatgcaccgccccgcgcacaggcagccagcatttgccattgcccctgccgcgatccatggccctcaggcgtgtactgcaggcgcaccactcgttcagccgttcccgccgggccttctcgcgcgtcgccttggcgacggctgcggtgctcatcgggcgacccttgcgcccaatgcggcgctgagagtcgtctggaggggggcagggggggggggcggggg

SEQ ID NO: 22370 - DNA, 69 bp, Chlorella protothecoides
ccaggccgatgcacccgcctcgttgtagctccgggttgcgctttggaactgggcggcttgtgaaatttc

SEQ ID NO: 22371 - DNA, 475 bp, Chlorella protothecoides
cccgacgtagacccaggcggcggccgaggcagtggccgctgggcagggcgcgaccacggtcttggcgttccctgtcacgtctgcgacggccaggacggaggcgcaggtgaagtcggaggagagcgcccagaggcgcagcgtcttggcccccagcgaggccaggtgggtgccgcagacggtcagcgcgcggatggggtcgcggtgcccgcgcagcgtggcgacgcaggccagcgactgcaggctccacaccttgatgctgcagtccgtggcccccgagaagagcaggtcgtgcgaggcgcacagcgccatcaccgtgccggagtgccccgtcagcaggtggcgctccagtgacgcgctgctgggtggcggctgcgtggacgcgtcctggtctgcgtgcggcgaaacccccgcctcggggaccacgcccgctgagatgtggccggggccggcctcgtccgcatcctgagagccggcg

SEQ ID NO: 22372 - DNA, 85 bp, Chlorella protothecoides
gattcacacgtgcatcgcgtccttatccggcttggccttgctcgtccactgcaggtacccgtattctcactgtcatgagaccgga

SEQ ID NO: 22373 - DNA, 783 bp, Chlorella protothecoides
gggcagggggggggggcaaggggggcatcgggttgtgcaaagcactgagcctcctgctggacaaggagaagacgccgcgcacactgccttcggccggcttccttgcaatgttgttgcgtcactcccagcctcgtgctgtgccttgcgcagccattgcgacgactctctgagctgtgcgggcgagagcacgactcgaataggtaggcgaggggtctagggctggactcaagactgctaccgtgtctagagatggatgccctattccagctaggggcagcttcattggcaaggtgccaggatgaaggaatgattccccaccctgtctcgctgccccctgcacacattcccagacctgtacggtactggcatgacccccgcaaagagtgcacccggggacaagtcatcctggctggcatcgcaccactccctctaccaggtgcgaatgcggtctaggagggcattcctagatgccttccccccccgcccaatcctcgcctgcccaacctctcgagcgcaaagagctctccctcatgtgcagggtgggggtattgagatgagcacgacaccgggctctgggcttgcctgctcgttcacaggcacccgctgtgccacccccatggcccccttgcgcgacatctccaagagctcgccccccccccaaaaaaccgcgcagtccccccgaccccagttgttcctcgagtctccgagcaagcatgcctccccaggcccgcagcgccagcgcacctccccgagccgccgcccggcgcccccgctggcctcccg

SEQ ID NO: 22374 - DNA, 122 bp, Chlorella protothecoides
gcatgcatcactgtggggcggcgggctccggctcctcgaaagaaggacgcacgtgtctagtgcttcatcacaggctggcaagcgccgtatctaccacccctacatcccaccccccaaactcc

SEQ ID NO: 22375 - DNA, 74 bp, Chlorella protothecoides
accacccctacatcccaccccccaaactccgttgctcctgcaggcgacctcagcgacgatatggtgcagggaca

SEQ ID NO: 22376 - DNA, 140 bp, Chlorella protothecoides
ggggatgtcgtcaccaccatcaagggagacccacagtctgaaacgctaatgtcagcttatgctcttggaaccgcatacacattctcaactctagagaacattaaggagatcgtgccgctgatgctcatcaaccctatacc

SEQ ID NO: 22377 - DNA, 65 bp, Chlorella protothecoides
aggtgagacctaggatggggaatgagggttaaagaaaggactctcaatcatggcacgtcatcagc

SEQ ID NO: 22378 - DNA, 78 bp, Chlorella protothecoides
cgtatggagtatgacatttcaccccctgcgtacatcaggatggtaaccttgacacacaaggtggaggcatgcggagga

SEQ ID NO: 22379 - DNA, 71 bp, Chlorella protothecoides
gtggggtgatgatgaagaccacggtgcgtgtcggggggtcggccttggatgactgccgacccccgtctctc

SEQ ID NO: 22380 - DNA, 61 bp, Chlorella protothecoides
agacgccagggtgtcctgattcccaagcacccacgggacggggctgttccccgtaggacac

SEQ ID NO: 22381 - DNA, 61 bp, Chlorella protothecoides
ctgcaggatgctttccagctcgtggcaagacgtggggagtgcacctgacgcacacagccgc

SEQ ID NO: 22382 - DNA, 61 bp, Chlorella protothecoides
taagggctcctcgacagacggcggtggtcgtcgcctggcgcagcgcggctacgggtctgag

SEQ ID NO: 22383 - DNA, 61 bp, Chlorella protothecoides
taggagcaccgctgtgctcgctgttttatgagtcgggcacctgtggggaaggggtcttgag

SEQ ID NO: 22384 - DNA, 61 bp, Chlorella protothecoides
tggggaaggggtcttgaggagggctggagtaaacatgcggccctcgtcttgcaggaagtca

SEQ ID NO: 22385 - DNA, 61 bp, Chlorella protothecoides
gcaaactcttccaaaagccacggcggtgggtggagggaatgtcagccagaatcatccccct

SEQ ID NO: 22386 - DNA, 1376 bp, Chlorella protothecoides
  modified_base (303)..(312): a, c, t, g, unknown or other
  modified_base (864)..(873): a, c, t, g, unknown or other
gggaagggggggtggggtggggtggggggggtcctgacgatgcctggagggaaggagccttgcagctacatccgcttgggcagggtgggaggccggtggctggacgagtaatccggggcgaggcgcgatgatgaagactcgcctttgtgcatgcaaggcaccagtgtctccggcccagcgctggtttcgtgagccatgctcatgggtcccagcttctggcaccacccaccactccctaccaccccacattgcagggggtgggcagcgcggatgacatcgaccgtggcatgcggctgggcaccnnnnnnnnnnctgtgcatgcaaggcaccagtgcctccggcccagcgctagcttcgtgagccatgcccatgggttccagcttctggcaccacccaccactccctcccaccccacatcgcagggagtgggcagcgcggacgacatcgaccgtggcatgcggctgggcaccaacgtgcctatggggccgctggccctggccgacttcatcggactggacacctgcctgtccatcatgcaggtcctgcacagcgggctgggggacgacaagtaccgcccctgccccctgctgcgccagcacgtggacgcagggtggctgggcaagaaggcggggcggggggtatacgactacagcaaggagcgatgaagggggagtcagtgcagagacctgaatgaaccgtgcatactccattttcgtcgcaagtcatcgattttccgaagaagcactttactctctcgctggtagcgaaatgcacattggagaatttgaatccaggggtacggggtgctgtggggcgcgcgcgcccaagagtgatgacgtagagtgatgcatgatctcacgcacnnnnnnnnnnggtgcagaggcctgaatgaaccgtgcatcctccattttcgtcgcaagtcatcaattttccgaagaagcactttactctcccgctggtagcgaaatgcacattggagaatttgaatccaggggtacccggtgctgtggcgcgcgcgcgcccaagagtggtgacgtagagtgatgcatgatctcacgcactcgccggggaaggagtggcacggtgccccgcagccgagccatggcatgctgtagggcacctatcagtctcataacacccttgactggggaccccgccagccgatcccaggagcttccctgcagcccctgacgcccatgtcggcctccggggagtcctccccgcccgacccggagcgcagcgggaatgtggagggcaccctgctctgccttagaaatgaggtaatgcgtatggacaacataatggcgacgaggccctccgtggcggccatgcggagcgcaaggggcatccctcagccctgccccagacaccccccc

SEQ ID NO: 22387 - DNA, 61 bp, Chlorella protothecoides
aggtaaggagggaggaggggctgggcagggtaagtgggtaggaaacccagagcccttgtcc

SEQ ID NO: 22388 - DNA, 61 bp, Chlorella protothecoides
catggagcccaggcaggcgtccagcaggttcagcaggatgatgttcttggcattcttggca

SEQ ID NO: 22389 - DNA, 550 bp, Chlorella protothecoides
  modified_base (274)..(388): a, c, t, g, unknown or other
ttcaacgggtgcctgagagtcaatgcgcatccttcactttgtagcatgcattcattcactatgcctcagtgatcgcttatcgatgcctccgtgcatgcggatgctcgacccaaatctcattgtatttgtgccatgcacaaccgccaaaggtgtcaggcataggtgctcgatattcaggcgcggtgcaatggcagcctgatctgtgaagaccgcttctacgatgaacagtgggtaaagactactaggtttctattcctgtctttggtatacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgggataccccacttcagtgcatacaccagaggcagtcgatttgaagggacgtgtacactccgatacaccagatggaattgttgaggtacagacggcagtagggacaccattccttgagcaaatagttgggtaaacttgcgcagcgcaagtggatttggc

SEQ ID NO: 22390 - DNA, 79 bp, Chlorella protothecoides
catgttgatgtctgatgtacccttgcatgccaatggctgaggcttggtgggatgcatgattggggcatgctcaccgata

SEQ ID NO: 22391 - DNA, 61 bp, Chlorella protothecoides
ctctgccttgccatgagtggctgcagatgggatgtaaaaggatgggactatgccatgctgc

SEQ ID NO: 22392 - DNA, 73 bp, Chlorella protothecoides
gcactctggacaggcatgcctggggggggggggccaacgcccgaagtcaggcaggcgaatcttgtggtgaagt

SEQ ID NO: 22393 - DNA, 75 bp, Chlorella protothecoides
ggcacaaaagtggaggggaggaaagggggagtgtggggatgaggaggggggtggcgacgccgtggtcccctgccg

SEQ ID NO: 22394 - DNA, 61 bp, Chlorella protothecoides
caggtgcccaccctggtagctgtcactcagatactccaccgcctgctgggggtgtccattg

SEQ ID NO: 22395 - DNA, 64 bp, Chlorella protothecoides
aacagctatggcaacagcttggagaaacctgtataatcgctaggcatcgcctgatctggtactg

SEQ ID NO: 22396 - DNA, 74 bp, Chlorella protothecoides
tctcacgtgaagtagggagggtagctgtagaagacgggcatgggaaagtccgccatggtcgcacggatgggacg

SEQ ID NO: 22397 - DNA, 65 bp, Chlorella protothecoides
gaaagagggtgagcggagggtcccggggacgacaatggtagcgcccccctcgctcggacaccctc

SEQ ID NO: 22398 - DNA, 61 bp, Chlorella protothecoides
ggaagccaatcgatgcgctgcccctgcaaaactgtgcctcctgacttacaccattacgcca

SEQ ID NO: 22399 - DNA, 61 bp, Chlorella protothecoides
ctgcatgacctcgtctgtgaaacctgggttcccttggatgtccaggcattccagctggtgt

SEQ ID NO: 22400 - DNA, 22695 bp, Chlorella protothecoides
  modified_base (574)..(583): a, c, t, g, unknown or other
  modified_base (1226)..(1235): a, c, t, g, unknown or other
  modified_base (1577)..(1586): a, c, t, g, unknown or other
  modified_base (2173)..(2182): a, c, t, g, unknown or other
  modified_base (2594)..(2603): a, c, t, g, unknown or other
  modified_base (2692)..(2701): a, c, t, g, unknown or other
  modified_base (2758)..(2767): a, c, t, g, unknown or other
  modified_base (3304)..(3313): a, c, t, g, unknown or other
  modified_base (3763)..(3772): a, c, t, g, unknown or other
  modified_base (4467)..(4476): a, c, t, g, unknown or other
  modified_base (6075)..(6133): a, c, t, g, unknown or other
  modified_base (7660)..(7669): a, c, t, g, unknown or other
  modified_base (8102)..(8111): a, c, t, g, unknown or other
  modified_base (8687)..(8696): a, c, t, g, unknown or other
  modified_base (8982)..(8991): a, c, t, g, unknown or other
  modified_base (9291)..(9300): a, c, t, g, unknown or other
  modified_base (9547)..(9556): a, c, t, g, unknown or other
  modified_base (9956)..(9965): a, c, t, g, unknown or other
  modified_base (10149)..(10158): a, c, t, g, unknown or other
  modified_base (10685)..(10694): a, c, t, g, unknown or other
  modified_base (11481)..(11490): a, c, t, g, unknown or other
  modified_base (12445)..(12454): a, c, t, g, unknown or other
  modified_base (13436)..(13445): a, c, t, g, unknown or other
  modified_base (13703)..(13712): a, c, t, g, unknown or other
  modified_base (14187)..(14196): a, c, t, g, unknown or other
  modified_base (14537)..(14546): a, c, t, g, unknown or other
  modified_base (15497)..(15577): a, c, t, g, unknown or other
  modified_base (16508)..(16517): a, c, t, g, unknown or other
  modified_base (16632)..(16641): a, c, t, g, unknown or other
  modified_base (18320)..(18420): a, c, t, g, unknown or other
  modified_base (18608)..(18617): a, c, t, g, unknown or other
  modified_base (18683)..(18692): a, c, t, g, unknown or other
  modified_base (20126)..(20135): a, c, t, g, unknown or other
aggaccatggcatcaaaggactcgaagatctccaggctcggctgtgaggtgggtagggggtggcaaaattcttgtatcccttgtccctggaatgctgaggtcatgtccgcatgcagtgaaggcagatctcgtatcctccgcatacttgctcagccaggcctatgctgagcaagctcctgaccccaccccacccctggcagcaagcatactggtaatctaagccagaccgggcaatcacaatccccatgctggattcaaagacaacctgtgtcccttgcctcttcattggacccctaccaacctgatggatggtcaccatgacggttcgctggctgtctgccacgttccgcaccgctcgcatgacgatggcggctgccctcgcatccaggcccgacgtgggttcactgttggcagagtggagttgatgaggaccagcagcggtgtttcatggccggggaaaatccctccttgaacatgggcaacccaacaagaagtgttctgagtacggtgttgtccccgacccacccctcaaccccccgcccctgtagctcactccataaaaaccaccgatggnnnnnnnnnnaaaggttctgagtacggtgtcgtccccgacccacccctcaaccccccgcccttgtagctcactccataaaaaccaccgatgggttggccacgagctccactgcaatgctcagccgcttgcgctgctcaatggagatgccggagccgtcgccacccaccacgcgccccgcgatgcgatccagctccaccatcagcagggtctcctccacgatggacttgacctgatagaatgggggggagggaaatgaagatgcagcatcccagctgtccatgtcccagtgaggggaagatggcgatctatgttgcgagccttccttggccaacatcaagccaggatctcccaggctctcatgatttgttgacggatcgtgaggctccaaccagctcctgaatacctggtcataggaaacgctctcctccagccgcaggcgcgcagagaagaggagggattcgcgcactgtcacgggtgccgagtggatgtctgtctgctccacgtacctgtgttgggtgcacgagcaggaggaggtcgaggtcccaggagccatgccggcagatcaagctgtgatggaatctcggtgcgtgtcattggcaaggcaccaaacacatgcataaatctccgtcgtaaacagcaacccctccccaannnnnnnnnnctcaatggcaaggcaccaaacatatgcataagtctccgtcgtaaacagcaacccctccccaagctcttgtgcccattcccccctaccactcacccgaccactcgcgaccaggtggcctggtcctttgggtggccattcacgaggatgtcgccccgaatgacgcccactgtcttgcggccgcagatgacgtcctgcgatcggccccgcatgcggaccgtcccttcatgcacagccgtctcttaaatgacatgcattgcggatgtttccacctgatcatcagcgagagccgtcagtggccggctcactcccaaggccccccaagccccctgtccaccaaaggcnnnnnnnnnntggaccgtcccttcatgcatacccgtctcttaaacgacatgcattgcagatgtttccacctgatcatcagcaagagccgtcagtgaccggctcactcctaaggccccccaagccccccccttccccccaggcacaccagcctcaccatgagcgtggtctttccggcgcctgacccccccatgagggccatgagccggccaggctcggccaccaggctgatgtcgtgcaagagctgcagcttgccgtccagctcggcgtcccccgtgcccgtcacgatccccctgccggagcccttgcccttggccgggtccggcacgtagtactcgatgccgcggcacaccagggtgatgggggtgaaggggatgatgacgtgcttggcgggcagggcctggagctcaatcgaggtgagggtctccaggttgcccgaggctgcagggggatgatgggtcggggcaaggggatgggtcgaggaagaggggtgggtcggtgcaaggggttgggtcggggcagggtgtgtcacggtagggtggcacgacgcgagcgtggacggtgcgcagagcagtgcaccaaaaacgcatgctcagtcnnnnnnnnnncgatgggtcggggcaagggggtgggtcgaggaagagggattgggtcggggcaaggggttgggtcggggcaggaggtgtcacggtgggttggcacgacgcgagtgtggacggtgcgctgagcagtgcaccaaaaacgcatgctcagtcggagccgcgctctgcatgggtcgaggttcggagtctgcgcggcgactcccaaacccaccactcctgccacgcaccgttgctgtgacggcttgaaagcgcggagaccgcccgtgaggtcatgctggccatcctcccgacagtgctaaagacggagcgcttcacctcctccttgccctcctccgcggcgactgcggcggcgtgaagagggtgggacatggccggccggcgcgaggggccctggggacccttcgccgccctccatcgnnnnnnnnnngacccagcactgctgccacgcaccgttgctgtgacggctagaaagcgcggagaccgcgcgtgaggtcatgctggccatcctcccgacannnnnnnnnnttcccccaaaaaagaatcactcccttgacgcactggtgggcctgggcttgggcgggnnnnnnnnnncccccccaaaatgaatcactccctcgacgcactggtgggcctgggcttgggcgggtcggtgatggtcagggccaaggctcccaggatggtgaagatcagcaggaacacccaggagaacacgacggacatccagatgaagatgctgcacggaggagggggggccaccgggccatgcttgtcactgcgcctgctgctgacggccggcgcaacacccctcccctcaccccgatcgggctcgatgcgtctctgtgggcctctcccacccccctcccttgccccactcacgtgttggtgctcatgccgaacacggacagcgcaaactcgccctgggtcatgcctcccccggcaggtggcccggggaactgccactgcgggctcatgagctcgttgatggacactgcccggaccgtccaggcaagggggttgatgtagtagagccactgcgccgtcgcagggggggaaggaaactgggaattcgtggatactcgcagccggtccctgcatgagctccgaagccccgcacgtttgccagggccnnnnnnnnnntccactgcgccgacgaatgtggggaaagaaactgggaaatcgtggatactcgtagccggtccctgcatgggctccgaagccccgcacgtttgccagggccgctccatggctggagcgtcatgcctgtggtgccccaaacctcagattccccccggctctggcaatcgcgatgcaaggtgggcctgagagcgccgtgggcaccgcgcagcatgacagtcctcgctctcccctcccacgcaccacgatgtacttggggatgtcggggtagacaatggagaacccatttgtgatgacgaggatgaggatgacgagaccagtcaccgggtttccgaccaacactgtggggaggcatgcaggggccctgtgggtgctgttcccatgccaagctcggcgcatgcactcgagtggcgcacgctgacactgctcgtgcatcaggctggaggctcggtnnnnnnnnnntgcatgcaatcgagtggcgcacgcagagactgctcgtgcatcaggctggaggctcggtggaagggccccgggcccacccattctagggacacagcccgagatgcatgcacccctttcggcatccccacccaccaccccctctcccacgcatcattttctccagcctcacaggagggtgtggagaaggcgatgaggcggaagaggcccgccaggcagttgctgcaggaccaggcgaccaggaggaaggtgaagaagtgccccgcggtgcgctcaaagttgaccatgaagtagacggggatgcagaagagcagggcctccagggtggagggcacgacctgggtcagcgccagcccgcaggcatacgaccaggccgggaagaggcggttgtcacggtgcttgaagaagacgctgcgccgggggagggttggggtgcatgtggcggtgtgccggagaatggaccagagcgggcatgagcgtggtggagggccggcgccagggacaagcgtgggggggcagggcaggtcccggggccctacactcctcgtcactctccccccggaaccccggcagcaggcgccctgcggcaccgccgccctttccatcatagagacctgcggacctagtgcatgcacccctgccagccgatgccaggcaccacaaccatcctcattccttcttcgacctctccttacccnnnnnnnnnnaggcagggcagatcccagggccctacactcctcgtcactcctcccccggaaccccggcagcaggcgcccggcggcaccgccgccctttccatcatagagacctgcagacccagcgcatgcacccctgccagctgatgccaggcaccacaaccaccctcattccttcttcgacctctccttacccctcttccccctcttccgccccccaacacaacccactgtttggtcatgaacaccagggagagctgcggcgtgctcatcatgaccaggaagatggtggtcagcgcgcacagcgcgatgaccttgcgccaggagtctgggctgggctggatgtccacgaatagcgagccgatgatcagcgccatgaccagcgcctgaacggcgcgggcgatcatgaaggcccgcccccgcaccagcgtcagcagcgactgccgcttcagcaccatgcccgccaggaagacccagctgggaagggggaggggtggcagggctgaggggggggtggggagtgcgagaccggcaggccaccgctcagccagcaaaccctgccaggcacctgttggcgtatcgggtggtgggtaggggctcggccgcccccttccccggcttgccgctgtcgagtctggccagcatgtcctggccccactccgtacccctccagaaggcatctgcacgccgggagcaaggacgggggtatgtttgagcgtgacaggacggcatcggcggcgatgtgcatggggtggggcaggagagggcggcgcaggggtggctgccaggctggtgtgggagcaggccggcagggggcccttgccggcaccggcactcgccgagcctcccagtcaacaaactctggcatcacgcaaggcacacccgccctcctcacacggcacacgcccggccaggcagcctgcatcgccctccacccctccctagcacacccagcagcaggacacaagcacaggcccaggcctcgatgcccctgggaggttgcccccgcctcacacctgcaatgtctgcgacaggtgtcagcagcgtggttgggggctggctgatgagctggcgagggttccgcaggctctccggcacctgcctctcctccagcagcgccttggtggcgtaggtcaactgccccgctggcgtggtgacctcctgcaggaagctgccagggtcctttcggggcgggcagacgaagccgaggtccgcgaagaagccaagcaccgactccaccgggccactggggaggtgggagggtttggagtggggtgctgagcgtcacacgcagcaggtgcaaggtccctggttgtggtgcaggccaagctgcggtgtggcacaggagccgtcgctctgtggcagccgaccgggtcggtgctgtgagcgcttgagccaagccccgcctcacggacgccacccggcagggcaacctccactcaacgcactggtagatgacgtggccgtcggtgatgatgagcaggtcgtcgaagaggcgcatcacctccggcggcggctgcagcagcgacaccagcatggtgcggtgcagcgtgtggcaggcgttgcggaaggtgcggatgacgctgtaggtggtggcgctgtccagacccnnnnnnnnnnnnnnnnnnnnnnnnnnnnnnnnnnnnnnnnnnnnnnnnnnnnnnnnnnnactgcggccccaccagcacctcgcccgtggtcacacgcttgcgctcccccccagagatgccgcgcgtcatgccgtccccgatgcgcgtgtcggcggcgtggctcagccccatcaatttcatgatgatgtagggcttcagcttgtgccgcagcacctgcctgcggggcggcggggggatggggtggcacacactctccctcccttgccattttcgctgtgagccaggcacggcaatattcgctcgacaagagtgcctgcacttcactcatattcttaatccatctcggcatccccctctcccctcccagctcacagaatttggtgcatgaagttggcatccagtggctttggggcagccaggtggtaggtggaggagtgcttcatgagcgcggcgcgcttgtacgcatcagccgccagttcggcgggtgatggcgccccgggctctcccttgcaggggacagggaccccaccgggagaggcgagcgtcccctcccccagcacctccctggcatccgtgtacgcgctggcgaggctggccgctgagctggcacggcgtgaggccgcgtccatgaactcctcgtccgtctcggtgccgacgtctggtgccccgccgattggcaaaggctggcgcgcaaagggcgtgtcgcccgcggccgatgctccattcgcggtgagcgtctggggctccggcccgggcgaggcttccttctcccgcggggcggcgcgccctgctcccgcagggccggacctcgtggcgcccgcccgcccctcctccatctgaacgagggtattctgctctcgcacggtgctggcctcgatcgcggccagcttcctctccagctcggtcaggccggcatccacctgctgctggttggtgaggcaggcatgcgcgaactgcagcgtctccagcacggacagctcggcgatgtggtggtcgtctacggggagggggggggggggggggcgcaaatgtgatgctgtgcttgccacacccccgggccgcagcctccctaacatggcagagcaggtccctgccaagcgcacaacgcacattggtcaaccagcccggcggcacgctgcaccatgaagctgtccagcggctgcccattgtactctatgctccctgacacctgcagggggaggaggacagcaggtactcgtggggagggccggcggagctgtagcgtgacagctgccgggcgcaggcagcactctccgctcagagcactgtatagaaaaagagctttcagcacccaatgccgcatggtcaggcatcgaggcccctgctcttggacacagaacatatgaaacgcaccctcaggcctccatggggcttcaggcggccggagagagcttggaggaacacggacttgccggatccgggcgggccgatcagcaaggtcagtttaccctgggtaggatgggagatcggccaggggtgcggagcggagtgggatcgacatccggtaaggcgggcgtgatgtccatgcaggtccgggagtgttacccgtgaggttgtatccaagnnnnnnnnnnagccaggggtgtggagcggagtggggtcgatatccgggaaggcgggcgtagtgtccatgcaggtctgggagtgttacccgtgaggttgtatccaaggcggggtcgtctctccctcaccatgtcaaccctgcacccaccggccggagcgccccattcacgccatcgaggatgcgcaggggctgcttattagccctgcctcgcaggagtagggagttgagcacccccaccgcagaattccataggctagggttgttgctcagccccacagcagcatccgcctcgacgaccaggttcttgtactggatctctatctgtggcactgccccaggcagcaatctgaacggcaagagagagcggtgaaaggtcacaccttggacagacggggggcgatgaatgccccggtctgcgggttccttgcaatggcccatcacannnnnnnnnngagagcggtcaaaggtcaaaccttggacagacggggggcgatggatgccccgctctgcgggttccttgcaatggcccatcacaacgctcgacaccccaggagccgaccgtaccggaggactggagcgagtcgctggtgaaaggtcaccccatctacggtgtcgctgaccaagtcatcagcgattgcatccttctcagccctgagcataagagggaggtgtcgggcccaatgaattgggttttcggacaggcgtgccgtagacgccgagcacgcgctcacctatcaagggccttgcggctttgcgaggagaggggttgaccccttgcagcgtcgataagttcctcctcatccctgcgcgcagatgcatccagacgcttgcggctggtgacaaagtagtcgccgaccgtggaggctccgtcgaccccaaagctgctgtccgtacgattcacaaggggaggatcaatgtgttcctgtgccgacatcctgtaggaggaatcgcactttgtgtggcaagatgtagacttgaaagctgtccatttgcaattaaggtgagtgcctcttccgaggagtgtcgannnnnnnnnnaaggaatcgcagtttgtgtggcaggatgtagacttgagagctgtccatttgctataaaggtgagtgcctcttccgaggagtgtcgagtttcttaaaatcttggaagcgcagattcttaccaaatcatgacactgccatcttataaaaaaccctgatcgattgcaaggacagatagtcgtctttgatgcgtacgtcactcttgatcaagctgacgagttcctccccttacgatgagcccaatcacagctcatacctagtccattcctctcaactaattccctcagcnnnnnnnnnngggtttcttaaaatcttggaagcgcagattctgaccaaatcatgacactgccatcttcaaagaaccctgatcgattgcacggacagatagccgtctttgatgcatacatcactcttgatcaagctgacgagctcctccccttacgatgagcccaaacacagctcatacccagtccattcctctcaactaattccctcagccttgtcagggagtggcatgatctctcgcagggagtgccggggatctccttgaccattatcatctggtgtcgacatcagaaggtcacatcgaccgggtccnnnnnnnnnngcagggagtgccggggatttccttgaccagtatcatctggtgccgacatcagaaggtcacatcgaccgggtccccccccaacacttatatgtaattgggcgactactgctattacactgagtaaggacacgcgctaccggatcagtcattctcaacatgttggctgttctcacgctgtttgcaagggggcacgactcgttgcacaagcagcaaggctccatcctcccagggggtcatcagcgtcgcnnnnnnnnnncggctgttctcactctgtttgcaaggggccacgcctcgttgcacaagcagcaaggttccatcctcccagggggtcatcagcgtcgcaggtagctgaccttgctgagcaggatgacagaggctgtcctgaagaagatgcagtaggcgaagacgatgaggacgcaccaccaaatcatcgcaaagtcccaaccaaagtaggctctcatgaaatcgggcaggtaaatgtcgctccccgacaagcctgtcatcagagtttccttgtcgcagagctgactgcatgctagaccatacagcgaccacgtggcaggactgcgggtgggagagaccaaggatggaggctcacccggggtccactggccattagcagttgggagatgcttcatgcaagggctctctgcagnnnnnnnnnnagggggtcgatggccattagcagttcggagatgcttcatgcaagggctctctgcagtggcaactccttgctgggtggggcagattggcccagcctggaccccaaatgcccactgccgtccagcaacatcccccacaaacgaatgcactgcccaacctgatcctgttgagccacttccaaccccnnnnnnnnnnggccgtccagcaacatcccccacaatcgaatgcgctgcccacctgatcctgttgagccacttccaaccccgcgggatctcggagtaggggatcatgaagccactgtgggagattgcgggggttcaggtgggcgggtgagcgcatggttggggcagcataaagcgaaggctgccccttgtggactcgcgtcaccgcacgcctcggcgattacccagtcagcagccagtcccatcgggggatgagttcagccctcgtgccctccccacaggctccccagccgccgcacttgctcaggttccagagctggttgaacagggaggccagcatcatcgccatcagctgattcggtgtgaggtagatcaggaactgccccagcagcgtgtacatggtctgcaaaggggtgctgaggtcctgagcatgctgcaggcgaggctgagcggtgcgcgcacccgagcctggggtgtctgccttgagtacacagctcaggggctcgccgcagcgtgtgcatcccccgcccttccagtgannnnnnnnnnggcgcacccgagcctggggtgtctgcctggagcacacagctcaggggctcgccccagcgtgtgcatcccccgcccttccagtgacaggatagacgccgctcgtcccatgctcgcagacatacgtattctggcagcacagccgccccattcctcaaggcagcagcccccatggagcagggcattcatcaggcagctgcacagcggccccagcggcttcgccgcccacccgggcccccccccacttccccctcaccagcaccagggtcagcagcagcaggaagtagaagaacttccaggccacggggtcgaagcccaccatccagtaggccactacggacatgatcaaggcttggatgaggaggtaggggatctccgcgacggaggtggccagcgtgtagggcccgggggagtacatggcggcggcccgctcccggtagaacacggtgcgctcggcggagaggagaggaatgatcgatatgcagttgaagatgcccaggaaggtggtcatggagaagagcacgcccgcgatgttctggacctgggccgccgagatcgagccgtccgcggccaccttgccctggttgtagtacagcgcgccgtagatgaaggagatgatcgtggtcaggaagatgcgggtcatgtctgtggcaaaggggcaaaaggagagagggaggaggggcaggtggtgaggggaggggaaggcacgagcagctgccccccttgtggaagaccagagcagtcatcatgtcttcctatggtaacataactttgggcgctgcaaactctnnnnnnnnnnacaagggccaagaggagagagggaggaggggtagtggtgaggggaggggaaggcatgagcagctggcccccttgtggaagaccagagcagttgttatgtcttcccagggtaacataactttgggcgctgcaaactctgaggaccatcctgcgacctcgaaactaatccctgcccccccttaaccctatccacccgtgacccccaccccaatccaccgccacaggtgctcactgtactgtggaaggtgccagtacatcttgcaaaacttgcggatgagccagcggcgctgcgtggcttgggacgctgcatacttggacctcagggtcaagggggggtgctccttggcacacctttccagcagctgggaagcatgggcctcattttgctggaagagatggctcacctgtggatttgcatggcgattgatggagggaggggagggatgtgctgagaatactccgaagcggtgttgggcagggcacatcaccatcgtgtgaagtgtgcgcggagttgcgtctactgattcaaacccccttgcctcatacatgcctgtccatgcgcccaacttaccctgtagagggtggggaagtcctgcccagcgtccttgaacgtggtgctcatggacccaccagtcacctccagcatccaggtagcgggattgtacccggggcggatgggctccacacctggctgggcctccaggtatgccaccagggtcgagctctcgtaccccagatccccaaagtaggtgagccgaccaccacgctgggttgggggcgcagtggagagggatgggggaggtgaggaggagtcaggcagtgcggcactggacggcacaggtatctgcatccgggcgctggccggtcactggagagccgagcttagcaggacactgggacaggaatcctgatctacacctggagtaggaccatggcatcaaaggactcgaagatcnnnnnnnnnngagctgtgagctctcaaagcccaggtccccaaggtacgtcagcctgcccccgcgctgggatggtgcagtcgtgtgaggaatgagaagtgcgtcgtgacagcaccgattcgccggtgttggcaggatcgctgcacgtgaacaccaaacattcctgacgcaactcccccacaccccgcccgcctaaccatgaaggcgggtgtaggcatcctccctcattaaatctcccctgaaactcacttgcagaagtaggagagcatcaaatgcttcaaagatgtccatgctcggctgcagtgcggggaggagaatggccagctggcttagcatgtatgagccaggaggaggaggggtgtctgtgtactctttcagaaggaattagactcgagcatgaatctcacaggcaatcgtcacggtcgcccgggtagcagtgggccaccgttgttggggggttcgagaaggtggacatggaagcgccgaccatcccagaggatgctggaacacaggcgatgcactcccacggccaatgttccccacaccccaccaacctgatggatggtcaccatgacggtccgctggctgtctgccacgttccgcaccgctcgcatgacgatggcggccgccctcgcatccaggcccgacgtgggttcgctgtggggagagggtgagatggaggtggctgccggtgcaggcgcagaagaggggctcgctccccgtgcctgtgcgtcaccccgtcccagagacacctcctggtgcagagctgccgcggtgccaccccaccctgctcactccatgaagaccaccgaggggttggccacgagctccacggcgatgctcagacgcttgcactgctcgagcgacaggccagagccatcgcccccgacgatgcgctccgcgatccggtccagctccaccatgcgaagggtgtcgtccacgatggccttgacctgtttgacggggcaagaacttccatggtggtcatgctggnnnnnnnnnnatctacgatggccctgacctgtttgacagggcaagaacttccatggtggtcatgctggggtcacagacacagctgcgttttacactgctttgcacacagctgctgtgggcagggcctcttccacgcagccttggacaggatgacacagggtctcacccacagcacctacatgttcaaacgacacgctttcctcaagacgcagccgagcagagaagaggagggactcccgcactgacgctgctgcagagtgtatgtctnnnnnnnnnnacgctttgcactgctttgcacacagctgttgtgggcagggcgtcttccacgcagcctggacagcggtgatacagggtctcacccacagcacttacatgttcaaaagacacgctttcctcgagacgcagccgagcggagaagaggagggactctcgcactgacgctgctgcagagtgtatgtctgtctgttccacatacctgagtttggtgaaggagagaagatgaaaaggtgcatgggagtcctccaagcgagagatggggtggtgctcccccacaaagcaccgcacaccccaagcatcagcctttcccagtggctgttctcaacgcaatcgctcccaaggcgccaatcagccccctcttgtgactcacccgaccactcgcgaccaggtggcctggtcctttgggtgaccgttcacaaagatgtcgccacggatgacgcctacggtcttgcggccgcagatgacgtcctgcgatnnnnnnnnnnacgcagtggaggggatgggaggggtgaggagaagtcaggcggtgcggcactggatggcacagcgatatgcatccgggcgctggcctgtcactggagatccgaggttagcaggacactgggacagggatcctgatctgcacctggagcaggaccatggcatcaaaggactcgaagatctccaggctcggctgtgaggtgggtatggggtggcaacatacttgtatctcatgtctgtggaatgctgaggtcatgtccgcttgcagtgaaggcagatctcgtatcttccgcacacttgctcagccaggcctacgctgagcaagctcctgaccccaccccacccnnnnnnnnnngcgagggcggggtcgtcaccgtcgtccacagcgcccttgcggacggccttgcccttggacgggtcagggacatagtacttgattcctcggcagatcagggtgatggggtcaaagggcaccgccgaacgctgtgaggtggaggtctccagctcatctgagccgcaagaaagctgggcacccaggtctgatttgatagggggtgtggggggatggaccagtggggcccagcatcggtcagagctgcggcgcgcgcgtcgtgagccctccccccgcccgagcgtggcgtgcacaacagcagcacacatccctttccccccaaaggatggctcacggctgctggcttgggcggacagcgtcgacatcgccatagaagacatcctcgccatgcgaccggcggtgtcctgcacctcccgctcaagctgcttcttcccctgctccacttcaactgccggacgatgatgagaggggaagtgggagttcagaaggaggggggggatctcctcgtctcacacccgctggcatcatgctgcgcaggcatagctctgcaattgccccgaggcagcgctgcctggggccagtgggcctgcacctgtgggtctgggcttggccggctccgagaacatcagcgccaccgcgcccgcagcagtgtacacgaggagcatgccccagaagtaaactacgctgtaccagatgtacatcctggagttgggtcggtgggaaaggggggcgagggcgagggagcggtcggcacactgcacaggacacacctgctggggcgtggactgagatgttcccagaaaccagggtcctgaggaaccgacgcttgcccatcgacaaagcaaaggccccgcctgcaatgctcacatcatccccaccttacccctgccactcaccggtccctgcgcaaaccaaaggcagcgagcgcatactcgccctgggtcaacccttccnnnnnnnnnnnnnnnnnnnnnnnnnnnnnnnnnnnnnnnnnnnnnnnnnnnnnnnnnnnnnnnnnnnnnnnnnnnnnnnnnatggcaaaggcctggacacaccacgcgatgggattcaggtaatgcacccactgcaagggtgggggtgggttggagacgagcatgtgaatgtcggggaagggggtaccagcaggctcctggcaagatcctggggtgcctcgtgggcaggagcacccagtgaggtctggctgggtacccgaggattccaccacgtgtcacaggcagaaggccagagcaaaggaaaggtgctgccgggcctcctccctcctgcaaggtgccaacactttcttccctgcaccccagagacccccccccccctcccccttataccccaacagctcactatcaggtaatcggggatgctggaggtgatgatggtgaagccattcgtgagggagatgagcaggaagatgagccccatgatcgagttccccaccagcactgggaagggtgagtgggtgggtggcgcgagggggtcattcatgactgccccttgctcccccatgcatccggctggatcagggcgggagccgctgccgttgcatgcacagcagcgcagccacaccctggccccatgtcggtgcacgggggcagaccctggtgggcgggccgcacaccgagtgcttgctgccaggcaggcgcaggcgcgaccaggcatgcccgcggagctcaggccccgacccctggcactcacgactgggcgaggagaaggcgaccaggcggatgagccctgccatgcagttgctgcaggaccagaccaggaggaggaaggtgaagaagcatcccgcgctgcgctggaagttgaccaggaggtagaagggggggcagaagagcagcgtctccagggccgatggcaccagctgggtgacaacaaagcccgaggtgtaggaccaggccgggaagaggtggttgtcgcggtgcttgtaaaacaccctgatgaggaggggggggnnnnnnnnnncgtctttcgccaagtggttgcgccgggtgtgatgccgaacagcatggatcccatgatgagcgcctggatggccgcctcgatggggcgggcgatgatgaaggcgcgctggcgcacnnnnnnnnnnggaaccagtggagccaggtggggctgggtggacgggctggtggggcagagcattctcaaggagtttgggaagggggttcgaagacatgtgacatttgggtaagcagatccctttcccccccttacatcccagtcagcacctcttggtgttgaacaccaggatcagctggggggcgctcatcagggtcacatagttcaccgccacgacgcacgccgcaaaggcctttcgccaagttgtcgtgccgggtgtgatgccgaatagcatggatcccatgatgagcgcctggatcgccgcctcgatggagcgggcgatgatgaaggcgcgctggcgcaccaggttgagcagcgcctggcgccgaatcaccagccacgtggcgcgcagccggctgggggaaagggtgtggaggaatgagggtggggaggagcactggccatgagagcatgggcgtaactcacaaggcaaccagggattcgagtggcagcaccttcccaggccgtagtgaacccacatgccccgcattcccgccctgcgacctgttggcaaacttggtggatggtaggggtgcctgctgctcggccccatcgcctgccgagtccaggctcgccagcatgcgcccgccccactcgctgcgatgccagaactccgctgcatgaggcgggaagggcagggacctcagcatttcagcatcctagggcaggtggcgagcagaggggaggacagtgcacgggcatcattgccgaaggcagcggatttgagatgtcatctccctggaggaggctcccactcttccaggcacgcaggctacagtcagtcccagataacattcccccacctctcccctcaaccgtactccagggtcctcagaaaacctacacccacctgcaatgtcctcgacgagaaccagcagggaggcgggcgggttgatgatgagattatggggggtgcgcctgctctcccgcacccgttttgacttcagcagcccttcggtcgcatacgtcagctgcccgatgggtgtggtaacctccagcaggaaactggccgggtccttgcggggcgggcaggcgaaccccagcctcgtgaaaaagctcagcgcgtgctccacgggaccactggcgagagtaaaaggtggagagggtgaggtgggggtgttgggggggcgcctccaatattgtcccagaccgagcatgaactgtgaggataggcatgcatccccttttacagcaatggcaggggctcaggccccttggactctccgaaggccctctcttgtccaagtccttggcccccctgccctctggccatccaccccccccctcccttttcctatctctcagacgcactggtagatgacgcggccgtcggtaaggaggatgacgtcgtcaaacaggctcatcacctctggcggcggctgcagcagcgacaccagcacggtcttgtccagggtgtggcaggcgtcgcggaggtggcgtaccacgctgtaggtggtggcgctgtcaagacccgtggagatctcgtccatgaggaggacggcctgcggccccaccagcacctcggccgtggtcacgcgcttgcgttcacccccggatatgccccgcgtcagcccgtccccgatctgcgtgtcggcggcgtggctcagccccatcagcttcatggtgacgtgggggttcagcctgtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgaggcacaggctcactgcacgacctgcaccgccccaaagaacagggtcctccagggaccgccggggggaagggtgagggaggctgcagcgcgagagggcacagagccaccaggccccatgcacaaggcgcaatccacccacagctcacaggagcagcttcaggaattctgcatccggaccctcnnnnnnnnnntaccaccagcctgcttgagaggggggtgggggggtggggtgaccaatgagcgccgtcgagtcgggnnnnnnnnnngccagaccccatgcacaaggcgcactccacccacagctcacaggaccagcttcaggaattctgcatccggaccctccatgccatcggtctgacagcatccagggggcgctctgaccgcctgacgctgcacgccaagccccgcagcacggccaagcgtggctgacgcggcacgccggccggcggccggcgccccggagccatgcctgcgggtcccatccagaccttgcgtcccccgcacggcgctgcggggtggccccagagacggactcgcagggctcgcgccaccttcggcgggccgggggggacttcccgtgggcgcggcgggggagcctgcaggggagtcgggctccttcccgttggagctccgcggactagcatcctttccatgtgctaccatttccagcccctcctccagctgccccagcgcctgcgagagcgcctgcgagagcgcctgtgagaggtaggcagggaggggctccgaaccctccagcgcccgcttcagctcctccatgctcctcagcacctgcccctggttcaccaggcaggcgtaggcaaacttcagggtctccagcaccgagagctgggggttgtggtggtcatctggggggcggggaggcagggggggcgaggggaaaggatggcatgttaggcgctggaggcggcggcgcgggcttaaggccaacactgccctcgggcaggctccgatacactgccctcgggcatgggtggcaagcgggcgcacattggtccacgaggccggaggcacgttgcactgtgaagctgtcgagcggctgcccgttgtattctatgctccctgtgacctgcagggtgagggggaggattaccctccgtcaggcgccgccgccacaaccctgaatgtatgctgtgtgctccagccaggcacttggcgtggcccccagcacacaacgaattgtgacctcggctggccagtcacgagcatgcccagccaccctgccccggcactgcccaccctgagtcccctgttgaccctcagccgcccagagagggcctgcaggaagaccgactttccagaacccggcggccctatcagcagagtgaagctgccctgcaggtgtgcgacaagtgaatagcatcagtgcaggcacctgtgcaggtgaaaacccaacacttcttcgtacagaagcatggaaaatgacatgacatatccatgctgcccttccattcacaactccaatgatctcctcaccggctgcagcatcccattaactccctccagaacacgcagtggtttcttggacacatggcttcgcagtagcagggtgttgaaggtctgaagagccgagttccagatgctgggtttgtcgctcagcccgacagcagcatcgacctccacagtcagatccttgtatttcacctcaatacgcggcagagcgtttgggatcagactgcagnnnnnnnnnncagcagggtgttgaaggtccgaagagccgagttccagatgcttggtttgtcgctcagcccgacagccgcatcgacctccacagtcagatccttgtacttcacctcaatccgcggcagagcgtttgggatcagactgcagggcaggggaatgggtggggttggaggaactgggaggatctttgatcgcttgagcctcaggatccgtgctcccctggtagagaatagcttcccccctcctgcctggggcatcacggaaccacgcctcgtaccgaagaacggggagcagacgctgtgggaggctggtgccctcggcagtactcccgatgacattctccacaataacatccttttcagtcctgcttggagggtaagggcttgtgcaaggatatccagtgtgggaatgcatgtatgggcgggcttcaagctttgctcacctgttcagggttttagaatgtgggtgtgcaggaagctgcagcgagacagcctggatgagttcaagctcatctagaatggcgctcgtgttctggatctggtcgctcgcagagaaaaggtcgtagacctggctgaggccctccaacccgagggacctctctggccggtccatgcgccctcagctctcacagcctcacgaaagagtagggtcaaacctcccgagttctgagcgtttttaactcacgtgccggtatgtgacgccgacatatttccttgacgcgccctgcttgggtgaccggaaaattgtattacaacattctcatccgtccggcatgtgaccgagcgtacacagattcctctcgcaaatcctcgccaatctccggagcattcccatctggtttagacacgaggtcgttccttcatagtgtcaccttttagtttatggggccttctatactgacatgaatgtacgctccagattagctccgggtgtcctcacaccagagcagttcacgaccctgggcgacctcgattgcaggcaatgagcctgatggatcgtccatttgcatatatatcagactggtcttcgagggcaaggctgaccggagacgtgcggtgcctgtgactcagggacggtccggagcgttaagcttgtcggacattcgtatagccccgcgcgcctccccgcacaacagcgaaaggctgatcgcagtcgcgtcttgttattggaggtaccaacctgtcatcatcttttgatatactcgaatgtctgtcttgcgcacggagccgcgatcgcctgcgctgtgcaggagtggccatgcatcatacatcgctcttggatcgggagctccgaagcctgatgccaagggtggcaacctcggagtaatatgggtgacaaacacctctcaatacatgcatgaagatgggtccagtcccctgtgaccatgtccctcactggctcccggcccggggccactcacaacaggctgtcctgagctccacacacagcgcatcgaagggtgcacgccacaccccaagatcagcagcgcacacacgtggctgcggccggcatacaaaaggacagggaggggtctggaagcgcacaggacctgtcggcccgtgggcgtgatgggtgctgtgtccgaccctgccgcccgccgctgccacaagggtaccccccctcaatccccccggggtcaagcggacttctcacgtcccgccggcgcctgctggccaggcaccgcggccgccggctcgccggcgaccacgccctcgtcgccatcccgggccctcgggtcccggggccgcctgcgtggcgggagcacggcgcccaccagcatgatggtcagcaccaggccgtggccatagaagcccaccgacctccacaggttccaggtgtcctgccaggtcagcacctgcatatggaggaaaggggtccaggcacaggagggggcggttgggggaaggggccgggcggggggtggaacgccgagtgcgaggcaccctcggggcgcctcgccagccgatgcccccgcatcggacccttcatggctgcccggcaccagacccgccggggcgtgtgcatgcaccccccttgccaactagccagggacaaagcgtccccaggccccagcctccacccaccaggaaggacatggcggcgtagttgagcacacaggatgtcaacgccatcttggccgcctgccagggccagaagcttcgggcccagacaggccagccctgctcgtacctgcaggatggtggggtggtggggaggggcaggcattggagagcagcttgttgacaagggatgccgtcttgtgatgagcaggggattgttcactgtaccgtccaacattggggcccaaagtttggggacagaggtggacctgaacgccagggcaccccccagctcaccgatagatgaccttggacgcctcaaacatgagcgctgaggtggcaaaaaaggcccagtatcccggaaacaggccgtgccacacccccgaggtcagctgcgtggccagcgtggtcaccaccgtgggcttgcgacccttgggggtgaggcgatcgtacacatcttggggtattccggggtggggggggtggggggggtggggggggcgctagg

SEQ ID NO: 22401 - DNA, 91 bp, Chlorella protothecoides
atgataccctcatgccgaaaagcgtcctgatttggcgagactggactgagccgctcacacaattctcactgtgcgctgggtgtgcctggtc

SEQ ID NO: 22402 - DNA, 121 bp, Chlorella protothecoides
atttgaagctttgaaaagggagagtgaggtagtgagggggctgaacttggcagagatcgagatctggcatttacacatccccctaaacaaaagcaagcctgcctgatcagacgcttcagca

SEQ ID NO: 22403 - DNA, 85 bp, Chlorella protothecoides
atgatcgcccagcaatgatcgattgattttccacagtcatagcccctgcttgtccgacgagcgtcccggggtctggcctcagcca

SEQ ID NO: 22404 - DNA, 61 bp, Chlorella protothecoides
ttcctgctgtcagtttccatcctccagacctccgtgcagagcaactcgatgccctgccaca

SEQ ID NO: 22405 - DNA, 91 bp, Chlorella protothecoides
cagcctccatggtcctgggctttgtggatcactccacaccaacagtatggggacggacttcaccctcttgacagaaggtcgcttgggcttt

SEQ ID NO: 22406 - DNA, 78 bp, Chlorella protothecoides
tgatgctaactcgcgtggggttgtgtgagcgcgctctgttcaccatgagagggtgaacgtgcacacgaccgtgcgtgt

SEQ ID NO: 22407 - DNA, 74 bp, Chlorella protothecoides
cagcgctgcgcccggcctgcgacgggtgagtgtgggtggcagggtcgatacaggcgtggctgggaatatgagaa

SEQ ID NO: 22408 - DNA, 70 bp, Chlorella protothecoides
acggaaggcccgtgtgatgagcatgcagccggtccctttcccgctgcactcagtcccagctcttcaacac

SEQ ID NO: 22409 - DNA, 72 bp, Chlorella protothecoides
ctgcactcagtcccagctcttcaacacacacacgcgactgactgtcagtcaagtactacaggtgcgcccgtg

SEQ ID NO: 22410 - DNA, 80 bp, Chlorella protothecoides
atgcttcagctccagctcactcatgcgcacggcggacgggctggactgattgcctgggtggctcactgacaggggcgggg

SEQ ID NO: 22411 - DNA, 66 bp, Chlorella protothecoides
gtcctgatggtgcaagtagtcctgatggtgcaagttgtcctgatggtgcaagtagtcctgatggtg

SEQ ID NO: 22412 - DNA, 142 bp, Chlorella protothecoides
tccaagctgctctgatcagtgagcagggggatgcagctcccgcctgaagcccatccactgactaccgaaggactgccacccaatcccatcctgtaggagcacagccgcacccagaccgagacccagctccgcgaatggctgg

SEQ ID NO: 22413 - DNA, 61 bp, Chlorella protothecoides
ctgcaacctccttgctccgatgctgtcttcaaatgcgccagaaagacgatcaagacccaac

SEQ ID NO: 22414 - DNA, 77 bp, Chlorella protothecoides
gtttcagccatcatgcatccaccaaacactttcctggctgagaccaaccttgtgcacaacccggcatcctcaatcac

SEQ ID NO: 22415 - DNA, 61 bp, Chlorella protothecoides
ccctagcccggaggagtcaccctctcagagtcctgaggagtcgccctctcccagccccgag

SEQ ID NO: 22416 - DNA, 71 bp, Chlorella protothecoides
gcggcgctttctgtgctggaacatccgtctgcagttgccttctgtggcattttcatctgatgagagtactt

SEQ ID NO: 22417 - DNA, 79 bp, Chlorella protothecoides
ggccagtgaaaaggtggacatgtcagccgcgaggcaaaattaggggtctggcggagatactcaccggtctttgggggcg

SEQ ID NO: 22418 - DNA, 61 bp, Chlorella protothecoides
ccaagcccctagcacctacatcaccaagtagtacccttccaaacacgcacagtcttccaga

SEQ ID NO: 22419 - DNA, 61 bp, Chlorella protothecoides
ccgagggcgtgcctgcgaatcgggcgggggaggatgttgtgggggccccctctccggaggc

SEQ ID NO: 22420 - DNA, 472 bp, Chlorella protothecoides
  modified_base (202)..(391): a, c, t, g, unknown or other
gttcatacctccattgttgccacatggaggggaacacggccttgtgacgcgcaagcagcgtctccttttcttgagcatgcaatactgggagctgcacggtgcatttgggttgataaacttatatcattatttcaactccagtaattgcctggttctcccatgcgacccacggcccaaagtcctctatgacctgtgctaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggcgaatgcacgattgggcttggatctcgattagttccgcgagctttacgtgcatacgggagcatacatcccagata

SEQ ID NO: 22421 - DNA, 61 bp, Chlorella protothecoides
cgagcgttgtccggcaagtcctcccgtttcacccctgcattctctgcccgatgcatgagcc

SEQ ID NO: 22422 - DNA, 687 bp, Chlorella protothecoides
atcaaacgaacgtcgtcggtgtccagtgtgagggacccaagtctgaggcagcggtgggtcattgcgcaatatataaatgaagggttacgctgcagttaagctgatcctgattgtctaggagaccgaatcgtcaagtagacaaactaaagccaccttaagactctgagagccctcgcagatgccttcgaagaaatctatgcttggctgtgtaatgtccaagaacaaaatctgcagtctttcgacctcgtaacagtgcagttcgatgttatatggcaacctcgtgaagtccatcaaaattgacgaagccgtatgcaagcagatagcaatcgacaattcatcatcatcgtatcatatggggtgatagctggcttcagaggttgaacggtgcccttccacaccttgccaatggcaccggcaaaaggagtgcatgcagacaaggctcttgcgtcttcatcggaggagaagggcatcgagtgtattggatctcaggccacgcacataccgacgtaactcgaatgattaaactcagaatgttgccgcatgaagcccatgcagatgtcaatcaagagtcttcctttataagtcacctgcacaccttgatcttcacttcatcttcacaagtcgagcctcgaccacatcaatagctacgggcatgctaggcatactcacgtaagcggcccagagact

SEQ ID NO: 22423 - DNA, 63 bp, Chlorella protothecoides
ggctcacacttccatgggggtcggccccatgtccagcgccgcaaaaaggccttgggcggggat

SEQ ID NO: 22424 - DNA, 78 bp, Chlorella protothecoides
tactaaaccccgagatcggagatcccttttgttctccattccaaactcgcattccacagctctctcgtgggatcccag

SEQ ID NO: 22425 - DNA, 62 bp, Chlorella protothecoides
ccaagggctgtgtgctgatctgttccttcgccctcccggggcgatggtggacgtcgaccctg

SEQ ID NO: 22426 - DNA, 63 bp, Chlorella protothecoides
ctcccggggcgatggtggacgtcgaccctgtcgtgcaacctgtggccgcggacgacgatcgta

SEQ ID NO: 22427 - DNA, 77 bp, Chlorella protothecoides
catgtacccaggaaattacatggccgctccataaccctaagttcgtcattgatggctggttgcagggagtcatggcc

SEQ ID NO: 22428 - DNA, 100 bp, Chlorella protothecoides
ctactagatcctccttggcatcctgcaagaccatgcatcaactaattgcatcatcagcaaaaacattcacacacacaaacgcataatgtgttaagcgggg

SEQ ID NO: 22429 - DNA, 61 bp, Chlorella protothecoides
atctgagcccttctgtccctgcagagaattacctgacaatccgtacccagaatctttcttc

SEQ ID NO: 22430 - DNA, 291 bp, Chlorella protothecoides
ccactgcacctcggggatgatgcgaactttgacattgccatgcggttgtgagacacatagaagggcatatcccttggaacggacgtcttcactgagcattcctgcctcttgatcgacgtctccctcctcctggggtaggatgtggggggcgaacactgtcaagagaccatcctgcctggagcacacctgtgagtggtccacaatcgtcttgcctccatagtcagatcttcttaaacccacattagacattcacgcaccagttttgcggcgcaattcatgcagacgcccatt

SEQ ID NO: 22431 - DNA, 61 bp, Chlorella protothecoides
aatggcatgcgaggtgctctctcgactagtgagatgaggcgcggtattgtgagggtctctc

SEQ ID NO: 22432 - DNA, 78 bp, Chlorella protothecoides
ggagatccattctcagatgcagccattaagaccatcaacccggatggttgggccgtgtgtgacccttccacgcattcc

SEQ ID NO: 22433 - DNA, 126 bp, Chlorella protothecoides
tggagcgcagtctgcacatatcgatcatgcccactgccccctgtcggctattaggagccaaaagattccccctcgcgcttctttgggcccagatgcagctccaccccccacccacccacacacgct

SEQ ID NO: 22434 - DNA, 61 bp, Chlorella protothecoides
ctccactaccctcaactttcccatggccttcatagaccccagaaacagagtggtgtgctcc

SEQ ID NO: 22435 - DNA, 102 bp, Chlorella protothecoides
gggaatttctcttgggtctcgaggtcattacaaatgttgtagtcaccccagttgcggttcccggtgttgaagcttccatggttgtcatttcctgcacaaggg

SEQ ID NO: 22436 - DNA, 160 bp, Chlorella protothecoides
agtcgggcttgccccaacttcaaaagacaaaaagctcccactgtagttgacaaggtgaagcgtgagataatgaactcaccttctctggcattgcatatccgatggacaacattcgcgaagtaacgagtttattgcaagcgaatacaactaccaggatgaa

SEQ ID NO: 22437 - DNA, 62 bp, Chlorella protothecoides
gaagtgtccccctggaaagaatacaaactatatatcaccgattccttcagtcaactcgaagg

SEQ ID NO: 22438 - DNA, 101 bp, Chlorella protothecoides
ttaccttgctcgcgcatggtccttatcccgatcaagtttttgcatgccctgcttccaatcacagaattcgagcaaagctcactcagactatgaagaatcct

SEQ ID NO: 22439 - DNA, 77 bp, Chlorella protothecoides
tctcttcacagagcttctgaccaaacgtcttcttccaagtttggtccttcatgcatagagctatgatagcctcctgc

SEQ ID NO: 22440 - DNA, 67 bp, Chlorella protothecoides
ctgggtgagttcaaggagctgctcttgcaacttccatcctggcgatgggttgcctgaggttgcgatg

SEQ ID NO: 22441 - DNA, 103 bp, Chlorella protothecoides
aatgctgtcctcaggcacaaaggagtgcgcttcacgcgtattcctgcacggcgaatgggtgcaatttatagttacacttgtttggtgaagcctgaagcatgcc

SEQ ID NO: 22442 - DNA, 61 bp, Chlorella protothecoides
acacttgtttggtgaagcctgaagcatgccatcagggaatgctcttcagatgcatatcgtc

SEQ ID NO: 22443 - DNA, 73 bp, Chlorella protothecoides
atgcagtgcggctttacttgctctgggaacggggatgagggtagagcagacctaagatcgatgtcaggcgaag

SEQ ID NO: 22444 - DNA, 73 bp, Chlorella protothecoides
gcgccgcccacagctcgggcacctgctgggggtggaatttatcgactgggaagggggtcggggttgaggagta

SEQ ID NO: 22445 - DNA, 61 bp, Chlorella protothecoides
gcctacctgcttgccctcgggagtaatctcgtactcgatgacatcttccagcaccatgttt

SEQ ID NO: 22446 - DNA, 111 bp, Chlorella protothecoides
tttcaagggcatcttgaaactgctgtcgtgggaacctctcactggccccactctcccagctctactgtaaagctgccggaacccaccatcagctcaccgctctggtctgag

SEQ ID NO: 22447 - DNA, 153 bp, Chlorella protothecoides
ttgcttggtggcagtggccgcatgctacacggagttatataagtgaggggctggtcctacatatccctgagactcacattctaacccccacgacacacacatagccccagaacactcacctctcggacgagggctgcctgcacaaacaggttc

SEQ ID NO: 22448 - DNA, 62 bp, Chlorella protothecoides
agggtggagcgggtgatcaatgaccttgggaggagagctaccgcaccgacaccagaagtgct

SEQ ID NO: 22449 - DNA, 70 bp, Chlorella protothecoides
ttcccgaatgaccggcgatgcgatgcacaacttgaaatatcatcgcgaaaagttcgggcgcgaatgttgc

SEQ ID NO: 22450 - DNA, 116 bp, Chlorella protothecoides
tgaaacagcggcaagcaggcaaggggtgtcatgccggcacctgggcgatgattctgctgcaagggcgggtgtgtttgagaagacttgatcatattgaccaagagcgaatggtcttg

SEQ ID NO: 22451 - DNA, 141 bp, Chlorella protothecoides
tggcacagccatgaataaagcagatgaggaagagccttagggtggggaatggaggatgctttctggagacatgtcgatgggcccttcatcaccgccccattttcaccccatattcacaccttggtatggggaggagtcggg

SEQ ID NO: 22452 - DNA, 297 bp, Chlorella protothecoides
catttccccgaaaagtgccacctaaattgtaagcgttaatattttgttaaaattcgcgttaaatttttgttaaatcagctcattttttaaccaataggccgaaatcggcaaaatcccttataaatcaaaagaatagaccgagatagggttgagtggccgctacagggcgctcccattcgccattcaggctgcgcaactgttgggaagggcgtttcggtgcgggcctcttcgctattacgccagctggcgaaagggggatgtgctgcaaggcgattaagttgggtaacgccagggttt

SEQ ID NO: 22453 - DNA, 61 bp, Chlorella protothecoides
cggacgatgtgcccgtcgccgaagcctgcacggaggccgggccggaggaggccggcgaggg

SEQ ID NO: 22454 - DNA, 80 bp, Chlorella protothecoides
ttgcaatgatggagctcggcgtgcacgcaaggggcagatgcactgactttgtttttccccggcgcgcgccctccttgatc

SEQ ID NO: 22455 - DNA, 580 bp, Chlorella protothecoides
gcccgcacgtcctcccgggcgcgcatgtccccccgcccccagcgcacgccgtcgcccgccgccagccccgctgcggcgtcctgctccgcctcggcgcgcggccgcagcgagccccacagcacctcggcgcacagcacgtcgccctggccgttgtcgccgacgagcacgagcgcggcctcggggtagatggccgcgtactcgcgcgcgcgcgacagcttcttggccgccagcatctgtgccatggccacccccgccgcatcggagacgggggcgtgggtgaccacctctgcgggcggggacaggaggcggaggtaggagagcagggcgcgggggccggagcccagcgaccccagcagcatggagggggaggtgtccaggtcgcgccgcgccaccgccggcgcaaagtagcgcttgtgcgcctcggactccgtcatgcccttgtacgactcggggcgggcagagaggaacaccaggttgctgccctcctggtgcaggcgctcgcccggacgcggggccgcgccccagcgaaaagaaggcgcgcgcggcagcgccggcggcggcgtcgcctcgccgccccgcg

SEQ ID NO: 22456 - DNA, 66 bp, Chlorella protothecoides
gggcgcggagcgcggcgcgctgccagcgggcgaaggtgcgtgggtgctctgctgcgtggctgctcg

SEQ ID NO: 22457 - DNA, 78 bp, Chlorella protothecoides
tgcgtgggtgctctgctgcgtggctgctcggctgcgtggctgctcggctgcgtgggtgctctgctgcgtggctgctcg

SEQ ID NO: 22458 - DNA, 68 bp, Chlorella protothecoides
actaccaggtgtgtgtctgttcgtgagggggggggtgtttggggacgggtgaaagtggccgccggcac

SEQ ID NO: 22459 - DNA, 2564 bp, Chlorella protothecoides
ggcgcaccgccagcgggcgcagcccgtccgccgcgccgtccagcgtccaggccacggcgtccaggtgcaacgtgccgcggcgccgcggcgccgcgcgcaggcagaccacggtggcctcgccggcgcggaggcgcagacgctcctcccacacctcgaccccatcggcgacgtcggttgggcgcgagcctgacgtggcgccgggggccgatgacgcggcacccgccccggcctccagccggcacaccagccgcaggcggctgacctccaggtcgacggacagcgggttgctgatcctcaggtcgatgctcaccggctcgcccacgcagcagacaggcacgcggcgctgcgcgcgctgcggcgccgcccctgttgcatgtgggtgtttgggaggggtgggggcggggcgggtccaaaagggagtaggtatggccgacgggcaggttgttcgggattctgtctggatgggtgtgcagtctgaggagatgctcggggccgcaccctatgccagtcgatgacgggcagcagggcacgtgaatcatggtgccttccccccctcgcgtgtacggggcaaattgatcatcacgagccacagcttgtcccctgaagcgccctggtctgctcatcccgttcccccttcctgctcacgcaccgtccagccaagagggccccgcctcccgcacgtccccgacgacagcgcgctcaagtggcctccacagctcggcgggggcctgccgcgcagcggcgttgccgtaccaggtttgaccctggaaaacgaggccgggccgctccaggtccatctcaggcagcggcagctccagcgggggcagcgccacctgcggcaggggtgggtcgggtgggagtgcaatgagatacagttgccccgccgctctaggtgtaccgccactgtcgtggccctcccggccggatggccctggtggggaccccggagcggcggcgcccttcgacttcgtcccacccacgtcccgtctgcgagagcagtccgtggcctgtccgccgtcccactccccccagcctccaccgccagagcaccctttcccccttcgccaagccccacctccttggcggcagccagcctgacggcgtcgtacagctggtcgaggtgggagcgctgcgtgccgggcccgctgcgctgcgcgccgagcaaggcggcgtggcagcgcgccgcggaggccaggtcgcccagctccctgtggaaggatgggcgagtggacagggagggatcagaggcggctcggcaacgacatcagatccctggacgcttgcacccacgcaccgcccagcgaccaaaaccctgtgaaaagattgccccatggccccgacccctctcccggggatgaacaaaccagccggaagcaagcctacctggcgtaccggcccagcacatcgtgcaggtgctcctccaccaggccccagcccttgcctcggtacacctccagcacttgtctacgacggcggggcggaagttggaggaatgggatgatgtgatgccactaatccacgcggctcccatcatcctgcaccacctgcaccttgcctgacccgggacacacaccgccatgtccggtgcccctcctcgtggtcctgcagcggggcatctcaacccagcacgcccgcgcatcgcggctcggcacagcacaggctctcgtttgggagcctcgccgggccaccctccgagtgccccgccctcccaccccatcaatacccctggccacctgtagcatcgctgggccaggccatcctggtcgcaggcgccgtaccgcagccccgccagcaccaggtggaaggcgaacttgcgcgctcgcggcggctgcaggcgcagcagggagtgcgcagcctgctccagcagcagccccgccccggtgttgtcttcctgcacgcgttggggtgggtgagcgggcatgtgtgttgaaggggaggatgagagcttggggaaggagggagagagggcatgccagccccttcagcagggcctgaggaggggggttctgtggagtatgcctcagcactcctggccccacctcccagcttccggcaggctcactccacccctccacacacgtccacccccgccgtcgccactcgccctgtagtgtgccttcatcaggatccagacggcgtcgccgtgcagccccgcgccgcggcagtactcggtcagcatcagcgcagcgcgcgtagcgtaccgcacaccctgtcgctccggggcgggcccgggtgcgcccggcgccgcgctgctgctcctggctccggctgccccgccgccgccctgggagtggcggtagaaggcttcgcgcaggcaggcgttgacctcggcggagggcgcgccggagagcgcggcgcagacgcccagcgcctcctgcgcgcccgcgtagtggcggaaggcgcggtccgccttcaggtcggcggccagcaggcgcagcgtggaggccgcgccgtccacgtcccccagcatcagcgccaggtccgccaggctgcgcatgcggtgcaccaacgaccccgaggggtacagcgggggcggggcgccgccgcgggcgcccgacaggtcg

SEQ ID NO: 22460 - DNA, 1452 bp, Chlorella protothecoides
  modified_base (1164)..(1212): a, c, t, g, unknown or other
gggggggggtcggataggatttagggtctcaccaacggccgcggtggcagtgttctcgcatgcacattccggttcctgattttctcaacatcgtgaataggagcaaaagtctcatgtatcgatcgaggtgtcatataaggcacgtctagggcgctccccctcttctgcaccgacgccccgcgtgatcaccatcgtagtgtcctgcctcgcctaccatccacctccaccgccgtgccatccgactgttatgtcttggtgagtcccgaggtgagctgcgaggtcgatatatcggactaccgcatattacgattgtcctagattcggtggttgctgcatgggtgggatccgagtgcatcgatcactttaggtatgctcttcccatcgtcttgcggaaacattttgcaattttctctcgtcgaagaccctcagcaccccttcccactgcattcgacaggaatggccgggctttgtgggcggctgcgtggtgacatgtgccattcacgcaggcgcaagtggactggatcgtccaacttcgccgctgcatgccgaagaggccgacgcggggcctgtgggaacatcacccacacctctgcctgccgctggccaggcgactcctcgcggagcgcgagaggcgacagccggccgcgccagctcccgcgcaggctccagagagcgcgccaccagggcaggtgggcgaggaggcgatgcagcccgacgcaaatcgcccagatgtgagtggtgagggacgaccgggaatgcaggactgtgcggagatctgtgctggtttgacacggttacttccttgcaccctcgaggtatcaactaggattcagacagataggtagcatggctatatgtgtaatcaccagtccccctcttacctacatgcacaggttgatgccactgcagcgtccaccatcgccgccgggctccagcgcctggttgaagaccgcgcgaagcagcacaagtccaacaaggacgagggcatccccagtaggcggcggggccttgggaaggctcgacgggcggcactggccaagcgcaagaaggctgcagagaaagcagctggcagccccgccaagggggctcagaagccgccgccgccgacgcacatcgggcggctgttcagccttctgccctgcagacagggctttgaggcggtgnnnnnnnnnnnnnnnnnnnnnnnnnnnnnnnnnnnnnnnnnnnnnnnnntcgacaggggcggcgtgaagaagttgacgggggtgcagcttcccaccgagaaggagtggagaatgcacacggaggttgaggtgagggatgttgccagatgtcgtggtggaggagggggtccggtgatgcagagatgttgttcactttttcacttcaagcctggggtgccttcctcaggaagctttgatagggttgccctttgctgttcattactctgtggaccggtttgcagcggtgttt

SEQ ID NO: 22461 - DNA, 205 bp, Chlorella protothecoides
ttccacaccagattgatccatgcgaccgtgggatgctgcaatgggcgagctgctgcctcagaagcgtgcgaggtcatgcgatgtaggattgagtatggaatcaccattgcacatactgtggcaagaatagggtcccaggggggtaacgagtggtgccggatgctgagcgcagcctgcccagacccccccaaccacagtgcgccag

SEQ ID NO: 22462 - DNA, 71 bp, Chlorella protothecoides
tttcgatgcatgtccttcagcttcccgtcttttggctggaagtaattctgtaagccactgatgccatgcat

SEQ ID NO: 22463 - DNA, 61 bp, Chlorella protothecoides
atcatcacttgttccagtctgcatcggctccgcaaagcccaggaatagtccaggattcgat

SEQ ID NO: 22464 - DNA, 5140 bp, Chlorella protothecoides
  modified_base (2266)..(2321): a, c, t, g, unknown or other
ggaggggttggtgggggggggtgggggaggggccgacgagatggaggatccctggtccgcgcacagcttgtactggcccgattccacggggcagtagagaccgtcccctaggtcgatgcaccgccggattacttgaccattgtacacgttcggcaggtcgcaggcctggccgtccagcgtggtgagcacctgcgctcggcaggaagtggccagcagcaagcatgctgcgaggcgcagaagcactctatggcgcattaaaggtcgacaggggccagcagcgggccgcatggccccaatggggccggaggggcggccgttggttgagcgctcttcaccctcgaattccgggaccgatcaggggctgcgatgcttggcgtcgagcatgtgtgggaaaggcatgaccatgctgtgcagagtttaaattggtggcagccaagaggccaaggtaatgagcgggtgcaagctcggctccgggggctagcttctgaatcaggtgccgagttccggaaaccctctgggtggcgcgcgcagcgcaagatccagccgacagccagggtttcattcccgctcccctctcgccgctgcgtacttttcctgcaggtagtcgtccgggaagtgccgggacgagctttaaggttctgaatcgacatctggtatttagattgaggtgaggtgctcgtgcaggttttgtgcacacacacatggtgccctcaggtgacacatggatacgacgccaccctgtcatgccagcatgtacctccccaaccctgcacactctccagcgaaccaaggcaccttgagggcgggggtctgcaccaccccgctgatgaaggcggtccagggcgccacaaccgcaccccctggcagccgctccagggccgccactgcgcggaggcagctgcgcagcaggtcgtcgttcctgtccacctcttgcttcactgcggcatggcgggcgcatagaggggggagggagctgggggactggatggatgagactaatggcctgcagcaagaaaacactgaaaatgcaaggccgacaccctctgcgtcccgacgcttggcccacctgcgtccgccttgaccttggccgtcagcgtggcggtcaacggctccaccagcgcctccagccgggccgtggtctgcttggggagggacaggacttggtgacttgatggaggagagcgatccgggtcgggtcgaagttcatgtacagctcggcatgggaccagtactctggagcgattctgtcaaaaccacagcacggcagatggggccccggccgcctgcaccctcccacaagcagccctccaacagcgcgctcgcacctgatccggctccagcgccgccaggcgcgtcagcaggatgtggctcgtgaccttgacgtcgtactggtcctgaggcggcggggcggggagaaggagagaattggagctgttgtgtgacatggctcgagtggagtcggtgacgcgcagagggctcaagtctcgctcaaccccgtttcgcgacgcagcacggtgacacaggagcgctccatgcttgatccccaccaacgcacactcgaatcacaccacgcgcccatgcaccttgaggccggaaagcagagcgtcgtgcaccgccggcatgtccagcactgcggggcatgcgtccaggaggaccacaagggcctcaaaggcggccttgcgcacctccagcccgtcgtcgatggtgtgcttgaaggggcccagattcacaaccctgcagaggtggacgcatccgtcgtcggttctccacgttcggggtctgtgactgtgggagatgcgggcggccgcggcgagtcgcgcaagctcccgacgggtggcagggcggcaactggcgcagcgcgggggccgtgccagtttcgaggcaatcacctcgttcaacccacagccccttatcatctgccgtctagtcagacccgggcactgagctcatttcccctcccagccacacatgcaacttgcctgaccaggctagcgtcgggctggcacagccggaggaggaaaggctgggcactggctacgtgcggccgcaccagcgcgggacaggcgtgtgctgaggaggaaagcaggagcacggcggtgtgccgcacggacctgtgtcgagggggagagtgacgtgtatcaggggtactgggcaaaatgtatctgctgtgaagtattcaacccatggcacacgccattgccggccaccattcttccccgtccttcgccctcgccgctccccatatcctcttaaacccccccccccnnnnnnnnnnnnnnnnnnnnnnnnnnnnnnnnnnnnnnnnnnnnnnnnnnnnnnnnccactcacaagtcagggtcgttcaggcaggccagcatgggccccgccacgccgtccatactgggcgtggctcgagcgcccaggtgcaccgtggcgtggcgcgcggccgccagggccagcgccctcagccccggggaagagctctgcaggggctgcgtcagaatggcggtgcaggcgccggcgcccagggccgccagcgtccccaggcactctgcggtggtgtgaaggggggaaggggggggagggggcggcaggagtcagcaacgctggggacagtgaaggcagggatggcacgcgcgttattaataaggcacaggagcatctcatttgctggcttgacaccccaactctccactcgtgccaagaggtgctctgtgtgaagtctgctcagcgactgcccacatctcgcccgcgtagcactccctgagcacgcaccgtcccaaccctgcttcaccctcccccccacctgccagcaccgcgttgctctcctccctctcctccgcgaccgccgctaggatcaggtccaggacggactggcgctgggagggggtcagctcctcggcggcctctgagtgcagtacctccgccagcgccctgaacagctggtactgcaggcgcggcgtggccgcggcgtccctgaccaggcccagcagcgggtccagccgcgcgcccagcgcgccagaggtcacgcctgtttgagggtggggggggcggtgagtgggggcgggtccgtgggcggggggccagcaggaggggggagggagatgtgagcaggtgcgaacaggacgatggcagagggcggcacgggactggcgcgttcctggaaacccaggcacacacgcccccttcccctgcctccctccagggctcgcgcacttcccagcgctgtggcagcggcgtccgccacgtcctcggcggacagggcggagaggagggcctcgagcacttgtggcagctgccccaggtccctgccccgcccgatctcgcccagcacgcccagcgcgaggcgcctcgccgccgcctcgctcctgccaccctgcaagggatcggagggggtgggtcggtgggtgggcggcgatcgtcgagctacatctcactggggcattgccgtccacatgtgttcgggcggtggataaacctatgtgaagagaaccccatccagaggggtgtaagaaagggcccagcgacaagagtacgccaatgacatgcaccactcccagagccagccctcccgacaccccccacctgcagagtgtgcagcaggtgctgcagcgtgccctgcacccgctcgtcctcggtggcacacagcgcgcacagcgctgcgacgcagcgcgccagcgcgaggtgcccgcccggggcggcgccggccgccgtcagccccttctgcatcaacgactcgcgcagctccgcaaaggcggccgcgtcgccgctggccagcgccaggcgggcgaagaaggactggagcgccgtgagcaccgagggctggagcaggggggaggccgccagggtgagcgcccccgggagcacctggacacgagtacagagaggcaatgagttcatgagagggggtgggtcagtgcgctgattgcaagaattgccagagtagggctggccttcacacgcgatgtgtccttcctgggcaccgcacatccccgcggtcagccccccatgggccccgccttcctcccctcatccctcgtacctttgagcgggctgcctccagcgcggcctcgggctggctctccagagccaccacggccagctgcagcgccagccccgcgtgcatcagctccgcctcgctcagctgagtgccggcctccgccacgacctcggcgagcacgtcggccggcagcgaggccccctcccgtgcgaccagcgcctgcatgcggaggtggatttgtctgggcggccgtggactctgccagcaacaccagggcccagcaggagcttgcaccaaagaatgccatcccgagcatcagctacttccccacacacaccttcagggtcctcagggccgccaggcgcagcgagcggcttgactttttcaggagctgagtgaggtcccgcaccagcttctccagcactggcaaatggaccaaggagtgtttgagggatgggtggctccacatgcacgaccagggcatggggccaccgagcatcggcctgaacaggccagccaattggccgtcccgcccagccctctgcactcgcggcacggctgttggtggtctgggggtgcggcaccacatcctccaacgcaccaggggtcaggttgagggggcgggaagaaagggcgacctgctcaaaggccctgatggcagcggtggccgtggactcgccgtgcaccctttccagcagcagctccagcatctgtgcgctcgggttgaaggggggcacttggagtgtggaccagcgtgtggccgtgcgacacctcctgcggcgcgtgtaccgctcaacctcctcccaagaaacccacctcccgcacctccgcgctggggccggcggcggccccgcccgccgcgccaacctccgcgccgccgccggacagcttggcgcgcttggaggtgcgggccttgggcatggcagcgaactcgcgcgtcagctcccccaccgcctgcgtctccaggcccagcgcgtcgcccagcgccgccagcagggcggccgcggccgcgatggccccctccttcacctcctggtccagatccacggggcgcagccgcgccagcactgccgtcgcggcgtcggcgagcgcgggcgcgggcggcgacgcggggtcgtgcttttcgcctccggcaccggcgggcgccgcgccagccagcg

SEQ ID NO: 22465 - DNA, 87 bp, Chlorella protothecoides
atcgaagatggcaggacatcagctcaagcgatgtcctatgttgtcgaccaaaaacttactgtagccctggaccacttcgccgggtgc

SEQ ID NO: 22466 - DNA, 61 bp, Chlorella protothecoides
gtatccgcagtgatcgctttgcgtaaaccagccttcatcactgctgcaagccgtgtgatca

SEQ ID NO: 22467 - DNA, 80 bp, Chlorella protothecoides
cgacccctggcatcacctcagacgaccctctccccccccaacataaaaaaacccaacccacaggcctgaactgcgggcgg

SEQ ID NO: 22468 - DNA, 123 bp, Chlorella protothecoides
caagcttccgacatgtccgaagccagctcgccccctttgcagcagagttcgggtttctccatcttcattgtaatgtgtttcaggctgccgttatcggcagtctgcgtgcttgcgtctcctagc

SEQ ID NO: 22469 - DNA, 61 bp, Chlorella protothecoides
gttgcgaactctggtccacgtccttgcttggctatttccctgaaggtgtcccttagtacga

SEQ ID NO: 22470 - DNA, 813 bp, Chlorella protothecoides
  modified_base (185)..(194): a, c, t, g, unknown or other
  modified_base (380)..(389): a, c, t, g, unknown or other
cgcgagcccgaccccgcgctgcagctcgtggcggcggggggcctggccgacctggtggcggccctgcgtcgtcgcacccccagccccgtcgacaagtgaggctcgtggtgcttttggattgcgggggtggggggaatgaacgccggtcaggggaagattggcgggcgggggaagatggcccggtnnnnnnnnnnttcttgggctgcgggggtgggggggatgaacgccgggcagggggagattggcgggcgggagaagatggcccggtcaccctgggaggaccaatcacgggagggtatcgtacaaataaacaaatgctggagtgcgggagcatgcaggactggacctagggtgctgggtctcgtttggcatcgtggcgnnnnnnnnnncaccctgggaggaccgatcacgggagggtatcgtacgaataaacaaatgctggagttcgggagcatgcaggactggacctaggggtgctgggtctcgtttggcatcgtggcgtccagatggagccgtgatttcgttgcgcaccgacgtgccctcgctcctctcctccctccaaaatccttgctcctctcatatcatgcccaggattgtgaagaacctggtggggtttgttaccggggaccgcacgccggatgctgccgcgccaccgccctttccacccgaagacgaggatgcggaggccgccggcgccacggaggcggacgacactggcgcaggccccgccgccgcctcgccggccgtgctggcgtgccggggcggcgaggccgcgctgcgggcgctggcctcccgcctgggcgacgacctctt

SEQ ID NO: 22471 - DNA, 72 bp, Chlorella protothecoides
ggcgcggcagcatccggcgtgcggtccccggtaacaaaccccaccaggttcttcacaatcctgggcatgata

SEQ ID NO: 22472 - DNA, 78 bp, Chlorella protothecoides
agacccagcaagtacagtactgggcatccagaagtccacagggcaccctcaatgtctacccctgctgggccctgctag

SEQ ID NO: 22473 - DNA, 116 bp, Chlorella protothecoides
cattcggcctgatctcagctgcattgtgtcccccacccagcaaggtatgtattgcatgattgggggacgggagagcactgcacactggagcaggacatgcgggtttgcagggatca

SEQ ID NO: 22474 - DNA, 65 bp, Chlorella protothecoides
aagatattgaaagaggtaagatgcaagtgagtttcttaatgttcaggagtcttctcatgctgcga

SEQ ID NO: 22475 - DNA, 71 bp, Chlorella protothecoides
ttaatgttcaggagtcttctcatgctgcgatcttgggttgcacggatgagactggcaagctttgatcttag

SEQ ID NO: 22476 - DNA, 71 bp, Chlorella protothecoides
ttgaatcggtattcagcactggattgctctggcaagctcccgcgtcccccaaccactccctgccctcacag

SEQ ID NO: 22477 - DNA, 116 bp, Chlorella protothecoides
cacacctcttgggacagccgctgcccggctcactccctctatttttgagtgctgttgctcgtgctgagctggctgcgtgtgactcgttgccagggaggccaaaggcagctttgcac

SEQ ID NO: 22478 - DNA, 1580 bp, Chlorella protothecoides
cccgtagcgcccttcccgccgccgcagtcggccaagtacaaggtgccgcacgcgtcggcgcccggggtcgtggtcccgccgcccccgccgccccgctcccgcccgcaggcggagggcggggcacgccaggcaggcgcggctccatgcgagcagcccggcggcggctgggaacccatgggcagtgggcgcagcgggtgagggtcggaggggggtttttggtggggagttgtgcctggatctgcgctggttctgccgaccatgtaccaccgttgcagtggcaggctgggatcctgttacatgccagcttcatcagtacctcatccttgctgacccatcacaagagacccatgacgacacacacttgacaatcagccgagtgggaggacactcctgtttcccccagctgccgatcacatatttcttcacccgaggtctctgcatccgatgcccctgctcagaaatccatggacgttcatggtctgttcagcacgtaaacttcccttccatacactctacacgatgcgcgcagggaggatgtgcaaggccccagcatactgcgtgccgccgcctcgcggcagccgtccccgacgccggcacgcacccgcacgccgcccgcctacgccggccccgccaccccggccctgtcggctccggggccaccccatggcacccctcctgcaaactgccatggcacccaggcaggcggctggcccggactgatgcagggccaactagcagtcggtcatggtcaggcgaatgcccaggcgacggcccaccaggcccccgcctgggagccgcagggcggcaccacgggcgagagcctgcgccagcaccacctcgcgcccagcctgcccggcgacccctttgctgccgcgccgccgccgcgcttcgacgcattcaacggctacggccgcgtcgcgccgggcctgggcgagtggccggcgctgcaccagttcgaccccgcttcgctgctcggctggccggcgcagggccccgctgcgggccccggcgccggggttgggccgggggatgtgctgtgggccagccgcggcgaggcagaggggctgccaccccatgctccgcccgccgcttccgcgtatgccggctttgatctgggaggcggggggtatgcgccgccgtctgggccaccctttggagcacgcgaggccgaggcaggtaccatggacgactggtccgagctccaggcgcagctgccttctgatctgggtgatgtgctgaacctctgaccccctgtaaccaggacccgcctatatgacacgcagtgggtggacaactgtggccaaaggttgtgggggggttggggtctggtgcacaggtgacggagcaggtcaacccgctggcatccacctcacggctgctgcttggcgaggaagccagcgagggagcgctggccgggcgggcggagtttctcctgcggcacggccacgggcttgcgacggggtggggccgaggatctcgcagtttcgccgggagctgcgtctgtccctgacgtcgtgtggtgcggagcagcaccagctggcgtggctgcagcggtggctgccgtgtcaatgctgccgccc

SEQ ID NO: 22479 - DNA, 81 bp, Chlorella protothecoides
tgcaatcacaccacccgtcgctccgccctggtccacacttaaaaatgacccccccctaaagccgactctggcgaaccccca

SEQ ID NO: 22480 - DNA, 61 bp, Chlorella protothecoides
gcactagccctcagactttggtgcctaagcacccccccattgacacggcaattgagctgcc

SEQ ID NO: 22481 - DNA, 61 bp, Chlorella protothecoides
ggttggagggcgttttaggagggtttgggcacccggaaggggcgaccttgggagtcaggcg

SEQ ID NO: 22482 - DNA, 61 bp, Chlorella protothecoides
catgtacactcctgtaacaatcccgagcgtcgaccttggccctgcatacgggtcccagcac

SEQ ID NO: 22483 - DNA, 61 bp, Chlorella protothecoides
gccggccttgaggcactccacggctaccagtatctccgtagagcgtggtgtcatgatctcc

SEQ ID NO: 22484 - DNA, 83 bp, Chlorella protothecoides
gacagcaatgctgtctgagatggggaccgctgcatgggaggaggaggagacttcctgacaggtgggggaggcgacttctttgc

SEQ ID NO: 22485 - DNA, 78 bp, Chlorella protothecoides
atcggtgagctggatagcggaagatggtgactggatgtagagggtctgaagcgatggaatcactaccgtccttcctca

SEQ ID NO: 22486 - DNA, 61 bp, Chlorella protothecoides
tgacatgcgggatgagcagtctagagaaatcgtgccactccgcacattgggttggcgacat

SEQ ID NO: 22487 - DNA, 61 bp, Chlorella protothecoides
ttccaggagcttggtgtcgggaggggcgggttccgcggcagtcatggcgacagaagccgta

SEQ ID NO: 22488 - DNA, 61 bp, Chlorella protothecoides
aggcacacggttccggcggggcctggggccaaggggagagggtggggccacgctgggttcg

SEQ ID NO: 22489 - DNA, 115 bp, Chlorella protothecoides
tcatgaagtctgacaccgcgcacatccatgcttcaaatatttcactcctcgcatccctgcaaagggaacagcttacgagtacactccgtcagaaaaacaaacaggtggccctgcg

SEQ ID NO: 22490 - DNA, 61 bp, Chlorella protothecoides
ccggggatgtgcacgatggcctgtggcggaagtggcgctccgcatccgttgctccattggt

SEQ ID NO: 22491 - DNA, 79 bp, Chlorella protothecoides
gtggcgctccgcatccgttgctccattggtgtgctcgtgatatctgatcatcgcctgtacgtttgagagacgatgccaa

SEQ ID NO: 22492 - DNA, 137 bp, Chlorella protothecoides
ctggttccactacgtcatgctggcctggctacccacctacttcaccgaccgtctggcgctcgacctggacggcgccgcgcgcttcgctctgctgccgcccctggccgccatcgccgtctccttcgcggcaggcaaga

SEQ ID NO: 22493 - DNA, 67 bp, Chlorella protothecoides
aagagtatcgagtacagagcgatagaacgctgtcataacacatcggtcgtgcccgatgggcccctgg

SEQ ID NO: 22494 - DNA, 61 bp, Chlorella protothecoides
gtcctgagctggttctgatcccggggctggacccctccccccgtgctgcttgcggatgctc

SEQ ID NO: 22495 - DNA, 130 bp, Chlorella protothecoides
ggggcagtgctgaaggagtatgtgggtggtcacgccgttccattcccacttcgcgtcagaagtgtacacgggtgcacctcgcagcaccggggaggaagcggggagcaggcaagggccggcaacacggtga

SEQ ID NO: 22496 - DNA, 62 bp, Chlorella protothecoides
gaattgggagtatggatgagggacgaggaacagggagtatggatgagggacgaggaattggg

SEQ ID NO: 22497 - DNA, 61 bp, Chlorella protothecoides
tggatgagggacgaggaattgggagtatgggtgagggacgagtaattgggagcggagaggg

SEQ ID NO: 22498 - DNA, 109 bp, Chlorella protothecoides
gaagaagggggcctgcaatcgtgcactcttatcatatcaaaccatgcgtccaaatgccaatccgccatccctgcaatcctgctcaccgatgttgttgttgccgtcgttg

SEQ ID NO: 22499 - DNA, 71 bp, Chlorella protothecoides
cctgcacattgcagctcagatgtgatgtataggccccagaatgcaccatctcgtaatgtcctctcccagat

SEQ ID NO: 22500 - DNA, 61 bp, Chlorella protothecoides
tgcaccatctcgtaatgtcctctcccagattagattccagcatgtgtgcgcaccgagcggc

SEQ ID NO: 22501 - DNA, 61 bp, Chlorella protothecoides
acgtccatgccaggtccagcacctgggcgttgaagaagcgagaggcgcagaagatggggcg

SEQ ID NO: 22502 - DNA, 68 bp, Chlorella protothecoides
aaaccccagtaacgcccagctacttccctcatcccgctcaccgatgttgttgtcgcccacattcttgt

SEQ ID NO: 22503 - DNA, 74 bp, Chlorella protothecoides
cggcatcctcgacggccattgatatgcacagcagcgtccgcgccagcgcttgcggcgcttggcgcagcgtggga

SEQ ID NO: 22504 - DNA, 382 bp, Chlorella protothecoides
  modified_base (112)..(283): a, c, t, g, unknown or other
aatgtccgggtgtcgctcggagcagtgggcgaccgtacaggcatgcccagtgtccatatcctcgctcatgggcttcgcactgttgccatgcaggccgaatgcaagtcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctacaaagtaacctcgaattcttcaaccccctcgcagtgtggatggtgagctttacttgatctcggagaaaagcggcccagcattctgccggtgagac

SEQ ID NO: 22505 - DNA, 499 bp, Chlorella protothecoides
  modified_base (124)..(376): a, c, t, g, unknown or other
gccgagaccttggcactcccgcccatgcagttccaggcaccacacactgctatcgcctctttgccacaggacaccatcaacgtgtcgccagcaacccttccggggtacgatgagaagatcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggggacatgctggtgctgcccgaggggatctaccaccggttcacactggacacaagcaaccacatcaaggtgcgcagtttgaagctgctttgggatggtgcagaagctggagtgggtacat

SEQ ID NO: 22506 - DNA, 67 bp, Chlorella protothecoides
cacccgatgttaaaaatcaaccttgtgtatacgaggtagcagcgggacccaggcgtgatggccctgc

SEQ ID NO: 22507 - DNA, 78 bp, Chlorella protothecoides
tgcgtggcctggtctctgcagacaatgcatggggcggctcggatgttcagcgatgctccttgctggaccaggggaagg

SEQ ID NO: 22508 - DNA, 274 bp, Chlorella protothecoides
atcttcgtcgccgtgggtgaggcgggggggccgagggtgaatggggaaccgggggcgcgttggaggtgcagggcccccccatgaatcagccctgcgtcgccggctccgttcgtggtcgtggtcttcctgtgcccttcctgccatgcaccctcaggcatgcataaaggtagactttcaacacttccatgcacttacccaccccacacatcaccccaacccccaccccctccaggcggcggtgggttgatcgcgggcatcgccgcctacgtcaagg

SEQ ID NO: 22509 - DNA, 61 bp, Chlorella protothecoides
catccgtcaggtgttcagcagtgcggcgggtccgtccagagaccaaagcgcgtcatttgtt

SEQ ID NO: 22510 - DNA, 80 bp, Chlorella protothecoides
caggtgtttgtgctggtagcagaccctcagggccagatcctggactgcaaggagtacctcgcccccatcatcacacacca

SEQ ID NO: 22511 - DNA, 79 bp, Chlorella protothecoides
gaggtactgggagtgtggtcgaggactgggaatagggtgtgccacggcttgccgcaattcatcctgatcgccgcgcctt

SEQ ID NO: 22512 - DNA, 153 bp, Chlorella protothecoides
gcaggggcatgggtggaggctgcctggtgaatgacgcattggcaaagggtcattgttggccagacgaggggcttgagggtcctgtgcaaggcagacttgaagggaggggtggctgaccagcatgtcatggagtgccctgcagcgccaccgcac

SEQ ID NO: 22513 - DNA, 102 bp, Chlorella protothecoides
accggctttgagcaccctcgctggctcatcctgacagccaacatcatggtggtcgtgcacatgctgcctgcgtaccaggtgtggcttggcacagcctgggac

SEQ ID NO: 22514 - DNA, 174 bp, Chlorella protothecoides
tcaaggactcacatctcccagcaggtaggtcggcatgcgggggctgggactggtagctttgattttgtgttccctgcgctccgcacgcagcctctagaatgatcaccggtcaagctttcaaggttgcctaccacttcgcccccatatcactggaccagtgcaggaggaagccaa

SEQ ID NO: 22515 - DNA, 162 bp, Chlorella protothecoides
atgcaggtgacagacctgtcacaccctgtcaagcgcaagcggtatttttgcgtgaatgcttgaatatctctcagtcagcaggtggttcccaggccgacgacaattcagctccaagaggcacatttgagcagcctgcgcccaatccccagacagcacgcgcca

SEQ ID NO: 22516 - DNA, 145 bp, Chlorella protothecoides
cagtaccagctgctgcattgaccccaccgcgttggcgcatcacttccacaacgtcgagccagccgagttctacacaaccaacactccctgaccctcacagggatgacgcgagatgctctgccaagtacggcaaatactgggacca

SEQ ID NO: 22517 - DNA, 61 bp, Chlorella protothecoides
tttcatgtccctccgctcggcatcctcaccaccaccccttccacactcggcatgcagaccg

SEQ ID NO: 22518 - DNA, 93 bp, Chlorella protothecoides
tcactgccatacgaggtgtggagagctggcagctgtgtgctggagttcttcgcagtcggccatgtgactaagtgctgttatgagacacaactc

SEQ ID NO: 22519 - DNA, 111 bp, Chlorella protothecoides
acagccagctgtcaacaattcaatgcacacagcctcacctcctgtaagccgagcatactacgtccatggttggtggtggagtggagggtgttctgcagctcctcggagaag

SEQ ID NO: 22520 - DNA, 75 bp, Chlorella protothecoides
gcctgcgaatatatcgctgttgtgtctttcgatctgatgaagatgtgatgtagaagcggtcccatggatgtctca

SEQ ID NO: 22521 - DNA, 78 bp, Chlorella protothecoides
gcccgcagggcatccacatacggaccaggtctaaccttcccggccctttccggccccacagagctggaggagctgttc

SEQ ID NO: 22522 - DNA, 61 bp, Chlorella protothecoides
cattgttacatgggcacaatgtgctcgaggacctgcctcaccgacaatgtgcatcgcacca

SEQ ID NO: 22523 - DNA, 205 bp, Chlorella protothecoides
tgacacaagatatccaggtttggatgtaaattttcacaaatggaggcaggaggtacgtcccgtaaatcaggtcactcattcacagtcggtctcccagccctaattttccggaatggtcgacaagataccgatcagtccccgcaattacatatacaatataagcatatgaaccccgcaaacacccccgagggcccgctcctactca

SEQ ID NO: 22524 - DNA, 108 bp, Chlorella protothecoides
ggcagccccgaggaggaggaccagctggccaaccacctgctgtcgcaggcgcccagcgccgccttctgcgccgaggttgggggggggggggggggggttggggggggg

SEQ ID NO: 22525 - DNA, 69 bp, Chlorella protothecoides
acgaccgacacacaatcggtggtggtcagcgtagttgatggggtgatgtgcgagttttaagtcacgata

SEQ ID NO: 22526 - DNA, 70 bp, Chlorella protothecoides
tgaactcgagcattgcagaaatcactaggcgtctgggtggagtggtggcagggagagttggggggggggg

SEQ ID NO: 22527 - DNA, 647 bp, Chlorella protothecoides
  modified_base (101)..(156): a, c, t, g, unknown or other
atagtaggaaggtatttggcacctgctctgacaatgatcaccgcccagggtcagcgcttagagcggcctactttgccaatgcatgctctcagtcacgcacnnnnnnnnnnnnnnnnnnnnnnnnnnnnnnnnnnnnnnnnnnnnnnnnnnnnnnnnagtcagcgcttagagcggtgtcctttgccaatgcatgctctcagtcacgcacctggcttccatctcgggatcgactttcactttgtcaagctgtctgactggggtataaaaaccctcatcatcggaatcagaatcagagagttcccattctggatgtgggtgaaaattcaacgtcccatcatgtgcctgcaaagggatgaacttgctcagcaaggtacgtatcgggcatggtagcacacagatgtatgaaatctccaaagaagcggcatgtcctcaccaagccctcaagcccagccctccgggagtgctcaccgcggagacgtctacatctagccttgcgccacctcccttagccgcgatgacagcgtcattgtgaggcaactctcgcggaaatcgctttttgcacaaccacgagctgcagtcacgtacgattgaggtgtgttaggcacacgggcggtcgcgaacatgcagaggtcttcaaggcaagcgta

SEQ ID NO: 22528 - DNA, 269 bp, Chlorella protothecoides
gcgacagagcagggtcgtcctgggtctgcccatccgcgaacgcaaatcaaggctgcacggatgtggcacggcatgggggccaaagggataacaactcctaaggcgcgcaatatcaggcacttgtgggcacgaccaccgcccagccgccccaactcccttccatccctggcgcagcatgttgtttccttgaccctgacttacacctgtgctgaggaaatctattcaagcttggctcatttgggagcgcccactcgctgacgaccccctgc

SEQ ID NO: 22529 - DNA, 72 bp, Chlorella protothecoides
atgccatgcgattcatccgcgccgcacccacgcaggcgcgccatggccgaagccctggacgagcggcgcgac

SEQ ID NO: 22530 - DNA, 61 bp, Chlorella protothecoides
gcacagcccatgctcgtgccgctgcagttggctgcagtgaagaggcccgcaggaggatttg

SEQ ID NO: 22531 - DNA, 74 bp, Chlorella protothecoides
ctgcagtgaagaggcccgcaggaggatttgaactccaaggcggctgggctctcaggccacaaggttgaggagta

SEQ ID NO: 22532 - DNA, 77 bp, Chlorella protothecoides
cttgatttgatgcacatgcattctatgtacgatacctcgatacatggatgaaatagtttgcatcctgcaggcacgtt

SEQ ID NO: 22533 - DNA, 61 bp, Chlorella protothecoides
gttgaagggggtagtgccgcgtgtcgtatcacccccacgcgggtttcattaccgcgtttac

SEQ ID NO: 22534 - DNA, 69 bp, Chlorella protothecoides
tgtcactcttcgcacccatgcagaggtgctggaatggctagcaccaattgccccagtgacggcagtccg

SEQ ID NO: 22535 - DNA, 170 bp, Chlorella protothecoides
acggcacccagaatcgtgtagcatggcatctgaggcatgccacgaaggtttgtagtctaagtacaccaaataatggagatgcagggcctttggatgccatactcgtactaggagggggcctacacgaggatggcaaggtacctccctgggctactcggcgccttcagctg

SEQ ID NO: 22536 - DNA, 147 bp, Chlorella protothecoides
gtggtcctgagactggggtgggtgcggggatgggaagggaggagggcgtcggctgcagcaggcgggtgcgcatgcgtcccgaacgcagcacatgcgcgcgtccatggcggcgcatggcagcaacagggagcggcagcccaggcgcgg

SEQ ID NO: 22537 - DNA, 272 bp, Chlorella protothecoides
aactggagtggaggcactcaaattcggcttggattccatatgggacagctcggagtctttgtaaggaccactcagcgtcacccctgtacatcatggaaagattgattttgaataatcagggatgccgctatccatggtcccatgtcgattacacaacgtcaccgctcttttcagatagttgaaagatggtgtactctcatcgctagcaaatgtgcgcacaccttctctgtgtgcaaccatgtcacatataatgcaccacatttcccaccttt

SEQ ID NO: 22538 - DNA, 71 bp, Chlorella protothecoides
cgccctgcctctctgtgcactcgcccccgacgcccccccctcccccccaatcgcgtgcgctggcgcaggag

SEQ ID NO: 22539 - DNA, 10236 bp, Chlorella protothecoides
  modified_base (2645)..(2729): a, c, t, g, unknown or other
  modified_base (7153)..(7263): a, c, t, g, unknown or other
ccgtggggcggccgccgtcgccgcggccctggccccagccgccgcggccgccgcggccgcgctggccgccggggggcttgcgcaccacacgcgtgtccaccagctcgaaggcctcgtcctgtgtggcagggattggaggggcacgcagagggggtgagggaggggagatgctgtgactgctgagcaagcgctgctgttcccatgtgaagccgctatgtttcttttctggaacccaggcgatggatccagagagcccatggcccgctgcatatacgatccatgttgcccatgctacactatagaatgactcgatcacatacttccccaaatccagcgcccccacctcctcgcccttctcgaagttgaagaccgccatgcccggcagaatttcgcggtcacggtaccgccctgggccaggcgtggaggggtaagagtgtgagccaaatgcatggcttcaacccacaggtaagcgccccccatcttcctcccctgtccgggcaaagtcgcaccctggtatccacgctggctggcctgctggctgaagtcggcgatgcggcccaggcggtcgcccttgctgtatggcatgaatgggacatcgcggaatgcctccggcacggtggtggggccccagtcctcgtcattctggtcgatggcgggcagcttgaagcccggcatcctgctcccaggggggatcgtccaagtgcggcgcaggcgctctgtgtcaatcagtgatgcacggtcagggggtaagactggcgactcagagctggtctcagaagtgcttattaatctcgtgcgacctccacgtcgactgaccgagacagcgcaaaggcttggctggcttggtccatcctttcctccccagccatggagcgcttctgtcagagcagctatcacaaatccacgaaatcataaaagtgcagttcttgacggaccgtcatggctgattgatgcgacactcgtgcgcgtctcgcttcgttcaatcactgggtattacattagaagccacaaaaacatcatccagatcgctgtgaattcttggcagaatgggtgacacggagccccatgtcgcccccaccccccggcacacaaagttcaacccagcccagctggacctgtctctgtacccaccactggaccagcagtgcatcgtcctgacacaggaatcagactcgcccggtacgggcgccgtgcgcaggtgatcatgagcatgattgggtaattggtaggttgccaaaaccctaaatcaccggaacctcctcccgtaatcggccccctccccccgcgaccacccatcatgcaggaatgcccggcaccctgatacgctggtagattcccttcccgacccagacggccacgtcaagacggcgtatgagctcctggagctgagtatcgccaagtatggccaggtgcgggcatgcttaggaggggggccgtcgtggaggggcctgagactcttgattaaggtcacgtgctgcgatcactgctgcgtgcagggggtccactgcttgcctcggtgcttccctgcaccaccggctgcccctcgcagctgcgcttgtggggatgtgtgtgcgctccgaccaccggctccgtccgatcccaccccttcccgctctcacacccccctcccgccccgcagagggactacttgggcacccggagcgtggacgcgcagggcacccccggcgcctacacctggcagacctacgccggcgtgggccaggcgcggctggagatcggggcggggctgcgccacctgggcgtggcccgcggcgcggcggtgggcctctacagcgccaactgcgcggagtgggtgctggtcgacgccgcgctgcatgcgcacgcgtgcgtcggcgtgccgctgtacgacaccctgggcgcggacgtggtggcctacatcctgggccacgccgagctggcggcggtggcctgctccgccgccgtcctccccgcacttctggagacgctgccggcctcccccaccgtccgactggtggtggtctacgcccagccgcccggcttctcgccgccggcaccccccccggggtcacacgcccgcgtcgtctcgctggaggaggtgcggggggcggggcgcgcccacccgaggccccccgagcccccggccccggccgacaccgcgctcatcagctacaccagcggcaccacggggcggcccaagggcgtggtcatcacccacgccaacatgatcagccaggtggcggccagcgtctgcgccgcccttcccctcctcgtcgccagtgcgtggctttgctgttttgggcgggtgttgttggagaatcgggggcgagtggaagatggggaaggggaacaaggtggactgaaccgcattgctccgggtctgtatgctcgtttccttgtcggggggtgcttgctccccaagcccctcccgtggggattgtgcagcatggcttcaccatccccggcctcgcgtagtcccccccctgcttcccccaggcaactcgcacatcaccccctccccctctccccccacctgccaggccaggccatggagcgccacgtgtcctacctccccctggcgcacatctatgagcgcatgacctacgcgatgtgcacctacctgggcgggggcctgggcttcttccgcggcgacccgcagaccctgnnnnnnnnnnnnnnnnnnnnnnnnnnnnnnnnnnnnnnnnnnnnnnnnnnnnnnnnnnnnnnnnnnnnnnnnnnnnnnnnnnnnngctgtggaaccgcatccacgccaaggtcatggcccaggtggcggccagtagcgcggtcaagagggccatcttctgggcggcctacgggtacaagcggcggcgcatggcggagggggacatgacgggcgggcggtgggcgcccttcttaaatcgcctggtcttcaacaagatcaaggccgtggtcggaggtgggaagaggtggctgtggttgggactgctggggttaggagtctgggggggagcattcaatgccccccccaaatttgatcaatgctgcagcggcagtcctgggttcctcatggagaccgcccccagccttgcggaagccttcccacagagctgccatccaatgcactctgcacctcctcaaccccctccaggcgaggtcaaggtcatgatcagcggggccgccgcgctctcccaagatgtcttcgagttcctgcgcgtcgtgttcgactgcgtggtggtcgagggctacggcaccacaggtcagggtttttagatgggctggaaggtgacaggtggtggaggggagacccttgtgttttgggagggctcttcctctggcaaggttttgagcgactccatgctctccgggccaggcatcgcatggtgctttccccacctgaagatgaggtgaatcacactgtacccctccctctcatccccaccaccccgccctctccctcacatccttgctaactcctggcagagaccacggccgccgccacggtcaccacccccggcgacccggtggtgggacacgtgggtccccccctgccatcctgcgagattcggctggccgacgtgcccgagctgggctacaccagcgcggacctgcctgatccccgcggcgagatctgcgtgcgcggcaacatcgtgttcaaggagtactacaaggacccggagaccacgcgggagacgatcgacgcgcaggggtggctgcacaccggcgacatcggcacctggctccccggcgagcgcctgaaggtcatcgaccgcaagaagaacatcttcaagctgtcccagggagagtacgtggcgccggagaagatcgagggcctgtacacccactccccctacgtcgcccaggtcttcgtccacggcgacgccctgcgctcgcgcatcgtgggcgtggtggtgcccgaccaggaggccctcctgccctgggccgagagcaatgggctcgagccagacctgggccaggtgggtggctggccgtccggggtggggaatgctgatgaatggctttcactccctgggcacgactgccgggcgtcctggcgcttgtctggagccccactgtgctgcgtgtggttgcgagtgcctggtgacgtcaggaggagtggggcagctgcaggtgtgtcacccctctggccagcttcccaccatgacctgcagttgtgtaaggaggagcgggtgaaggccctgatcctgcagagcatgctggaggagggtcgcgccgccaaacttaacggattcgagcaggtggtggacatcaccctgacgccaaaccccttctcggtggaggccgggacgatgaccccgaccttcaaacccaagcggccccagctcagggccgccttctctggcgccattgcagacatgtatgcccgcgcgcctgcctgagagtgtcttgagactaccactccgatgacccaaaggccggaggctgtctgaaaggcctggaccttgaacggctatctactacatcccttcatgcctggttgacgtgccgccctttctgcaatggttgatctcaggctgggttgccattgtatacttcatccttctcattgcaagaaccggtctgagggcatgcatagcctcgtgacaacatacaggaggtggccaggtctgcacatcgaagtttagacatgccatggtcgtgctgaagaggcgtgcgcagccccgcgcgcgagaagtaatctccgaaaccccgtcagcatccccggtgtagtttatgaaacaccatttagaaagacctcctccatcgacttcgtgcactgtttaaatatacttgtgacgagacttttccaatgcagcattccaacaatcgtatcagggtcctggctgggcacctgccccccgggcacgaggcgaccagtgagcaggcaaccctgaccacgtctcccaccctcgccctggacatgtccaccttccctcccctggatgcgcagtgcgtggtacttcctgagaagctcaacgcacccggcccctggacggtccgcaggtgagccctgggttggttgccgtgccctcccgacacagcggcagcgggcctcctgcgcgcctgtgctgtgaagctgcagggtcccagggatcgaggtaccccactttccctcctcccttccaggaatgcgaactttcccgaagccctgatcgactccttcgatggcgaggagagccacgtgaggacctgctacgacctgctggagcacagcgtggtcaagtacccagatgtgcgtgggatcctctgtggcatcccaggccagcctgcctttggagtgatgtgattgcactctcgatacacgcgaccagctgtgcgctgggtttgatgcgcgcccatgcctgcactccgtgtgcctgcctggcgcaaaccctcgccgcttcccaccccgctcccctctcatactccccccttccccctcgccacacacagagtccgtacctgggcacccgcagcgtggacgcgcggggcgcccccggcccctacgcctggctgtcgtacagccaggtgggcgaggcccgcacccagatcgggtctgggctggcgcacctgggcgtccgccccggctccaatgtgggcctcttcagcaccaactgcgcggactgggtgctggtggacgccgcgctgcacgcctacgcctgcgtcagcgtgccgctgtacgacaccctgggagccgacgtggtccagttcgtcaacaaccacgccgagctgtcggcggtggcctgctccgcggccaccttgcccgcgctgctggagacgctgccggcctcccccaccgtcgccgtggtagtggtgtacgccgcgcccgccggcttccgcatgcccgccacgccccccggctccgccgcgcgcctggtgtcgctggaccggctgcgcgcgctgggcatgaagcacccctcgccgcacgtgccgcccagcccggctgacaccgcgctgatcaactacaccagcggcaccacgggcatgcccaagggtgtggtgctcacgcacgccaacatcgtggccagcatcgcggggcagatcaggtccaccgccgtcctcgccaccatcgacgccacggagcgccacatctcctacctgcccctggcccacatcttcgagcgcgtgacctacatgagcgtcacccaccgcggcggcgccatcggcttcttccgcggcgacccgcagaccctgctggacgacatccaggccctgcgccccacctacttcccctccgtcccgcgcctgtggaaccgcatctacgaccggatcatggcccaggtggcggccagcagcccggtgaagcgcaggctgttcgagaccgcatacgcctacaagaagcggcacatggcggcgggggacatgaccggggggccctgggcggggttctggaaccgcctggtcttcaacaagatcaagcaggcggtgggaggtgagagggttcgagctttggtgtgtggtggggctcaaaaggggcgggtgcgaacagccattcagtatggaagcactgcgtgaaaatcccaggaccggtgggaatcggggcctctgttgcccggccagccccgtggctgggcctcgaatgcaaacagggctgcatctgcatgtgctggcccgccctcacacgctccccctcccgccacgcaggcgaggtgaggatgatggtgagcggcgcctccgccctctccccagaggtcttcgagttcatgcgcatcgtctttgactgcgtggtcatcgagggctacggcatgacaggtacgcggtgtcgctggcttgggggggccaggctgagatggcggggtgattccatggccagggatggatgcgcggggcgctgggtcctacagctttgcgcagaacctccccccccctcctgtttgccctggcaatccctgggattcaagaccttcacagacacaccccccccctcatgattcccctgtgtacacccccgttcatgcgcagagacgacgtcgggggccaccatctccatccccggcgaccctgtgatcgggcacgtgggcatccccacccccgcctgcgaggtcaagctggccgacgtccccgagatgggctacaccaacgcagacctgccgcgcccgcgcggcgagatctgcgtgcgcggcccactgcgcttcaaggagtactacaaggacccggagaacactcgggagacgatcgacgaggaggggtggctgcacaccggcgacatcggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggagaagatcgagaacatctacgtacgctccccctacgtcgcccaggtattcgttcacggcgacagcctgcgctcctgcatcgtgggcgtggtggtgccggacccagaggtgctcctgccctgggccaagcagcgcggactgccccaggacctcgccacggtgtgtgtgtgtggttgagtgtgggtgaagagtgaaggggaaaggggttgaggcgagggccgggcaccggatgcagggagcaagggagcgagcaagcttgcgattgccacagcacgctccatccctccccgtcgtctggcttcaaaccagtgtgctgcatgccactccctgcgtctcttctcatccagaaggatcaccagcccccccccgcccccgcgccccatctctcgtgcaacactccaaatcacccatccccaaaccacgtgcagctgtgcgaggacgagcaggtgaaggccatgatccagaagtcgctgtccgaggaggcgcgggtggcgaagctcaagggcttcgagcaggtggccgacatcgtgctcactcccgtgcccttctccgtggagactgggaccatgacccccaccttcaagctgaagcggccgcagctgagggaagcctatgccccggccctggaggccatgtatgccaggctccccatgtgatccgggtgcccaggcaggtggactgcatggagccggtgcgctgccagccgcacctgctcggtgctgaatcatgtgccccaccgcaccccgcagcccactacaattttgttgcccccaaagcacggcatggcgccgctcaatcccctagctagtttgcgaaaagattgtcacctggtaatcggattggatcagtaactgattccgggagggtgggccatgccggtgttgtctgcgcgcaacgacgtgtgggtgatccggacgacacgcagtggcatcgcgctgctgacaaattagatcggagttggcttgaagagactgacgaggaaaatctctctccagggtgtcagggccgagactcgccccatcatggaggcctccagggcgaccccgacacccaccgccaccctgcgtttcaccctgctgcggcatggccagagcacctggaacgcgcagggaaggctgcaggggagcacggatgcagcgtgcctgacgccaaagggcgtcgagcaggccaaggatgcagctgccagggtgggtgggtgggtggcagtggctccggaatgccttgtgcttccggattgcctgatgctctgaaagcacattctgcacccgctgtccagtctttagcccgccacgccctgccatgccgttcgagttcgctgcgcaggcgtctggcacgatgtgccggtccccgatcacgatgtgccggtccccagcgtcaccacgtggcaggccaggcaagggcaacgctcccccaaccttcccccttcccctgcatcatctctgcgtagctgcgggacacccacttccatgccatggtgcacagccccctgcgccgcgcggccgacacggccgccatcgtctggggcgagcgcgccggcccgaagcatgctttgcacgacctgcgcgagctggacctgcacagctgggagggcgcgctcaagaccgaggcggctgcccgtgacccgggggcctacgccgcctggaaggaccggcccgcggccttccagctggacgggcgccggccggtgtgcgacctctggcgccgcgcgcggtccgtctggcgggcgctgctggaccccggcggcgcgctgcggggatctctgggtccggcgcagggcgccccctccgtcctcctcgtggcgcaccaggggatgaacaaggcactcatcagcacggcgctggggcttgaggaggatgcattccggagcctgccccaggtggggggccagaggcggggcggaggcgggaaggacgaagcttactggtcctccggggggtggggcttgtacggaggtgtgcaaccttccctggcctgcatgagatggacaggtgctggccctatgaacagcatgcaataagccttgctcgctcgtgcctggtgcttgctcgcgcctcgcattccagtcctggcctcccacgacggtgcatcggcacctggacatcccactccccactcccaccctgaaggccaactcggcatacacctgtctggacattggacttggccagcagcctggcatccacagcgtcaccgtggtctgcctcaaccaggtgggcggtcagatgaggggtggcacaagggcccctggcctgggacaatgtctgtgctcggccgcaggctagaccccaggccctcctccatgtcatcctcgctccagcggcgcaggcctcaccccggcacctcctttgtatacatcttccccctctccattcgcccagggtcccatccacaacatcctggcaggcatcagcaccaccacctctggactgctcgtgctcctggccagggccgcagacgcggacgagcaagaaaggacggcggcagccgtggcgcaggccctcggcctggaggggcccagctggcagacgccgcaagcgtcggaggacgctgccgaccttcccggcagcatcctgtctttggcggcaactgacgacgggcctaccctggtgtgcctggacgccggtggggtggaagcgctgctgcatgcctgcctggggacccggccggaagctgtgcgctgggcgcgacagcccggcacgctcactgtgctgcagttcgaggcaaaaggcgatgccatgcggccggtagtgcactgcgcaaactgcgtcctccagggatgaggtgcagggccgagccagcagcggcccagcatggattggtctagatgggcagcgttggtgctggaggggtccatatcctgaatccaaattattgtgtacacttgaaaccagcccatcggatcttctgtacccacagggaagcaagcgtacgcagccgggtgtgtgtgttcgtatgacgagcctgtaaggt

SEQ ID NO: 22540 - DNA, 68 bp, Chlorella protothecoides
aattggcccgggcatgccatgtcgaggcggtggagcagctcccacagcgtcgtgagggtcacggtcac

SEQ ID NO: 22541 - DNA, 80 bp, Chlorella protothecoides
gagtgtggggacagagtgggaagctggtgtttgggcagaggaggtttgcgagttacgaaactcagcgcgtgtgacacact

SEQ ID NO: 22542 - DNA, 70 bp, Chlorella protothecoides
ttgctgctattcatgaattcatcctcacccagaagacgatggcgacggtgtagaagccggagccaatgta

SEQ ID NO: 22543 - DNA, 149 bp, Chlorella protothecoides
aggaggggccagcagagggggctgatgcctattctggtcgtcgatttcgtcccggagctggtatacttgtgcacagatcctccctcactggccccaaaatccgtcctcgatccattttcccaggtccgagtgaagcgcatgatcaccgc

SEQ ID NO: 22544 - DNA, 75 bp, Chlorella protothecoides
acagttgtgcaggaacaatggccgacatgcgaatgcctatgtaaactctggcgagtttgtttatcagagtgagcc

SEQ ID NO: 22545 - DNA, 106 bp, Chlorella protothecoides
ccagatgggttcgccgatatatgtgaggagattggagacatttagggggatggatcaggaatatgaacatatgtgttgcttgctctctctaatcctcccacctctt

SEQ ID NO: 22546 - DNA, 63 bp, Chlorella protothecoides
cgagatgcaggccacggggcgcagcgaggcacccgccgctgcggcgcagccgccgccgcggcg

SEQ ID NO: 22547 - DNA, 78 bp, Chlorella protothecoides
aagttcagacccaacacgccacgcggtctcgggtcgggccgtcaccatgagcaacctcccgtcaagtcgcagcctgtt

SEQ ID NO: 22548 - DNA, 68 bp, Chlorella protothecoides
gcactgcagatacgggacgggcgccgctggagacaccagctttggatgctccctgtcatcctccgtgt

SEQ ID NO: 22549 - DNA, 121 bp, Chlorella protothecoides
ctccagcttctccacattggcctcctctgcggtttccaaggaggggggaaagagcattaggtgtgggactgctgagtagggcaggggagacttcgagcttgctctgagcacttcaggctgg

SEQ ID NO: 22550 - DNA, 74 bp, Chlorella protothecoides
tgccatattcttcaagggatccatcgcaccatgggcttacaattaaatgcatctgcatcgcagtcagggacact

SEQ ID NO: 22551 - DNA, 61 bp, Chlorella protothecoides
tgtgagcgaggaatggcaggcatctgcgacacctccgccacaggggacaccttgaaacggg

SEQ ID NO: 22552 - DNA, 72 bp, Chlorella protothecoides
gtgtgtgtgtgcgcagagaggggggaggggggggaccacgggacaccctcccgcccatgccgccgctccata

SEQ ID NO: 22553 - DNA, 2845 bp, Chlorella protothecoides
  modified_base (1426)..(1679): a, c, t, g, unknown or other
cttgcacagaacttgcgaagggtgcccaaacaggcagttcaatcttgatacttactgcagcattaagactggcttggagaccggacgggcgattttgtatgtctacccatgcgatttccaaattgactcatcattcggggcacggggatccaatcttgtactaaacacatagggtatcccaacacatatggtaaagtctgggctcgggctggagcccgatgtcatgtagacatgtattgtagctgagttgatgggcttccaacgcatggcacgagagattagagctggagatggtagggggcctcttatcaatcacttgaagttctccggctacttacggactgaaaatgagagttgagagtccttgttactgaaacgtgctgctgctttcaaccccaggagtacatccatgttgtgaggactgtggtgggagaataccacacccatcctttgtatctttaggaggtcctgttcaggaggcaaacccattgacgatactacacaaacacgtagtctgtatagtcagtaagcagtggtgcagacgatcagcttaggcaggtctgggaatataaagtctccccccaaattccttcaaacgagacacaatgtgcagaaaagctcttggaagcacatgcattgcacttccccctcgcccagtaacgcttacttccgctgtatgatttgacagcgaatggacgaaatcatcatcagaggtatcaaagctttggtgcttgagcttctgaggagagtcgcgcgtctttttgtgtttactagagtctacagaccaagatatcctgtttcatagtatgatctcgtgaaagagcatggccagtgtgctataaggttggagagtaatcctcaatcaccatgtacccaaaattgattgtattgaatggtatctgcattaaaacggagactctgtccaacgtaaacatttgtccttgcaaaagtatgtacaacgtgatcttcgtcgacatagtttaaacgaacatcaatcagaaggcgctcgtaggaaatttgggtaatgccgaacaagaacactttcataagctaaagcttacaataaatcgtcgcggcagagtctgactgcttttacgcctataaattaattgtttgagtacagttcatggggacagatgggcactaccaaagcaattgcaagacgccagttagaggtatcgagtaagcaatgtctgcgggaacgagtaacttcaccaatccgatctcaaactcgtctgcgacagcatgctcagcaattcgcctctcgaagtgtctcggtgcattacctgtattacagaataatgcgggcaccaccagtctggtttccatttgagcagaatggcaggaagagttgggaagatttccgggcggtacagcaactctacagtagtatacctttgcgtttgctgctttgaagctggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttgcttgtcaacccacaaattatgctcgtcttctcggtggccaggcataagtgcggaaggcttcaagaagtcgagagggacgcattgcaaggcgctagtgatgactcccgcatacctgttatccagtatgttgctgattatcactcgaagactccgaaaactttggaacgggcatggtcttggtggaatcaagagaccccacctcctttttcatgtcacacatgcatttgacaacatgttctcctcattgaggttgtagagacctggataccgtgatgtcatcgaaatctcctcgagccgtcctgctcactgcaatgtgactgccaaggaatgatccgtgaggattgtgggatggtgaagtataaacgatgtatagaagacaaccgtagaggcactggccggaatctcgcttcattgcatcctttatttgggcacagagccttatcatgaaagctgtcgcatgtacatccccgcccattacaaacttaatattgcgtgtcaacactgaaaaccattttcagccttgaacaggaccgcggtaatcctgaaacgaggaaacgtcatcgagtaaaagccagcatgaatcgatccatgaaatgcagtatgagagtacacatcaactgaatcatctgtacatcacaacaacgagatagttgaataatatccactgtcgccttcgcaatctgcgtgtcgttcgagtagacctgttctccaagcacagatactgcacagatgtatagaaactagttgaaatatcgccgcaaattttagagttcaatattgaatcgtgaagcgagcaaacaccacgtgcggatcttgcggccttctatagaacctgattgcgtatgcttgtttcaagtcaaaatcattacagcagagctcgcaacattgcacctagccaggacgtaagaaacggtcctgtacggtctgtctcatttcaacgcacaactcttagcagactttgacctccgacagctcatgaagccccacttctagcgaaccacatttggttggtttctcaatcctttacaaagcacagtctgaaaaagcagcccccatttgtcaagtgcctaacgtaaagatgagttgggcttccaagcatgagctggtgtcctgttcaggtgctctcaaggcattcgatactagcttgacatcatataatcc

SEQ ID NO: 22554 - DNA, 77 bp, Chlorella protothecoides
cttggagggcaccaggtctccgccacgcttgagatctgtgtgatgtgtgtgtgtggggggtcctctgatggacgggg

SEQ ID NO: 22555 - DNA, 1010 bp, Chlorella protothecoides
  modified_base (722)..(731): a, c, t, g, unknown or other
agcaggccctcctcccccggcggcgtgaggaagcggatggcctctgcggccagcgcgtaccgctgcgagcgtaccgcctcgcgcacaacctgcaccgccaggttctgggcggtgccggggccctccaggtggttgatcaccagcaggcacgccgccgctttctggaaagggacgggggggtaaagggttgggggggtcaaagggttgaggggggtatggggttgggggagggtaggccatcgggggaatggtctgtcaaagctcttcgtatgcccgacaaggtcgcatcgtccttttgccgacgcggcactgcactgacacagcggagcggtcgacgccctgcgtcgccctctggctcccacctgaacacctccagagcaccaggtttcacccccttccccccatacatatacacccatgcacccagggtcaccccagcctccataacaaccctaacctacccacctcccgcccacccacctctggcgcgccctggtccagcaggctctgggcgaggcggaagggcgagcccacggccgcgaagagcgcgggccacagcgcggcgtccgtcttgcgggccaccgccaccacggtgcccgcgtagagggcggggaaggcggccagcatgtccaccgcggcgcgcagggtgggccccgcgcgccgcgcgccgcgcgccgacccgggccacctggcgctggcgaggggcgaggcggcggccgcgnnnnnnnnnnggaggtgggtgggcgggtggtgggtgggtaagggttgttgtggaggctggggtgatcgtgggtgcatgggtgtatatgtatggggggaagggggtgaaacatggtgctctggaggtgttcaggtgggagcaagagggcaaggcagggcgtcgaccgctccgctgtgtcagtgcagtgccgcgtcggcaaaaggacgatgcaaccctgtcgggcatacgaaaagctttggcagaccatccccccaatggccttaccccccacccccataccccccccacc

SEQ ID NO: 22556 - DNA, 145 bp, Chlorella protothecoides
aagttgtggctttgcaaggcaagtccaagccaatgcatcgcaccaagtcgtcagccacctctcaacagtgccatgtgctttcatcatgcaccgcaggtggatgggctacgccaaggcaggttctttcagagagaccacccttcac

SEQ ID NO: 22557 - DNA, 120 bp, Chlorella protothecoides
gtcttctgcagatgccagcacatcggcgccgagtgccgacgagccgccctccctgccgggcaagacctcgagcgtggaaaggccggcggcgacggcaccaaacgtgcacagcgagggccc

SEQ ID NO: 22558 - DNA, 61 bp, Chlorella protothecoides
ctgcactccgcaatccacacattcgaaaccaccacgcacaatctacctgccggtcagggcc

SEQ ID NO: 22559 - DNA, 97 bp, Chlorella protothecoides
gtgttcggcgtcgatcggtggcctgcttggcctcgaacagggcttcacccccgcacccctaacgcagcaggagcggagcacatctcctcatggcagc

SEQ ID NO: 22560 - DNA, 61 bp, Chlorella protothecoides
agatgacgaggaggaagaaggggaggaggacgacgaggaggccgagggtgacgaggatgag

SEQ ID NO: 22561 - DNA, 75 bp, Chlorella protothecoides
gggtcaggttgctccgacacttgatcacatctgcttctcgagcatgtttttgcgccctggcatgctgtgcatgct

SEQ ID NO: 22562 - DNA, 83 bp, Chlorella protothecoides
gctcgctcgctcgcagtgcgacactcagcgcggggcgtccccctcgccacaatcccttcctgccgtatgaggaggcgctgtgg

SEQ ID NO: 22563 - DNA, 99 bp, Chlorella protothecoides
gcgtgaacaagaaggcgctggactggtgagctgcgggatgggaacccgaagggttctggggtgtatagctggcttggtcctctgacccatcaccaccct

SEQ ID NO: 22564 - DNA, 69 bp, Chlorella protothecoides
tccatgcatgcttggccaggtgctcgcatagggcgcaccgaatgtacttgatgtccccccgtcggggag

SEQ ID NO: 22565 - DNA, 211 bp, Chlorella protothecoides
ctttgaaaccacaaagtgtagccctcacatctgcaacccgagctgtgacgaagaggagaagcagtacgcctagtgtgaagggcagcacgtccggtctccccatgttgaggggcccaagcctgatttgatctccctcgggaatgagcggttaaaaatgcggcctcgagtaatgcacctgaccaaagagctaacagtgattatgacacgatgg

SEQ ID NO: 22566 - DNA, 125 bp, Chlorella protothecoides
cccagcaccctctgggcacacagtccacagagcggcatccagtgaccgtgcccctgccggatctggatgccccaaggcccagtgcactcccggtccccccccccacagcccctcacctaggtcct

SEQ ID NO: 22567 - DNA, 77 bp, Chlorella protothecoides
gggggagaatggcacaccctatgccttaccctccggggctaccataggcctggaagtccagctagacatctccccat

SEQ ID NO: 22568 - DNA, 76 bp, Chlorella protothecoides
tcgtgttgagttattggtacgacatgggcgcatggaccccgggaaagatgtcatggatgcccaattcattgcacct

SEQ ID NO: 22569 - DNA, 61 bp, Chlorella protothecoides
gcctgctggctggattgaatagggccaaaccggtcctggagcaggggtcagacaaagaggt

SEQ ID NO: 22570 - DNA, 62 bp, Chlorella protothecoides
ggtcctggagcaggggtcagacaaagaggtcgacgcgttcatccatgcacgggacgcagcca

SEQ ID NO: 22571 - DNA, 76 bp, Chlorella protothecoides
cacccagctggaggtgggatcgctgggcaggggtggaggtccgagtggcttgcaatcgattcctgcggcgcacagc

SEQ ID NO: 22572 - DNA, 66 bp, Chlorella protothecoides
tccttcggggtgatgcctttgtcatgatccgtatatgtgatatgttccgagccaagcagcaccctg

SEQ ID NO: 22573 - DNA, 61 bp, Chlorella protothecoides
ttgataccgggtgacaatggcgatggaggactccagctcagcgaattccacaaacgcctgg

SEQ ID NO: 22574 - DNA, 209 bp, Chlorella protothecoides
tataacagcttgccagagctcgtcctgagatgacatgcagatctccctaaggctgtgcagcccttggaggccaggacaggatatcctaccttgagcatctcacgcttcttagcaaagcatcctgcagcatctctttgccgccctcaaccccctcataaccccattgatgcagttgtacgtggagcttgattcatgtacgtggagcttga

SEQ ID NO: 22575 - DNA, 494 bp, Chlorella protothecoides
cctcccagctcgccatgtaattccatgtcaggatgctgtatcaaagcaagaggtatacttgaattgaatgtcagcagggattgggaaatgaaacgaaatacatccccattgtacatgactttgatgctcttctgcgtgatacggccggcctcatctccactccccttgaccaacagcatggctcttggtgaggggacatcacggaagagggcaagcattcagtcattatgccgaatctgggggtttgtgaagcacaagcgattgctgtgtatagtgtacctaaaccggttgcctcgtaatggagtttaggcagtagacccacatacagggcgatcagaatgtgacatagatatgcagactgatccgtgaaaacaattatctgcctgcaccatctctaagtgcgtttgggcaacgtaatcaggcaacataccttataaaactgactcaggatgtcattcaggaggctcacaaaggcttccagcagaagcaaaccc

SEQ ID NO: 22576 - DNA, 78 bp, Chlorella protothecoides
ttcgtcttcggggccgcctcggcggcggcatcgacggaggccgtgacgtcagcgccggccacctccgcagcgctcttt

SEQ ID NO: 22577 - DNA, 78 bp, Chlorella protothecoides
caaaataacctctaagaagtcctgagcccattttgattttctgcgattgccccctgtgtcgccgcagctcactctttc

SEQ ID NO: 22578 - DNA, 61 bp, Chlorella protothecoides
ggggggtggtgtccgcatgggtgtgggggggggcgaggagcatgattccccaggtggacat

SEQ ID NO: 22579 - DNA, 61 bp, Chlorella protothecoides
ttgtcaaaagaagacatcagcgtgtgggggtgttttactgcttccttccgaggggaaaaga

SEQ ID NO: 22580 - DNA, 61 bp, Chlorella protothecoides
ctcaggcgcgggggcgggtgcggctgccggggctggggctggattcggcgcaggtgcagga

SEQ ID NO: 22581 - DNA, 63 bp, Chlorella protothecoides
gacggccataaaactcctcctgcatgcaaatgtggagggagcagctcttgatgcactcgtggc

SEQ ID NO: 22582 - DNA, 76 bp, Chlorella protothecoides
gagggagcagctcttgatgcactcgtggcgcgagatgctgcccatatggatcagaagctgtcaccagggtcttacc

SEQ ID NO: 22583 - DNA, 61 bp, Chlorella protothecoides
cgcggtcgcgctgcatcacggccaagcggtccagaggcgccgagcccatgcactcgatctg

SEQ ID NO: 22584 - DNA, 76 bp, Chlorella protothecoides
aggacgatccgtgagtttgaatgtccagggggagggcggtgattccggggcgtctgtgatgcattctgcatgtatt

SEQ ID NO: 22585 - DNA, 61 bp, Chlorella protothecoides
tggcaggcatgtggagatccatgttgtctccgcggcgtttgccggcaagaatgcggtggcc

SEQ ID NO: 22586 - DNA, 102 bp, Chlorella protothecoides
ttccgtagcagcagtgttctctgggaaaaacatcaactatcgggtggacactctctttcaaagccagatcctctcagtatcacacttttcgattgtagggac

SEQ ID NO: 22587 - DNA, 66 bp, Chlorella protothecoides
gttcccagagcaagtaaagccgcactgcattcgcattccaaccccttcgtatcaacagcgcaggaa

SEQ ID NO: 22588 - DNA, 61 bp, Chlorella protothecoides
gcatcctccagcggctgcgtggcaggagggaaggtggtggtggggtttccgtccgggccac

SEQ ID NO: 22589 - DNA, 67 bp, Chlorella protothecoides
ccactagtggaactaggaagtggcgggacacttccagcatagagaaagggaaggtgttaagtctgct

SEQ ID NO: 22590 - DNA, 66 bp, Chlorella protothecoides
ggatgggcggtgtgtcatgcgggcggggttgtcgggtatgcaggactcctttataagcttcccatc

SEQ ID NO: 22591 - DNA, 75 bp, Chlorella protothecoides
tggggtgccggtctggaaccttaaggcttcaaatcgtggcgaggatcgtggaggattaccttagtttacggtctt

SEQ ID NO: 22592 - DNA, 73 bp, Chlorella protothecoides
ctcgaagaggtggtgaatgcggtgacgctgtactcccactgtggcaaaagcaaatccctcagtcccaaacaat

SEQ ID NO: 22593 - DNA, 76 bp, Chlorella protothecoides
gcaaaagcaaatccctcagtcccaaacaatgctacgccatgcagcccaagattcgctcatcactcccagaccttgg

SEQ ID NO: 22594 - DNA, 77 bp, Chlorella protothecoides
ggcgcaacgcaattgtatgctggatggagaaccccaggaggacgagtatcggccaccaacggcaggagactccctcc

SEQ ID NO: 22595 - DNA, 61 bp, Chlorella protothecoides
cgggcggcatgagcccaccttctagcaccccagtgacaggtgcagggcctggcaactgctc

SEQ ID NO: 22596 - DNA, 79 bp, Chlorella protothecoides
gggaagcgtgctgtccgccatggcgccgcgagcagctttaagaatgggacaaaatataaacaacaaacttattgcgtgg

SEQ ID NO: 22597 - DNA, 61 bp, Chlorella protothecoides
gatgctgcgcttgaagaggtgggccctcccaatgcggcggtccatgctctccagaaaggcc

SEQ ID NO: 22598 - DNA, 72 bp, Chlorella protothecoides
ggaggctgaagcgatgcgggtttcccttttcaaaaaggatgtttcgggatctctgctgactcttcgaccagc

SEQ ID NO: 22599 - DNA, 61 bp, Chlorella protothecoides
cctgccctggtcatgctgggatgtaaacgcacccccgcctcttttggtccctcgtttgtcc

SEQ ID NO: 22600 - DNA, 213 bp, Chlorella protothecoides
atgggagatcgcataggcaaggaggcagtgagcatctcacaaggtcattctcgttcatgtaccttgtcttctcactagaaatcgcagtctggggctgtgaacagaagagtccaaggtcaggagaatcgccaaaagacccatctataggcccccaaaacccagctcaacaacgcgatacaagattgcagaatgtccggggttcgaatcctcgca

SEQ ID NO: 22601 - DNA, 94 bp, Chlorella protothecoides
taacgccggtccgcacgcagttacaaagacgatctgtacatggtggatgccaaggaatccgactattactgccggtacgttcgtacacaactca

SEQ ID NO: 22602 - DNA, 79 bp, Chlorella protothecoides
tttaggatccggtctcctcctcctgtgagactcacatctgacggtgatttcagcgcctcaccctctcaagcaacactct

SEQ ID NO: 22603 - DNA, 110 bp, Chlorella protothecoides
ctgctccaatcaccctcgactgtgcaggggccggcagcagcagcgtcaaaccaaggacttcacagcgcaagatggtctaaaatcctttgcttgagtcacgcatgcacatc

SEQ ID NO: 22604 - DNA, 61 bp, Chlorella protothecoides
cctgcgcgtgcatggcaatggagagcagctgtcagcatgcatgagctggatgctttacgag

SEQ ID NO: 22605 - DNA, 186 bp, Chlorella protothecoides
atcatctcgacggcttgaccatcgtatcccctgagcctgtggggggtggatggtcatggggagtgggcgagagccccaaggtgtttgtgccagacccttggcatttttgacaggccagcaccaaccgtctggatttgattacacactagacaacccctcgtcagcatctacagaggccatgggatc

SEQ ID NO: 22606 - DNA, 134 bp, Chlorella protothecoides
aggtggccccttgccacccagatgcatggtcattgttacagcagcccaggactctggcaatgtaacggcccctcaaaatcgattctctccaacctcacacacacgcacgcgtgcaggaggcccgggcgcagggc

SEQ ID NO: 22607 - DNA, 105 bp, Chlorella protothecoides
cggtcttcgcggagagatccagcatcggagaatttacgagggcgggaaccccttcctgacagtgtgttgcccgtattgccgtgttgcaataggtttaacaagtat

SEQ ID NO: 22608 - DNA, 61 bp, Chlorella protothecoides
cgacgaccatgcatgaccatactcgcaaggtgccgccttcccatggcacctgtctactttt

SEQ ID NO: 22609 - DNA, 80 bp, Chlorella protothecoides
cccagatgcacttcctcatagtaggaccctccccccgctctctcccaaaatgttcatcccccctcgccccctcctcaccg

SEQ ID NO: 22610 - DNA, 1560 bp, Chlorella protothecoides
  modified_base (578)..(672): a, c, t, g, unknown or other
cccctccccaccccccgcaccccatccccctccctccccggcccccctcggatccaggctgtcggtgtacatcgccttcaactccttccccgactacgaggatgtggaggggtgggaggggtccctcaagtccatatcccgcctctgctgctgcaccgcgctgatgcagcagacggcactggacggctcggacgccaccgcgcagcgcgagatcgcgctgtccctgaagatgctgtttggcggtatcgacctggaccccaccgaccgcttcctggccgccttcctggtgtcggaggcgcagcaccggcagcgcagacggcacgccaccgccatgctggaggcgacgggcctggtcccggccccgcgctcccgcaaccgcctgctgggctggctgggcgcgggcggcggcgtgcggcgcggccgactgggtggcatcggccccgacgccgtggcggggggcgtgggcgctgaggccgtggcgcgcctgccctcagccggctgcctcggtaacggcgacgcggggatgccgggcctgtgcggcggcgcggagaaggagggcgcaggggcgccgctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatcctgcgcatggacgagggagacgaggaggagggcggctgcggcggcgccggcagcgactgcggctccgcctccgcctccggcggcagccccgacggcggcgccagcgacgcggccgcgccgctgcgtccgcgcctgcgccttcatgccacgcaccgctaccaccccatgctcacgccggtgggcctgccgcggcacgtgacacgcagcgtgggcctgcgcgccgcggcggcggtgtacaccggcgcgcagcgccccgtggagcgcgccgtgctggagcgcgcgcgcctggtctcgcgcttcgctgtcggcgcctatgcgctgcagggcgtggtgtggaaccgcggcgtgcgcccccctgcctgcatgggcaacctcaacatgctggtcaagtgcctgcgcgggccgctgcgcttggagccggcgctgcgccggcgcaacctggaggccatgctgggcgtggcggggatcgcgcggggggacctgctccacgtctcctacgccaacgcgcagggcggggcgctgccctacgccatcgccctgcaccgcgagtcgcgctccgtggtgctggcccttcgcggcacggtgaccatggaggacctcatcaccgacctgctctccgcgcccatcgacgtgtcggagtggctgccggactgggtgctggacgccaacgagggcgggaagcccctctacgcccacgccggcatcgtctcctccgccaccgccgtgctccaggacctggacgagcacggcctgctcaaggtggctgggtgtgggtgtctggggtgggtggggaggtgtctggggtgtcttgcctgggtgtgtgtcttgcctgggtgggtgtcatgcgtgggtgggtgtcatgcgtgggtgggtgccttgggt

SEQ ID NO: 22611 - DNA, 61 bp, Chlorella protothecoides
gcactggcccatgcccacgcgagcactcacaaccccaaacatggccgataccaatgccata

SEQ ID NO: 22612 - DNA, 89 bp, Chlorella protothecoides
ctctgtcctcatgggatggttccccatgaatgtttttttctcagaacccccagcacttctgactgtcaagctgattgcgagcggtccat

SEQ ID NO: 22613 - DNA, 79 bp, Chlorella protothecoides
tgttgccagtgaaggcggtggcgtgggcccgcgcctcgcccaggatgacatcagggactcgggatgtggggatgactgc

SEQ ID NO: 22614 - DNA, 96 bp, Chlorella protothecoides
ggcagccgccttgtgccatggaaagtcgatctgccgacccgcatctcgccagtggagcaaacccgatcccctacaccagtccagctcttcccagcg

SEQ ID NO: 22615 - DNA, 61 bp, Chlorella protothecoides
cccgcttctgtcacattcgatgtattgggaaccagacatgagcactctgtaggtacagatg

SEQ ID NO: 22616 - DNA, 138 bp, Chlorella protothecoides
ggcagcagcgtgtcagatggaaagcaccataaggttctatcccctcacaggagtaagcgtgcgtttttaagagtcccacagatgaaacagagctcgtttcaggatcgacccagcattcacagactccgctcctgggtc

SEQ ID NO: 22617 - DNA, 71 bp, Chlorella protothecoides
gaggcgtccaggagctctcgggcgtccaagtcgcaggggaggcagaaaaccagggcgagcaggaggagggg

SEQ ID NO: 22618 - DNA, 61 bp, Chlorella protothecoides
gcagaaaaccagggcgagcaggaggaggggtgcggcgacgcgcatggtcccggatcagcag

SEQ ID NO: 22619 - DNA, 61 bp, Chlorella protothecoides
attatcccaccccattaccccatgcctcgtacccgccacggtctccaggaacagaatgcgg

SEQ ID NO: 22620 - DNA, 199 bp, Chlorella protothecoides
cgcatggccgccctgtgtggatcgacagcacgcatggcaccaacgacctaaacgagagaaagcggtgggatgtgcagcgatggcgtgtatggcctggcctccctctgggccactcaagcctccgacggtgggggggggacagggcacgatcgatctgtgcagactgcgctccatagcctttgcactcgttattctacca

SEQ ID NO: 22621 - DNA, 110 bp, Chlorella protothecoides
agcctgtcagtatggcttcatccccgtgccaagagggagcttggtcaatggcaaccggccgtttgccactgctcccctttggcctagatcctcggctgagctggcgcggc

SEQ ID NO: 22622 - DNA, 71 bp, Chlorella protothecoides
agttccttcaatgcccagactgcgagaaggcaatgatatggaagcttgaattgtctctgtgtgctggttca

SEQ ID NO: 22623 - DNA, 61 bp, Chlorella protothecoides
tgtcccattgaaaggtgctggcaagcacgcaccctgacgggagggagccggtgccggaaaa

SEQ ID NO: 22624 - DNA, 139 bp, Chlorella protothecoides
gggttggatggtctggctgctggttgaatacccgccctgtgacagcattaaaaatcttgagagctcctcggcccttcaaaaatgggcaggtacgacgaggccatcgatctacaacccagttcctcggtcatgcgggctc

SEQ ID NO: 22625 - DNA, 63 bp, Chlorella protothecoides
atgcactgagggctataccaggacacccccggaaatatgctactacatctgctttgagcaagg

SEQ ID NO: 22626 - DNA, 70 bp, Chlorella protothecoides
gaccggggtgcgccccgtggtcgtctacggtggcgcgccccaggtccagcagctgcgcgagctggaacgt

SEQ ID NO: 22627 - DNA, 69 bp, Chlorella protothecoides
gccatactgcggtcacgtggccttcgcgaacggcgagttgggagccttccttctttcgtgtcgtacacc

SEQ ID NO: 22628 - DNA, 69 bp, Chlorella protothecoides
ttccagaacgacgcgccatattagtagatgtagcgctttaaaaactccatgcatgcagacatgttttta

SEQ ID NO: 22629 - DNA, 61 bp, Chlorella protothecoides
cagcatatcagatggcccttgaagtgatgcagcgggaccagagagagctgtatgtggtcaa

SEQ ID NO: 22630 - DNA, 730 bp, Chlorella protothecoides
agcagcctgcgcgaccccgggcgccgcatcaccatcgtgaccacggccagcctgccgtggatgacggggacggcggtgaacccgctgctgcgcgcggcctacctggcgcgcgacgcgagccgggcggtgacgctgatggtgccctggctggcccctgcggaccaggcccgcgtcttccccggcgacctctccttcgactcccccgcggcgcaggaggcgtgggtgcgcgcctgggtgcgcaagcgcaccggcttcgactccgacttccggctgaccttctcccccgcgcgctacgcgcccgagaagtgcagcatcctccccgtgggcgaccccacgcgctacgtccccgaccacgaggccgacgtggcggtgctggaggagccggagcacctcaactggtaccaccacggcgcgcgctggagcgacaagttccgccacgtcgtcggcgtcatgcacaccaactacctggactacgcgcgcagggaggagcacggctgggccaaggagctggtgctgaagcacgtcaaccgcctggtctgccgcgcgcactgccacaaggtggtcaagctgagcgacgcggtgcagtcgctgccgcgcgaggtcaccgagttcgtgcacggcgtgcccgacgccttcctggcggtggggcgggcgagcgcgaccggggcgcgcgccgcgccaggctccggcggcgagggggccgagggggtggagccgggcgccggcgagg

SEQ ID NO: 22631 - DNA, 80 bp, Chlorella protothecoides
gacatcgacactgccaccctcgctccttacactgataagcctcaggtagtgccgagaagtatgaagagccataggatacg

SEQ ID NO: 22632 - DNA, 61 bp, Chlorella protothecoides
ggcgaggccccgtggcacggcaggttgcccaccccgaccctcctccccacctgttccgtcc

SEQ ID NO: 22633 - DNA, 212 bp, Chlorella protothecoides
aggacgctgctgatctcgatctggagtctggggagtctgggctagagtgggccctggcacggcaaataaccaatgctgcctagtcagataaatataaggatcctgcaggatgctgttcgagtgttccagggcctcggaaggctctcttgcttcatgcgcgatggagtcctctgacttcactgtctcacacgcaattgttgccccatcggctg

SEQ ID NO: 22634 - DNA, 78 bp, Chlorella protothecoides
ccgattttcggtgggacaggtgttgtgggccaagccttcctgcgtgtgtcttacacttcacctcacaccacagacgac

SEQ ID NO: 22635 - DNA, 76 bp, Chlorella protothecoides
gttcatcgtggaccagttcgacaagatcgctacccaggccgcccagttgtcccgcgtgaacaagaagcccaccctg

SEQ ID NO: 22636 - DNA, 61 bp, Chlorella protothecoides
tggtcgaggtcgcacagaatcttggcaggggccgtcgtgcgggcacacagtgcgcaaggcg

SEQ ID NO: 22637 - DNA, 64 bp, Chlorella protothecoides
gagcgggtgcctcctcggcagcaatgggcgcatcctcggcagcaatgggcgcctcctcggcagg

SEQ ID NO: 22638 - DNA, 78 bp, Chlorella protothecoides
tcgcctcaatgcacctctttaaaagacgaattgaagttgggttccatgtgtcaatggtcaagcggcatgcacattgtc

SEQ ID NO: 22639 - DNA, 78 bp, Chlorella protothecoides
ccgggcatgccctgcatgcacatcagacctcctgcccccctcgcaccctccctgtgacctgtcggcacgcttggacat

SEQ ID NO: 22640 - DNA, 61 bp, Chlorella protothecoides
tccctgtgacctgtcggcacgcttggacatcccccttcctcccacttgacaccagggcagc

SEQ ID NO: 22641 - DNA, 8287 bp, Chlorella protothecoides
  modified_base (2353)..(2429): a, c, t, g, unknown or other
  modified_base (3442)..(3496): a, c, t, g, unknown or other
acgcgctggggctgggcggcggcgtcgcctcctccgcccccgccgtcctgcacggctccggcaagtcgcgagggggcagcccgcagagcgcccctggcggcgaggaggggccgggcaagcccgcgccctccggcatcgacgtcggcaagatcagcgccgcgttcggcgtcaagcccgggcccgcggccgcgcaggcagtgcgcggcggtgccggtggcctgggcccgggcctcttcgcctccttcctgggctgacgcgggcgccggcgccccagcccggggacggggcgccgccctcggccgaccagctcccccctccggaggagtacctttccccctgccccctccttggcttgacccccttgtgcccacgccacggggtttgggcgctcgcgccttccccctctcccatcccggcggcggcgaggtcgccgggggcgcagcgccgttgatcccgcccgcgcacccagcttcaggactgtctccttctcgacgatgcccaacccttctcttacacccctccgtccaccactgcgcgtagcctcgtttctccccatgcccccaccgccgcccgccccctcccctcgccccggcccccgcgcctcccttcgtcgcggcgggccggcccggcgaccgggcgccgccccgacctcgtgtgtgcatgaatcgattgcttttgcctggcgatgcccaccctcccaacctgctcggcccagccctccccgctcatgcttgctgtccgcctgccccagtcagatacaaaccatgttttgccccgctcatctgccacacacgtgcatgcaaggccattcgcgctccttccccagcgctgtaatatacacgagatgcaggtcgggccagagggttggggttgatgatgggggacagcaagaatcataacttcgagttccagaccatgaggttttggtgggaacggaggtgtgacctgatttccaacacatctttgtcctccgagaatccaataacatgttgcagccgcgcgcagagaatctggagcggtcgcaccccgcgcagtggacaccacgcgcacgcagcatgccccgcgccctccaccagctcgagggcatggcgaggcaggcagggacagggagaggcgtccatcgggccgggctctcactcatgccgcccgctacctgctcagccccgccagcccctggcagagaatgtgaccacatgctgcggggccggtccgtatgcaccgatgacaggcagatggcttgatggaattttttgacgaacgttagggggtcctgtgcgtgatacaggggagcctcagcatgtcgacatgggagcggcgagccgggacgcaactgacgcccatcctcatgaatctggcctccatcgtggaacgtgagcctggcgtccgagacacggtattccccctggcctgacactgtctgcactgtttgaccaatcaccaagcccatgcgatgcaggcatggacgagggcatcctgcctgcagtctactttttcatcgggcgcagcctggacgccaccctgccccagctgggggccctcaccctctgcagggccatcgtacaggtgcgtgcttggggcctgtcgcaccatgtttggccttctttgaccctgtcccggggtttggctgcctgcctggggcgtaggaggggccgcgccatggagtagccccaggggatcccatatctccccagccccgaccccttcccacaatccttcacccctccaccaggcgctgtcctcccccatcagcggcatcctgggcgacagatgcgatcggaccagggtggtcacagccgggtgcctgatctggggggtgagcggccgtgggtactgccgggacggcgggtactgcacacagcgtgtggtgcatggaccggcgcctgacctgccccgtgccgcgtcgcgcagcaccgcaatcgccagaccccaccccggccctgcgcacacgctcggtgcaggtgatgacggtggcggtgggggtgtccacctccctgcgccaggccatggtggcgtgcgccttcaacggcatgggactggccctcgtgatccccagcgtgcagagcgtggtggcggactgccacccggccgagcagcgcggccgcgcgttcggcctcatgtcactcacgtccagcctgggtgagtgatgaggagggaagtgtggggacggaggatggtgagggggtacttcaggcggggaaggatcgctgcgagagggaacctctcccttccctgccttgcaagatgaagccctgctgcctggggcccacgctgggagcctcaggcttgtcagcagttttgctcctttgcgtgatgttcgtagaggacctcggtgcccccccccccccccgggggnnnnnnnnnnnnnnnnnnnnnnnnnnnnnnnnnnnnnnnnnnnnnnnnnnnnnnnnnnnnnnnnnnnnnnnnnnnnngacccacctgccgccctcctgcatcccgtacacaggcggcatggtgggcgccttcttcgccaccaacgcagggtccagcacgttttatggcgtggaggggtggcgcttcgctttcttccttgtcgccgccatttccctgggcacggggttcctggtgctgcacctggcccgggacccgcgccacgcctccggccccgggtttggcgaggaccccgtgccgctgccgcgccagctggcagttctgcagcgcacggggagcgggggcatcggcgagccgcggccgccgcgccctccccacgacgtggtgaggtacggcccggagagcctgcaggcgcgcaaggcggcgatgccggaggagggcccggacctgccgggctacgcacccctcaggatccccgagggctgggccgcggtggctgtgaatgggtgggctggggtggcggggcggtgaaggggagcaggggtggtgtgagcctcgcctgacaccggctgcatgcatgagagagtgggtctgaagggtcaggcagggcgcccccgacggcctcctgtcgggcctccacctgcctgttggggcagggacgcatgcagggcaggcgctccgtgccgcccaggccccagccgcccgccataatccccgtgtgcagctccagtggattcaggagcgtgatgagcgaggtgcggctggtactgggcatccgctccttccaagtcatgatcctgcaaggtgaggcactttgcgtgcagggacgagggcggccatgccccgcgccggcggcggggcggcgggggtccagcaaagccctgccccacgatctgagcccggatccagccaagagattgggggcctctcactcccgtccgctccctttaatcttcccaacccctgcacatgacccgccttgccaacaggggtggtggggtcgatcccctggcaggccatggtgatgttcactgtctggtttcaggtgggaagcaaggacagggtgtgtgtgtgggggggggggggggggggnnnnnnnnnnnnnnnnnnnnnnnnnnnnnnnnnnnnnnnnnnnnnnnnnnnnnnntttgtgtgagcactgccacggcctgggacagcgtccctttccccgccccaacctccctttcccctccacaaaacccccacttgggacaacagcttctgggattctcggacctgcaagccagctcctgcatggccatattcgggctggggtgcgcagtgggaagcctcatcggcgggcacattggtaagcggggggggtccggggagtggttgcttggcctgagttgtgagggggcggcggcattgcggcgccggagcagctgggggacaggtgccgagctgtaccctcccctcacgctatgccaggggatgtgatggcggccaggtaccctggatcgggccgcgtgtttgccaaccaggtctcaggtgcggcagggggggttcatgatggggagggcgggcgatcgggatggtttgcagcgggcatgcggaccgaagcttcatgagtgcgggcttagagtctgcgggcccggctcaatgcctgccgtttccctcttacatgtatgtggtgggagttgctcgctgccacacgtccggccctcagcgcatcccaacctcttcctcgacctccccccaacctccccgccacctcggcgcagtggtgctgggcctgccgctgtcggtactgctcatcaagggcctaccgcagcccgtggcgggggacccccactttggcgcctacgccggcgtcctgctcctcatgggcctgctggtcagctggtgcggctgcaacaactctgcgctcttcgccgacctggtgccggagcagctgcgcagcaccatctacgcctttgaccggagcttcgaggttcgagggcaagggtttttcttttgggggggaggggcgtggcctcggcagcgggagggggaaccgaggatccctgccgggttcgtcggtcgctggaggggtcccccctccccaccactcccctcaccccgaccaccttccctacttcagggcgccatcggcgcctttggcgccccactggtgggcctgaccgcggagcgctgcttcggcttcagtgggacggtgggcgcggggcgggacgacgccgagtcggcgcgcaacgcgcgcgcactgggcgacgcgctgctggtcatgcttgccctgccctggctggtctgcctgctggccttcacgggcatgcactggacctacccacgcgactgcgcggcggtgcaccgcgccgcgcgccgcgccgcctcggagatggacctggcggcgctggtccccctggagcacgccagccgcaggcggcgcgtgcgcagctgacgcggatctctacgcccgggcggagccggcgacgcgcatcctgtgtggggcggtgccggagcgcgcaccactggccccggcgacgccacatggccgctgcatcacgaacatctgacggctcgctgttccgcactgccttttgggcgacagacagtgccggcggtgctgatggcccggcgacccctgacaaccctctgacaaccctcggaaccgtcctcttcccctgtatctagagtagctagtcggcatgcatggcagggagctggggggttcatgccccacagcccagccggcagtcattctttgccttgctcacatctggtcccagtgctcacatgtcatcactcatgccaatactggtcatgcccacaccttgtaactagtatctgttgggggcgtggcctggggtttgttcctgtgcgcggggctgtcgaaattcgcgaatcccctgaaagaaccggagcaatttgcgattccacaaggctccgttgcatctcggaattcccttcttcccttttggctgacatgttgcatgctccgccgccagaccaaatcacaatgcagggcaaattgggaccctaaggacatttgtggcacaccacatgttgccatccaatacaccagcattgtgtagggaaacccgcttcgcctcagagtccctgattatcatactactgccgagtttgggggagcagttgcagaaggggatctcttcggcatagttttgcttggatgcaggcaaggctggaagccaagcccaccagttttcctcaaccgtcatcttctgcaagtgctcccccatatccagcattacaatgataatcatgataccgttcagccattccttgatgccccacactcgctcgtgtctgagaagcgccacagacccgcagtgcacccgattgcccgactccaccgcgatcattaggagggattcgagctgtacagaggaggagtaagggacgtctgggaggtcagcctttcttaccaaagtggcatccggaggcgaaggcctcacactgcatggctgccagtgccgtcgtaccttcaggtcactggtgccatgcgtgctttcgatccacacggggcagccatgcgcatagtcgcgcaggacacgctgatggttctcgttgaactcgacgaggtctgccagcccctgttcgtcatgctggaaaatgggaaagtcagaacgccgagcttggacagtcatcatcgggctggtggctgcattttggtgcagcatccacaggtttaaccgcttggcttgacgaatgttcctgcgacaggatgcacaaaggatgtgactctctgaatgcatgggagtgcagaatactggacttgagtaactgcaatgagcaggttactagacatgttggccggagatcatgtagtcccggcacggttcaggatgcacccacaggaaggtcctgttgtccactacacgagtgtactgcgtctaacctatcctggcttgacgcattgcagccgcttgaaccgctccgcagatgtcggtgttggaaaaggcagggttgatggtcagcaaggtacctgcaagagctcacatttagcacggtaagcgaggacactgcagggtgtcactgtcatggccaaagtgtgggatggcgtactagaagacaagggattttcctggctcccgcctcggctgcttgatggagaagtggtgctcgcagccggtcttgtgagagcagcggcgattcttgctggtcttgccctcccgctgtctggcgtcgtagttcttcacccattcaggtttgcccggatcacgggcgcacgtgaattctttgaggaagaccaaggcctgtgtgagttgaagagctcaggcgagtgcgggaaggacaatcgagccggggaggtctcgcagcgggcatccgttgggtgacagttcaactctggaccttggtggcaggacggggggtgtgattgaatgatgtcctgaagcgggggcgccagccttgcagagagtcatacatgcgctccgtggggatcgtaacttgagttgtgagagccttttagctggtatcttcctcagtagtcccggcggccaccagctgggccaccgtgtatacgacctcttgtgggtatggatgtcttagacacgttccgcatcatttgcaagctaaaagatatgattatgacgagcatatgctgtcgcgagacgctggggagcatctcttccaaggtttgcagtcttgtttcaaaaatggaaagagagattgtaaaatgtagggtcctcaccccggggctgtatgtccacgtgtcccacgtgtccggtacacccaacgaatagccatcgagccatcgagccatcgagcctccgaaagaacaaaccctcgcaccaaggcgaaagcggaaggaaaatagattgttgggttcttgtaatgctcttgggattgttcgaaaggtctccaacatgacggaaggcccgacgatgacgctggccggggacacacgccgaggcaggaagccctgggcctggacgaaatcggacagttcacccacctttccctctcacaccgaaatagacatcaaactagctttggcagcggaaaggagggaggtgaggcgcttgtgcggtgttcgaggaccatgaattgtgctcgcacagggaagaattgcaggggtggaatctacggtgttgtgggtcgtatattctgcgttctgcatatctgtgtgggacccagaaccgctaatgacattccgaaagatttgagaggccgattagggggcatcttgctgccttaaggagtccggtgtggggtgggatctggcgatcccactggcacaccccgccctccctcctcgcagattcacctgaggagccggggtagccaggctagacgttcatcttgctcttcagatgacagcgacaggcctcggcgggcgacagcagtcgaccacctggctgcaaaactccaggtgagagcatgtgtgaaagcgggtggggggatgtgattcctctgcgctctgctcagctctggcatcgtggctccctgtccatgcactctgcacaaattcttggtacctgtgcgggagcagtgataagcaatcctccccgaaccctgtgccgccccttataatcctcctccagaccaagctggagctggcctggcggaaccgggaacgcagcctggaggcggtgagggcacgcgcggccagatccaagcacagggcggccgccgccagcgagagaatggcgaggcagcgggccgccctggtcctccgtctggagcgcaaggcggccgccggggcccgcgtggctgggggagccaggggcgtgggcgccgcgccccggggcattggtcccgccgcgccggtctctggctcatctaaagcgggcccccagccgcggcccatccaaggtgtcgtacatgcgccggagtcgagcctccccgcggccgagcccgcgcgacctcacggcgacgagcgccccgcgccctcccccgcgccctcccccgcgcccgccgccgagcagccagacccgccctcgcccgtcgaggc

SEQ ID NO: 22642 - DNA, 111 bp, Chlorella protothecoides
ccaaactctgggcaggaggggcagaacggggcaggttgatggtaaggaccgtgggctcagtgcggcatgcgtgcgtattccagatcaagaggtcgacaacatgcaggtggg

SEQ ID NO: 22643 - DNA, 73 bp, Chlorella protothecoides
gccatgataggtctaggctgcagccggccttgagagcctcaggctggtctctagggtggaacactcaagggcc

SEQ ID NO: 22644 - DNA, 1020 bp, Chlorella protothecoides
cccccaagccctccacctccttctccgccgagtccaccaccatttccatctcccccaagccccgcacatccttctgcgcccagtccaccaccgtccccgtcgccgtcaaggcccccacctccttccacgcccagtccaccatccccgccgcccccgagccctccacctccttctccccgccccaccaccctctaccctgacaggaacatttttccttcaactatgtgaactcagcgggagccaatgtgcacgacgtgttgccggagctggccacagcagcctctaccgcccacctgcggtcggagcttgctgcgagtgggccagctgccacagtggcgagagcgcgcgctctgcaggcggcaaggagcgtcaatgccaaggcggcgttggccagcgctctgctgcgtgccgggccgatgctgagtgcgtttttttcgcctggcctagatggaggtgaggggtctctgcaacctgtgtacattttggagctggtctgcacggcaagcgccacgcaggatcccacgctgcgccaagcgccgcaagcgctggcgcggacgctgctgtgcatatcaatggccgtcgaggatgccgtggaagacggtgagggcggcggagagctctgggaggctgtgtgtgagtggaagggtgtacaacagtcatgtaggcgctaggggcttagatgtgtcatggtggttggtctggctgcaggaagttccagtctctgccggactcaacatccccaagctgatgcttgcactttacagtctgcagggcctgcagccgtcgcgcgtgggttctctgctccatggcgcatcatgctgcgctcagccatctgcccttcctatatcctctagagacaaccaaaagcctgcaacgagtcaggtcgatggagtcgtacacggcaaagctgcaccgttgccagaggcagcgggtactgtggagagacccgccaagcccatagcactgagcgagctgggcgcctggggtaccgacctcagtctcgtcctcaagatgtgagtg

SEQ ID NO: 22645 - DNA, 64 bp, Chlorella protothecoides
catgacctcactagcattcgttgaataataaaaccgcaatgtgtgggtcccacggggtgcgatg

SEQ ID NO: 22646 - DNA, 71 bp, Chlorella protothecoides
cgcaatgtgtgggtcccacggggtgcgatgcatgtccctagccatcgatgcctgtgcaacctctcgtgcct

SEQ ID NO: 22647 - DNA, 107 bp, Chlorella protothecoides
agggagggagggggaggacttgaggcgaggcaaggctgtggtcaagctccgaatgtgtgaaacttacgaagtaaagacattctctctgagttggaacaacctgtagc

SEQ ID NO: 22648 - DNA, 75 bp, Chlorella protothecoides
cccgttctctgcccaagccccccccccaaaaaacaaaaccttgaaaacaagatcgtgacgtacccaggggcgagc

SEQ ID NO: 22649 - DNA, 133 bp, Chlorella protothecoides
catggccggacccgacgggccggttgccgggatccggggccaggatggagacccgtcacgtgcgccacgccgcccacgctgctcctcgcccacgatcaccacgccacgcacagacacacccacccacccacac

SEQ ID NO: 22650 - DNA, 79 bp, Chlorella protothecoides
gactcggtgagttttggtggggttgtgggcatgaccatgcaatggcaaatgtgttgctgggaatcttgctgaggagcgc

SEQ ID NO: 22651 - DNA, 61 bp, Chlorella protothecoides
aactgtctccaaaggtccactggtccacaagccgaggctccgccccaacttccccggggta

SEQ ID NO: 22652 - DNA, 887 bp, Chlorella protothecoides
  modified_base (718)..(730): a, c, t, g, unknown or other
cccgcaggtggcggccacggtcgtcgcaccacccagcggtcccggagcacgtattgcgtcgatggtatagggggcaagggctgggtgtgcgattgggtgtcaccggcagcagccatggcccgcgcagcgcccctgtctctgaccactccccccatccccaccccaccccctcccaagagaccccacctcccggtaaggcgagggtgcaggctccctaccaatgcaagacttcagaaattacagagatgcaagaccacgcccaaggtggcaaccatttcgacaaaactggactgactgttgcatcagggtgaagaaaaggatggggaagaaagtggaaatgacatgtacactcatgcgcccatgcccagaccgagccagctgcgcgcgaacgaggcgatgcagctgtgttttagccattaccgacttgagacgatacaacacatctctttcgaagcaagagatgcggccatctcgctcttggccgtgcttgcatctggcgacctgggagagtgggcatgacccggcatccagtactcatgcaggggtgccaggaagtggcaaggactcagacccagcaagtacagtactgggcatccagaagtccacagggcaccctcaatgtctacccctgctgggccctgctagcgattttgtgtgtgacggctccagcgcctgggagtgtctcgaccccccatgcacaccatgggcaggtctttgnnnnnnnnnnnnngatgctcaggggcaggagtcatattcttcagagtctaagttatcaaatgacccaaagtgcacctaagttcaccttgtactggtgacttggtgggcgaccaaaatttgggggcagaggcccaaacctgtgatccctgcaaacccgcatgtcctgctcc

SEQ ID NO: 22653 - DNA, 119 bp, Chlorella protothecoides
ggacgtgctgaatgtgctgggcatgtacccgggagaccccggcatgcccggctcggactgttccggggtcgtactgaggatcgggtcggccgtgacccacctcaaacctggtaggtgct

SEQ ID NO: 22654 - DNA, 63 bp, Chlorella protothecoides
aggagtgctggctcaggcagtggtaggcaaacaatgcatgctcgcgtctgacctcggcgcatc

SEQ ID NO: 22655 - DNA, 96 bp, Chlorella protothecoides
cggcccagcacacagcagagcgctggccaatgccgcgctggcatatgagcccctcagccacccgcaagcgcgcagcgcactcgtcgccgtggcagt

SEQ ID NO: 22656 - DNA, 72 bp, Chlorella protothecoides
cccagagcgtctgagcatgcaacccatatcactaccgatgggccgccccaccaagggcctgggtgtcgggaa

SEQ ID NO: 22657 - DNA, 61 bp, Chlorella protothecoides
cgagaacatgcccaggcccatgcccgccgcagcggccgcccccgccacgatgccgtccagc

SEQ ID NO: 22658 - DNA, 111 bp, Chlorella protothecoides
tgtgaatgggagtgtgtacctctggagtgtacatctgcaattttgtaaatcagttgctcatctttcgatccgggaagaattcgaagtcagcagccaccccgctatcatgaa

SEQ ID NO: 22659 - DNA, 61 bp, Chlorella protothecoides
cacacacgggagatgtggcgcaggatgcgcacctccaccgtctccctctccccgccggctg

SEQ ID NO: 22660 - DNA, 277 bp, Chlorella protothecoides
gtcaggatgaggaggaggactgtatctgtaacgagtggttttggcaatgtgttcctccgcatttgctagccataagtatgtcaatccgttgttgtgtggagtccttgcacaaaggcatactctcagtggtgagagaacatctatattggcaatgaggtgcttgctcatcttggctgtctggaagcaatctatgaacaaatcttgctgactctaatctcctggccacgcagactcacagcttcttctgttacactgcactatgacaggagtatcatgg

SEQ ID NO: 22661 - DNA, 61 bp, Chlorella protothecoides
acactctgctatctacagaagaatggcaggcctgtaacacaatctgtatttcaacatttcc

SEQ ID NO: 22662 - DNA, 103 bp, Chlorella protothecoides
atggtgtgggcgggctgagcaagtgtggaaataagcgcagcgtgcgcaaaatgcaactggagttggtaccaatacgttcacagcacgttacagggtaggcttt

SEQ ID NO: 22663 - DNA, 69 bp, Chlorella protothecoides
gtagggatgggaggggtcttggaggccagtttgaggcattaagaagtgagagcagatttgaatcgcggc

SEQ ID NO: 22664 - DNA, 294 bp, Chlorella protothecoides
cgtccctccagttgtacagcgctgggaggagttcgattggggcgttggggttggggatgaggatgcaccggggatggtgagaggattgcgcagcaccgccccacctccctcgtcaatcgtggggacacacagaggctgtgcgtggcatgatgtgaccacaagtggtgtgcacacaaaccaatgcgcccttgaagagcccactgaatgcaaggatgagaagcaggctgcccagcactctgaacacaactccacaaccccacccagcccaacctcaccctcaaagacggccagctg

SEQ ID NO: 22665 - DNA, 62 bp, Chlorella protothecoides
ccctggacgtgtacaggtgcaaggggggggtggcatgggaaagggggagggcggggagtgtc

SEQ ID NO: 22666 - DNA, 78 bp, Chlorella protothecoides
ttcgcaagttgcttatgcaccaggaaggtgtacattccaccccccccatttcccacgccaggatgctgtgagctcggg

SEQ ID NO: 22667 - DNA, 76 bp, Chlorella protothecoides
ccactcaggcaggtgtctgcatgcacagcctggaccagcgcatgtcacaactacgtctccatcccctgcctagccc

SEQ ID NO: 22668 - DNA, 107 bp, Chlorella protothecoides
gaatgggagctgattacgtacatccccctcgccatgaacgcggtacgatggagttgcaaactcaccaacgaaatcttaccccaaccattcttcaatcgcgcacgaaa

SEQ ID NO: 22669 - DNA, 392 bp, Chlorella protothecoides
gggggggggatgaagggggcagggtggggcagcagcgtgccggcggtgcgctccgcggcgtgcgggcgtctggctctgggcgtactgcgcatgatgcagagcctttgccgttgcgacacacctgtgccactcccagagcagcagcgcccgcccccttcctccccatcggctcaccagaggtggtgcagtgcagctccgcgccccccagctcctctgcgctcacatcctcgcccgtggccgccttgaccaggggagggccgcccaggaagatggtgccgttgccccgcacgatgatggactcatccgccatggcggggacataggcgccgccggcggtgcaggaccccagcaccaccgcgatctgggccgggcggggggtgggggcggaggcg

SEQ ID NO: 22670 - DNA, 63 bp, Chlorella protothecoides
gggcgaccacatcccatcctccgtcttggctgcaaagtcgggcccaatctgtgcgaagatggg

SEQ ID NO: 22671 - DNA, 62 bp, Chlorella protothecoides
catctccatcccccaaggccagccccagcctgtctcccaaggccagccctagccccagcccc

SEQ ID NO: 22672 - DNA, 73 bp, Chlorella protothecoides
ctcatcggctggagaaagggaggcgttgcctccaccgctcctggcccccacccctcccaggtgtaccccaaag

SEQ ID NO: 22673 - DNA, 76 bp, Chlorella protothecoides
aggtgctgcgggatggctgctgcacatctatcagctgcaatgcctgtgctcccgcaggactggcaatggcagggcc

SEQ ID NO: 22674 - DNA, 264 bp, Chlorella protothecoides
cctgtggggcgccgggagggggagcaggtgtgggtgggtgggctgctggaggatagagagggatcatgaggccgggtggtgatttggcacaggcacagcatgcaggctggccagacgtgggctcatactcccacgaaagcctgcaatggagtcgccgggcggcatcccaccttctcgatggagagggcgtccatgcccacggcaatgtcgccctcaaatttattggaagtgccgggcacggcaaatgtggtgacggggtacact

SEQ ID NO: 22675 - DNA, 80 bp, Chlorella protothecoides
gctgggtgcccatgtcctatggatggcgccaccgtagttgtgaaccctacgagtatgcagcacagtctgccgcccctaca

SEQ ID NO: 22676 - DNA, 76 bp, Chlorella protothecoides
atgagtgggtggcaggttgtcactcgacttgttcacttggctgcacagcagatgcgagctgaaactatcacgccac

SEQ ID NO: 22677 - DNA, 68 bp, Chlorella protothecoides
ccagatcttttgacgttcaagggctgagggatatccaagaccaaaacatgcctggagggcgcctcgga

SEQ ID NO: 22678 - DNA, 109 bp, Chlorella protothecoides
ctcctcgacagtaccagacgcctgagcattcacccctcataacacactactacagaacaaagctcctcttgcctccctcaccctgctggaggcctggcgggacgacctg

SEQ ID NO: 22679 - DNA, 72 bp, Chlorella protothecoides
accaggaagggccccatactgcgccgtggcgatgatgaattcatcacaaacaagtagatagagacaactgag

SEQ ID NO: 22680 - DNA, 92 bp, Chlorella protothecoides
ttgtacatctgagcgaggcctgaatgaggggacgcagagtccatctggggtgcagaaacgggcctgaggatgcgtcaagcaggtgctgtgca

SEQ ID NO: 22681 - DNA, 61 bp, Chlorella protothecoides
cgccttggccctccttcacggtcgccttggtcctccttcacggtcgccttggccctccttc

SEQ ID NO: 22682 - DNA, 70 bp, Chlorella protothecoides
atcatccacctctgatcggcatcactcggattctgaatgaccttgatcaggtttgcgcaccatcgcagag

SEQ ID NO: 22683 - DNA, 76 bp, Chlorella protothecoides
cggggtagatctagatagcctcgagtcagcattccccaagccctgaccaactaagcaatccagatcccccccttca

SEQ ID NO: 22684 - DNA, 268 bp, Chlorella protothecoides
ttcaagatgggttcagtattgatgcatgcatgtctgacaagttggtatcgccattccacagccagtgtcgtccaggcgttcaaacttgtcgaccaattccccagatatgccatactcggaatgttgacagagcactttagctgcacagcagccaattctatctctgaatctttgagcatcatggtgcagaggtgtcagaccacattctagcaagctcatgtcaatcgaaaggcattttctcgatcacttcgaaagggaagaatccccc

SEQ ID NO: 22685 - DNA, 416 bp, Chlorella protothecoides
aagcggtcggcctcgacctcccaaccccacctggtgttattcaacaccacctttgtggaaactcaaaacttactgatttggtagcagtgttgtgaaaataaaccctggggcagaaactttcgtgttatgccatcaagtgtaagaggttctagttctgctgaacattgagcaggttgaccgcagatggggggccatacggtcttagaatcacagcacagccgatctggtttgggcagccttactcacactaggcgactcatagtgtacacagccacacagaaggtacaaagagtctcgttaaattgaccaggcactgagcacatcattgctgcctactctagagtgacgaacaacaaattatgctgaatttgttatgttatcgaatttctacacatcaaactcctcgtttccaatga

SEQ ID NO: 22686 - DNA, 115 bp, Chlorella protothecoides
aagcagcacatggcagtgacctggactcctcagaggcttgccatattgctgtgaacccgctcacttccaaacactgcatagagccactgtcgccacagatcgcttattctcaacc

SEQ ID NO: 22687 - DNA, 75 bp, Chlorella protothecoides
ctctcattccagattgtctccagtacaattggtagcaattacaagcaccatcccagagacgatgttgactgttgt

SEQ ID NO: 22688 - DNA, 84 bp, Chlorella protothecoides
caaggtgtgtacactttcctggttgcactacaaatcagggtcattgcattttgggccaggagggactactttctggattcgggg

SEQ ID NO: 22689 - DNA, 61 bp, Chlorella protothecoides
gcatatcccaatggttttccgcgtgtcggcacgctgggttcctgccgattcccctcttagg

SEQ ID NO: 22690 - DNA, 61 bp, Chlorella protothecoides
tgaatcagcgctgccccgtcagcaccgctcacctgccgaggagacttgcaacttgttgttg

SEQ ID NO: 22691 - DNA, 152 bp, Chlorella protothecoides
gagttgcctgagatctgctcacgcgagaacgcgcattgctctgcacctagagcgaggcttcccggaacagtttccgctcatcaccgtgaggatgccccccaaaacctcccaccctcgtcccgtcaagcagggcgggggtggcgcggcgcttc

SEQ ID NO: 22692 - DNA, 256 bp, Chlorella protothecoides
atgtatacatagtacactgcgtgggggagggcgggggtggggtgaggtgtggctgggacggcgcacttccgtcggcaccaagaggtgcacacgcatgcaggcctggaggggggcgagccatctgcacagcctggccccgatggttgctcattcctctgacatcccatgcccccttggaacatcagaagcagaaacccctttccccctcccccccctgtctccaccagcccctcacttatgatgccaagggagtaga

SEQ ID NO: 22693 - DNA, 126 bp, Chlorella protothecoides
tccggggaaggaatggcctcaggcggtcccgggacattctcaactccggggatgcgacctgagatcctgaaggtgtcttccccagctcgttgtggaactgttgtgggggttccccttgaccgggcc

SEQ ID NO: 22694 - DNA, 80 bp, Chlorella protothecoides
agaaggcaagggggcgcatcgtcgctgcgacggcgccgcatcacccctcgcgatcctttcccgagccccgtggccacaca

SEQ ID NO: 22695 - DNA, 135 bp, Chlorella protothecoides
ccctgtgcgtgtggggggggtggggacagggggcttggagaaggccaggctgtgcatgggtccaggcatttgtccatgcgactgttgcccaagcttccctccttccttacagcaggcaaacccagcctcaccccc

SEQ ID NO: 22696 - DNA, 72 bp, Chlorella protothecoides
agaatctggagacacggtttagagtgcctggataatgccgaggatgtttcaacacacagagaaacgtgtttg

SEQ ID NO: 22697 - DNA, 61 bp, Chlorella protothecoides
cgcagcagtacatggtcgacccctccctctttgcctccagcatcaggctttgcgggggagg

SEQ ID NO: 22698 - DNA, 75 bp, Chlorella protothecoides
gcacgaccctgtgctcaaccccctgggtcaaatgcgcgtcctcttcgacctgtcaggttttcaaggggggggggg

SEQ ID NO: 22699 - DNA, 61 bp, Chlorella protothecoides
tgcatattatagtccctaagttattcggtttctaataatgtgaaggtcctcccaagtataa

SEQ ID NO: 22700 - DNA, 294 bp, Chlorella protothecoides
ttgaagcccaagggacgcaagagacgcaccctgcccgtgcctgcattgggagcaggtaaagggggttttctttctgcttccattttatttgagggtgctagttgcccaaagccagtatgccttgtggcatttgcacgcagattagcattaaactcccttactagctcatcgtcgtcttttggcttccaagtgctgccgagccgtcagcatcagcaacagctgcccccagtaggaagcctgaggcagaggcactggcactcgtttctgccgacattccagggccaagactggtgc

SEQ ID NO: 22701 - DNA, 71 bp, Chlorella protothecoides
ctgcacagctgccaaggcggcatgtgacgggtactttcattcggcacccctgggacctggaccctacaact

SEQ ID NO: 22702 - DNA, 61 bp, Chlorella protothecoides
ttctccctgctacctgtggagcttactggccagggtctctctttttgctgacagacatctg

SEQ ID NO: 22703 - DNA, 68 bp, Chlorella protothecoides
tgctgtgagctaccggatattggaaggtcttgataagatctgccctttgtgctgcttgattggtgggt

SEQ ID NO: 22704 - DNA, 103 bp, Chlorella protothecoides
ctgcctggagagccctgacaagccaggacaacaggaggctggaccctgcgacccacctcacggctcaattttccagtcaggctttgccagggcgtgggaaacg

SEQ ID NO: 22705 - DNA, 72 bp, Chlorella protothecoides
gtcttgccgaggcggtgcagggtctgaggcagatctcacactgcggacccctcctggattccccaccctcag

SEQ ID NO: 22706 - DNA, 67 bp, Chlorella protothecoides
gcctgcccctctgctgaggcaaagcaaggggttgctgagcccccgcacgcatcgctgggcttctgat

SEQ ID NO: 22707 - DNA, 61 bp, Chlorella protothecoides
attgtcaaatgtcgggctgtatgtgatgtgcagtggtccgaggacgaggcaggcgcctctg

SEQ ID NO: 22708 - DNA, 81 bp, Chlorella protothecoides
tcaatccaacttcataggagcacagccacaggcccagggtgcagattaacgccctggacacaacgaatctcaacacacccc

SEQ ID NO: 22709 - DNA, 90 bp, Chlorella protothecoides
atcctgcgagctcgaagcgatctccaccattgatatgtgcaagcacggattggataaaaatctttgaggcagccaggggggataggccgc

SEQ ID NO: 22710 - DNA, 61 bp, Chlorella protothecoides
aacaggcatgagagaatggcatgggaaggtgctggcaggccaggcagggcatgggttcctg

SEQ ID NO: 22711 - DNA, 61 bp, Chlorella protothecoides
ggcggcggcaaggcaaggacccatgcatgcctccggaactcgagcaggctacagtcgttct

SEQ ID NO: 22712 - DNA, 93 bp, Chlorella protothecoides
gagggggaggggcggctttggttttagaagctatcaggaatcgcgatggggtgtgatggactaaaggcggggggaggaatggcttccacgctc

SEQ ID NO: 22713 - DNA, 131 bp, Chlorella protothecoides
gcaaaagggggagcaggaaggacagggcgcatcgcagcatgagttttaggaaggatggagggttttggcacctggaagaggatcgtggccaggagatggcctcacccgtctccctcactgtgcggacgcgg

SEQ ID NO: 22714 - DNA, 65 bp, Chlorella protothecoides
ttgcggatggatgtcgccaaagaagagacttggaacttctggccgtcccccttgtaacacgcgga

SEQ ID NO: 22715 - DNA, 78 bp, Chlorella protothecoides
agaggacggacggattgccatcggaacgattgatgaagggtggggttccttacctttgtaaagagccacagacagccg

SEQ ID NO: 22716 - DNA, 67 bp, Chlorella protothecoides
ctatcgccgctgcatcggcctttgacctggaggatgcagggaggggggcaggctgtgggttatgaat

SEQ ID NO: 22717 - DNA, 73 bp, Chlorella protothecoides
cccagcagctggtcagggtttaccgagatgtgacagcgggctatccgcatcagggtttaacaagaagctgccc

SEQ ID NO: 22718 - DNA, 61 bp, Chlorella protothecoides
gaacgtctctggcggctgggtcaaaggaagcgtcccgggcgtcatcgacgggtcgatgggt

SEQ ID NO: 22719 - DNA, 61 bp, Chlorella protothecoides
ggacgaactccctgtcctggagatgggttctgatgcgacgacgtccgacgtctggggcaac

SEQ ID NO: 22720 - DNA, 115 bp, Chlorella protothecoides
tgatggcaagtaggccagggcagaaggcctagaagaggtgctggtcttgggagggtggtcgggagagagggcaccctggcgttcgtgtcaagggggccggggcttggaggtcgtc

SEQ ID NO: 22721 - DNA, 78 bp, Chlorella protothecoides
gtccaccgacgcctgctggctgagcaggggacttgagttatggatgacgcggcccagcaggtgcctgccgtgcacgat

SEQ ID NO: 22722 - DNA, 74 bp, Chlorella protothecoides
ggtggccatggagtccaggaagcaggccgccaggcggcccagcccgccgttgcccagcgccgcatcgcgctcct

SEQ ID NO: 22723 - DNA, 61 bp, Chlorella protothecoides
tgggcgatgaggtggagacggcggcgggggggttggtgggggtggtggtggaggactcgga

SEQ ID NO: 22724 - DNA, 76 bp, Chlorella protothecoides
tggaacatgcctccatcaagctcaaatacgatgtgtgtgttcttaccctccgtcccctctgatcagcccccccccc

SEQ ID NO: 22725 - DNA, 96 bp, Chlorella protothecoides
cccggacctgcgtcgatgaccggcaaacgaccagtgggttgcggtttcgacttcaaatgggcaggtatatggccgttaacacattgtcttagtttg

SEQ ID NO: 22726 - DNA, 68 bp, Chlorella protothecoides
gtatgtgccttggctactcctgtgagcacgagtgccaaccgtcctgcccaggctcacacgttctgtgc

SEQ ID NO: 22727 - DNA, 191 bp, Chlorella protothecoides
cgggaacctgcaacgcctggtgcgtgtctgagagggtggcggctggaatgtggagaaaggaggggttggagtgcgggaccctgatggggctgatggaagacagggtttttaagacacggagcctggaacttcaggtgcctgaggaatcgcattggtgtaatcagaggaggagtgcagtaaggccgagcgca

SEQ ID NO: 22728 - DNA, 77 bp, Chlorella protothecoides
tgggctccgacaaggtgaggaccaacaggatatggacacctggtggattgtccaccctgcaacccatgttccgcaac

SEQ ID NO: 22729 - DNA, 82 bp, Chlorella protothecoides
tcgggagtctttcagaggtctgtttccctcgttacaacttgcacagtaaaaactgtgcagggcatcgcccttgtgatggatg

SEQ ID NO: 22730 - DNA, 155 bp, Chlorella protothecoides
cggagcatgaaaggggttacatgataccccaccagatgcacgtgttcaagcctcaggctttctcagacaattgagccctgcagcctttatcaatgaccaatcaatcctccgtacaaactgatgatccgtcatgacatctgtgagcctcgccgtca

SEQ ID NO: 22731 - DNA, 61 bp, Chlorella protothecoides
ttgggtggaaaggtatcgcaatggcgacggtgctttacctgttgaatctctcttccaccct

SEQ ID NO: 22732 - DNA, 70 bp, Chlorella protothecoides
acagccttcgaatcagcgatcaaaaccaaaatattgagcgctgaatatatgtggggcgcgttggctgcaa

SEQ ID NO: 22733 - DNA, 118 bp, Chlorella protothecoides
ccgccgccctgggccgactcctcgctgcccaccatgcagctgtggggcgagggacgaggagcctgaggcgggacgggcccggggcgcgagcgccgtccagtccctgcaatccccatgg

SEQ ID NO: 22734 - DNA, 213 bp, Chlorella protothecoides
atgagggaccatgcggggccttcggcattgtaggtgctcactcgataaagtgctagcagatgcatttcagttgccacttaactgacgtgcaggatgcgggctcagcttttcttgctacggaaagaggcagccagagggtacacggaagtattggactatgtcaacagcctttctggtactgtctataatccctctacatctccatcggaacag

SEQ ID NO: 22735 - DNA, 68 bp, Chlorella protothecoides
attgtttgatctgcccttgacattcctgtgacagcctggactcgctctcaacacagtactcgggaagc

SEQ ID NO: 22736 - DNA, 112 bp, Chlorella protothecoides
acctgctcaaagtacctacatagggtgtcaccggatcagaacattgggcaattaggtctgcagtctgtctgctggcagagatggcagcatgcacggcacaaacaggcctgat

SEQ ID NO: 22737 - DNA, 66 bp, Chlorella protothecoides
aaaatcatgcattggagcctgataagcagaccccaccccacctgctgccagggcgtcggtgggttt

SEQ ID NO: 22738 - DNA, 126 bp, Chlorella protothecoides
cctcaagcggcggccagggcgggtgccgtgcagcagggctcgcacggctccgcctccgccgccccccgcgccggcccccgctcctcaccgccctcaaagagccatggcagcgcagcgggcatgtcg

SEQ ID NO: 22739 - DNA, 61 bp, Chlorella protothecoides
ccaacctatgcacacctccacccttttcccaccccaccatgccgcagcttctcctcggtgc

SEQ ID NO: 22740 - DNA, 71 bp, Chlorella protothecoides
gacgacctggaacggcttccgggaccttcagaagaagaagaagaagaagaagatgaggcagcagcagcagc

SEQ ID NO: 22741 - DNA, 61 bp, Chlorella protothecoides
gcagatgctcgatgacagggctcagaaagaagcagctgccgttattttggttcaaggatgg

SEQ ID NO: 22742 - DNA, 71 bp, Chlorella protothecoides
tccccggcatccagccccgcatcctccccaaccccggcggtcagccctgcatcgtcgccatccccgacggt

SEQ ID NO: 22743 - DNA, 62 bp, Chlorella protothecoides
accgtcggggatggcgacgatgcagggctggacgctggagagggggaggatgcggggctgga

SEQ ID NO: 22744 - DNA, 61 bp, Chlorella protothecoides
ttgatgcctgccccgcccctctcctccacacgttccaggaaacaaggtttcaatccacctc

SEQ ID NO: 22745 - DNA, 2456 bp, Chlorella protothecoides
  modified_base (1475)..(1484): a, c, t, g, unknown or other
  modified_base (1722)..(1731): a, c, t, g, unknown or other
gtgggcggccagccagccggccacgcgaggtgccgcgcgcgctggcggaccgcgacgcgctagacgcgctgcaccccgacggcgccgcctggggcgagctggcggcgcgggccgctgaggcgcaggtacggcccgagctgtactgcctggcagcgggcccgtacatggacgtggcctcgctggacgcctttgcgcgcggcgcggcgggcagcctgcgcctctaccccggcttccatgcgcccgccgacgcggctcggctgcaggacgacctgcgctgggcgctggcgcggccggcggggctggaggcggtgggccgcctgcgcgtgtccacgggcctcagcgtgggtcggtgttggggcgccttccaccgccgcacgcccaccgacctccacttcccggccatcgatgccgatcaggccctggcaggtgtgtttggatatgagtgtgtgtgtgttttttgggggggggggatggtgagggttgtgtctggtgggtgggggggatggtgagggttgtgtctggtggggggggtgtaaggaggagcgtcctttgtcacagatttccgttcctgcaccatactatccccttcccctccccctccccaaaaccatccacagcctccatcgaggtggacgagaagctggcggagcggggggaggcgtacgcccagttcgcgctgctctacacctcgcccgccggccggcggctcgtgcgcgtgcacaccttggccctgcccatcaccacggggcgcagcagcgccttccgcggtgccgacatggacgcggtgctggcgctgaccgcgcgccgagtggccgcgcaggcgcctggcaaggcgctgggcgcctgccgcgacgcggtcatggccgctgccgtggacctcctggtcgcctatcgccagcacgtacgtgggtgggttggtccttgtttcgactgcttgaggtgtgtctttgtgcgaggaaaacggggggcggggtggtcgtgctcgtctcggctttcaggtggggcgtcgagcccgggaggcgccccgaccgacggcctctctcccccgacccccactccccacccgacaaccccatcacgcgcgcaggcggcgcagcagtcggacacctcgcagctgctcctgcccgaggccctccagctcctccccctcttcagcctgggcctgagcaagaacgcgctgttcaggcgaggcgtggcgtcgtgggggtggtcagagggggggagggttccatgctgcgtcgcctgtgggctgctccccgcgaatcactggctcctcccagtcacccccctcgtccattacaacccgtctcgagcacacttccaccgggcaggaacgacgcgcggctggacgagcgggcgctgtggctgcaccgcctgctgacctgccccgtggaggccatggccagcatcgtgtacccgcgcctcctccccctgcacacgctgccgctggccggccccggcggcggcgcgccccnnnnnnnnnncctgtcggccgcctttgtcgaggcccacggcgtctacctcctggagaacgggtgcgccgtgctttcttgctgtggctcgttggggccctggtgtttggcgttgcgcgcctgcctggccccgctcgtcgcctgcctgccgcccacgactcgctcagacgccatccacccactcactcacgaccccctcgaccctcacaaaccacccacccccatgcgcccaggtacgaggccagcgtcnnnnnnnnnntgactcgctcagacgccatccacccactcacacccccctcgaccctcaaaaaccaccgtccccatgcgcccaggtacgaggccagcgtcttcttcggcaaggccgtgccccctgcgaccctggaggggctgctgggcgcgcacagcctggaggcactgggcccggcccccgcgcccctgccgcgcctggcgacgccgctcagcgcggccgtgaacgcgctgctgaacgaggtgtgccgccagcgggggcgcctgctgcgcacgcgcgtgctgccggcgggtgaggcgggcgagcttgccttcttctccgcgctggtggaggacaaggcgggcagcgcgggcgggtcctacgcggactgcctgcgccagctgcaccgcgccatcgtgaacaagctgtcctgacaacaccgcattgggcttggagaaccggttgtcaatcaccgagagcatgccaggcaggcacagcaaagcgcatgtcggcgtgcagggcgtgaaaactgccggatctggttcatcatgaaaggcggaggcggcgcagcgggtgcagggcatgaacgccgagagcgagcgcgggtttggggcattcgcacaaaccagccagctcagcctgggtgctgggggaccacgagctcggggtcaaagcccaggagctctgccaggacgtgcgttgtgtcgccggagccagcgccagcatcagcgccggcctccacgaagaggcggcgccga

SEQ ID NO: 22746 - DNA, 61 bp, Chlorella protothecoides
cactcacgtgaggcccttgagctccacgcgcacgggcaggcggccctgcagctccgccatc

SEQ ID NO: 22747 - DNA, 68 bp, Chlorella protothecoides
attcatagagcgcgggttgccacgggcgggatttcgcctcccagggtgttagcagcgaggtggtgcgg

SEQ ID NO: 22748 - DNA, 71 bp, Chlorella protothecoides
ctagcatgccagccccaggctcgggtgccggcatggagccactccaccctacagaagcgggggagtgaggc

SEQ ID NO: 22749 - DNA, 61 bp, Chlorella protothecoides
gccgggttctttggtagggaatgattgccctcctgccatgaattgacggatgtgtgggtcg

SEQ ID NO: 22750 - DNA, 119 bp, Chlorella protothecoides
tggcgtgaggtcggctggccctctgctccctgggccgcatctgcactgcagcctcaacgcggctgcatgggcaggcaccaaggtcgccaacctggagtcggccccgcagtggtcccaca

SEQ ID NO: 22751 - DNA, 65 bp, Chlorella protothecoides
gcgggaccacggtgggtggacggggtgggtgggctggtgggtcactgcacgcgcgggacgacctg

SEQ ID NO: 22752 - DNA, 73 bp, Chlorella protothecoides
cgcttgcctccccattactgaccgcagcgaccagcgtctcaatctgactgcccgcatacattcatcgctcact

SEQ ID NO: 22753 - DNA, 66 bp, Chlorella protothecoides
gtgtgtgtgtgtgtgtgtgtgtgtgtatccaatgggtggggggtatggggggtggagtattggcgt

SEQ ID NO: 22754 - DNA, 79 bp, Chlorella protothecoides
cccaccccttcctcggcatttggttccagcattccccggacgctcaccgtcccacgtcacgcggacggagttgtagagg

SEQ ID NO: 22755 - DNA, 81 bp, Chlorella protothecoides
cccattagtcagccatcagggctgaccaaaactaattgcgcatgggctggtatctgcagaagcccccatgcagctggtgta

SEQ ID NO: 22756 - DNA, 71 bp, Chlorella protothecoides
caaagcgatcgctgtgctctcagcggggctccaatcggtaagactcttcagctccctgcagtggtccccat

SEQ ID NO: 22757 - DNA, 89 bp, Chlorella protothecoides
actggggtgtgtgctgctgaggatagctctcctggcttgtcgacacgatacagggattccctgggacgcttgcaagtggtgcgggagtg

SEQ ID NO: 22758 - DNA, 76 bp, Chlorella protothecoides
ggacgcagggccggatcgcagacacacacagtgccatccatgctttcataggctcgtggacagaacacagcgctca

SEQ ID NO: 22759 - DNA, 63 bp, Chlorella protothecoides
gtctcggcctggcacaggcggcggtgtgtgggggggtgtggttgtggtcatcgacactgcggg

SEQ ID NO: 22760 - DNA, 599 bp, Chlorella protothecoides
tgcagtatgggttaagactccggtggaggggaacaaagtggattatggcagcacgtgcccgtcccttcgatcagcatatgccccggataggagggatgggcacgtgctgccataatccactttattaccctccaccggagtcttaacccatactgcacagcagttcctagggaaccgccggcgatgggaccggctgcatcagtgcttccatggccgtcagccatctgtggatcactgatatgcactattcaccccaccagtggggctaggaagtggcgggagaattcgagcatcagatgagaaagttttggggggggtaaatctgctgctgaggcaatggcgcagttgtgcgattggaagcttataaaggagtcctgcatagcggataatcacgcccacatgacacaccgcctatcccctggccagaatcacaccacggaccaccagctgtctccccgccaaacaacaccacgcagtatgctgggcaactcaccctgtcactgccgctgaatggcagggtatcgccctctggtctccactgtcgaagatagcccccaaacatggccaaacgcgccgcatccgctcccatcttgagaggg

SEQ ID NO: 22761 - DNA, 64 bp, Chlorella protothecoides
ggactccccaagccccagcccggaggattcgccttctcccagccccgaggactctccctcaccc

SEQ ID NO: 22762 - DNA, 79 bp, Chlorella protothecoides
agccaatcagtggtgaggccgtgccgacggtgtgcttcgctgtgcttcgtcgccaagactctggaaagggtcaagtgtc

SEQ ID NO: 22763 - DNA, 75 bp, Chlorella protothecoides
ggcgccgcagtagggccagggtttggggcagctgtaaagaaggcgggcgccgcagtagggccagggtttggggca

SEQ ID NO: 22764 - DNA, 64 bp, Chlorella protothecoides
ctgctgcagatgatccattcgtggtaggtgttgtggagggggggccagcaaccccggccgctgc

SEQ ID NO: 22765 - DNA, 119 bp, Chlorella protothecoides
ccctaccactgttctgagattctaacacacaccctgcatggacgtcacaaaggtgtcccgtcaggggacgatgggggcagggagaaggggtgccccgctgcgcaagggcagggggaagg

SEQ ID NO: 22766 - DNA, 269 bp, Chlorella protothecoides
gtcgacctgaatgtctcccgcatcgccgcctggaactcggacaagctccctatctacgagccaggcctcgatgaggtggtcaaggcttgccgcggccgcaacctcttcttctccatcgacgtcaagaagcacgttgccgaggctgacattgtgtttgtgagcgtcaacacgcccaccaagacgcgcggcgtgggggcaggcaaggccgccgacctcacctactgggagggagctgcgcgcatgatcgcctccgtgtctacgtcctccaa

SEQ ID NO: 22767 - DNA, 206 bp, Chlorella protothecoides
gtgtcaggggagaggcttgcaaacactgggtcatgaggagcaggtacgcagcattgaaggtttcaggggaaagccgaaagccgatcacataccatgcatcgagggttgccctgcagaggcgcagcaggcatgcaggctgatagagcacaggccacagcaatcctccgccttagtgttggccatcgttctgggtgacgccattcacc

SEQ ID NO: 22768 - DNA, 93 bp, Chlorella protothecoides
ataccaggggggtgcaggtttgagaggtagagagggtggggggcacaccatcggcgtggagtatctggggtcacgcctgcccaccataccctc

SEQ ID NO: 22769 - DNA, 76 bp, Chlorella protothecoides
tgtgaagacacatgactggagctatatagcatcatgcaaaatgaatcgcttgctgagatggagtttcagggtacaa

SEQ ID NO: 22770 - DNA, 6273 bp, Chlorella protothecoides
gccgtccccgccccgccgacgggggcccgggctcggcccggcctcccacctcccccggcgccgggccgtggcgcctcggcgcctgggtgtacgcgggcgcgccctgggaagggtacccctgggccagatgcacggcgggcgctgcctgccgctccgcgccgccggcggccaccgacttcatggggacagggccgcccgccgcgccgccctggggatggcccgaggtgaccatggagccccgggggggggcagagctgtactcgctcccgtgcgtccccggccgggggaagatcggcgccgcggcgggcgacgggaagccctgcacgccggtcacggcttgggcgccgttcgaataggggccagcggcaggggccgtcgtcattgcctgctgctggccgaggtacgcgctggcgccagcagcgccaggggtggtgagcgccgtgtgcgagtttgaggcggccaggccctgctgcagtctgctcaccaggctcggcggctgctgctgcggctggtatgcaccaggctgttgctgctggtaggcaccaggctgctgagactgctgctgctggtaggcaccaggctgggtttgtgcctgagcggggaggatgccccccctcgaccctgtgccgccgccgctccctcgcacgccgctgaacggtcgtgcgtagacaggctcattaccctgaccgcccagcatcggggagtggctgcttgcacgggcatcggcgctcgggccggggacaaagtgcgtctggtgtgttgcgccggtgtagccctggctatggtttgcagagaaggggcccggagccaagggcgatggggccaggcccgggggtgccgccgtggcgctcgtgctgtggccgtgcggcgtgggagcctgggcgggggccgcgccaggaatccgctccctttgcgcccggcgggggtcgaacggctgatgggaggtggcacgcgggagggtgggcggggcgtagcgcggctccggctgctgctgctgctggtgcgaggtaggcccggcggtcatgccgccatgccttggcgcaggctcgtggctcagccccggggggccggagggatcatatgcgccagccaggctgccataggcgctcatccccatcggctgcagagtgaatgtgaagcagagggtgagagaaagatgacattgctgccagatgcacctcgatgtctaacaatatatcagtgccgacttcgcgcagagggtttgaaggccattgacacccatggcttgcacagacctggtttgatatatttccagcctgataggaggtggcaggcagggctgtcgactgggcatacccctggacacaagaatggcacagcgttctcaggaacacagatgaggaccaggccctacacaataaagaaatcccaatctgaggatactcaaccatcatgcagacaatggggatccacctctatgtccctacctgctgcgcggatgcgccatatgcgtactgctgctgttgagagggtgcttgtgcctgcagggttcgcacggaggccagtggcgcatgcatggccagcacaggacttgacagggacacagaggtccactttccaggcgtcgctcaaacctgccttgcggctcaacctctcgccacccccagcacccgtcacggagttgcatgaacgcgatggagcagatacgggaacattcaccagcccgaaacctacagtacctgctctgagggcgtcatccattgagaagcggcacctggctgccctccaggtgcgttctggtataatcccgggggtccttgcccgtactgagacatctcacacacttcttcaaaatcggcttacatcttcacgtcttagcatcaccatgttcgcggacaaaagcactcgctgctccaatgcccccatgtggtggcttcccgccgcgtgcgcgcacgaatttgaactggggaccgagctaatgcacacattggagaagatacctgtaattgtgatcacacacgatatcgtcatacactgtacctccatcggccatcatgtctccctccgcaacgcccaagtgggtgccggccatcaccaagccgctctctgccatagcctccctgcccgtctcgccggatgatggcaaggtcgacatcagcgccctgcaagcagccctccttcagagtgttgggagctgggaccaggtgcgcgctgtggatctcgcccatcgagggttgctgtcccgtcgttctcgtgcgcggccatagtgtcaggtggaggtacagctggcaggggagcatctcgttctgccagcttgcgccgagcctgagcatacaccttgcgacacaggtccccctgctcaccgatgataatgtggacggcttcccctgtgggaccctggttcgctacaccggcatggtaagcaatggagatggagtaatggggtagacagtgctagatatcctggcacctcaagctcatcatccagcatgtatgaaacggactcaacgtcccatgcgccgctttccaccccccttcctcaacgtcatcactgttgtcctgatcccacccaccaggtgcaagacatgttgaaccccgaatactatgtgggtgccgtccagcttgcagacggctcctgggtgtcagcccgcttccaggaccaggtgaggcaagcttccctgagagggtggagcacggctgcagcaccatgcgctgttcagatcccagcgagcacgcccccattccctgcgcgctcagcgccaccttgccgactgcaccgtgctccctgccaggtcagtgagtgcatgccttccggagcacccacaaagatcgaggaacggcgcccgctcttcctcaccgccccgcccggcacggctgactgggccaggcccgccccggtgacccctcctgaagccaaaacctcgcccagtagtgctcgcggtggggccctggaatgtggctgtggagttgggccgtgcctgggggtgtttgcagtatagccactccatggcggcaggtcggcatgtccagtttgcgcatgtgccactcaccctggtacccccgtctgtgccagggcctggtgggaagagggagcgtgatgcggacggcgccagcatgaatgcggaggaggaggcccccgctgtggtctcacccgcggcgcgcgccaaacggggcagccttggccaggggagcacagaggatggtgaggcccccacactggacacatcctgtgcagcagctgctccgagccccgtcggctgcatggtgtatgtgagtgcggaatggggtgccggggctgcgccagaagagctggggtgctgggagaggagctgcaacctgcccatgctggaggggaggcttatggcgggagcaggcgctcgctgatgcaaagcagcaggtggtccctgcccatgatcgcccttccccctgcgttcctccaggtggtgaacgacctcaaagctcccgtcctgaacgacatcgtcaccgtggtcgggatcttgagcatcgtcccggagctggcggcctgctgccaggtggagatagggacagcatgccaggccatgggtgctgatggaagagcagcgtcctggcagcctctgccctgcctcctgcatcagcctggatgaccactctccctgcaccccagcaggaggacgccatggacgcagagctggcaggcagccacccccccacctcccgctgcccccgcctccacgcactggccatcctgcccgggcccagcccagccccgccgccagccccactgccgcccagcgccattgcggaggcccgcctgcggaccataggcctgctgtcgctggtcctaggcggcgacgacctggcggcagagtacctgctcctgcagctggtcgggaggtgggtgctggcgaggggaagggtcaccaggctcgcgccagccaggggcctgtctcatggcagggaccgcatggcgtcactcctgagttgggcatcgttctctcctccgcccaaaccctctccccccaacccacctgcctccgtgtacacagggtgcatgcaaggagggaggatgccggcgtcatcggcacgggctccctcaacctgaccggctgccccgccgggcaggcctctggtcccgcctccctgtcgtccctgggccaggcactggcactggcactacaggccctcatgccgcgctcggtgagcctgggcctcaccacctcccaggtagttggtgtgggcatggtaggtcgcacgggcattctggactggtgttcaggaggagtgttggaccccggcaaaacctgcagagtcaatccgtgtgtgtgtcactcgtttcggccctggccgaatctcagcgggtttgaggtggtctgaggagcctggcccctggtggacgaggctgggtggggctggcgtgggatgctggcccgtagggcaaggctcaccttgtgtccaatccctgtcacaccacctgcagctcaccgccaggccttggtggccccgccgggatcagaacacgcagcgtctgctggaggggaggcttcagatggccaaggggacgcaggtggggaagagaaaagggtggttcctcgatgtggagtacgagcagcgttgtgttccagtgcagcgcaagacattgcgtcgtgctcggtcgctgtgcaagggccagaacctgccttggaatgagtgtaagcgtgatggtacctgtctccgcggtttggagctcacacagaccgcttcatcctgacccagccctcatccagccacccttgccactccccaggttctgctggacgagactgtcatgtcggcaggcaccctcaacgaagtcggcgtgcgtaatcttcaggtatggaggtttaggggcgtggtgatagttctggatggagcaacagggagaaggagccgacctgtggtacagctgtcgagaccctgagcctattgtacaggccaataatatccctttgcaccccaaaacgagtgcctgcatacgtcctgcactcatcttgtcatacaggcctcttctctagataggcgtcaacaacccacccaccacccttcccccaggcggtggatgtgctggtccgcacacaaaaagtggcctatgacttcgaattcttctccctggatcaagaggcagatgcccccgtcaccgtcctgtcctgcggccgttcactgctaaaggacgcgctgggcacgagcctgcccctggctccaaccgcgccgctgggtgaggggaggctgccgtgagctgcgccaggctgcggttgagagtgttgcctggcacgcccatcatcagtgcgaaacgtgacattgcagcgagccagaatccctccccaatcatgcgcctctttcctatctccacagccgagccggagagcctggcgagcatgctgcagacgtccagcctggacggcgtgagggagtacctggctgctgtgagggcgcttgactttactattccctcacatgtagccgaagtggtggagaaaggtgagggggatttgtgtgtagtgcgaccagcatgcagaatgtttcaagtgacagacttccctggctgcccctgggctcacgaggatctagttttctttccccctccagacctagccagcgcgcggcagaaggacgcagccattacgccggccagtctgcaccacttactcaatgtaggacatgaaacatacatttttggatggtgggacgacccttcaagtcacctcagggactggcatttgtcagcactggcctggcttccggatgcaccctgcagagactgttcaaagaagcatcattccctccgcatcgacccccgaaaaccatcatggcaggtggcgcgcctgctggcggtgagccacggcgaggcggagttgacggccggccgctgggcggcggtgcagtccatggagctgcgacggagcgcccgctgcaatcccacgcccagtgcctgaggcaggctggtcggcgcgccgaccagcctgcatcgcacgccctgcccagcgcccatccccatccccaaaccgcctctgccctccacctccacctgggctgtggcctgggcaagtacatgtctgacagcatgcaattcaagttcaaactgagtcatgtggggcaacctacgcggtgcagtcctgagcgagcaaagcaggggaaaatccgggagtgcagtaatgcgatgttcacgcgcgagaaggctggggcctctgtcattcacaggccagcgtgggtaagtgctagggaggaggagtgcggggagggcgggtaaacgcgccctttgggcttgcgggtctgaacttggggttgcaggtctgaaggggggaaaggtgggggggg

SEQ ID NO: 22771 - DNA, 74 bp, Chlorella protothecoides
tcggggtcttgttctgtaacattcctacttaaggtcatatacatcagtccacgttgtagggtctaaaccgcccc

SEQ ID NO: 22772 - DNA, 64 bp, Chlorella protothecoides
catggcatggagctgccaagcaccatactccattttatgcagaacttgtgcaccaaggggtgca

SEQ ID NO: 22773 - DNA, 61 bp, Chlorella protothecoides
ccgtcccaaggcacctcaacctacatcacctgtctcccagaggagatcggggacagttgta

SEQ ID NO: 22774 - DNA, 61 bp, Chlorella protothecoides
atctcccccccaaagtcgttgcggctggggtcgtccttcagcagcttgatcatgacatcct

SEQ ID NO: 22775 - DNA, 19630 bp, Chlorella protothecoides
  modified_base (550)..(559): a, c, t, g, unknown or other
  modified_base (904)..(913): a, c, t, g, unknown or other
  modified_base (1353)..(1362): a, c, t, g, unknown or other
  modified_base (2122)..(2131): a, c, t, g, unknown or other
  modified_base (2364)..(2373): a, c, t, g, unknown or other
  modified_base (3192)..(3201): a, c, t, g, unknown or other
  modified_base (3835)..(3844): a, c, t, g, unknown or other
  modified_base (4531)..(4540): a, c, t, g, unknown or other
  modified_base (5155)..(5164): a, c, t, g, unknown or other
  modified_base (5505)..(5514): a, c, t, g, unknown or other
  modified_base (5745)..(5754): a, c, t, g, unknown or other
  modified_base (6368)..(6377): a, c, t, g, unknown or other
  modified_base (6766)..(6775): a, c, t, g, unknown or other
  modified_base (9319)..(9328): a, c, t, g, unknown or other
  modified_base (9441)..(9450): a, c, t, g, unknown or other
  modified_base (9633)..(9642): a, c, t, g, unknown or other
  modified_base (10448)..(10457): a, c, t, g, unknown or other
  modified_base (10730)..(10739): a, c, t, g, unknown or other
  modified_base (11198)..(11207): a, c, t, g, unknown or other
  modified_base (12459)..(12468): a, c, t, g, unknown or other
  modified_base (13026)..(13035): a, c, t, g, unknown or other
  modified_base (13126)..(13135): a, c, t, g, unknown or other
  modified_base (14027)..(14036): a, c, t, g, unknown or other
  modified_base (14261)..(14270): a, c, t, g, unknown or other
  modified_base (14834)..(14843): a, c, t, g, unknown or other
  modified_base (15258)..(15267): a, c, t, g, unknown or other
  modified_base (16048)..(16057): a, c, t, g, unknown or other
  modified_base (16221)..(16230): a, c, t, g, unknown or other
  modified_base (16883)..(16892): a, c, t, g, unknown or other
  modified_base (18822)..(18965): a, c, t, g, unknown or other
  modified_base (19057)..(19125): a, c, t, g, unknown or other
cccgccgcaggtcttcctgccgcgggccgcgctggctggcggagggccggggcccctgggcgcggtgccggacgccgcgctgcgcacgctggaggtgtttgtcctggacgacgccgagctggcgcgcggcctggaggcggcggagcgtggcgatggagcggcgggggcggagggtgcccccggcgcggaggggccggaggcctgtgcggccacgcgtgcgcgcctcgagcgaggtagggtcagggaaacgagggtgagggactcgcctttccagctaggcaggtctggctgtgcttgtcgcgtgcgacatgctgtgttctggcacgtgcacctcgtcatgggtgaggattgccattctaattgctctcagcctccattgcccctccccgcatgcccagatcctgggctgcgactggcgctgacgggcgcgctggtgggactcctgcagctcatggtgcagggactggagacgggcgatggctgccagacgctggaagcggatgctgagctgtccagcactccgacgctgatggccgggctcagcgccaannnnnnnnnnggatggctgccaaacgctggaagcggatgctgcgctgtccagcattccgacgctgatggccgggctcagcgccaaccagcgggccgcgctgatgtaccgcatggagcaaaagtcgctggcgagggactggctggcacacgccaagagcctccgggcgatggccatggaggagctgcgcgctcaaggagcggagtgacgggcacgcccggcaatgtcccggccctgcctgctcccgctgggtgtcgcgaccccagatcaatcaatgcaatgtattccttctaccagatcaaaattatcgtcagtgctgggctaggcatctgccgaatgttcaggccatatgatccnnnnnnnnnnccagtcaatgcaatgtattccttctaccagataaaaactatcgtcagtgctggtctagacatctgccgaatgttcaggccatatgatccaccgcatcccgaccccgtgatacggaaaaggggggaagagtggcggagatcacagaaccttcgctccgtctcggatgcgacttcaggaggtaccacaatcagcagacgtaaggatagtataccctagccaagatattactgtagatgaatggggtcgaagccagacagacggggcccgctcgctcatcgtcccatggacagtccgacacccacttaatgacgaccggggtgatgctcgcaaatagcgacgcacagcctcgagcaccttgcgcatgacattgatcctggacgtggaatttgagctccagttcttgggaaatatgtacgccatgctgtccatgcttccttgannnnnnnnnnggatgctcgcaaacagcgacgcacagcctcgagcacctcgcgcatgacattgatcctggacgtggaattcgagctccagttcttggaaaagatgtacgccatgctgtccatgcttccttgacacattgtcgttcttggtcctgacgccgggcgggtctcgacgttgccgcgtgtccttcccgtacccacgctcggcggtgggaaactgtgcgcgaagcagcggcaggcattcatgacagtgatgtacggttgcattagcgagtgaaggagcagagatctgaagcatgcatgcctcgctaacactggcatgcctgtgcatgctggccctcgcagggctgggcgtcgcacggccggcacggacgctcctgcaggtgtgggagccacatcctgattgggggcgactgtgccgatcccacatgacgatctgccctttgaactacacctcgagcccttgcacccatgcaggaggacatggacgagtttgttcgcgtgcgagggacacagttcgtggtggggtgcaagacgtggtacgcgtcgggctggaaccagtgggaggccatggaggcaggagcgggggccctggagctgtttggcgcctccctccccaataaaaccactggaccccaggtgcatgattactttggattcaggaacgagggctgcactcagcctgctgcagctcagataccttggagtatcggagggtgtgtgcatgtgccggcctggcgccaacccatggtgtgttcgctccctggcaccnnnnnnnnnnggtatccgagggtttgtgcatgtgcctgcctggcgtcaacccatggtgtgttcgctccctggcacccttctgccagggcgttcggcctggagaagaaccccatggcatgttcagatgtgggttccttctgtacatcgttctttccccctcacagcccgctctcaaacaccttcttcccctccatccatgctttcctcagctggtgcgggacgtgctggaccgcgcccaggccnnnnnnnnnngcaccccgctctcaaacaccctcttcccctccatccctcctttcctcagcttgtgcgggacgtgctggaccgcgcccaggccaagggtgtgaacgtggtgcgggcctgggcccaggccgtgacccccaactacgcgctggagaccgcccccgggcagtacaacgaggccgtgttccagggcctggactacctgctggacgaggcgaggcagcgcggcatccgcctgctcctggtcctgctggacaactggcagccggggggcgccgacacgctggccaactgggcggggtcgaacgtgcacgaggacttcttcagcaacgcggacgccaagcggctgtaccaggcgcgggcggaggcaatcgtcacgcgcgtcaacgccatcaacgggcgcagctactcggaggaccccaccatcttcgcctgggacctgatcaacgagccgcggtgctaccgctgcggtgccaccaccgccgcctgggcctcggagatggcggcgtacgtgaagtcgctggacggcaaccacctggtgacgatcggagaggaggggttctacccggccggccaggcggcctccgccgccaacccccagggcctgcagtcctgggcgtttgaggagggccaggacttttatgccgaccacaacgaccccaacatcgacttcacggccatccacctctggcccgacaactggctggtgggtgcttgtgtggcgagggcgccctgcatcagggcgggagggggtgggtgggcacagcgccacgagcctcggctggctgggaagcagtactgctgctgggcttcaggagatcctttacgagnnnnnnnnnnagcatagcggcacgagccttggctggctgggaagcagtaccgctgctgggcttcaggagatcctttacgaggagcccacgggggggggagtagccgccagcactcctggttgcaagggcgaaaaggtgggaggctacatggcatccatgattttcaggaacacatattgcgcacgtggtgcaccaaaccagaggccgctcatgctcatgcccctccctctccctcccatgcaggacaagaccacggactttgtggagcgctggatcgcccagcacattcagcaggccgcctccctgggcaagcccatgctgctggaggagtgagtggcagtcgtggggaaccattgcgccatgggcggtggtggggacggggcggggctggtggagggagggttgtgtagtgccacccacggccccaccactccacccgcacttgcaggtttggcgtgtaccggtcaagtggggccgacacgatgcgggaccagtactacaagctcatctatgacctcatccaaaaggtgctgcaaagggtttgctgggggtgattggcatgggaccctaggaaaggggcaccggcatacgcatgtattccacaccgacaattctgtgctcaaacaactttgccaatggggatnnnnnnnnnngaagggtttgctgggggtgattggcatggaaccctaggaaaggggcaccagcatacgcttgtattccacaccgacaatcctgtgctcaaacaactttgccaatggggatcgagcaaagttgattgccccccttaccccaccccccattcccttgtttggcccgcctctgcctgctctccagccctgcgttaccaaccttccacaggacgccgagtcaggcggaccctcaggcggcgcgctcttcttccagtactatgctcccggccagcaggctccctcggaggagggtggcggtatcaccggcgtctttggcgtcgtggaggccgacaacaccttccccatcatcgacgccttcaccgccagcatggcgcagctgactggcaagagcgtgagccagtgctccgccacgtccggagtatctgtcaccaccgtgcgtgactgctcctacacgcaagtcaacgggcgaccgggcacagggtgagcgggggattcactgttggctggtctggcaggggacggctgggagcgggcatcctaatcagggagaggtaacggtggtgccatgaggcagctggcaggggtggccggattaatgtccgacacccaagggtaggaaggcccccgccatttgatgattgtgccatcaaccgcctccttacctgcccaggcgtcatgtgcgcgccgggnnnnnnnnnncacatgattgtgccatcaaccgcctccctacctgcccaggcgtcatgtgcgcgccgggacctgctgcagtgcctcggattggtttcctttgacgacagtttgtccacataaccacccccaccccccactgttgccaggtatgagggccccgcctgcgacgtggacatcaacgagtgcgtgcgtggcacgtcaggctgcgcgatcactggggccgcctgcaccaactcggcgggcgggtacacctgcgcatgcacgctgggctacgccggggacggcttctcctgcaaccccacgcccaccctggaccagctgcagctaaactacaccacccagggcgccgcgcagctggcctgcgacgaggggcaggacgtgaagtaccccaccggggtcccgggctttgcttacgacccgacggggggcctgtccagggcggatggggcctccgatgccatggtggggccaagggggatttcttttttgtggggaagtgcatctttgaggggtgcgggccacgtgctgcatgctggggaagtgtgtattggggggaggttgacacgatcggcgtcatggggctctccttgtgtcatgctagtagccacaaggctggccctgtcnnnnnnnnnngttggggggaggtttgatacgattggcgtcatggggctctccttgtgccatgctagtagccacaaggctggccctgtcctgataaccacgggggacttcagcagcccttgccaggaattgcttccagcaaggcttcacacgctcaagcaatcaaatctctgactccacactcacattcctgcctcttctcaggtgagctccgggtcttccatctcggtgcagccggtggactgcatggcggcctgcaatgaggcgcccggctgcacggccttttcctacaatccgtccctccaaaagtgcttcctgaagacggggtcgtcgtacaacacctgccaggtgannnnnnnnnntggctgcacggccttttcctataatccgtccctccagaagtgcttcctgaagtcggggtcgtcgtacaacacctgccaggtgaggtggcacacactcgcaggccaatagcgtgccccatctctggattgcatggctcagcaggcgatttgatcttgcacatccatgatttccatgatcaagtaaggtggggtgatattccaagtcttgtcgctcgtcaccacagttcacannnnnnnnnnaatccatgacttccattatcaagtaaggtggggtgacattccaaagtcttgtcgctcgtcaccacagttcacaccctgcaacacgtccatatctccacaggcacaagagacggtgtgcacatcttcacgggggacgcagtattcatgcggattctggcagtcgtactacagagaggacagcgggagcgcctcgacagcagtgcagtcggcctcccttccctcaacgtccccgtccgattctagtacaggaaattcagaaccagcaggtgcaagcatcacattgcttcagcgagaaatcaactcagcagatggagaacccagtgcatccccctcaatcagcctgcttcagtcctttgggtagaatcctgcctcttctagtggctggcaatggtattcccatattcttccgtattccaagtgtcgaactctagtgttctgaacggatgcttttccatgtatataacaaatctgtaaaccctccccatagagaaactaacaatcttcccgcccaaaacacatgcattcaaatcagtgtgcaagcccacactgtcatggcggagtcttcgccttcgatcagccactgagatcgtcattacattacattacatgtcgcnnnnnnnnnnccacaaatatgtaaaccctccccatagaaaaactaacaatcttcccgcccaaaacacatgcattcaaatgagagggcaagcccacactgtcatggcggagtttccgccttcgatcagccactaagatcgtcattacattacattacatgtcgctgtagatcgacctgggccggagcccgcccagcccctggacgtgagatcgaggtgagcagggtgcccgcacgtccatttcctgtgcgcggagatgaaggactcacagcggcatgcataggatttgggaaaaggcataggagttcaagatcaataaaaccagcgcttacgttcctcagcgcagtgaactggtcgaattggtgccttgtcgggatgagcagctccgacagcgacctgcnnnnnnnnnnacaagatcaataaaagcagcgcttacgttcctcaacgcagtgacctggtcgaattggtgccttttcgggatgagcagctccgacagcgacctgcatggcttgcaggccagtgccctggccgtgctgaatgacaacccagagggcgttttattggttctcaatggaatgaacgaggtaaagtctggtctaatacgggatgagcgaggctggcgtcgacattgctcccaccgcatcgtactcatggacaagctgaccatgctgaaccccatgcaggctctcaggaagcaggatcctgtccttcagaagctggaagtagtatcccagctcgcggccctgtgtgacggaagaatcaggtgacaaccttgctcttgattctgccatcagagacctgtggatgtatggggcatgctccttgcttacttctcagtctgattctcctccctagcagacctgacgagccatctctggccaaggcagcatcagaaaccgctgaggcggtgtgcaagctcctaggagaagcggcccttgcggtgttgacagataaggtaggaggctccatgctggtatggaagaaaatggtggtgaagtgagtgtcacagtactccacatcaggtcttgccctccatctgacaggctggcgagagcatctgcgagatgctcctcctcatgtctcagcttgggctggtggagatgaaggggaagggtaagtgacttgatacagaacatgagaggttgggagcagggtatagttctggtccagagatggatctgatgagagtgcttactggttgctgtcctcttgaaacccagactcccattgtttacttctcaggcgaaaagatggagaggctggcccagagcctggccccgcacttcatcccagtgtgcacagacctcttcacaaagtccacgtaagtacctggggggcaaatactcagaggcagataaatctgtccaactcaattcctatcctgctctgtgcctatgacctcatcctcagacatgtctttgaatgcactctcccttgatggaaaagcaggacaagcagtggcagtcgcctgcaccgcagcattgcttctaccctgctggactacgtgtttggtaatcgtgcggccatctctgtatttggaaaagagaagagcaggctttcagccctctatgagactgccttgggtgacatcagcgacgcctcaacgcaggtggatgggactaagaagggttgactgcagaagtccaggcttgtagcagagtagtgtgcctctttggttggggtcgtctctgctgtctgtgggacaccattgggatatctcctgactccagatgtaagttagcagactatagatcattttcaattgcgctctctcactccagctggacgtcctggagatcatgtaccgatgcctcagggcaaatgccaagtgtgctgaggtgagtggggctcatgtgttcaggtttgtaagtctctggggtgcgattatatgacacctctgaggtaatgctcgctgaaaactttccagcattgtgattctgcttctgtacctgcgtcacgacttagccacagactctgagtatatatcccctggacctgctgtgcaggccctgccgcctgctgtcagatctgccttcagggaagtagcggcaaagcctgcacgggaagtcaacctgccagaagagctccgatccctgctggtgtcctgcacaaagtcccttgaaccaccaaggaggaggtagggccctgggtgtcaggatatggattcaggaaagaacaccttgcttcagtgcatgctgaggagtattcaaataccatgcccagcctgcggccatgcaagactgtctctggtggcaacgcaatgggtctggctcctaccaccgtgcacccctgcaggctgttctcctcccagtcgacctcagtgagctgtggcgccctgacattcaaggatgtctgggtagatttcgggctgaggcacttcaggtaggaggccttggatgctggtggccatctgcaatcggcaggccatgttcaaatgattgccgaggtttgcatgcatgccctccaggtgccatacttgaagtccacaacaggaagtttcgtgcaccgccaataacagcacccaccttcaagtcccatcctgccaaggccgacgaggaaacccctgacctttactcgcagcatgtcgattccagccaagccggaggaggatggcttgaccgcgatggttgacattctggacatcccctatggtgagagaggcgaatctgttggtgttgagcctgtcgtttgcagggcagcgacgtcattctatcaggtcaagtcagccagctccttgccagcttggtgatgcccatgcaccgaatgtttcccccctttcccaccccatcggccctgctccacaaccccttcgcccccgcgtcgcaccatgcagaggatgttgcctcgttgagctgggtgcttgcagattgccagccccctgtgcaggcagctgcagctgacttgagggtggacctcaagaggttgccccaggacttggaaagtcttctgaagtnnnnnnnnnngcgtcattctatcaggtcaagtcagccagttccttgccagcttggtgatgcccatgcacggaatgtttcccctctttcccatcccatcggccctgctccacaaccccttcgcnnnnnnnnnnggtatgggctggatcacgaccttgtttgacaaataatgtacaaggaaatgaggctagaatccccggccctgtactggggaaggttgtcgtggcacgatggtgtgcgtggacattactgttgagcagcctctcatcaacttcatgacgccggccggtcatgcaggcaccgcctcccaaccttgnnnnnnnnnnaatagtgtgtgtggacattactgttgagcagtccctcatcaacttcatgacgccgaacggtcatgcaggcaccgcctcccaaccttgtgcctggggcttgccaaggacttccaccaacgtatccgggaggatgctccggctgtggctggggccctggctacatccgggctccttcccacggaggcaagcagtgggcgatgctactgtgccctgcaggcgctgacgcaaggcacaccaccatggccccacccccatgaaccctcccctcctccgcgatgcaggcatgcgcccccattcggacgcccctgccggatgtgtcacagggaccgcgcaaggtctcatggtgggtgccacgcagggtgtgggccagccgtcacgtgccctgtgccgcactgatgcctggacagtcaggacctgggctctgcacccatgcctgaccaagccaccctgcctcccccggcctcccattccagggggacttctgtgtacagggcgctgcccctccgcccctccccccacgccggcagtgtggcgggcatgccctcaggcctgggcgaggctccggcgccgtgcccggccagccccgggcgggcgcggcagacgacccagcatggaacccacgccgggagtgggggggcatcccgcacccagagcaccgcctgctgcccccccagccaggatgaggggatggatgccctgggggaggaggaagagggggtgcaggagccaggtgcgcgagacactggattgagtaggacttgatgtcggggccagcaccgtaggagctgggcgagggaatcatcgcnnnnnnnnnnagcatcccgcacccagagcactgcctgctgcccccccagccaggatgagggagtggatgatctgggggaggagggagagggggtgcaggagccaggtgcgcgggacactggatcgagtaggactcaatgtcggggccagtaccgtaggagctgggcgagggaatcatcgcagaccctttcgcagggcccctgggagcaaggcatggaagagcatgcagatcctactggaagatgctttcacgggtcgcgggagcaatcacctggccatccctnnnnnnnnnncgagcaggcagctcctactggaagatgctttcacaggtcgcgggagcaatcacctggccatccctcacctcaccctcacagcagccccggggaacccccctcacctcggcctgaagcccatcctggaggaggacagaggtgaggggtgcaggagtcattgcctattggatgcagccgggatgctggtcttgattagctgccagcaaggtctcgtgggtgtggcctgtcatgggtgaagcttgagtggtgatcgaggtgccaacagcatctccctgccctctgcagatgccagcctcaaggccgccagcatcttcaccactgcggaggccccaaaggtgacttggtggggcacgtttcccacttatgattagacctgcccattcagtgcatgtccaatggattcaagcatgcatgctcttgactgcactcggaaacagctgtggccggcgacgaaggggnnnnnnnnnngttagacctgcccatgcagtgcatgtccaatggtttcaagcatgcatgctcttgactgcacacggaaacagctgtggccggcgacgaaggggctgcaccccccactccaacacacttgcacagaaggaggcgcgtgagcccacctcgaagttggcgcccaggtcccgggggaagtcacaggtgagcattccttgttgtagtggcattgactagcatgcgaccccaatgagctacgcctctgacagcgccatggcgattgatgcagggtgagattgtccatccaagcccagagccagagtccaggctgccccagggtgagccgggccgccatggcatgcacatggcacagacgtttggactgagcatgctggtggtgatcaggagaactgctccccccagctatgatcccaactgcacacagggacaccctgtgtttccttcacttttcctgcaggatgcgtgcttcgtgccaagcccacaacctatctcagcaagggaaggccagatgcacctaggccctgcacctacgactttctaccttctgcccttgccggagcggatgtgccagtacgcccggtgagtactttcaaagggaaccaatgtcttcctcccttctgctgcccctcgcactccagcaacactgaacctgagctgtgtacgtgatccggtcctccccacttttcaccaacgagaatatgttcctgcgaagcagggatcccctccacttgctggcggagcggtcgatgctggcatccagatggtcagagacccgccggctgcacgccgcacggcgctgacacccctggcagccatgaagcgatggacccctcccaaggagggccagcaggagcacggggagaagaggaaccacagatcgcaccccaccgcgatcgacgatcgggagcgtccagcggagaaaccatgccaggaaggggtgcggcccccggccaagagggtgaagagcagggcgccgtccaaaaccgcagacaaacccctgaagcaagtgcttggcggtggaaagaggggaaggagcattgccgccgctgctgacacccctcgagagctggtgcgatgcagtggcacctggcgttgggtcatggtatgggatgcgtggttgttttaatgtgccctctggacaagcacctcgctgcagaggggatgtgggtgccaaattggaggtgccacccatcaacgaagtcccttccccatgctccaggctgttgcggtcacccggcgccagcccgctcgagcnnnnnnnnnngattggaggtgccacccatcaacaaaaccccttccccatgctccaggctgctgcggtcacccggcgccagcccgctcgagccagcaaaatcactgcggtccagcgcaaagccagggtgagcatggcctgcattcacctggggggggacatacttgcagtgttgtgcgtgcgtctgtcaaggctatttacccatggttgactttcttatcaaatcaccagtgtctaaaatcacgaaacgctcatgccttgcatcccttgttgactctccttttctgccctgatgtgcgtgctccctgccccagacggccgactctgaccaggaatcagcgagcgagggacgcgggacccctgaggatgctttagcaaaaaagccacggcctgcggcgcccgtctcctctgcaccccccatcccagccacgtcgaccttggcgcgccaggtcaagccagctggcaagcaggcgcagccgcaaaatgcaggtaaggtgtgcagagaagaaggccaagtggcagctgacacttgtggcccagaagaaagctgggcctgctggcacccctgannnnnnnnnnaggtcaattgccgccgtgcgagggcgggtgcctgtcccccgagtcgatgccccgatcgcaacggccgtcccgcccgcccggccctcgcctnnnnnnnnnngcagcgccctgccccgtccaatgccttgctccatttgtgcaggcaccacaaaccctatcacgcccacgctcatcaccccagcgctcaggaccgcggatgagcccccaggtgagggtgggtgcgggtggtgcgggggccaccccacaggctgggcctggcgcgcatgcgatcggtgcacaccccaccgcccaccattccctgaccgaccctgaaaccacaaccccacacgcccagggccaggcacggtgccccttcctgggtcaaatgccgccgtgcaagggcgggttcctgtcccccgagtcgatgccccgatcgcgacggccgtcccgcccgcccggccctcgcctcccaggggcacgcccgcagcgccgcacgcgcccacggccaggatcggcgcaggcaccggattgcggcgccatggccccacgccgcccctgccgtccgcactgggcgtccagccgctgccggcgcccatcgtgctgagcccggtgcggaagctgcgcttcatgccctccaagcgcgacctgcgctgggagctgagctcggacggggaggacgggggcgaggagtccgaggccgagcaggagggcgagggggagctgggcctggcggccctcatgcgtcaggccctgtgtgtgaagaaggcaaggcgcagggcgtccatcgccagcagccagtcctccgagggccagggggacaggtgggcgccactggaggatttcgagtgtggccgagtgtttgtggtggaggggggccccttgggcttccactggtgtggtgaggatgcgagggatggctggggccggaggtgcggcacgcggagccgtgtgagccctcatgcaccagcgagcacccctcccaccccctcctgaccacagcgagaccgaggagnnnnnnnnnnacgtgtgagccctcatgcaccggggagcacccctccacccccctcctgaccacagcgagaccgaggaggcagggatggcccagctccaggcgacgctcatgggcatcctgcgccgccgcaaggccggcgcggcaaaaaagcgggcggcgctgctccaggccctggaacgggacaccgccgagaggctgtcgtcgctccaggcgcaggccgccgaggagcggcggnnnnnnnnnntggcgcggcgaagaagcgggcggcgctgctcgaggccctggaacaggacaccgccgagaggctgtcgtcactccaggcgcaggccgccgaggagcggcggggcctggaggcgcaggcgcagcgtgcgctgcacgagctgaccggcaggatggaggccaaggtgagggtctgccgtgccccgccggcgcaagccctgcctcgggactcgccccgtggggccccgctgcacagccccatccctcgcccatcccgcagtaccaagagctggtcgccgcgcatgagcagtacgtggcagacggccggcggatgtgggaagagtaccagcacctgcacgaccaggccagcacggtgaacgaggaggccagcgctgcgctggcacggcaggaggaaagcacggcgcgccgcctgaccgagctgaaggcctggacccagcagcagcaggcggccgcgcgcaggcaaaggaggggtgtgggtcaaggaagggcgtgtctggcgagcgtgcatgggttgggtgcccgtcaggcatgggagcttgagtcgggggggaggggctgctccacccgnnnnnnnnnncggcgagcgtgcatgggttgggtgcccgtcattcatgggagcctgagtcgggggggaggggctgctccacccgcatgcagccccgaaacgggagcagctccggcgcgggcgcatgaccctgccttcccgtcccgcccctgagctgcaggaagatagcaaaggccaggaagcaggctgccaagctgccgcagctggcaagcatgctcctgcccttcatgtgaactggaaggctgctccaatggcatgcttcgtgccgagcacacactgagcaacatcgagccgtgatgatccagcagcactgcatcaaaccttgagggcccctgtcatccagccacccgtcatcatctggcccgttccatgccagagcccaaaaccctagaacccccaccaccatgcatgtggcatgggaaaagcnnnnnnnnnnaccagaaccccaaaccctagaaactccaccaccatgcatgtggcatgggaaaagcgacccttctgccgctgcaacagccatgatccagtgacttgtgctttggaaatcaaccctaagacatgtagcgaaaaggcgacattgcccgtatcatgctcactcggccagtgtagcctcggcttccccgcacacttcctcccaagggagctggatgctcgctgcctgctcaaggagctttgtccctggtcccaggtctgcatcaaccctgagcagggcctccagtgtcagggggtccccaccgccccgagcagcgcactcaaagcagggccaagggggcggcggcgcactccagcccccggactcgctcctcatgtgcgagcggtcagactcaaagcgagaggtgagtgcacgacctgacaccatgcggaacaccctgcggacaaccaggtggcggaggtgggcttcagggttggagcgccagcaacaccaatggaggaccattgaggattgatgccaggtctcggcttccatggtgcgagctgcagtgcaatgcatagacgccttgagggatatgcattgggtctcacctgggtgcaaaccttgccacctctgcctcgctggggaagagggctgccgagcggtatgcatgccatgagcagggcagaagtagggtgctgcagcacagggaggacaataaattgcgttacgattctttcagggagtgtcatgattgcacatatgaattggtatcccgcctctgtatgccagcatggggctgtctacnnnnnnnnnnattatgattctttcagggagtgtcatggctgcacatatgaatcggtatcctgcctctgtatgccagcatggggctgtctaccagtgccgtgccccccttcagcagctatcatcagttgccctcccaaccaggacgtccacacagcagcccacctgtccatgtcnnnnnnnnnngagctatccttagttgccctcccaagcagggcgtccacacagcagcccacctgtccatgtcccacacgaggcagtctccctcctgctggcgatgcagggccaccacgtggtagtcccacaacacgagcccgtttgcatgctggcttgctgcttgacgccaaacaggagtcagccgggtgtggctggtgatgaagagggcggccaggtcccgccaggggacgttgtggctgtcgtggagctgattcaagagcatacatacattctcttcacagtaacaaggagtgtgaagtgggtggacctccatgggttattgtgccctggtgccatgagatggcaggacggcccttccttgtgtatatgggtgatttgatgccgtatacagcgccatgggagcaatgaccctcttatgaccctgcaagctgatgcatggtcatttccattgttggcgggtccttttacaatggacgttgatacctcggtcgtgatgtccaggtcgctcaagttcatcgttgacagaagtaatcgcggtacccttcccggtacccatacttcgcaaacaccagcgagcccatcccttcccccatgcgaagggcaggtaaacgtagcagaggaaaaacataatataaaactgtagtgcattgcattgacagtgnnnnnnnnnntgaagggcaggtaaacgcaacagaggaaaaacataacataaaactgtagtgcattgcattgacagtgtggtctggtctggaaaccggctgagcaagcgagacctctcgtcgactggctggtcgggggccttattgctctggaatagacgcgacacccacctggcgcagctccgagccgtgcaagcatgggagagaagggaaaggggaatccgccgcgggtgaaccccaagaaatttaccgtcaagtcgggccagtgcttcgaagagctgggcgcctacctggcgtgcatagcggtgagcagtggggtttgggagtgcaggacaggattcgaaacgacgaatgctggtacatgggtccttgggcacatctatcaggggctttcaggaatggagtgcccgtacgtcactgattctcagagttatgtggagagttacatgatgaacagactcgcatcgacggatttgcatgtggaacccacatcaccatcccaccttgcacctgctggacatgtgtgcagtcatctggcggagaaacggacgagaggtgtgcccctgcacgacgagccatgatgctttgtgcggcgacctcggtgagtgtcctcgtgggcatgcacgcaggagtagatgccatgcacatcgagctcgccatcttcagtgcagttccagtggaagttggagggcagatccaaccaaagtgcactgatgccctcattctcccacaggcaaacaagaacaagggtttgagtagtgtgaactatcatctgcaggtgaggatggggttctgcccaaacatctcaggcactcatcacccattagaatccggaaatgccctcatcgaggtaccaattgaatatgacaaaagttccttgtccccttgatgcagaggatatcgcggctgatgcggtagcagtacgatggatcagctgtccacgggaagatctctcgcaaatgaactccgcaagccctcaagcctcaatcattgattcgaagcctccggtattttgtaaacagtgtcgtttgagtgtttggcagggactgctcatgcagaatgttcggatagatagtccgggcaacttcggtccctcgcggagccgggcgatctcagattcgctattgcctctggcagcgcaacctgccctccaattcgagccgtgcaaaagcgacctgccttccagccacctcccggcgcatcgcctctgcccctcgaagactcaaatatgtcctgaggctgagcaagatgttgaatttgagtttctgaagctgcttccgcactgctacaaagcagttggccactgcctccacgctttcttctggtgcgccagccgcgccgaggtgttgcgaccatctcatctccctggatctcgtgtccgcgcaacgtttgcgcagacttgcttcgcacgcagaggcggccaacaagcccttgtcggtcgatacacccaaacttttgctactttcgcgcttcgcagcagcgtctcatgtggcgcgcacctcctcgccaggccgacagccctctgggctacgcgggctcgaggggcgccaagcaggccgacatcgaccatctaaagccacttcttcaggctttgcagcaatggaatggattgtccgcgggccccggcctcgatgcacactttccggggtcaccttcccaccctgccggagctgtgttcccagggtcgtctgcacggcgggtcggacccccggagcttctcgacctgcaggagctcccggccctgatcaaggcgcatctggatgtggagcgttccatggacgcgggcctccgtcccgtcaccgcggatgtcgtgggcaaatgcgcgcaggcggtatccctctgggcccaggtgcgtgcgctagggttgtgccagctccggctgcgaggcgagccggccggaaatcctgcccaccccggctcccatgtgcctgcctgtgttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctccagatgctgacgcggcagggcctcatgcatgccctggccaacagcgaggcggccatgcccggcctggcccaggccctcatttccagnnnnnnnnnnnnnnnnnnnnnnnnnnnnnnnnnnnnnnnnnnnnnnnnnnnnnnnnnnnnnnnnnnnnnggacatcgccatgcccggggcaaaggagcgcgcgcccccccgcgccccccagttggccccggccccgcccgccccggcgccgccggagggggccgacccggcccagctgctggagctgctcctccgccgcggccacgacatccttcccgccagcccggtgcgcccgcacccgggccccatcgcccacccgtcccatgccaagccacacgccggcccggccatcgtgtcgctgggccaggacgccggccgcaagcgcgcgcggcgcagcgagggctcccgcacctgctccaactgtggcgtgaccgccacgcccttctggcgcaagagtcgggccagcgggctgcccctgtgcaacgcctgcggcctctactcggccaagaacggcgatgcgcaccggccgcccaagctgtggcgcgagggacagccggtgccgcccggggtcggcgacgacgcgcgcggctcgcccgccgccgtcgtgggcgcgcaggacgggcgcggcgccttc

SEQ ID NO: 22776 - DNA, 72 bp, Chlorella protothecoides
agggacacccttggcgtcgtggcgcgagcgtggacggtcgactgcatcccctgtcgtgccgacgctccccac

SEQ ID NO: 22777 - DNA, 64 bp, Chlorella protothecoides
atgtagctcttgtgggtgggagtggctaggcggggtgggtgggcggctgatgatcaagccttga

SEQ ID NO: 22778 - DNA, 61 bp, Chlorella protothecoides
gcggcgggtgtgcagggtggtggtggtcgatgagcacaggacttccaaactgtgttgcgcc

SEQ ID NO: 22779 - DNA, 61 bp, Chlorella protothecoides
ttgctgtcttgcagaggaggatgcggcaaggttggaccctcagcccggacccgccctgaac

SEQ ID NO: 22780 - DNA, 136 bp, Chlorella protothecoides
gtccacctccacctcgtactcctcccgcttgcagtggaggcaggcctcaaccgccctgcgcttgttggcggtgagctttgaggcctcggtgagacataccttttccaggttgaggaatttcagtacatgggattgc

SEQ ID NO: 22781 - DNA, 61 bp, Chlorella protothecoides
cctccaggtacctgggtgctttggctggggtttgggggggggagggggacaatcgtgagga

SEQ ID NO: 22782 - DNA, 79 bp, Chlorella protothecoides
tcccctccgctgtctggtgggactgaggagatttacagcgttgctctgcactcgaggagttgaggatctaccgtgccga

SEQ ID NO: 22783 - DNA, 61 bp, Chlorella protothecoides
gaggccgggaggcgctgccgttgagggaggtggccgcagccgccgcaccctcgcggctggc

SEQ ID NO: 22784 - DNA, 61 bp, Chlorella protothecoides
acaaggccaccatcaagaatcggtacccgccgccgcgggccgatgacctgatggacaggct

SEQ ID NO: 22785 - DNA, 467 bp, Chlorella protothecoides
gccctgcacatcttcctgtgagatgggtggggagggtggagaacaaatgcatgtagtgcatgcacacagctttgataccgtacagtcatatctcatcccgcaggtatacccacttgaaaagcgagcacttgttgggcagaggcaccctctcacggctcatagaccagtaggtggcgcgaaaaccccaagggggggggggttgccctcctgcatgcgggaggatatttgtgcttactaagacgaggctacagtgccggaggccatatactctctggcagattcggctgtcctcagcagattggccgcggtttcctgcatggaggactcatctgcgcatatctaaatcagtgatggaccccgcctgcagctcaccctctgcacccctctactcctggcaggggcacagatgtgctggcggtgcaggcgctggtgctccggaggagcctcaccagcaggctcatcccggc

SEQ ID NO: 22786 - DNA, 284 bp, Chlorella protothecoides
tctgggtaatcgctatcgtgctgttgtaatcgtagtggcgcgtgagacccaccgcaggcctcgcatgtacaggccatcgccgatgctttaacgggaggtggccccgcatgcacagcacacccctctcgaatccagttctctgtgcaagggcagtcctgccgtgatcgatctggattgaagctcatggaacgccaatttattggcgctaatctggccactcctcaatgaatattgtatgttgccggagtaaggccacatcagatacctgagaatcgtaacgctgt

SEQ ID NO: 22787 - DNA, 1109 bp, Chlorella protothecoides
  modified_base (374)..(576): a, c, t, g, unknown or other
  modified_base (679)..(891): a, c, t, g, unknown or other
agtggctcgggaggcacaaaactggggggatggtgagggcgtatgcagcttcgcctcgtgatcagggtgggatggcaggatgtgttgtgtattgccctccttcatctaaatggggccaactcagaatgctggtgcactgcaaatggctggcttgcagtcagcatcacctccatgtgaaccttcacttgccctccctgcacgggcactccggcgagccctggccatggcccccttaaccaaaccatacaccctaaaccacctcatgcgcacccagctgcagttgtgtgcacccaccctccttcaccccccttccctccttccctcccgtgcagtggccaagctactggttcctgctgggtgtcggcctcatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctcccacatgcgctcctgtggtcttaacggtgcactgcttcatagggcctccaaaccccatcccaataacgctcttccccatctcgggcgcttccttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatgcttggatagcgtgggagcgctgcctgaccccaatgactggcgccaagccacaaaaacttcaacatgactctcccatgcacggatgtctttttgacaccttctctgtatccagcactgctcttcccgagccattgtaagcattaggcagaaagggtcgcgcctgatggggtgcgacacagattcccagcgctcccaacacccctacctcgaca

SEQ ID NO: 22788 - DNA, 145 bp, Chlorella protothecoides
cgttgatggaaagctggtgcaagtaccactgatggggtacacctggctcgagcaggacagcagagggtcactggggccggtggtgcagtgggcagcgttggcggcataattgccatcatagcagagtgctgggacggcggtgctg

SEQ ID NO: 22789 - DNA, 290 bp, Chlorella protothecoides
ttcaaggtctgtgaggctatcagagcgagtgatgtaagagagaaacatctccaaagaataattcagcaaaggcctgtgcaaggactgcatcgtccaactgagatggagttccttaatgttacaaagaagcaggataatacgtctgctggctcgtttggatgcaactcccgtcccttgtgattaaacctgctgcccatgctggtcgtcatgatcgtgccctttgcacctgagcctgtggaaatcccatcatcttttgaatgcttattccaaatgagcatgtcgaatagagg

SEQ ID NO: 22790 - DNA, 61 bp, Chlorella protothecoides
cgagggagggggttgcggcggcttcccctttctcccagattggaaagcctgggcctggcat

SEQ ID NO: 22791 - DNA, 147 bp, Chlorella protothecoides
cttgtaccttattactccagcatgaaagataatatcaagacacccaaggtactggggtataccatgtgcttctggaggcgcgaagttttataagaggaaatagtaaagtcttatttgtttgtcaactccaaggacgagccctgaatg

SEQ ID NO: 22792 - DNA, 61 bp, Chlorella protothecoides
cacccataggcccctgacttccagctcggggatcgaggcagaggacattgccaagcgtctg

SEQ ID NO: 22793 - DNA, 61 bp, Chlorella protothecoides
agcttattctgccacagattctacataatcgtgtgagtacgctcagagcgaagggtgcagc

SEQ ID NO: 22794 - DNA, 179 bp, Chlorella protothecoides
agcagctggcagtggcagacggtagggtgatttgcagaagtacttccttgcatgcataggagaagggacatcaaagtagatcagtgaaggtgcttcgtagtcggcatgctgggactgttaacgtctcgcagagctgcacccgtttgacccaggagtgtctgtgtgtggcacaccgtctg

SEQ ID NO: 22795 - DNA, 307 bp, Chlorella protothecoides
atctccgttctgcagcaagcaataacaattcaagatctcgagatctggatctgttgccaaggagtaaccctagcttctttataaacataactaacatctccatttgtctgtccttgaaggaaattaccagtacagtatcaccccataaagttcacgggctcgcgcgtcgctttcccatcacttccgatgcggcttccgtcttcacaacgggatttgcacatccttttcatactccgtttgggcctccttccaggaatattcctaaaacccacatcagaccattttgcctcactcaaggtacgacagg

SEQ ID NO: 22796 - DNA, 74 bp, Chlorella protothecoides
caacacaagaagagatcgtgattcaaaaaagtttaaatggtggtccaaaaccattgataaagaattcgtggaaa

SEQ ID NO: 22797 - DNA, 92 bp, Chlorella protothecoides
tggcggagcacaacaactacgccgtggacttcatcaatgccacgcgcgagatcaagaaggtctgccccggcgccaaggtcagcggcggcgtg

SEQ ID NO: 22798 - DNA, 61 bp, Chlorella protothecoides
ggattcttgttgcgtgtggatgggggggagtccttggaaggtagaagcggtggttgccgag

SEQ ID NO: 22799 - DNA, 107 bp, Chlorella protothecoides
gcatcaccgcgcacggtgcggggcatggggggctggaccgctgcctggccccccagcaaagactgtacacaacaccacctcctcacctctcccacggctgcgtccgc

SEQ ID NO: 22800 - DNA, 66 bp, Chlorella protothecoides
agcttggatccatcgctgcatctcgatccgctggacactcctccgcggatgctgacaccctgtcct

SEQ ID NO: 22801 - DNA, 73 bp, Chlorella protothecoides
gtggaccctgctcattgccctgcggatggtaaaaaagagtccttggatcagcaccgatctgcttgcatgccat

SEQ ID NO: 22802 - DNA, 3863 bp, Chlorella protothecoides
  modified_base (3626)..(3697): a, c, t, g, unknown or other
aggaggagatgaaggtggagaggagggaggggggaacgagggtgacggggacggaggcggtggggcaggtacgggtgatggcggtggaggcgaggttagagttggggatgcaggaggtggggtcaactgacgagggggcggaggaggagagcgggggaaaggagaaggtgccggtgacacctttgtgggaggcggcgacttcctggtgggaggcggcgacttcctggtgggaggcggcgactgtggggagggaggcggtgacttcctggagggaggaggagacttcttggtgggaggaggagacggctttttggagggaggtggtgaaggattgaagttcttgtaggcgttcttgcggagttcctgcaggccgcacttgttcgcacccatccaagtccccttggagttattgcaatggacgtcggtccctgtgttgttgaagccccagttcctgttgcccttgttaagagcacctgtgggtgaagaggacgttgatgccaactggacgcaaggagtaatgtgggggcatccaaataatgaaagagcttgcatgcatggtccataccgcttgccgacccccccacccggcctccttgcctatgttgttgttgcccgtgtttttcctccatagttgtcctttcccctgttgccagtgccgatgttgccgtccttgtctgccgtgcaagccttttgtccattcttcacacactccacggccacgatgatctttgtggagcgggccgtcttcaccttcagagtaccggcgttgatggcatcaacagccagtcctagggtattcagagtggtgtcgcgcagagatccagccttgctgaggccctttgccctctgatggcgagtggtagcgttgattgcgaggtggtccgcggtcttccccacaatgaggtgtgtaaaatatcctgaccagctggacagtcatcgtgtccatttcagagcttatagggagaagatcctttgtgaaaaccattgtcacctgcagaaagcgtttgcactctcgatgtccaccatgtaaacttgaggtccgtatctgagaattcggtgtaaaaggctttgcaaagggacgaaggaatatccggaacacttcgacaacgtgggcaggcccctcgggcgactgcaacccctcggcatcgaggaaaggcggtttatgcagcaacactccttctcgaactcacatgatcgccggtagtggatagaatgcggaggtgcacgccccctactgttcgcgggaatagggggtttagcgcgatttcaagggcctcactgcacactcgtccaccctaatgctctacgtaaatttaaggtcaattcatccctacaaactcactctggacacgatagcgatcccgagaaggcagagaattatacctaaatggatgatccgcccgtttgcccgcatcgtgctgttgggcaacaaggggcggacggatgaatgttcctagtcaaataattacacaattggtgaaatgttttgtggatatttctctacaggagtcttggcacagtttgtgttccgcttgagctgcctgggtctaatccgtcttgtccggatgaccggtccgcactttacttcaaggacaccctggacatgtgcgcgtgactaccgttgtctcgagaacgcaaaacagagtgttgtttcttctccgcaccagatgtatgattgggtggaacatggttgttttgctttcgtgatttcaaaacttccctcgaggcaaagcacccttgtcctcgatccccttgggggtgaggcagaggaaaggggtttgcggtacattcgctgctcttcaagggaacagtgtgtgctgtggagctacccagctccccagctgacccagtccggcgacaggcaggtccatgtgcaactccatctcgctaacagtagaaatcgccctgaggagggcacccttgacccttgggcctaagacagcggcgatcggggggtcgccaggacgtacagagcttgttccgtcgaatacaccctatacccttgccaacttgtctgcaagaacaaagttaggtctgcctcatacagtgcactgggaccctcagtttgtcagggcacgggcatgggcatgggcatggaatgaagacggagaggagctcctaccccttggacgagtagtcgtgctcaaatgttaggttctcacctgtctacgtttgccgtgaagaggatcccaaatcgcatgaaaactctgtcgttgtttcttttgctggatcgcattgacaggaggtcctccccgacacgcgggccaagggtcgtgaatccactcagcataatccgatcattctgccaatcgccaatcacactctgcacatctcctgcatgcgcctgttctccagcgtggttcctcatctgagggttgtgcacgggctttccctcgagccggtcctttcctcgtcgtatgctgcccgacacagagcagcccaccacctcgcaagccccctgaaggtgggtgccaaaggtagtcgcctgggtcgtggagtctctcagcgaggccgcatcacggacacggcgtgtctctctcacgcccatttcaaccccaccgcagaccgggagattcctgtgctccgcttcgctctcctcgccagctccgaccaggcagcgcagcatggtggcgtccaatgaatctacgagccccaaactggacgagctgcgcaccctgctgagcaaggcccaggacggggagggcgtggctgccttcatcatccccaccgaggacgcccacatggtgaggggcgagggttggtgtgtgctgtcgagcagggctccgggagtccaggcctcccctggcggatgatttgtcgctgcaagctcctgcctgtgcacggtttgtggggcatgtgtcatgcattggcggggtccagaccaaccctcttcccatgcaccgcggccagggggagtatccgcccgactgcgacgcgcggcgcgtcttcgtcaccggcttcactggctcagcgggcacggccgtggtgacctcagacgccgctctgctctggacggacgggcgctacttcctgcaggcggagtcgcagctggagagcggctggacgctgatgaagcatggcacccccggctgccccgaggtgcgccggccgcctgcctgtttgccggatgcatcgctgctgaccggctctggcacctcgatgccgtcccgcggctggcgtgttgttcactgtgcaccatgtcatcatccttctcccccccccctgctcctacccacatcctgagtattgttcagatcgaggactggctggccgagaacgtacccgagggctccgccgtggggtacgacccctggctgcacacggtggcggccgcggagaagctggaggcggccctgacggagggcgggcgccggctggtccccctgtccccaaaccccgtggaccaggtgtggggccgcgcccggcctgccgcccccgccgcgcccgtggccccgcacgcgctggagtgggcgggcgtggcggccgccgagaagctggccgacctccggcgcgccatggccgcgctccgcgcctcggccctcctggtcaccgccctggacgaggtggcctggctgctcaacctgcgcggcggcgacgtcgcacacaatcccgtcttcatctcctannnnnnnnnnnnnnnnnnnnnnnnnnnnnnnnnnnnnnnnnnnnnnnnnnnnnnnnnnnnnnnnnnnnnnnntgcctggtcacggccgacgccgccacgctgttcgtggacggggccaagctgggcgaggccgcgggggccgcactgcgcgaggccggcgtcggcgtggccgcctacgaggcggtgggcgacgcactggccgccgcggcggcggaggcgcggcgcacctccacccgtg

SEQ ID NO: 22803 - DNA, 61 bp, Chlorella protothecoides
ccaaccacccccaccgccagcggtcccaccacccccaccatcaatttccagcgtctccggc

SEQ ID NO: 22804 - DNA, 235 bp, Chlorella protothecoides
gcgctgcaggtgggcgggcggtgtgatgcaaagggagggggtgccaccttcaggatatcacaggggctggactgcactgtgcaggagggaggggcggctctcggctgcatgggcacagtgcgactgtgctgcgcccctgggaacgatgtgccctgcagggccctggtctcggacgactcgtcgcagggcaggcccgggaactgtgcgtccagcaccccgacccgtacatcctgga

SEQ ID NO: 22805 - DNA, 157 bp, Chlorella protothecoides
cgctgcggccagagctgcaccctcggtcggaaagcctgggccacccgacggagatgcgcccgcattggccctggaacctcctgtccctccctcgtttgaccccgctacctcgcctgcagacatgacggccatgggctgcgtggcacgcaaggatggc

SEQ ID NO: 22806 - DNA, 149 bp, Chlorella protothecoides
tgtcggatgatggccgacttggacaggcaggaggccataggaacatttcatatcagcgttataatccttgtatatcagcgccactcgcgtaagctctgcggctgtctgcgaaggagcagtgcatgcgcccgagtcttccgcagactccc

SEQ ID NO: 22807 - DNA, 86 bp, Chlorella protothecoides
gggcaagatgcaggtgacattgcatgtgaacagcggctgcttgggtagggggaggtgcactgtataagtaaagggtcagcagcgta

SEQ ID NO: 22808 - DNA, 255 bp, Chlorella protothecoides
gcggctacgactggttcatggaggtgggtgggtttttgggggggggggatccgttcttccctacgggggtgaagggggtggccgtgacgtgttgaggcctccatgttgaaagggatgactgaaaaggtacatgtagatgtggaagtagcaaatttggcatgacagatactcctccagcatgtgaatctgacagtattattctccgccccgtcccgtcaccgccgacccgctctttcccaacccccctcatgcata

SEQ ID NO: 22809 - DNA, 61 bp, Chlorella protothecoides
ggcagcaggtccccggaaggacacatccaatcatggcaccattcaaatcagtcagagcgac

SEQ ID NO: 22810 - DNA, 4898 bp, Chlorella protothecoides
  modified_base (424)..(433): a, c, t, g, unknown or other
  modified_base (731)..(740): a, c, t, g, unknown or other
  modified_base (1270)..(1279): a, c, t, g, unknown or other
gctatgagaatggggatggcaaggcatactggcacctgtccctcacaagacattcctctatacctattcaccagacatcgacagccagagttattgtatcccaccacgacactcactcggtgtacgtgaactcccgcttgtccttctgatggagcttcagggactccagggcccaatttgcagctgccttgtggttatcatactcgggctcataatggcagaagttgtctgcatgggatgagggtcagcccaacggcactgatttcctcaatgtacagggtcccatgccatacagacacaggccaaggattggcagcatcttcccaggccacagctacagtcttcaatcttattcaaacacacgatccacaacccaccggctagctcccgccttatgatgagttcctcaaggaagcaatccacnnnnnnnnnnctcaatcttattccaacacacgatccaccacccaccggctagctcccgccgtatgatgagttcctcaaggaagcaatccacggactcctgcacttcaggccaggagttgaggtgcttagagaaattatagaggaggtgcttggacctgctgtcgcaccccaaaacacacacagctcccagctcccagtgcatctcatctcagaaacccgccaactcagacggcagagtcccttaaacagtcccacccaaatcaggtccccaacccacagcaccttctgccccaccttgtgcttgccgnnnnnnnnnncgtcgcaccccaaaacacacacagctcccacctcccagtgcatctcatcccagaagcccgccaactcagacggcagagccccttgcacagtcccacccaagtcaggtccccaacccagagcaccttctgccccaccttgtgcttgccgcgatgcttcctggcttccagggcagcccgttgcgctgacagctgcccgaaatgaatgaacggcgataggcccgagagggcctctgtggcagaaggcagaggtggggtaggctccagcacctaaagccctgctgtgtcttgcagacatccatgactcccaacagtcttgagatcagcaccaggtcgcacctggaatggctgggtcgttcctgaatgacttgtacttcttaagccgctgatccgtgaggaagcccccctttccacacaatgcctgtgtgggccgaggattgacacacatgatgaggctgtggaggctttttgcgcaacgcatgtaaatcacctccttgcgacactgcacagcagtcctcctgtgacccacagannnnnnnnnnttttccacacaatgcctgtgtggaccaaggattgacacacatgatgaggatgtgggggcttgttgcacaacgcatgtaaatcaccgacttgcgacgctgcacagcagtcctcctgtgacccacagacattcattggggtccagtccttgccgccctccctctgaccctccattaacatctcaccaagcacctgccatgctgcatcctctccaggtgtacaccaggtgatttcggggactgcgcgccccctctccaccacctcctcaaggatcccatcccagtccacccgtgggggcggcatgccggtccagccgacggtctgtgctcggagctcggggtactccaccaggaactcgggcagcaggcgagtgatcttgggcctgatggtccgggccgcgctttccctcttgtctgcggtgaatagattgtgggtgcgcgactggaccagctagcttcccgagcacctctcacacatgactccatgtcatctttcttgattcaaaaatacagcacgcccattctgattccatccttctgactcctccaccccccctgctacctgaggcaatccagacggggacgacattatgtgcatcgacctcatagaacgggatgctgatcttctctaccacctgcaaatgaggcagcggtgagtgcatgggtacacttgatgtaggtagctgaatgtgacaagtggacagcacgccgcacaatttggaagggtagcgctgttggaaagctacggtcttgcacaaaccccgtacaacttgcaagccagtgccctgcccagccgcctctcagcactgccaactcagcaccgacaagtgtccccctgcgcatgctcaccccagcacgccactgccggcccagacggagaggcccaaagtcagtgatcagggctccggcccccacgtccctcacgatcctggggatgttctcgacagggtcccctgggaagcgtagagaggcgcctcagccccaacaagtgcatcctcgggagatggaatctgtgctacaacagatgcctgacgcagcctccccatgccctgccatcccccgcccccccaagtatccggctcaagcaggcctgcaaccacagcaccctgatctgcacctttgaggaggaagaagggtatgtggagcttgcccaggctctgttccaggtgctgcagaccccgaaccatgaagccaaactgacgtgcgccggcgtgcatgtatgccgttacctgtgagaaagcatggcatgcgactgcgtgtgtgatcatgtatcaagaggtggagtctcagtggatgggtaggctcacgtctatggagcacaaggaagggcctccttcgtgcacggttgcaactcttggccaagcagcttaacttgatgcccattcaatggcctgcatcatgacaatcaacagcttccagccactcggcactggcccaactcccatcaccactgaggcccaggcaaccccatccaccaataatatctggcacccaccagattgaacacaacagccactggcactcccttcttggcggccaggtccaccgcatgcaagagagcccagttatccttggatcgttggtcccgagtcatcctgggagagggtcatggggatgggagtgagccattgcctgcccatgcgccctgcaggtcattgttgcacatacagggagctcgcaactgcatgccccactccgcatcaccagtagagcacaggtcctggtccctgctctccagatcgcagctccctgactcggcgagggtcgacagatgattgcatggcgcggccagtgccggcacttgcaggacccgcagcctccacctgtgcaggctctggcacctttctcttcacttgcatgccccctggattttggtgatccgaggaagcccttgggtgttcggccgatgaagcgaggcgtgtggtatgcccagtggccttggacaggaattgcctggggatcacacagtgaagccaagcaactctagccacagaagcagggagaatcgccagcgaatgcgatctgagtactgcacgggtatccaatgccaccaaaagctacgttgattgaagggagatgttctgtatttggatctaagggctacattatttcgatcaaggctgtcctgtggcatgtcggggcccagtgctctcgacggggacagcatgcttcgaccccggagcttgcatccgtgcgagcttcgcgatttcctcgcgctacccccgcgctccgagtcagcattccccggaaccggccaaggttcgatgtcagttagtacaaacatttatgccccagccgcaccctggaacggacgcacccagcggcccgtgacctgacaaagagcgattgaggttcgggaactttccctcgagcgtttggcgcctctggcacacacggccagcggtcgttcgatgggaggggtctccttctgattcagtcgagtatctcgcctcgtgagtcagaccacatttctaatattgcgctccaacggggcatggagaggaccatgagcatcacctcagatgagctgctccagaactttttcaagacgggaagcaccgtcagtctgccccgcattgactccgagtcgcaggtgccctgtctttgcgcgtcatgggcatatgcacctggggtcgaggggggtggcatggacttggggggaggagggaaggtgtaagccatgagaggggaggccacagagcacgcttggccaagcaacacactggaggtgtcgtggggcccctcctgctcaccatacccctccttcccccaccctccctagtttcaagagttcatgcggaagataccgtcggccaccaaccttgctgcagcgatgaccgagggcacagaggccggaggcggggagcaggccgcaccagccgggggagttcctcgtgtgcccagcctggactttatcaagtaggccggtggggggattggatttgggcagggacgacatcggttggttcccgagcggcgtgcagggcttgaggatgcaagtcctggcctgtatggccttgctagtcagtacatcgtgggccggagattttgttatgctcagcatcgtcgcttctcaaagtacccctcacccaccccccacgaattcatcgcagggccttcctcaccgcgagccgaccggcaggggacagcgccgtcaacggctctggctccatcttcgcgccgtacacggcgggtggcggcggcgcccaccccgcccccgccttcgagctgaacggctccgtggcgctggccctgggccgcgccaagctggaggccgaggaccgcggcgcgggtaacaacgagggccagcccggctccgccacctgcggccctcgctccgagggcgggtcgcgcggcgacacgcccaccgcgcacgggcggggcctggcggcgtccgcgctgaccgcgcctggcctgccccagcagcccgacttcccctctggcaacctgcaaatcgcggggctgcagggtgcaggcccccacatggtgctcaaccccaacgtgctggccgccgccttcatgcagtcgcagctgggcggcatcgcctttgccgcgcagcagcaggcggcggccgtggccgccgccgcgcagcctgcgcacgccgccgcggcggcgtgcgcag

SEQ ID NO: 22811 - DNA, 61 bp, Chlorella protothecoides
caatcttcccatcccgccctcggcaggcgggggcgacaagggctgagctggaggctgatag

SEQ ID NO: 22812 - DNA, 105 bp, Chlorella protothecoides
actggcgtcttgcaattgctttggtagtgcccatctgtccccatgaactgtactcaaacaattaatttataggcgtaaaagcagtcagactctgccgcgacgatt

SEQ ID NO: 22813 - DNA, 120 bp, Chlorella protothecoides
gccaccgctgtccacagtgcccagaatgtgacttttggatagaagcctcaattgccaggatgcggttctgggtcagtcagcaacaccttcccttgttgcgattaagaatgaaagcttgta

SEQ ID NO: 22814 - DNA, 78 bp, Chlorella protothecoides
gggcgtcctgctgcaacagggctggcactgaactctccaggccgttgtcctcggacatgggttcagaaaccagcctgc

SEQ ID NO: 22815 - DNA, 64 bp, Chlorella protothecoides
gtcttgcctcagctgcttgatcgtaaatgtatgctggcagccggtcctctcagagcggcggcgc

SEQ ID NO: 22816 - DNA, 150 bp, Chlorella protothecoides
atgctaagagggtgtcggagctttgccttaaggcatggtccgagcgacttgagcggctgcagcagaagactgcgtttgccaagacttcgaaggagccatctgccgctgagatccctcagctgggcgccacgggtaaatctccaagctctg

SEQ ID NO: 22817 - DNA, 95 bp, Chlorella protothecoides
ccgccccgctgccgctgcctgctgccgtgttttgcgacccccaaccaacatcacacatcgcgagccagagtcactgcgatctgggtgcccgaggg

SEQ ID NO: 22818 - DNA, 1707 bp, Chlorella protothecoides
  modified_base (459)..(468): a, c, t, g, unknown or other
  modified_base (538)..(626): a, c, t, g, unknown or other
gactggctggcggccagcgccgcgctgccgggcggcggcggcgcccaggtcggccccctcctgcgcctgctggtggcggggctgggcagccccgaggccagctccgccgccgcgctgtccatccggcgcttgtgcgagggcgcggcggcgcagctggccccggagctcccggccctcctccgcatgtttgccgagatccaggggtcgggcgacgtcgcccagaacgcctacgagcagtatgacctggacgaggaggacgtgcagcaggtcgactcattgttctcaggggaccattggctgtgttgtgttgttgctgttgtatcgaggggggggggggcactatgtagatgttggaatcccccagagatgcacgcaaaccacacctgcacacaagccggcaccgccacccaaccatcaacctcctccgctcctccccctcatccatccagctgatcgtgnnnnnnnnnngttgttctcaggggaccatcggctgtgttgtgttggtgttgttgtatcgcggggggggggggggcctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaagccggcaccgccacccaatcatccacctcctccccgtcctccccctcatccatccagctgatcgtgggcatcaccacggtgagcaatacgctggcgccgggcgcccaggcggcatgcctgtcgcagctgctggagacgctggtggcgcccatgcaggcggcgctggcgcgcgccgcggccgcgacacgtgccggcgccgagccaggcgccgagtccgggctggggctggtggtgccgctcatggagcgcaccaccaccgtcttccgctccagcagcgaccgcgccgcggtcggccaggcgctggtccagctctggcccaccattgaggcggccttgggtgcgtgtgtgggtggtaggagggggttggggagggttttggtgggggggtattctcatgtcgagtggagggggtcttgggtaagtgggagggagggcgccgtggactcacccactttgcaggatcacggctcccctccacatgtgcgagggtggccgtcgccccccctcctccccattgatacccaccagccacattccccctcagatacaccatatcccaaccccctcatacactccagatcgattcgcggacgaccccgaggcgacggagcgcatcctgcgcgcgccgcggtacggtctgcgcagcgccgggcgcgccggcgcgggcgcgatcccctccctgctctcctccttccccgcgcgcttcgcggccggccaccaccccgcctacctctacgtcatcagcgaggcgatcaaggtcttcggcgacgagcccgggtacgtggcggtcatggagcccatcttcgccgcgctggtcgccgccgcctgcgcgcggctgggcagcctggccgcggtgggggccagccccgacctggccgacgacaccttcctgctggcggggcgggcgctggcctactgcccgggcctggcgctgacgccggggacgctggcgcgcctgtgcgacgccgcactggcgggcctgctggtgcagcaccgcgaggcctgctgctccgtgctggctttcctcgcgcgcctgctggaccccgcgctggccgcgcgctcggggccggcggcggc

SEQ ID NO: 22819 - DNA, 253 bp, Chlorella protothecoides
gaggggtgcacatggtggttgacggggagcagtattgtgcggggtcaagacagcagactgaggcaatactagagtcggccaggcctcttcactgagcaaccaatgattgcggagctggagaagtctggaccgagacagctgggccaggcagggtcagggtcatcttggtaagtcaacaagcaggagcagacacgccgggcatgtgcccaacaccaatgacttaagggtcaccaatcaatcacctggagaagag

SEQ ID NO: 22820 - DNA, 61 bp, Chlorella protothecoides
cccatcacgtccagtggcagtgatgttggatagctgaacgttccagttgtcctccgcgtcg

SEQ ID NO: 22821 - DNA, 76 bp, Chlorella protothecoides
atactttctaaaaaattctcaatgttcgactaccctgtgaggggtatgccagaaccctcgcctgccttcacaacat

SEQ ID NO: 22822 - DNA, 69 bp, Chlorella protothecoides
tcgacaggttggaagccgtacttcagacaacctaaacttcccacctcgagacctacaagtatcgtgcgt

SEQ ID NO: 22823 - DNA, 75 bp, Chlorella protothecoides
ggacccactggtgatgcatgacaaggtattaatattaagagttttctggtaagcactgcatgaaacttcaaatga

SEQ ID NO: 22824 - DNA, 70 bp, Chlorella protothecoides
tcccttctgaatgtaacactgtgattaacccttcttggtgatgttcacgatgcggtgatcgcatggtggg

SEQ ID NO: 22825 - DNA, 72 bp, Chlorella protothecoides
gacacccaaggagctggagaatgtccagggcaagtgatggggggataacttctaggcatggacctgcatgtg

SEQ ID NO: 22826 - DNA, 61 bp, Chlorella protothecoides
agcgcatccatcgatctaagacgtccgccaacctcgccattgcgtccccaagactttcatt

SEQ ID NO: 22827 - DNA, 77 bp, Chlorella protothecoides
ggcagagagatggtctttcccatcacacaaaatacgcccccccccttgcacaatcacctggtcagcctggaggcggg

SEQ ID NO: 22828 - DNA, 196 bp, Chlorella protothecoides
cccttatgtgaatagcctggaacgatgcgaacattcaattcctcgagcatggtgatgctcacccatgcttcgcgctattgaggatgagtctaacgtgttttcgtggtgcagtgctggaggtacggtgtcgaaccctgacacgctaacagtactgcatgccaaggctaagtacatatttggccaggtttagaataca

SEQ ID NO: 22829 - DNA, 121 bp, Chlorella protothecoides
gggggatggtgatgcgcggcctggcttgctaccgcaatgccggggcatcaaaggagtgagcacaaagcgcagatttctcctcccctctttcccccactcccaaagcacagaagtcatgaac

SEQ ID NO: 22830 - DNA, 61 bp, Chlorella protothecoides
gccgcttcccatcgctcccacctgtacttcacccgcggcgccctgccaccataccgatgct

SEQ ID NO: 22831 - DNA, 104 bp, Chlorella protothecoides
gctgtatcagacagcccagggtcaccccttggacctcctgccattgaaaccacagccgccccccccggtcgcctttcagcatcacagcctgccactcaaaccca

SEQ ID NO: 22832 - DNA, 61 bp, Chlorella protothecoides
atcatagtgggagccctcagccggcagaggtgaggcaaaatggaggactgaggggttacgg

SEQ ID NO: 22833 - DNA, 77 bp, Chlorella protothecoides
cctactcacgcaccttgcgtgtgctgtactccaccttctggttctcctcagacacaatgggaatgtggggcgctggg

SEQ ID NO: 22834 - DNA, 118 bp, Chlorella protothecoides
cagagcgcgactgagcgtcgccaccggccattcacactttcgttttcgggctgtggcagccgcgagggcggctccaggacagggtgttctgccggccactgatgggctgggcggctcc

SEQ ID NO: 22835 - DNA, 65 bp, Chlorella protothecoides
acgaagccgtatgcaagcagatagcaatcgacaattcatcatcatcgtatcatatggggtgatag

SEQ ID NO: 22836 - DNA, 61 bp, Chlorella protothecoides
aggatgtgcacaccctctccgactggcacccgccccctaaccccgcacacaacctgcacaa

SEQ ID NO: 22837 - DNA, 88 bp, Chlorella protothecoides
tggactggagctgggcctgtggaccattccgatcatcagtgtctgcgacgcgtgagctgcagtatcggcaagcgacgagctttgattg

SEQ ID NO: 22838 - DNA, 65 bp, Chlorella protothecoides
actccggtcatgctgcgcctcagggatgattgttgccaggttcaaagagtatgagattggctggg

SEQ ID NO: 22839 - DNA, 61 bp, Chlorella protothecoides
ttcatggtagggcacataaaagtaagggaatgcctatgaggagggtgggagggctggcagg

SEQ ID NO: 22840 - DNA, 61 bp, Chlorella protothecoides
gacagcagtgttacttctgctgctagaacaacaacgaaaggccaatgaagatgaagtcaag

SEQ ID NO: 22841 - DNA, 70 bp, Chlorella protothecoides
aggtaccaggttcgattcctggatggtccaataacccgaccacgggccattagctcatatggtagagcgc

SEQ ID NO: 22842 - DNA, 79 bp, Chlorella protothecoides
accttggcgcctggaagtggtgagaaggctcggggttttgtggaagccttgacgcactccatggattgcggtgatgtag

SEQ ID NO: 22843 - DNA, 72 bp, Chlorella protothecoides
gagatcctccaccctgcgacagagcaggagtggggggggaccggccttgatcctcgcatctcggaagaggcg

SEQ ID NO: 22844 - DNA, 3748 bp, Chlorella protothecoides
  modified_base (2792)..(2824): a, c, t, g, unknown or other
cccccccccctccccccggaacggtcccacctgcggcggcgcgctcctcggatgcgtaggggtcgaaggcaatcacggtcatgcccaggcccttggcgcggcgagccacctcgccgccaacctgtcgggaagtgtggtgggaggtgttccggggttgctcggctgcagagtatgttgcctcgctgccacccgcccctggctacgccagagcggctcagcatggcagccagacccatgtctgccgcagtggctgaatgggccctcttgcaggacagctgagcgtggaacggcagacgggaatgcaccggccctgccccaagtacgacctcaccttcccaaagccgatgatggccagcgtcttcccgacaacagaaaccccgacgtaggtagtgcggtcccagccgccggccttcatggaggcgtcggcctgggccacgttgcgggccagagccgtgagcagggagatgccgtgctcagcggcggcaatcgtgttggcagtgggggcgttcaccactaggcatcctgtctgttgtgagtgcggggaagggagtgggaacaggggtggcgatttgaaagtggagggtgaggagcgtgagaggggtgtctgaaggcttcagcgttgcatatgcatgcattgcgcacgagtgaagggtagaggatcagttgctggagttgctatatgaaattctcgttgctggatccccgcgaagcacacccatgccccccaaagctggcagagggatgcgtgtgacgtaccccagatctcccataccacacactcccgacagtgctgctgctcgcacctcgctcgcggcggtgagatcaacattgtcgattccgacgccagcacgcccgaccacgcgcagacggcccttggatgcctcaaacacctcgcgtgtcacctgcagggttgagtgtgattggacagtgcaatcggacaagtgagaatggagcactggcagacacctcgtaggctgcttgagaccatccctttttacatgagactgagctggtcacacagtctccaacctgcgtgttccttgcaccagagccaccgatagatacatcaagaccaaccacatctgtatcctcaccttggtcgcagagcgaatgacaatggcatccacagtactgatgttctccagcagctgctccttggtcatgttcaggacggtcctcacatccgccacttccttcagcatctccacgccaccagctccgagcttctccgccaccagtacagtgggcttaccattggtggacagggaggcacggactgtgggagggtgaaaagacacaaaggcgtggggggcatggactggggttctcccatactcctaacaggggtttcaaatgtgcaagcagccaatcgtgcctgttccacgtgtcatgagagtatgcacaacgcatatatatgcgtgagcttcccgcgaaacgaacctgatgtggatgcccggatgcctttgctggatctcctgatggccgtgaccttgaatggcgcggtggcggccttggcctgttgccggggagaagaaacggcgatcgtaaacctttcagagaataacgaaatcacaaaataaacgctcacactctcgaacccaccaacgtgctgctggaggtgcccagcaccctgttttgcgcggtggtcgccaacatcttcagcacccgtgcttcggcccttcgagtgcactggttgaacgctgcgattggcagtaagtcacagacagactaagcgctttttagttaatattcccgaaaatgcatgcatgttttggccccgtgtgctcggcttgcactggtttgcggtcggttggagaaacacgtgcgcgaccatgtaatcattcatggtttccacacaaattgttcatgcaagccaagtcgccacacttattgaggctacaagtgattgtcttcagtgtccctggaattcgaggtggcaccgcacgcatgatcatgatatcactgactagaatacatgctgtctaagcccgttgatgacgctggcatacattggaaaatctgcagtcacacacagcacttgccaaggactctcctgatcctcggcttggtagcaggtgtgcgggccgcacctccctccagagaaatatcgtacattgcgaagaagctctcaaatgcctcggtcaaattatatagtcgatggtgtagcatcatggctggggaaatgtgcagcccctcccccatcaggtctgtgccaaggatggagaggacggacggattgccatcggaacgattgatgaagggtggggttccttacctttgtaaagagccacagacagccggccctacactcaccagcggcgttgatccacacggcatcccactgcactggcgtcttcttgcgccctctcttgaaggggcgcaggaacatgaccgacccgggagggtacatctcaggctggctgccgccttgcgaaagggacgttcggaagtacctgggcgaaataggagagcagtaacgattcgcatgttgtctacttggagactctcatgcatccatgtttgaaggaaaagcacagcagctgcacaggtgtgcagttcgccacacccagtgccagcatggctggcatgtcacccagttcaacggagctgcgctggacctgcctacctctccaaaatggccagggtatcctcggggatctcgtccatatcgcacagcgtcaggggtgggatgcgattccctccacgccggcgaaggatcagatccgagagcacaaccagcttgggacgccggcatctgacgtgggggggggggggggggggggcgggggggnnnnnnnnnnnnnnnnnnnnnnnnnnnnnnnnntggcatggtgctggcatgacgacgctcagactctcgcccaaagtctgtcgcatcactcagctcggaggcagtcaacctcgcacattgcggcccagtcaggctactttccgagacattcaagaccagctgcataccttgccaggcacaccaccatctcgtccaccatcctcttcacggtgttgaaggagagccggctgatggcgtccttgccaactaccagtgatgtgcagaaccggcgggagatgacgctcaggttccagctcatcaggccgccgggagggcaaaatgcccagcagtgcaggtctgcagtgcccaggagggaggtggagtctccgcgttgacggtcagcaagccaggagtgaagcgcaccatcctcaccaccaccaccataccctcagcgccaccaccccacctgggcactcctggtgcagctggaaggaaagcatgcatgccacagcggcgcccagggagtgccccgtcaccgccagcttcatggtacggccgctctcctgacgcagcagcgtgcgcacacgatcgatggtgaagaacgcctccagcttcccgcctcctgcgatagagcaatggtttgaaacctggtcatgtgtgatgtggccacagcaacagcacacaccatgcggcatggctgggagggcacggtgcacacaagctgggcctaagtttcccggctggcagcgtaactcggccgtccgcacctgccctccatgctgtgtctgagacctctgcgcgctgctccccgggaggcaggctatcatcactccggtccatggtctgagatccaggggcgccctctccagaatagcgggtggacattctgctcagcagtgcacgtctcttggccgccgcaagcagctcctgcatggattccacaagagtcacacagattgctttccctgtctcatggag

SEQ ID NO: 22845 - DNA, 63 bp, Chlorella protothecoides
ttcgcctaccactgcctgagccactgctcccccgtgcaagggacacaccagctcgttttggaa

SEQ ID NO: 22846 - DNA, 67 bp, Chlorella protothecoides
agctgtatgggtctcacagcaccatcaatgcagatgagtcgcagcagtcaccccagaaagtgcaatc

SEQ ID NO: 22847 - DNA, 61 bp, Chlorella protothecoides
tgcgccaccaggcctacatcggcagggagcaggccatcacccagctggcagagcagttctg

SEQ ID NO: 22848 - DNA, 64 bp, Chlorella protothecoides
gagcctggcactgcttcttgaccttcttgtagtggtagtagttgatgcgcatctgccagtgcac

SEQ ID NO: 22849 - DNA, 66 bp, Chlorella protothecoides
cagtctgcgaacccttctgcaccgtcgaaagtgccccctttctccaagacgacatgcccgccgttg

SEQ ID NO: 22850 - DNA, 80 bp, Chlorella protothecoides
aaaacccatgccaccccagccgttggacatgacaggtgcacagctccttgtctccagcaccatgcatgaaggctcgagac

SEQ ID NO: 22851 - DNA, 61 bp, Chlorella protothecoides
agggctggggctgggagacgggctggggctagggctggggctgggagatgggctggggctg

SEQ ID NO: 22852 - DNA, 62 bp, Chlorella protothecoides
cctccctcgaccctgcaacgcggaggctgggacacaatacaccccaaacatgtccaacgctg

SEQ ID NO: 22853 - DNA, 95 bp, Chlorella protothecoides
tgccgcgtggcccatccttgaaccctatcagcacactgccagggtgttgcttggccaggtagtcgaagatgcctgtgatgacattgtggccccca

SEQ ID NO: 22854 - DNA, 71 bp, Chlorella protothecoides
ctcgcgcacatgatcctggctcactgcctctccgtcccatgtgcgaatccccacaaccaccctgcgcccgc

SEQ ID NO: 22855 - DNA, 114 bp, Chlorella protothecoides
tggaaggcatgtgagagggttgtgggggggttcctgagcatccccctggaggaacaaagtgggagttgctgcggacagtgcatgtccgcactggccgctggtcgagtcgggaag

SEQ ID NO: 22856 - DNA, 106 bp, Chlorella protothecoides
caacaggcggcagggcttcagcaaggcgggtagtgtgcgaacatctaccctgcacatcctgggtctgcccatggaagctgtccgcatgagtactgcagagctagtg

SEQ ID NO: 22857 - DNA, 77 bp, Chlorella protothecoides
acaacagtcaacatcgtctctgggatggtgttgtgaacgatgccaagtgtactggagacaatctggaatgagaggat

SEQ ID NO: 22858 - DNA, 2400 bp, Chlorella protothecoides
  modified_base (1938)..(1947): a, c, t, g, unknown or other
tccgcggtggacgcccgctgcccgcctcgtgcgcggcacgggcgcttggcgtccgaggcagcccgtcccgcgccgggctcgggcgtggagggggagcggcggcggtcgcggcgccgcgcatcggcctgctgcgcggtgcgctggtgcttggccgcggccggcggctgctcggcggggggggtgcgccgcgtgtgggccttggtcttggaggtgacgaagatgtcgcgccccgccacagcctgtcgcaggatgagggagtggctacggtgagcggcttggggggagtttgtgtgtgtggggagcaaagcaggctgagaagggtgggagcttgccgagatgtgtgcgacggaaggccccctcctccccttgcagatcatgcggccatcgaattccccaccgaatgtcacatacacactgatattcatttccggaaagaaatggtgcaaaacaagtttaaagttagaattcaagtgaaatgttgagactcatttcccttccacatttcccatgacaccctcatcaccccaccccaccccccctgatgataccaagggggaaaatctcctaccgtgaagggcatggcttcccgctccgcccagctcgacacgcgctggcttgctttgagcgcgctggcacgctgcacccggccggagcctgaggggggagtgcgtccggtgtcacatcatgccccgatcccgtacatgccgcgaaatgtgggccgcgatcgcgccacgaacgcacctgggcgggcgggggatgtcgacgtgacgcccggcacactgggcgctgtggcctcgcgggcctcgctctcaaatggggcggcaccggaattgtagatgttgcgatcaatgtccattgtgcagtctggagtgggcgcgggaggcgcctgcattgccacttccatggcaccgacaggcggtgtcggacccagcagcagcagcgcgtccaggactccaaagggcctgcgcacgggtaggatcgtcagtgtcgagcactctgggaaatgtgatgcctggtcagctagagtgtgcccgtccaaagggcgtcagcagcaagcctgtaccagacgggcttggccactggcatcggcctcaacttcgcatggaagctggttccagttaggtcgtaatccgggttactccccgtgaccgtcttggatggcagttcccatacaccgtacctggtacgagctggagcgcgtgtggtaggacccgtgtcctggcgggttggaggggggcctgcttggccgagggggaagcaccaccctgtcctcttgctgctgagctccttcctcgagcaatgatagcccgctgtcgatctagaggatgttgggctcacgattcctgaaacatgttgtccgtctgcatggtgcggggacccccggggtctacgccagggagggccggtgaggggacgaccgtgtgcggtaccagtttccgcagtacccaaactcctcgacccagccgcaccatcgacccgggcccacaccgtggcccaggcggcagggcgcactaggccgttggggggcaaggactcggtccttttcagccacagacctgcacatagaggagcaggccggaggcacgagccagcatgaaggtacggcctgccacacccgccccgccggcactggacctctggccgatcggctcagcgctggcagagatgtccgagatgccccgaaccgggctaactatccaaaactacccccctcgtgcagctcaacattgcgtaccccgccacggggtgccagaagaagctcgacatcgacgacgatgctaagctgtgagttgcaggggttgaggaactgggaacctggccgggtacccggtcttcgcatgtaaacagtcggtcgacattccatgctccacttcccctctaggcgcgccttctacgacaagcgcatctcccaggaggtcgatggcgaggctctgggcnnnnnnnnnntgggtacccggtcttcgcatgtaaacaatcagtcgacattccatgctccacttcccctccaggcgcgccttctacgacaagcgcatttcccaggaggtcgatggcgaggctctgggcgaggggcgagcctgtggttcttctggggtcgctgctggattggaaggctggaattgcatgattcagagcactcgaggtctactgcaacgcggcgggatgctgtcgcggcgttgcattggggtcagggagggatggaaggagggaatggaggctcacccttgtgagattcgatgacgccatggcccagccatctctgcgtcagattactctggcctttgcgaggttcaaaccaggggcacgctgtcaccgtgacgtctgtggtgctgcatggacatcatcaacacctctgagaccagttgtccttgccaacccccccccccacaacccccccccctc

SEQ ID NO: 22859 - DNA, 76 bp, Chlorella protothecoides
gacttgttgagggccacatgcaatggcctctatagcttcaaaatcacgggaagccgtcagcctcttggaaactctc

SEQ ID NO: 22860 - DNA, 293 bp, Chlorella protothecoides
agggagggaaggagcaatgactggtggataattgctgctcgtaaaacgcaatctgtatgttgaatggtgcacatccaatctttccaggactgaaaggtatgccagggcgcgagattcactcccatcggaatacgagattagcgacccacagggaagtatacgagtaaattgtatgcacacgtgctcgctgtagacatcaaaattttgatagaacttggtgtgagagggagccactccagctggatcgagtgccggttcccctcaagccacccacccctgtggacacccgaatc

SEQ ID NO: 22861 - DNA, 65 bp, Chlorella protothecoides
tgcagcggctggaggcgttcggcatgtcaagtacagcaagcaactgaggccatcactttccaccc

SEQ ID NO: 22862 - DNA, 71 bp, Chlorella protothecoides
gcagaggacccttcaccccgcgccggggctgatgtcgggaacgaagaccagcggcccctgggattgctgag

SEQ ID NO: 22863 - DNA, 4803 bp, Chlorella protothecoides
  modified_base (138)..(147): a, c, t, g, unknown or other
  modified_base (602)..(611): a, c, t, g, unknown or other
  modified_base (1131)..(1140): a, c, t, g, unknown or other
  modified_base (1330)..(1339): a, c, t, g, unknown or other
  modified_base (1713)..(1722): a, c, t, g, unknown or other
  modified_base (2045)..(2054): a, c, t, g, unknown or other
  modified_base (2205)..(2214): a, c, t, g, unknown or other
  modified_base (2349)..(2358): a, c, t, g, unknown or other
  modified_base (2493)..(2502): a, c, t, g, unknown or other
  modified_base (2586)..(2595): a, c, t, g, unknown or other
  modified_base (2734)..(2743): a, c, t, g, unknown or other
  modified_base (3076)..(3085): a, c, t, g, unknown or other
  modified_base (3461)..(3470): a, c, t, g, unknown or other
  modified_base (3829)..(3838): a, c, t, g, unknown or other
agggcccacgttgagctgaggtttggggggtacctcggtgcccggcaggaggtattccatcgaaccaagaggtggatgaacgtgcgatcttggtcacaccccaaagcagcaaccctcccgccggcaaactcctcacannnnnnnnnnccaggcaagcacccggtgaacaagttcatcaccaccatcatcacccggctgaagcgcaagaagctctggaagatgtactttgggggtccggtgcgtggacggagaggagggcccacgttgagctgaggtttggggggcacctcggtgcccggaaggaggtattccatcgaaccaaggatgggtggacttgcgatcttggtcacactccaaagtagcaaccctcccgccggcaaactcctcacaccaaccaggtcacctcggcggcggctcccgactaccacaactgggtccggccacaggacgagatgtacctcgataagatccaggcaaggcttggaggttggaagggggttggtgcacctgaaaggcagggttgggagcgagttgatgttttcggtccggtgccatggaagggcgattgaggaccctgccggtccccatccttgttcacagannnnnnnnnnacaggcaaggcttggaggttggaagggagttggtgcacctgaaagggagggttgggagcgagtttatgttttcggttcggtgccatggaagggcgattgagaaccctgccggtccccatccttgttcacagaagaaagctgggaacggcaagtacaccagcgtcgatgggttccgccaggacctgaatgccatcctgaccaacgccatcaagtacaactccatcggccacggccggcatggtggccctggtgaggcgacgcagagcatggaacgatctcgttgcacggacccagctcatcaagacgctgaatgcacctctcccaatgtcctccccctcgcaatccttagatgtcatctcttatgccgagggcctggtatcagacgccgaggtggagatcgaggccctgtaccccgagatcagtgcagctcaggtgcgctgtgtggtttgtaggacaacgtgtggagattagggtccaagcctgtcgggtcggaccccatgtggctgtggagggagtagcnnnnnnnnnnattcgtaggacaatgtggggagattagggtccaagcctgtcgggacggaccccatgtggctgtggagggagtagctggcctcacgggggctgctgattgctgtagcacctgcaagccggccacccaaacctttctccatggccaacagctcccgatggccccgcacaggccgcctgggacgccccgccgnnnnnnnnnngggggggctgctgattgctgtagcacgtgcaggccggccacccaaatctttctccgtggccaacagctcccgatggtcccgcacaggccgcctgggacgccccgccggaaccctaccccgaatatgctcccgtggccgccgaaccgcatgcagccctggcgcctcaaatggccgtgcagcaggaccagtgggtccagtgcaacgcgtgccagaagtggcgagtgatcagcccgtgagtgatctggcgcctggtgtggaggggcttggcttgggcaggggtatggaattgggccttccgatggcgcagttcgcaccgggaaggcctgtgagctgccagattacgttcctgtgcctcgccgtcaaagcgatacacnnnnnnnnnnctacactgccttgttccggacgtacccatggtgctgtgggagccggagtgggcgatgtcgtgcagaggcgtcagcagcggggacgacactttgaccacgctcctcctgccgcaggccaggagccggctgccaggatcccgaggacacctgggtggagcccgcggctgtgtgacaaacctgcctctgggaggagcacccctttgcaagtacagtcaacaccttgagttgcagtttggcccatacttcctggcaacgcgcagcccttcccttgattttccttgcagcgccttatgccacttgacataaacaaacacgtgtggtannnnnnnnnntgagccctagctccaatgacccatggtactgcagcatgaactacgataggtgcgtggggagtgtcgcagatccgttgtacactgccttgtttcggacataaccatggtgctgtgggagctggagtgggcgatgtcgtgcagaggcgtcagnnnnnnnnnntagagagccatcaggcactgctcgttctgctaggggaagctggggttgtagcctctaccttcatgaagagcatccagcaattgatctgctgactcgctgccattctctgacaccagcagcagcaacgttcctccnnnnnnnnnncagagagccatcaggcaccgctcgttgtgataggggaagctggggttgtagcctttaccttcataaagagcatccagcgatttatctgctgactcgctgccatcctctgacaccagcagcagcaacgttcctccnnnnnnnnnntactttggccacgctcctcctgccgcaggccaggagctggctgccaggatcctgaggacacctgggtggagcccgcggctgtgnnnnnnnnnntcattgggatgagggactgcatactgtgatgagaaacccaggcctgctggatgccaaaccctgctatgcatcatcaagacccaccggtcattccatattgacatcaaggggcttgctaccatgctactcaatctatttnnnnnnnnnnccattggtatgagagcctgcatgctgagatgaggaacccaggcctgctggatgccgaaccttgccatgcatcatcaagacccaccaatcattccataatgacatcgagggcttgctaccatgctactcaatctatttgggacagtaatgttggttctccattcatgattaaggatgccagacatttggtaggtccaaggctttcaaaggtgtgagcaccaggacacttcccatgctcaacagtcgtaccagtcccccaaaagcttcttgacctagtgacagatcagcgtatgcgtatacacgtgcgaaatccaggccaaaattcgcttgtagnnnnnnnnnngtgttggttctcattcatgataaatgatgccaggcatttggtaggtccaaggctttcaaaggtatgagcaccaggacacgtcccatgctcaacagtcgcactagtccccaaaaagcttctcgacctattgacagatcagcgtatgcgtatacacctgcgaaatccaggccaaaattcgcttgtagcggcgtttctatgctcaatttcagggttaacaacgttgaatgtccgaaatcagctttgtctgaactttcttcggggtgctaggcacagcatcaggctgcaactgatccacggcagcaacatcctgccgcttgagattcaatgtccaaaatttggcgtcctaatagggggtctctggggaatttgcacattnnnnnnnnnngcgttgaatatccgaaatcagccttgtctgaactttcttcggggttgctaggcacagcatcaggctgcaactgatccacggcagcaacatcctgccgcttgagattcgatgttccgaatttggcgtacaaatagggggtctctggggaatttgcacattcttgtcgaacttcaatccttcacatgaacaccctcgacgtcaccgcagggagactgcgggacgcagaagcacccttacccgaggaccacactagcatgatcgaatcggctttgtaatgagagcaatggttcacagagaaacagaatccatacgagttggttttccctgctgatatcaacatgggaaggaacacggatcgnnnnnnnnnntaagcacccttacacgaggaccacactagcatgaacgaatgggcttcgtaatgagagcattggttcacagagaaacagaaatccataagagttggttttccctggtgatatcaacatgggaaggaacacggatcgccattatagaaagaaagaacatctcgcaaaagctttcgcccctggaccgagatttccctcgggtttgtaagcctgcgacgggtcctcagcactcacatagagttcaccatgccgccgaggagtgggccaggatacgggtaccccgacgagtaccagggtcgtcccccggctgacctggatgtcgagtcggatggtgaccccggggagtcggaggattccgacgaggaggccgcagccctcgctcgaattcgaaatcggagcaactcgcgccggggtagcacgaaaagggcgagcggcgagggtttccagcgcgtgagcacggcgacagctgccaagcgtcagaaaggcccggaaccgatcgtggatgcagacctctgggtctgctgcgaccgctgcaacaaatggcgtgtcctgcgcaaggatgtctttgatcgtaccgtgcgggaggacgagcgctggtactgcgagctgaatttcggcaggtgagcggacgggtgtcggggtgtgtgtgagtggggtccgaagtcatggggaaggggccagccgagtcgtctcccccagcaaggcagcgccatgcacacacctgctccccttgtcgcgctggcacacccctcctgctcacatggccctccttgcatgttcaaagttcatacaccagaaccccatgccacccaccccttcacacaacctcacaggcccggcgcctcctgcgccgacatggacgacgagaaggcgcaggctctgggccagcgccccaaccaccccgccccccaggccccggcacccctcacccgccccgccgccgccgccgccgcaggcctggcccacca

SEQ ID NO: 22864 - DNA, 77 bp, Chlorella protothecoides
ggtcagcatcagcatgttggcagccccgttcacgtcgcggttgacgacatgaactctgcaggccttgttgccgcacc

SEQ ID NO: 22865 - DNA, 117 bp, Chlorella protothecoides
ttccaaacctttccggacctaaacacaataatgcatcgcatccacagcacctcgagtatgtaatctgtagggtgctctgggaatggaagtatataaaaggaagcattcgagactcaa

SEQ ID NO: 22866 - DNA, 98 bp, Chlorella protothecoides
ggagtcgttacatccctgcctgacacccccgatcagctgcccaagtatctcaatggcctggacatccgcatccttaacattgcatccatgaccatctg

SEQ ID NO: 22867 - DNA, 72 bp, Chlorella protothecoides
ttggagagtgtgagccctccctgcatcacagcgcgcaccaagattgtgttgtccgacattgttgttgccctc

SEQ ID NO: 22868 - DNA, 94 bp, Chlorella protothecoides
agacgagggtgcacatgggcgggagaagaaaaacgacataacactcaagcgtgcgcagccggggggttgtgttcgtatgacgagcctgtaaggt

SEQ ID NO: 22869 - DNA, 74 bp, Chlorella protothecoides
atcacgaccgtgcatggctcagtcaagacctcagataatgtggtcagtggctcgaagaggacccctctgatctg

SEQ ID NO: 22870 - DNA, 116 bp, Chlorella protothecoides
ccaactctgccgacacttattaattcctcaccactcctagaagcgaagtgtatgatctatatacataatcaataaatcatgtgcatattgtttgatctgcccttgacattcctgtg

SEQ ID NO: 22871 - DNA, 61 bp, Chlorella protothecoides
ttagaatcaacggcgcagatgggacccactgcctctattcgacatgctcatttggaataag

SEQ ID NO: 22872 - DNA, 61 bp, Chlorella protothecoides
gcacaccagttcaaagtgcatggcgccgttccgcggcgcgccttggtccatgagcaggcgt

SEQ ID NO: 22873 - DNA, 76 bp, Chlorella protothecoides
tgccgcaggtcggagccgggagctcgaggccgagcacactcgactggagcgcgcagcacgagcactcgaaacacgt

SEQ ID NO: 22874 - DNA, 203 bp, Chlorella protothecoides
aatgtcccggtctccactccaggtcccctcaccgagatgctttcctcaaccgcaaacggaaggctgtccacaaccactggattgaagaagctcgtcccttgcacgtcgctccgcacaatacccctgtgtgtgaacatgcatgaaaaaggggtgtactcaaagtgcgaccaggcactagggcagctgcaaagagctgtgcaggc

SEQ ID NO: 22875 - DNA, 71 bp, Chlorella protothecoides
accccttgctcttcagtcctcgaggaaggagtgccggtggctcgccagaccgtgagcgtgaaccagccgct

SEQ ID NO: 22876 - DNA, 64 bp, Chlorella protothecoides
gctagctccgcgcagcttccagaggctctttggagcagtcagcgagcgtgctgtccgcagacca

SEQ ID NO: 22877 - DNA, 63 bp, Chlorella protothecoides
tgcccacgtctgagagcatcccctgcttcagcaccccccctcttcccccctcgcgcccgcgcc

SEQ ID NO: 22878 - DNA, 135 bp, Chlorella protothecoides
ggtggcgcggtggtggaggagtgaagcagtcgctcgcgcccaggcgacgacgacccggaataatgtgccgccccacccccgccccctccgcgactcgcgcgtcggcggtccagcacgcgttttgcacgcaccttc

SEQ ID NO: 22879 - DNA, 61 bp, Chlorella protothecoides
acgctgggctatcccagcgcacagcgtgcgtacggtctcgcgcctgccctccccccgaagc

SEQ ID NO: 22880 - DNA, 154 bp, Chlorella protothecoides
atagccctgagagaaggtggggagctacagaggggacatgccatggatgggtgagcagcggataacttctctccctagaactccaagtggctgtctcacccagccagtgcaaccccacatgtttacagtggagaagaagcgtgaggacctccat

SEQ ID NO: 22881 - DNA, 61 bp, Chlorella protothecoides
ggccaccgcggcgcgctgcaccgggtcggcaattcgatccaggtccaccatatcctcgtag

SEQ ID NO: 22882 - DNA, 80 bp, Chlorella protothecoides
ggtgtcaatgatgagatgacttcgcgcacaaaccgttgtctggcagagtctggcattgcggggctcttccgaaagctcga

SEQ ID NO: 22883 - DNA, 68 bp, Chlorella protothecoides
tggcattgcggggctcttccgaaagctcgaataatttccggcgggcgaatccgatgccattcttgaat

SEQ ID NO: 22884 - DNA, 89 bp, Chlorella protothecoides
ttatgaccaactcagcttgcactatctcagatgcagcagaaaacagattaccccattcggagcatcaaacaacctcacaatgcacctcg

SEQ ID NO: 22885 - DNA, 172 bp, Chlorella protothecoides
attccgttggggtccatgcacatggcccacgaaattcagacaacatattgccagaacaagtaccaaggaatagctgagtcaggtcagattccacacttagatatatgcatgcagtatgcctttttcaatcctgatcctctcaaaatccaatactccatcctaccttggcttt

SEQ ID NO: 22886 - DNA, 249 bp, Chlorella protothecoides
gccgctctcgcccatggcgtgcactgctgctgatgcgcttgcccctgagagaagagggggtatggcacctgtgtgatggggcgcgcggctgcagatccagccccgagacacccttggcaagtcccgcacccgaagctcgttatgccagccaccacaggccgatacggcaagcccccccattccaccctctggctcaccattgctcgccgcgttcgtggcgctttcgctcgcatcctcgccacggcggct

SEQ ID NO: 22887 - DNA, 16056 bp, Chlorella protothecoides
  modified_base (3628)..(3663): a, c, t, g, unknown or other
  modified_base (6137)..(6173): a, c, t, g, unknown or other
ggggaggcggggggggagggctggcccggggacagggttggggagggcgggggagggaacacgacgggagggggcgacgcctgcatggggatgaatcgaaaggggtgaggagcaggtcgaagcgcctggcggctgctgccatgcatgccgacatgcctgccacacactccccaggtgtgggcatgcaaaccagcagagcaccaagccagcttcccagccactctcccccacgccgccccgctccataccatcggctggggcgggggcgagatgtaggtggggttgatgccgggcagggtcggggaggagtccaggcacgaggcatagtacacgtcgggcttgggggagaagacagcgccgctggcgcacagcccggagttgcccgccagggaaagcgcgttgaggttcagggcggtccaggagtaagggatgccgccggacaggctgttggagctcaggtccagcgcctgtgcgatcaaggaggggtgcagccatgtgaggaaaggaggcaggagaaggttcggtgcccaagcgtctcacgatgtgtgggcaatccggagccccagtgtattgtcatgtgcggggacgaggaagaaggtacagggcagggtcccgcattcgaccctgcaaccactgattcaggcatctctttccagacagaggagtcccagcacagacgcacaccttgagggcgatcaggtcaccccaagtggagggcagggtgccgctgatgcggttgtgggagacgtccagccccaccaggtccttcaggctgctccaggtgctgggcagggaccctgagggatggggggacaggaggaaagagagcacacaggtcaggaggtgggggattgggtggcggcgcacgcgtcaggtgcggggtgcgcgcagcggcgtggggtgtccgggttagtctgatgatggccttgaccctgggaaagaagctgtgctctcccttggaagcaacccttgccctcccatccagcaccaggcatggcttcgaggcaacagatcaccaagctccccagcgcaccccagtccctcagcaggcaacatgcatccccaggcatccgcgccgcacccgtcagtctgttccctgccaggctcaggtagtgcaggctggtgagctgggagatttgggccgggaccaggccgctcaggtcgttgttggccaggttcaggttcgtgatggtgtccagctcctgccacaggttctcatccacggggagctgccccatgaggcccagcccatcgaggtccctggttcaggaatggaaggggagcaatatcatggttggcacagggaatccaagtctcaagatgggatgagggaacctgggaaacaagccactgatacgcatggaggatgtccagatggtgggctgtgtggcctgtccccgccctggcaagcccaggcgacatcagtatccctcaggccccttgagcacactcacacggtggtgacggagccggcagcgttgcaagtgaccccggtccagctgcacatcgctgtgttgacagaccagttcaggacgccggtggtgtcgatcgaggcggccaggaggagcagcgcattgcgctgggaagacacggccagcacgggacctggtgggagggcggtggcggtgcagtggaagctgggggggagggcgcccacatgcccggctccgtcggaatgcaggctgtagttcctttcttcacgccgcccaaccctcaccgatgaggatgaccatgcatatgcccaggaacttgaacgctttcgacacacgtgcgcgcgtgtcgggtcgctggcgacccatgggtagctgcggcgtgttggttggtggggacggcggggatcagatctgggcgaggagggcatggggggccgacccaccttgcttaaatcaccacatatgcactgccatgaatgatgcattcgacgcagcggcgcatgggcgaccacatgcttgggttgcaccgacacgcaccctggggggtggatcgctcaccgtgttccgcaccttctcactgcttggacgttgtgggactttggtatgctgttgaaaagttgttaagactgctaattggactgtcgtgaggcttggaaccaccgcattgcccgcctgtcgacattccgcgcagtaacggttttccgccctcctgctgctgcgcatgcggggttctctggtcgcgagctctgcaccgcccatcttaacaacatctctacttggtgcattacagctgccgtgattccacagtgtcaacatttcgttaagagagggcgagtggctgggcagcaagcgcagtaccatggcgagcccgggagcctctggcccctcaccctgtacgatgatcatccgcccccccctccccaagaatcaaccctgcccatcaggcggcgatgcgctgcagctcctcggcggcctgctcgatgcgctgctccatgaggggtctgaagtggcggatgaggccctgcacgggccaggccgcggcgtcgcccagcgcgcagatggtgtgcccctcgatctgcttggtcagctcccagagcatgtcgatctcctccagccgcgcatcccccgccttcatgcgggtcatgacgtcgtagagccaggaggtgccctcgcggcacggcgtgcactgcccgcacgactcgtgcttgtagaagtaggacaggcgcgcgatggcctcgatcacgtcggtggacttgttcatcacgatcaccgcggcggtgcccaggcccgactgccgctccttgagcgcgtcaaagtccatcagcacgtcctcgcacgcgtgcttgggcaggagcgggacggaggagccgcccgggatgacggccagcaggttgtcccagccgccgcgcacgccgccggcgtggcgctcgatcagctcgcgcagcgggatgctcatctcctcctccaccgtgacggggcggttgacgtgccccgagatggcaaagagcttggtgccgtggttgttcttgcgccccatgccggagaaccactcggggccgcggcgcaggatggtggggctcaccgccaccgtctccacgttggtcacggtggtggggcagccgtagagacccacgttggcggggaagggcggcttcagccgcggcttgccctgcttcccctccagcgactcgatcagcgcggtctcctcgccgcagatgtaggcgcccgcgccccagtgcaccgccaggtcaaagtccttgcccgacccgcaggcgtcccggcccaggtaccccgccgcgtacgcctcgtcgatagcgcgctgcagggccaggcgctccgccacgaactcgccgcggacgtagatgtagccggcgcgcgcgcgcatggccgtccccgcgatcaggcacccctctaccagcttgtggggttcgtggcgcatgatctcgcggtccttgcacgtgcccggctccgactcgtcgccgttcaccaccaggtacccggggcggccgtcagacaccttgggcatgaaggacctgtgaagcaggggtgtgacgtgtgtgaggggagaagggggtgtgcaggggggggagggaccgccatcaagcatccacctcccagccagcgacgtacagatggaaatcagacagggaaagcacacagcacatcactctcccccccccccccccccccccccnnnnnnnnnnnnnnnnnnnnnnnnnnnnnnnnnnnnatcagtcagtccatccacgcaccacttcaggccagaggggaagccggcgccgccgcggccgcgcaggcccgacttcttcatctggtccacgatccagtcggcgcccttgctcaccagatccttggtgcggtgccagtccccacgcttctccgcaccctgacagggttggaccagtgggtggtactcgcaggatgagggaagtctgaccccagggttaacatcccacctggcccacaccaacacagcagggcatctcctcagcccctcctgctcctcaaaatcaagtcagcctgaccacacggattcctgggagacacccgcaccttcaggaacgggtcgtgacgaccatatatgtttgtgaagatgcggtctttgtcctccaagccgccgaagctggtcttctccggggcggagctataagcgcgcaggctgcacagggacgtgagggggaggggtatgctcagtggacacttgatggacccctcccccccacaggccatcaggacccgaaaccggattcaccatgctatcgaaatcgccgcaaactcaccatgtgcgaacatgctccgcggctctgctgccggacctctgcagcatcgtgggccccttgctccccggtgacacaggcgacccgccccaaattccccggacgaataaatgcacagggactcgccttctacgagggagtcgtgcggtgtggcacgatatggaccgcgcggagaaccctgccatgcctggggctgagcctgcaaaattcgccagagcgtaagcggcgatggttgatcccgggttactaagggtgcctcgccgttcagcggtgcacatggcctgcccccctccagaccacagttcgcacagtcatcgtagctcgtatcgtgtgcatttctccttctagggtggagccacgtagaggagagcaagggttgcaatgcgctctgcgggaggggccttggtgcgggccatccgctgtggcctgcagaccagcgagagcggatcgagccggctgtcgcaggtgcgccagggatgtcgatggcatcgggtcgaaagtcggtttggtcctcgctgagcacctggtcccccggtcgctccccctcccgtgggcgtggtgcctgcactgcctgtccacacgtcccaaaccccgcgcctcgcctcatcccgatcccgtgaaccaacccttaccacctcgcgcagaacctcccggggctgaccgcgggcctgtcccaggccgggatccacagccaggccgatgcagcgggcagctctcagggctggtcccgtgctgcggccggcgcaggcgtgggcgccggcgtgctggcgctgactgccaccgccgccatggccgacgaggcggagcacgggctggatgcgcccaaccagaagtggagccacgagggcttcttctcctcgttcgaccaccgagccatccgccgcgggtaccaggtgtacacacaggtctgcgcaacgtgccactccgtgaaccagctgcacttccgcaacctggtggacgtcgcctacaccgaggaggaggtcaaggagatggccgccgagatcgaggtccagggtgagcaacgcggtttgaggttgttttctttctgtttgttttatgtcgtgcattggaggtagattgttttcagtggaagtgtgggtggggatgcgccgagcaggcacactcagctcagagcagggttggatccagggatctgcctgcctgtgcatgcatgccattccgcttcttgccgcctcaccccccacacacctcatgcccctccccctcccaacaacacaactcacagacggccccaacgacgagggcgagatgttcgaccgccccggccgcctgtcggacaagctgccccagccctacgccaacgaggagggcgcgcggtacgccaacggcggcgcctacccgcccgacctctccctcatcaccaaggcgcgccacaacggcgagaactatgtcttctcgctcctgctgggctaccgtgagccgccggagggcatctctgtgcgcgagggtctgtactacaacccctacttccccggcggcgccatcgccatgcccaagatgctcaacgacgagggcgtggagtacgacgatggcacgcctgccaccgaggcgcagcaggccaaggacgtggtcaccttcctggcctgggccgctgagccggagctggacgagcgcaagctcatgggcgccaagtggatcggcgtgctggccctggtcctggccaccaccatctactacaagcgctggaagtgggcgcccgtcaagtctcgccgcgtcatcgtggacgcgctcaactgagcggcgggggggaaaaggaggaggaggggggagagggagtggcctcatggtgcgccagccggacaggtggcgtacgcgctcgctgctgggcccccacaccccttccaagtgccccaggcaggggcatcgcctgggggttgagccgcccccccccccccccccccccccnnnnnnnnnnnnnnnnnnnnnnnnnnnnnnnnnnnnnctcaaatgttgaatgcgtacgatgtagacctccatgacccgggcgtgcatgccacaaggtgccgggagggcatgagtctcactggctggctgcccagctgtgctggacggccggcaccaggccgggtgtagcagaacttgacaatggcagaccgagggcctgggtcgagagggtgagatgttaaccaggctgcgtgcagatggggcgccgcgctggctacccacgagtcaccaccaagactcagccataccccttcgtcactctcactcatccatgattgttgctggggttctgaaaaacagggcatgcatgcaaagtgggacattctgaggaagcaaggggtacaggggggggacgggggcggaccgggggggtttcccaccgacgtcccacttcatttcactggccggctggagtgttggaagggcagccattcatctaggcagggcgccaggcaaactcctggcgatcggcacgttcaagcagtgggcacgaaggcggggtggtccggggagtcaaaggtcttaataaactccagggcgcgcttgagctcggcggcggccttccacctgccccagcccttctcctttgccatcagctccaccacctgttgttttgtttgtatgtgtgtggggggcttgttgggcgcgcgtgtgttgaatattggagtgtgtgaggggaggagcgtgggggcaggcctgcaggggtggtgcaacacttccggaccccccttgcacaccaccaaccacccaggcacccccccacacgctcgctcaccctgggcagggcctgctcgcaggcgcgcttgtccaggaaggcgaagcgcgtgcggcgcgcgacaaagtcctcgggcgtctcgcagaactcgttgtgcacggcgtagaccacctccgcctccagcgtggggtggccctggaccaggcgccggccgagccgccgctcctcggcgatgcgcgtgacctcgtgcgcgcggtcgccgtaggactccaccaggtacttggcgatcttggtgtcgatggcgcccgggcggtgcggcaccttgtaggtctgcgccacctcggtgaacagcccggggtagaacccggcgccgcccaccaggggcagcgcggcggtgacgcagggccccgcggccgcgccgcgctcgcgcagcacgcggtcgatggcgtcctgggccatgaggcggtaggtggtccacttcccgcccgtcaccgtgatgatgccgtcggggtccaccgtcacgatgtggtcgcgggaggccgacgcggtgtcagccgcgttggggtccagtgccagcggccggatgccggcccaggccgacatgacgtcggagcggcgcaccttcaccgtcaggtagtcggcgatggcgtccaggatgaactgcacctcctcctcgcgcgcctgggggcgcatggtcaccgcgcagtcggcgtcggtggtgcccgcgatggtgtgccccagccagggcagcatgaacaccacgcgtccgtccttggtcttgggcacaatcaggcccacgttctcgggggagtagtagtcgggcagcgtcacgtgcacgccggcggagggcatgatcatgggcgtggtgctcgggtcgctcaggcgccgcagcccgtcggcaaaggggccggtcgcgttgatgacggtgcgcgcgtgcacgcgcgtcgcgcgccccgtcagcccgtcggtcactactgcccccgtcacgcggccgtcgggcgccttgatcagcgaggtggcctccgcatggttgaccacggtggcccccgccagcgcggcggtcaccgccaggctcaccgccagccgcgcgtcgttgaactggccgtcgtagtacacgatggtgcccttgagcgtcttgccgtcggggcggtcgccggccatggtggggaactgggcgcgcgacttggtcgggcccaggtagtaggaccaggacagggccttgccccccgccaccgcgtcgtacagcttcatccccgcccagtagtagggcacctcccaccaggagtagcagggggtcatgatgggcagctcgtgggacaggtgcggcgcgttgctcaggaaggtcttgcgctcgtgcagagcttcgtgcaccaacttgtactggccataatcaaactgcttcacggcctggggggggagcatcacggggggggggaggggaaagagggcggggagaggtgaggacacgagtgacactggggtcgggccgggggaggggagagggaggggcagaacgagtggccgttccgaagggggggcactgagcgacagattggggctggagtggctctggggatgaggcatggagtgtgatccatacacaatgtgcggagagtgtgggagcaagcaggggagagtgcgtttcgccgccgccaccccgcgtcaccagaagagtcggggacgaaacgagcagggagcactgggcgggccagccgtatggtcctgtatctgttgtaagaagcccagcgcccccctttcctcttttcctgggttcgcccagggccctccccccccccaaaaaaacacctgcgacacaagcacaccttctccaggtagcgcacgccgccgtgcaccagcttggtggaccgggagctggtcccagctgcgaaatcctccctttccaccagggcggtggtcaggcctctgttttgcggggccaagggggtgcagaggttggtgggttgggggggcttgctgcgcgaggaccgggcgggccggaccgtgccgtcccggcgagcctcattccgcggaaactcgaccaaaccacacttcgacacgcagtggcaggggcatctcaccgggtgacggcatccagggcgcagccggtgccggtggcgcccccgccaatgatcaggacatcaaaagggttctcggcggtgcccttggcgaggctggccagccgctcctcacgactgggcacccgatcggccagcttgggcgccacgcccttggcatctgccagggatgacccggtcagggcataccccgcgcctgccccgacggccagcaggctgctgcggagcaccaggcgacgcatgactggccggacggcttgcgaggccccggggtgcgtacagctgtacctggttccagaaagattgtactcctacttgtgagtcgcatccaagcagatcttcagggttggcgctggaggtcctcgtcagagcgtgtgcatccagggaggcccaggtcagaaggaaagaaaggaatgcgaaacaccagacactgctcgcaggcgctagatacatgcgcgatgtcagacccacaagatactaatgtaatgtagagggttagaattgaagatttaccggacagtcatcgcaaactaagcaggaagcactgtaaacatatatttccgctcataatctggaaaatatccgctcacagcggcggcagcgtcatcgtgcgcatcggcctttcatttttgtgtgaacgatgttgttatagaataacgcaagctgcaggtgcgtgatcccaaggaccgagactgcatggagggcactgaagactttccatgcccgaccaccttcctcacgcagttttccgatttgggcacgcaatgcccatggaaagccactgaagcgaggttcgggaagattatgtaaaattatcaccgcagtatactatactcattcagcatcttccaatgggtcttgtcgtcggaacccggcggcagctatcgaggtgtaccgagacatacacctgctccaatgcgttcccccagcagcggcctgtatgggagatgggcccagcatgtaatgagtttatacaccaggagcgccctcgtgtcacccactacaacactcctcgaaaccacatgcgggcatgttgaagggggtagtgccgcgtgtcgtatcacccccacgcgggtttcattaccgcgtttacatcctcggacaagtccatggaaacacctgtttctccacccagtgacctctaatttctctatcgcacattaaatcgcaagaatgatgcccaggggcgtcacctctctgttgttgggttgcgctgtcctggccgtggtcgccggccaggctgttccgacatccgaggccggcacgccggttaccaagaccatccccctcgcggcattctcgaacatctccatctgtacacccctgaacaccctggtgcttcccgggccggccggccagtatggcattgtgctcagtggcgagccggaggtcctggccgagatcgacgcgagcgtcacggggcaggtgctgtccatcgtgctcaatggacccatcgacacctcccaggaggtgaaggtgaccgtcatgctgcccgcggacgccctgagcgcggtggagcactacgcacccggtgctgacgtggtgatcgcacgtgggttcaaggccaccgatttcagcgccaagagcgcctttggggcgggggagctctacatccaggggctcacagccaccaatgtgcagctggatgtggcagggtgcgtcagattttggatgtctgggtgacagtggatgccggggagaagaacagtgtggttttgcggtacccggcaaggagtgctgtggggatgctcatctctctgcttcacaagcagagttcagggtgactggccacgtatcatgaaatccctgcttcaaaccatccacacatgcacaggcttggaaatgtggtgctggagggcacctacaccagcgtggcagccacatcgtcaggcactgggagcctctacatcgtgggcgtcagcacacaggtgtccctgcaactcagcgggctgtccaaggcttatgtcatccccagcggccccacagcttccatcaccggatccgccagcgggcaagtggaccagaattgttggaggggcagtttgcaagggggcctggtctcgggtgccaggggtttcagggtgtgcgtctcagggtgggtgggccctcacatgcctctctcccatggaactctcacccgtgccccatgactcaccatccccatccctccaatccctaaccccccagacccccaaacccccaacctcccccccacacaggatcaacaacgtatactacaccacgggaacttgcgacgtggcctcccagttcgccttcctcggcggctgccagctgcaggccagcatcctggtcccccctcccacgggcgtgtggacctgtggactggtgacctctggtgccttccagtgcgccacaagtacgttggcgtggcgtcggggggtgcatgcatggtatgctggtggtttgtctcttggagagagggacttgataaactgtgatactgtttggctccggcagatcgctgggccccacctctgctctttctcaatcacttcatggactcacaaaccctcccctcccttcccccctcccccaccccagctggatcgacgtactcgacctccgccaccggcgccacggccgtctctggtgcagtggggtcccaggtgctgaccgggacgacggcggggacggggggcctccccccctccagctactccttcgccgtgcccgccgcggagggcggcgcgcagcaggctggctcagtcacgcccaccggctccaacgccgcctcctcggtgacgggcagcggccccgttagcgcggtcagcgtggccggcccgggaagcgccaccaccagcaccacgcaggacggcgtgaccaccacgggcgggacggggctggccggcttctcgccggcggccgggcgcctgggcctggaggccgggggcgtggtgcccgtggcccccctccaggcgcaggacagcggcttcagcttttccgcgcccggtgcgcagcaggccggggcggtgacccccaccggcaccaacgccgcctcctccgtggtcggcaccggctccgtcagcgcggtggccagtgccaccccggcgggggccagcacgtccaccacccagggtgggcagacgaccagcatgcagacggggggcgcggcgggggggtcgccgctgacgcccggcgcggcggcgctggcgcccgcgccggaggcggaggcggaggcgtatgtggcgagggtcagcgccgccggcgcggggtcggccaccagccaggcctgcgactcggagggcgtggcgatggagctgccgtgagggtggcgtgcatgaaccgaacccctgtcctgacagtgtgcattaccggagcgttgatcctttgacgattgtggtggcgcctgagcctgagagggccgcgatttaaatactggccggacttgtgtatgcttgggatgccggggtcgatggcgcgtccgaggaacagctcatgacgcaggcgagcggaccggaccatgacgggtgagtgaaggcgatgatgtccccgctcgacacaagcatcgacttgctcctcacgaagctgactttacaagacctgacctgacctcccgcccccctcccctcctcacgggctctgaccatcccccggcaccagtcgagcaagtggccattggtgaggattaccgaccaatactacctcgtttactctgaaacaactaattactgtgcattaataattcctagtgacgccacgcgaggccatggtgactgtcggaacacccagcaacccaggcgggtaccacaccattttcgaaaagtacgatcggtcacactcgcgagccctcaatgtcgacgacgtgcgcagactcctggacgactttgggtttctggtgagcgcaggggccgcatcgggggtgtgccggcccatcgtcgatcgagcagctgccggtttgtaaagccatcgttcccccctaagcggaccccctcgccgacttccctcctactcgcagaagggcaagtctgacacagactctgcggagctggtgctgagccacttcacatccgcagaccaggacagggacagcaagctcagctttgacgagttctcgggcctttacagcaaggtgggtgggtgtgaggagggtgccaaggaacagctcttgcagggttgaatgcagggacatggcattgccagagtcacttctcccttgaaaattcctgcaagctgacaagcgcttcaacctttcttgttcgtcgggacccaagtactcaccaacatcctgtgcagttgacggcgccctcactgaggaaggtgctcgccaccaaacttccagacctcatggctcaggtccaagatatctttgacacttgtgccacgggcagtaccaagaaggtgagactgcgagagacctgaaggttgaccatgctgctctggaatcatggcctggtctctgtggctgcaagatgcaaccagtcatgtgctcagtgctccccctgcctcgccacgactcgcagagcatgaccaacacccagtttgtgaagttggtgaggacatgccctggcctgagccacctccaagtgacagacctcgacatcatttttgcgaagattaagagcaagggggagaggaccatatcctttgaccaggtaggtattgttccacatagctgtcgagggaatgtgcaaggtatgaggaacgagggggaaaacacaatgtcttggcagatgcatgcatgccagaactcccgccccattgttaagctttgctgtctctggccccacactcaaagttcgttgaagcgctggagctagtgggtaacaagcacggtcagccggtccaggaggtgatgcagctcctggccaatgcccgactgggtgagctatggtgctgatgtggagagggagagggggactgtgtcatgtcgagggatagcatgaggggcccagcacattgaggcattgctcaggtggatgagccgggtcgacgacatgtcaggccacaacaactgatactatattggccgcaagacgctgccactgcagatggagtagaggcaagattctcatttgcgatccatgcttcccctgccaggtcctgatgccgacaccaaccccggcacaccactggcaaacacctcctcccaccccgaggctggttgcgacagcgcaaggtctgagaggtccccgctctcaccccaggtagggtcagttgattgttgtgcgggccagggtttaccttggtggctcgatccgtcgtgatcatagccctggcatgcatgcatgcatgactcctcagcagcagacagagtggccaattgcctctatgctgagaacaaagtgcctcaccatgctacctgcattcacctccttgggtcactcctttttgcacctgcactggcatagcatacctccactagtagtcccctctcccactacacttccatccctctcccctccccatcattgcctgtaggaccacgagctcctgacccgggtgcggcaggtatttgcccgctttgccgcgttcggcgccccccggcccagcctcacgccgccccggcctggatctgttgccggcgaggccaagcccggcatggactgcacgcggctggtgaagctgtgccgggatgcaggtatcgtgcggggccccaagagcgtcacgaccgtggagctggcctttgcaaaggcaaagcccaaggtgggggtcagaggctggtaacagggatcgaagtagggactggccaatgccttgcagagatgcaaggcggagcaaagacgtctctcggggcacaatagcgctgcgtcacgcttccatcccaccgccactcgcccagaccggacggcgcatcggcttcagggacttcctgcgggccctgtccctcatcgccgagtccaagggcgttcccggtatgcgactgatggtatggtgaaccgcgtgtagccctgtccaagagggcttgtttcccacccaggtgctctgccccccgaggcttcgacaagggctccatgattgccgtgaaccccccttaccaacgcctctcccctctatcacagaggaagatgtcctggcgagcgtggctgcgtgccccgagcccaccctgacccagaccacaatcactcagtccttcaagcaccatgtggacaggagcacaggtgggcggtgatgctgtatgtgggactcaaggtggtgggatggagagcctcctcaccaacctgggcgggatcagagcctctcagcatgtacccagtatctaatgtgtaccccccccctgtccccccccccagagtcccagcagatccgcgtcaacctgacggccacgccgggtacctgacctcacaggtccgtgctgatgaataattacagaggatgtgcgcatacaatcgcccaggcacctctgctggctccacagacaccaggtggatttctgacaacccatccgaaaccccctgactccacccgccaaccgacgcgctccccaactccattgatctcagcgctcccaccgacccagacgaccattttactgacaccacggtcctcctttgacagcctgtgtctgactgagtgcccatgctgtgctccagcggtaccccgcttctccccgacatgaaccgacctctcaccctcctccatgacttgctgccagggcttccagtgtaacaacactgtgcatgcatgcacctcactcgcagggcagcacaccagggaaagtggcgactgactgctcggcggggcgcaaattcggcaggcagtgcgatgtggcaggagcatggctccctcgctgcctcgcgcgaccgtcctcctgtaggtcccttgcccaatgaacagacctccttcatgccaccctccatcacgcgtacgtctcgccgcccagcttctcccactgcccctccagcgcctccttccacagcgtgacggcgttggtgccgtccgtgacggccagcacgttgccgctgaccgcccagctgaggcgccagacgggcgccggtgaaaagtcgtggagcagggcgcagtcccagcgccccggcgccgcctcgctccagacgtacacccgcccgtcctggcccgcggtcgccagggtcgcgcccggcgcgcccagggccggcgcccaggccacgtcgcgc

SEQ ID NO: 22888 - DNA, 79 bp, Chlorella protothecoides
ccttgccactggacagacgtcggcagatacaattccacggtgcaagacacaggaaacattggtggcgtttgacaatttg

SEQ ID NO: 22889 - DNA, 136 bp, Chlorella protothecoides
ggcgggctcaaagggaccagggatgtgcccaatcaagggagctagtagccatgcagggggtggaagcaatttcatcacgctcccacacgatataccccaacactttctgcgcacagaccgaccaggagtcgctctg

SEQ ID NO: 22890 - DNA, 2382 bp, Chlorella protothecoides
ggggggggtgggggggtgggggggattcagttagcttggggctagtaggtaacccaaaaggaaacgcagggcgcggcatacccgcctgatgcctggtcctgctgggagctctgcaccacagatgcatgggcaggcggagaaatcccactgcccggatcctggctggacgctgtcagtcacggtccaccaaaccaccccgccatcctttcaactcccccctctcttcctccatgtaccccacaggaggctctgagcaagagcggaggcgctggaggcacgtctctcgcgtccctgaacaatatgctgatgcagctgcgcaagaactgcaatccccccgacctcatcacggcggcatttgacggtgagtacagatggtcgccgttccagtcgacattccctccagccgccgtatgggcatgaaaagcaatgcactcagcctcacctccttgtccgagccccatgcaagtgccaactctcagccacagcctcctcccaatgaaaatgacccactcccccccaccaccaccaacacatgcaggctcggtcttctttcccccgccagaggagctggtggccgactgcggcaagatggcgctgctggagaagctgctgaataggttactacctgcggggcacaagacgctgatcttctcccagatgacgtccatgctggacgtgctttccagctacctggaggcgcgcgacatcaagcactgccgcctggatgggtccgtgtcctggcaggaccgccaggaggccatgaaggtgggaaggaggggtgggggccggggctaaggggtgagggaagagtgggcacgtgcgtgcttgcaactgtccaggagatgagcagggaggggttggccatatgatgagggtggaagcggactttgattctcattcacagtgctaaaacatccttaaacttagtgagtatgcatcatgcagggggccagacattgtctgatcaccctgatcgtcccatgtgctacctgcgatgcacctaccccacccactcatccgccccaaccccccaacacacagctcttcacgtccgaccccgagcacaaggtgttcctgctttccacccgcgccggcggcctgggcatcaacctgacggcggcggacacctgcatcatctatgactcggactggaacccgcagcaggacctgcaggccatggaccgctgccaccgcatcggccagcgctcgccggtgctggtcctgcgcctggccagcgcgcgcagcgtggagggcaagctgctggagcgcgccgcgcgcaagctgcagctggagcgcatggtgatcaagtcgggcgccttcctgcacgccgacgacgctgcggcggggagcatgagcaaggaggagctgctggacgtcatctcgggcgccgggagcggcgagcacgacctggcgcagtcgggtgacatcagcaacgaggtcagtgggtggggatgggggagtgtggtgctgaatcatcaagaaaggtgggggggtcctaggtggggtagggtgtggtgcgccgggtgctgcgccggggctcgcatgtgggaggttggagagctgccccggattccctggtgccctgcgcagcagcaagcaatctccctccgccatgtgcatcgcaatggccgcccccccccccatgcccctggtttgccatcatgcacccctcaccctccatcacatctattcatgcctggccttacacagaggaagcgcacctccccttccccattctgctgccaggtgctggaccagctgctggaccggagccacctggaggcaggatcaaagcggccgtaccccgaccggggggtcggatacgaggtcgtgcaccagctgagtggcagcgggctgctggcgggcgtggagtagggtggatgaggtgtgtacgagctgtacaggcaaggggttcaggagcgggcgagggcattcagagggcgagcagggcagacgtgccatctacgtggcccggcgcgcgggctgccaacggccgtgcttcgagaccctctctggcctctgccacggcgactgcccggcggcctccggatgtcagcccccgtaagatacccctgccgttgctgttgtcacgcatgtaacaacacagttgcacaagggggggcggccagggaaggtgtggggcccgcaacacctgcggcccgcgggcatcggtcaacggggcaagcatgccgcgagcttggccagcgcagtctcagtaaccaccatggaacagcgaaacacagccccctaccaggcagccggtgcccaccacctcccgagcacgccgcgccaggcgagccggagcaggcctggcgtcgcccgcgccgcggcgctggtcggcgggttgaagcaggcggcggggcgcggcgcgcccgccggcac

SEQ ID NO: 22891 - DNA, 80 bp, Chlorella protothecoides
ggggggctcgaaaaggccgagatggggatgagggaggatcgaactatccccccatcagaagccttgaaccacgcgtaggc

SEQ ID NO: 22892 - DNA, 196 bp, Chlorella protothecoides
cccatcagaagccttgaaccacgcgtaggcgctgcccttggtgaatatccctggtgcttgccatgtggtgaaggtggtgagttgggtgggctggaagcttgtgctgttctcatcatcaccattggtgtactcgacgtagtagccaccagcaggcagctcagataccgtcacactggccgtgcatgtgctcctgtgg

SEQ ID NO: 22893 - DNA, 78 bp, Chlorella protothecoides
cctaccccacctttcaaacccctcttcgtacaccgtgcacaggtgacgccggccatcaccatgaacttcatggagtgc

SEQ ID NO: 22894 - DNA, 150 bp, Chlorella protothecoides
agaaggcaccggacgagccgtccggcgaccgggcgagcgcccagcccggcgcggcagggctggcggatcgagtcgcggggtcggaaccccgggccgggcctggtgcgacggcagatctcagcgccaccgactccccagccccagagccgt

SEQ ID NO: 22895 - DNA, 139 bp, Chlorella protothecoides
tggggtggagtatccttcgatgagtgaaagtgctgtatgcaggcaggaagtgagttttgtctattcaatcagttctcctttcacctgagaatgcctgtggtgctctggcagcccctcaggcatctccatcgtccctgat

SEQ ID NO: 22896 - DNA, 35161 bp, Chlorella protothecoides
  modified_base (1290)..(1299): a, c, t, g, unknown or other
  modified_base (1947)..(2083): a, c, t, g, unknown or other
  modified_base (2171)..(2180): a, c, t, g, unknown or other
  modified_base (3206)..(3215): a, c, t, g, unknown or other
  modified_base (4243)..(4252): a, c, t, g, unknown or other
  modified_base (4464)..(4473): a, c, t, g, unknown or other
  modified_base (4664)..(4673): a, c, t, g, unknown or other
  modified_base (4818)..(4827): a, c, t, g, unknown or other
  modified_base (5861)..(5870): a, c, t, g, unknown or other
  modified_base (6986)..(7028): a, c, t, g, unknown or other
  modified_base (7395)..(7404): a, c, t, g, unknown or other
  modified_base (8672)..(8681): a, c, t, g, unknown or other
  modified_base (10556)..(10565): a, c, t, g, unknown or other
  modified_base (11378)..(11387): a, c, t, g, unknown or other
  modified_base (11728)..(11737): a, c, t, g, unknown or other
  modified_base (12243)..(12252): a, c, t, g, unknown or other
  modified_base (15731)..(15740): a, c, t, g, unknown or other
  modified_base (15804)..(15813): a, c, t, g, unknown or other
  modified_base (17122)..(17131): a, c, t, g, unknown or other
  modified_base (17490)..(17499): a, c, t, g, unknown or other
  modified_base (17591)..(17600): a, c, t, g, unknown or other
  modified_base (18768)..(18777): a, c, t, g, unknown or other
  modified_base (19493)..(19502): a, c, t, g, unknown or other
  modified_base (21275)..(21284): a, c, t, g, unknown or other
  modified_base (22170)..(22179): a, c, t, g, unknown or other
  modified_base (22393)..(22509): a, c, t, g, unknown or other
  modified_base (22608)..(22617): a, c, t, g, unknown or other
  modified_base (22981)..(22990): a, c, t, g, unknown or other
  modified_base (23277)..(23286): a, c, t, g, unknown or other
  modified_base (23564)..(23573): a, c, t, g, unknown or other
  modified_base (24022)..(24031): a, c, t, g, unknown or other
  modified_base (24348)..(24357): a, c, t, g, unknown or other
  modified_base (25006)..(25015): a, c, t, g, unknown or other
  modified_base (25612)..(25621): a, c, t, g, unknown or other
  modified_base (25827)..(25836): a, c, t, g, unknown or other
  modified_base (26938)..(26947): a, c, t, g, unknown or other
  modified_base (27124)..(27138): a, c, t, g, unknown or other
  modified_base (27801)..(27810): a, c, t, g, unknown or other
  modified_base (28816)..(28825): a, c, t, g, unknown or other
  modified_base (28880)..(28909): a, c, t, g, unknown or other
  modified_base (29239)..(29248): a, c, t, g, unknown or other
  modified_base (29649)..(29658): a, c, t, g, unknown or other
  modified_base (30010)..(30019): a, c, t, g, unknown or other
  modified_base (30636)..(30645): a, c, t, g, unknown or other
  modified_base (31429)..(31438): a, c, t, g, unknown or other
  modified_base (31722)..(31731): a, c, t, g, unknown or other
  modified_base (32226)..(32235): a, c, t, g, unknown or other
  modified_base (32935)..(32944): a, c, t, g, unknown or other
  modified_base (34049)..(34058): a, c, t, g, unknown or other
  modified_base (34647)..(34656): a, c, t, g, unknown or other
ctccccccccgcgcccccgttccactccccgcgcagtcaccccccagcccatgtctcaggccacccccctgctctgccccgaattcctggccgaagccctggcgcagtatgccgtgcctgccgcgggcccgccgccctccttcccccggcgccacatcaacattgtggacgcgctgctgccggggaacaacctgggacgcagcgtgtccaaggcctcggcctcccgcttcgcctcggcctttgcgcttggcctgcgcacactgcgcggggccgtggacaggtcgccctcaggggcgattgagggcgtggacgccttcttcaagaacgcatggcaggcccccatgcgcgcggcggccgaggcggcggcctgcctggcggggctggcctccctggggcccctcggctgggaggggctggtcggcaacggggccggcacgggacaggggccacgcgccgggcccggcctctcgcccccgcccatcaacatgcccccgccgccgccgcccccccgctcccaggggcagtggggcgggggcatcccagagggcgcgctgccgagggccctcgcgccgcgccccgcgtgggtgtcccagcgcgcccagcgcgcccagcaggcgacggcgccctggtcgccgcagccgcccagcgacggcctgcaggccgacctcctgcgcagcgacctggcggccctgctggccaacatggaggcggcgtgccggacccggtcgccacgggagggcgacgactggcctcgcgggaccgcgtcgcctgctcgcgccgagccgctggagcccaccgccgcactcgccgacctcagcctgcgtgacggcgatggcgcccgaatggacccgcgggggcgggacgctggacagcccgccgcggctgggcggccaggggaagccatggaggccccgtcatcgccgcaggctggcagctctgattctacgccgactctgcctgcgacgcgagacgcgggaaacggtgcctcgccaggcgccgagaatggtgctttgccaggcgctggcaacggtgcctcgccaggcgctgccgggagtggccctagacccccaggggcgacgccagcgccgctggtgagctggagcgccgtggcaatgggcctgcggcgcgccaccattgccgagacccagcgcgacccaaactccaagaccacgtccccaaaacttcgaacaacagcatgacaactgacagcgtgctgagaatctctcagggagcaccttgcccatccgcgcaggcaatgcacatcttgcctgctgtacatgaggcttccannnnnnnnnngtctctcagggagcaccttgcccatggacatcttgcctgctgtacatgaggcttccagcgccctgcatccgagatgggatgtgcaggcggccccctgttaccaccttccctgaccccctcaaagctgcattctctgcccctttaccctgggcatctgaggtctttaagaaaagaaccgagacacacacacagcagggtaaaccagaacggtgcagtggggtccgagtgatgatcagcggcagtacaaggcgcatggctctaatcaggcgaaggggttctccacgtccgcaacagggcctgcgtcctccagtccggagaactctaggaagtgcgtgggacggtgcacctctgcgtagaactccttggggttgtccagcttcaaaccgtacttcatcgcgctgctgaacttgactccctgcattgtgtcgaggatgcggagcgtgagaagggtggcgagtggtggagcgtacacgatgccgcttgagcctgtaaatgcccagcgctcagaatgtatggacgactgcgccgagcaataacagcatgccctttactccaccagtcaggccccgcttgtcccccaataccctcagaaacaaatgctaaccatgaagttgtaattccaggatcccgcatcgggcaccatgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgagggttgtactcgttgaggtcacgacaggatcggactgttacggccacctaaggaaggctgcacaagaacaaccaggcaggcannnnnnnnnncaacagcatgcccttcactccaccagtcaggccccgcttgtcccaaataccctcggaaacaaatgctaaccatgaagttgtagttccaggatcccgcatcgggcaccatgtagaagcccatgaagcggtccgagagcaggacttgcaccttctcgtagaacgctggcgagaacccggctgcaagagagtaggagggtcggacggtgcttgagggctgtacttgttgaggtcacgacaggatcggactgttgcggccacctaaagaaggctgcacaagaacaaccaggcaggcagcagaatcaaccccctcctccccccaaaacaattacatacctgggttggaaagggcgtcgcggtgtgtgcgcccccactcgtaccccgcgggcgtcagcttgtaggccgtcaggctgacggagcccggggtgaaggaggcggtgaccacaatgcagcgctcgccgtcccaggacttgtgcgtctccagcgccttggcgtgcgccgcaacgtccactggcgccatctggggcgactcggagggcgcagagtgcagccagcccaggggctccaggtccgacagcatctcatgctcgggaaggccggcgggaaggttgaccgctgcgtggctgccccactgcggcggcatgacgatgcaccggatctccttcaccgccgggttgtccggcggggaggagccgtacatgagccccgccacctgcgtccgcaggtccgccacgcagacaaacttcttcagcaggttcttgggcaggacgtacgtgtagcccgagtcccggatgtcgtctgcacgagtggaggtggggggtatggcggggtgagaggatgaagtgtggagatgaatcgatgggtcggaggagcaatgatgccacgatgtagacccaggaacgcgacttgaatgcgagtgtaggggagaatcttgatggccgggccagggacagaatcgctaaaagcctccgaatccaggcctgcccaaaccgacgcgactctcctcctgacattgcacaccattgttcnnnnnnnnnntgtgtagcccgagtcccggatgtcatctgcacaagtggaggtgtggggtatggcggggtgaggggatgaatggtggggatgaattgatgggtcggaggagcaatgatgccacgatgcagacccagggacgcgacttgggtgcgagtgtagaggagaatcttgatggccgggccagggacaggatcgctaaaagcatccaagtccaggcctgcccaaatcgacgcgcctctcctcctgacattgcacaccattgttcaccctctcaatcatgtcaatattaactctagcccccccaccccaccctccaacactccctcccaccctccaacactccctcccaccctccaacactcccctccacacatacccgagttgacgtagatgtgattcacgcgcaggtgcaggttggcggcggagatggcgcgcacgcgccagtcggttttgctgccgaacgcagcctgctcgtaggggctggtggtggtgacgatgaggtcgtcgccatgcacgttggtggtcttggtggtgagcgcggtggcgccgccgccctcccgcgcctgcttctcgatctccgcgatctgctggcgctgggcggagggcggcgtgatctccgcgcccaggatgatgtcgcggatctcgctctgcgtcagcgcgcccacattcacgttgttcttcttggcgtagtcgcctaggatgaggtccttcagcgcgatctccaccttgatccactgctcgtcggtcaggctgggccagatgtggtgtggctccgtcaccacgctcttgtccggcttcagcaccatgcgcgacttgtccacgttcacgtgcagggcgcgcaggatgagcaccaggcgcgagaaggcggtgtaggaggagatggtgcgcagccagtcgtcgtacaggttgaacagcagcatctgcggctccgtggccttcaggatcaggtcgccaaacttctcgatcttcagcgcggcctggtgggtttgttggatttatttatttattttggggggggggggggggggggggggggnnnnnnnnnnagaggggggagggggcaatgggtcaaccgtggagttgataagagtcaagaaacgcacgctggaggactggccgtggacgcacaagcgctttcatgcagcagcgcaagcgctgccaaattcctacgctgctcaaccaactgcacacacgctgaattcaccaggtccaggaaatcacatcctggcttgatgcctgccatgctctcagctggacnnnnnnnnnngtcaaccgtggagatgataagagtcaagacacgcacgctggagggctggcggtggacgcacaagcgctttcatacagcagcgcaagcgctgccaaattcctacgctgcttcaccaactgtgcacacgctgaattcgccaggtccaggaaatcacatcccagcttgatgcctgccatgctctcagctggacnnnnnnnnnntgcagccagcattccccccatctatatcagaattcctgttcccctcactgaccccgccatactccacatacctggaaggggagctgaagctccgaccccgtgatgacaatgtttgggaagtcgaggaggtggacctccagcgggnnnnnnnnnnatactccacatacctggaaggggagctggagctccgaccctgtgatgacaatgttggggaagtcgaggaggtggacctccagcgggtccagcatgcccttgcggcttacgatgatgcgcttgggctgctcctccaccggctgcgagcggatgagcgccgccacctcctccgccgtcttccacttggccagctggctgaggcgcttctgccccgcccacaccgaggtgtggatgatcttgaggaagagctggcccgtgcgcgggttgaagatgaagatggcgccgttgatgggcttggtggtcaggttcccctcaaacgtcttgtggatggtgacgcggtagacgttggtgtcgtccacaaaccagatgatctggttgctgaacagctcgccatagttctggctgctcaggtacggctcggtgggctcgctggagtagagctgcagcgccttgcgcactcgctcgcgcagcacgtacatggccgggttggacttcatgatcttggccagggcctggaccaccaggggcttggcccccgggaaccagttgccaaaggcggagtgcaggttgtaggccaggtccacgcccaccatcacccccgtgggcgaggggtagatgctcatgttgtcggtggtgtagtccaggaacttggcgcgcgtataccgctccacgtcgtgcgagtcgtaatcgccccagcgcagctgcacgtccacccaatatttgttggtggccttctggtcgaatacgtcgttggtgtcccccatcaggctgggcttggccaccggccatttgtaggccgcaaacagcaggatgtctggtgtgttgggaaagagggaaggggggttgcatgcggatgatgtgtggggagtggaggtcgatgaatggggcagtgagtgcagtgcaatatgcaggtcagggatgcccaaacaataatgcattgctgacatttccagcatttattgctggcactcccagccggcaccccccaccccacccacccagcggccccctctcaaggcacctgcacaggacgannnnnnnnnngatgcattgctgacatttgcagcattcattgctagcactcccagccggcaccccccacccacacacccagcagccccctctcaaggcacctgcacaggacgagttcatcttgtatgatttgcgcgggtggattgtctccttctgcaccgtctcaatctccagcgcgtccagttcctggtcaaacacctggcacaggtccatgaccagcgactcgtgcaccttctgccacaggtgggcccggaagatttggatcagcgagatcttcagcgtcgggatctgtgggcgggaggggggcagggtgggtttgcgtgtgtacgcacgtgatgggacattcatgcctgtgtgtgtccacaagagggtgtgcgcatgcgtgggaggctgcagttcggctctttgacgagctgcttgcgaccagaatgggaaccagatgcaactggaagaacggatggcgcgcccaaggcctggccattgcgtatgtaaccaccgccccccaacagggccattgtctggtcccaccaacaccgaaacgacaaaacctccactagcatcttgctcaccttgccatgcatgaagatgccggtcaggtccagctgcacctggaagccgacgtacacgttggcacggttgatggtagggctccaccacagcgtgaagcggcggttggggatctggttcagccccgagcgctgcgcgttggtcagcttcttgtacttcatgctctcctcgaagccactggccttctcccagaacaggccctcccaggtggggaagtaggtgcccttgaacagcgtgtgctccaggatgccctccacgccgcccagcgcctggataacatctgtgcgatagttgttcaggttccacagcttgccgtcgtggcgctggtgggtccaccagaaggggttcatccgcggcgtctggttgggagaggggtggtggggggaggggatgatgtggggagtagctcagggtggagggcaaactttgtcaacgctgtccttggcagcaccaaggcagccgtcactccatcaaggcatcccccccacacagccctcacccaagcttgagaggctcacctggtactgcttgaagtcctggcgcacccgccagcccttgtcnnnnnnnnnnnnnnnnnnnnnnnnnnnnnnnnnnnnnnnnnnngccggtccttctggaacagggtgttgatgcgggggatgccccggtcccagctgtcctccaggtcctccagggtgaggcgtcggttctgcgccagcgcctcctgccgcttcagcgcgtactcagcccacacgcgctgagagtcaatgaactccgcctcccaggactggatgtagcggaaaaggttggggatgagctggtcctcttcgtggctcatgcctgcaggagtggagggtcgaggagggagttggaggggggtgggctaggggaatgagggtcggagcaggcggccttaatgaccagacacagcacatgctgcgagttctcaaacatactcagccaactcattgcacaatacgcctggcccctnnnnnnnnnnaagttggaggggaatgggctaggggaatgagagtcggagcaggcggcctcactgaccagacacagcacatgctgtgagttcccaaacatactcgaccaactcattgcacaatacgcctggcccctcccctgcttcctacacacccgctctgaagtgggtgacgcccaggtcggtctgctgggagtagcgcaggtcggactgtgggatgaggatgtggcccatggagagcatgcccaggccgccgatctccttgggcgagtagaagacgacgggggggaagcgggagggcatcttggagttgagcccgatcttgatgcgcgtctggatcttgttctcgcacttgaccagcaggtccagcagctcctgggtgtgcaccgtggcctcgcgatagtaggtcatcagcccgatcagcgccgtgttccacttgttggcgatcttggtgaaggtggtggagccggaggacatgagcacctggcggatgcggttctcaaaggccttcaggccctcgtcatccacgcgcaggaatgcctgggtggggtggggagaggggaggagggttgggattggggggattaagacatctggactgtgcagcagtgcgccagagtgttctgaggagcgtcgagggccgtgaagccaggcaggaggacaaaagacctggctccacacctagggacccagttcatgcaggtcgatggcacaacgcatgcatgcaggtcgccacatcaagatagccagtgcggcatccaggccccaatcacaaaccaaccatgcatcatctccttccccaagccaccgacctgcgcggtgcgctccttggtgatctcgttctgcaacgcccacacgccgtccttgtgcgcaaaaccctccgccgcagcgcgcacgcgcggcaggatcctgacctcgaagccggccatggagaagaggaggttggggttgtcgcgcgagtacaccgacacgaacgcgttgtcccagtcaaaggtggtcagcgagcgcggcagccgattctgcagcggcgagatgcgcggaggattgtcaaacgggtgtgaatcagggagggcaaagaaatgccctgtgggaaggcaaagtgtggtccagggtcatgagacatggtctgcaccacagacatggacacttgcatgaaggccggggaccctcgcgctgcacagcagtgtttccggcatccaaggctggcacccactccatcagccactcctctgcagtccggcaccctctaccaacacaccaaaggacaaccgcccaccttnnnnnnnnnnaggggaccctcgcgctgcacagcagtgttttctggcatccaaggctggcaccctccccatcaaccactcctctgcagtccgacaccctctcccaacacaccaaaggacaaccgcccaccttcatgtcccagaacacggcgcgtcccaggttgacgtcgtgcttcatcaggcgcatgcgcgcgtcacgcggccagcactttttgttgttgtatcccacgatgttctcgttgttggggtccgggtgctcggtaaggtaacgctggatgaggtcgcgcgcctcgtcggcgctgaagcggaacagcatgtgcaccttgttcacatagcgctggtagagacggatggggtgccgcgtctccacgcgcacgtcgcggaaggagaggaactcattgggcgcagcgggagcgcccgccagctcgctggcccgcgtcaggcccaggagcaacaggtccagcaccaggccgtagtactggatgacaaaggaggcaaactggagtcctcgcaccaggccgtagctgttggtgtgggccatatccttgtacgcgatcaccacattgttcttggccgtcatgtagtccgcgatgttgtggtccacgatcaggcgcagcaggcggttgagcagcgtcaggtccaccttctcgaacagcttctccagcgtggcctgcatcagcaccacgcactcgccgttctctgtctcccacacgtcagccaggttgttgatgccctggcaccacttgtacaccagcaggggcgggggctcgctgtccccgggcttgacccagttggggaacaggtgccgcttgtccgactcataccacaagtactgtgtgttgtgtacgtgaagggtgggatcgtgtgtgcaaggttgacggggtgggtaatgagcgatttggaatgtatgagcgaggggaggggaccctgccgcacatctgggtcggatgtgaagcgggccagcacaattctctgaggcattcgtgtcgaggcacagaccctcgacttgccaagcagctccgtttccagtggtccgagcaacccatcgccccacccaaacccctcctccctcctcccaacatctccagccccccctcacccccacctggtctagataggcgtcggtgatcttctccaggggctcgatctcatagcaggggatgaggtgggagtagaggtcgaagaactcgatggccacctccttgaaggcgcgctgggtgagcaggtggcgcttgatgcgcgacagcgcctcgtgcgggttgtcgtaggcctgctccaccaggcccagctcctcgcgctgcagctggttcaggcgcgtggccaccgtgtactgctccttcagccgctccagggccaggatgaggagcttggtgtcgtgcttgtaggagagcggaggaaaggggatgggcgcaaagcgccgactctccagccagtgtacggtggtggtgtagatggccaccgcctcctcgggcgacacgtaggggccgtctttgaggtagttgtgctgccgctcctgctccgccttgaggtacaggcgcgtcaggcggcccaggttcttgcgacaaaccgtcttgtccaccgtggcgccgcggcggatgcgctcgcggttgtagtgcgccacgttggtccaccagtccgccttcatcttcacgtagcgcaggatcatgttttcgatcggcgcgggcaggccggggacctgcgtgacggtgtggaattgggttgaaagggtgagggaggggcagattgcagcagccgagcgtggatgcaggccccccaaaacacaaagtgggtgtatgatactcatatggtgagccattgacacaaaaaggggcaagtgaccacggcttagacatgtgacacaagctgtcctcacactcaggaggtagnnnnnnnnnngggcaagtgaccacggctgagacatgtaacacaagctgtcctcacactcaggaggtagatgcatcgtcctgccagcctacttaccctagaacatcctttagcaactgatcgcccccccctttaccctccataacacaccccctcccttgtctgtcactccctccctcaccttccaggggatgttggccttccagcagttgtgcgccacgatccaggtgtccaggaggaagaggggcgagccctccagctcaaacccgacgtactcaccgtcctcatccacgcgcgcgatggtgaagcgcaccagccgggcgtcggctgcgtcggcgcccagagctgccacagcatctgcgaccttgcgcggcagcagctccagccccgggccggacatgcatagtcgaagcccgccctcgctgcccggcgcgacgaccgtggtcggcgaggcgtcgccggccgggcccgcacggcggtacaggtcgcaggccaggcccaggctgcgcgccaggtcctgcgccagcaggagccccgcctcgtggcggcggcggcaggagacctcggcaaggcccagcgcttgcgcagcagcgtcggcgccgccgtgcgccgctgcgtcgccgtccagcaggcctgccagcgcggcgcggcgcaaggccggcgcctgcgtgagcaggttacgcgccaggctgggtccggtgagctcgccaagagcgcactccaaggcgccgtcgcgggatacgagccgccagagcgggtatccgcgcgcatcgcgctccagcatggcacccagacgctcggccaggcgcgacacgtggtcgcacnnnnnnnnnngagagcgcgctccaaggcgccgtcgcgggacacgagccgccagagcgggtatccgcgcgcgtcgcgctccagcatggcacccaggcgctcggccaggcgcgacacgtggtcgcacaccaccgcccccgcctcgccaaccgcggcaaacgccagtggctcctccagccctgcacccgccaggcagccggccaggtaggcggcatcctcgggcgcggcgccgaagagtccggcgtcgcgcagcacgcacgccacgtcgaccgccggcgggacagggagctggtcgcaccccacgcgcagcatgcgcacgcgtgcggcgtcgcccgggtggcaggccgcccacnnnnnnnnnntgcgcacgccatgttgaccgccggagggacagggagctggtcgcaccccacacgcagcatgcgcacgcacgcggcgtcgcccgggtggcaggccgcccacgccgcgtacgccgcggcgggcaccgtccagagcaggggtgaggccgcagccagtgcggctgcgtgcgcgcgcgcctcgtccgcgctcgcaaactcggtgcgcgtcgcctgcaggctgcgctccacgccgcacgccggaccggtgtacccccgcacctcggcgtgctccacggcccaggcagacccgcggtcgccgccgcacaccacgcgcggcgcggcagcccaggtcagcaccaggtcgtggcgcgaattgcagacgaagccgcggtctagcagcgcccacccctcaccagcaagcgccttggcctcgtgcgcattccccggcagcacgcccacggcgaacatggtgtcgcggccgcgcatggtgcgccggacggccagcgcctcgccgcccgcgcccagcacgnnnnnnnnnncgcgcattccctggcagcacgcccacggcgaacatggcgtcgcggccgcgtatggtgcgccggacagccagcgcctcgccgcccgcgcccagcacgcggtcgccgaccctgacctccgccgccggcctcacgcggccgtccgccatgcgcacaggggtgtcgggcgcgaagcatcgccacgcctcgctcaggtgctgcaggatggtcttggccttgttctgcttcaccccctccggcatcatgtccaggatgtcgtgcatgaccgcggcgcgcagctccaggtcgaagtggctctcgatgcgctgcttggtcaccgtcttggccacgcccttggactgccggccctcgaactggcgcgccagcaggttgcccagccagcgctccagcagcggcacgatgccgcgcaggaagaagagccagacgcgccaggtgggcgcccagaagcccacgccggggcccttgcccaccgggccggtgttgcccacgaccacggggcgcgatgccgccgtgacggcggtcgaggcacctccggcgctgctgctctccacgccgcccgccagcacgcggcgcacgacgatgagctgctgcgcggtgggcacggtgacgcaccagacggtgccctcgtaggggcgcgcctcgcagtccgacgccacgcgcagcgagggctgcgcctgcgccgccgcgccaaactccaggcggtacccgcccgcgccgccggccgcctcaaagtgcgcggtgtagccggcgtgcaggcacaggcgcaccagctcgtcgcggaggcccgggctggcgaccacgacatgcccgccgttcgaaccaggccccatcgcgccggccacggcgcagaggccgcgcaggacctcccgcgcgcggcccaggtccaggcagcgcagcacccagggccacagggccttgggggttgtgatcatggacgcagacttgccatccgcacccgacacagcaccgccgactgcccggccctgcttggcaggcaggcactcctcggagaagtaggcccaccaggcgggcgccaggatggcgtagcgcctcttgccgccctcagccgccgcgcaggccccggcctcgtcgccggccggcagtacgcggcgcagcgcggccagcgcgccctccgccagctcctgggcggcacccgactcgacctccaacaccacggcctgggcggccgggtccagggcgccggcgcccagccagaggccgtatatgcgcaggaaggcatccagctcctcccccacctgcagccccagggcccccaggcagggcggcgcgcccacgtcggggcgcgcgccgagcgcgcagctcgcctggaaggtcacacgcgcctggttgtcgcgctccccaagcccatgcacctcgtcagccgtggcgatgcggaagccgcctggctcgccgcccgcctcaccgccgtccgtgcgcacgtacatacggtggttgtcggtgggcgtgagcgagacgccgcgggccgtcgcgtcgccgccctgcatcgcgatcaggcggtgcctgccctcggccacggtgacgtcgcccgagttgatggcatggtattccagcgcgccgtccacgaagcaggcgacgcgcagggtggcattgctccggaagtggcgctggacatcgtccagcgacaggaagccgtgctcggtcaggacttggtggtcggtggggaagcagttgaagcggtagtagatgaggtgcttcaggtccttgcacatgcgcacctggcgcatgagcttgtacttgtagcggtacatccccgtcagctggcccacatgggagaaggtgtactgcagcccatcggccagctggaaggcgtcgacgttgcccagccggaactggacgttggcgtccaccaccagcttggtcaggcgcaggatctcgcggcacaggtgaaaggcgttgccgaagcgcgacttcttgcgctccttggtggtcagcgtcttcaccggcttcaggttgaagttgtagtccaggtgcaggtacgccaggtgcttgcgatggatgagcaggttgagcatgttgtagccctggcggcagacctggagccccgcctccacccagtccaactcggtggactggaagaacttggtggccgcaagcgacttgaatagcgaccgcttcttcatgttcttgggtggccgcgcgtgcagcttgttcagcacgtagttcttcagcagcttctggtaggacacgcgcaccttgaccgggtagttgccggggcagtgctcgaagaaccagccggcgacgagggggacgtcgcaggcgcggcgtgtgcgcccagaccgcaggttgaaggggcgcggcgcccagagcagggagatgccggcggtggtggtgtcgctggagagcggggtgtccgccagcagcggcgcgccgccctccggcagcacccaggcctcgtcctcctcgccgtagtcgtcctccagcgcgacaccagcgcccgacttgtagccagcgatggggtggatgagggggtcgtagtagaaggcgggcaggtctgggtcctccgccttgatgtacatgaccatggggtggtggtaggcgctgagtcgtaccccgcgcggccggttgttgtacaggtaggggaaggccaccttgtactcggtgcggatgggcgtgcggatgatgagcttgttgatgtcgttgaactcgttccagtcctcgtcccgcgcgtcggagtcgcggtgcagtggctcgaactttggcccccccgggatggccatgttgagcgacttggcggtgatgaaggagttgaggtcgaagaggtagaagtaattggcgtccaccaggtcggacagcagctgccccgccagacgatacaggttggccatcaccggcagcggcagcttccagcggcggtaggaggggccgttcaccgcgcgggtgtgctgcagcgggcgcgagtcgtacagccagcgcgccactgcgccgtcctccgcctcatccagctccagctcaatggcctccagcgggtccacatccaggatgttgtccgcatagtccagcggcggctcctcgtcatcaaagggcggaaagcgcatgcgcttgaagtggcgccggtcgcgcttctcgcgcctcatcatgatccacatggtcccccactgcgccaggtagacaggctcgatcacccagggcacctcgttcacaaaggtgatggccccagtgacgtggtagagcaccttgacatgccgaacctgctcccagggcatgggcatgttctccagcagcttgtacaccgcgtgcggcacaaacttgagggcgcccaggtagacccgcttgtcgtgcctgaacttgcgcgacgacatgtcgccgtggtcgcggatgatcttgcgcacgtgctctgggcaagttggggatgcaaggtggggcgtgtctgtgtgtgtttttgggtgccagactcgggagatacatgcgcagaaccaatcctggctttttagcagtaaggctggtcatgcacagtgccaggnnnnnnnnnntcacttcccacattcgcgagagctcatgcacctccccccccccccccccccccccgcccctccnnnnnnnnnnggtgtcagtgtgtgtttttgggtgccagacttgggagatacatgcgcagaaccgatcccggcttttttgcagtaaggctggtcatgcacagtgccaggtatgcaccaatttattcctccccaacataggaagagcacacggcgaagggccttgaaaggagaaatgcacgagcgccctacacttcccacttcccacatttgcgagagctcatgcacctctccccccccccatggccaggcgttccagcctctgtctcactgcccccttatacctggaggcatgtcctctttctgggcctggacatatccgaacttgcgcttgtcggagtagcgcttgctattcagctgctgccacttgcgagcctgcagcaacggcaggagggggatagggctcgcgagccacgacatcgtcgccaccttccgctgctattaataccagccaatcaacaaatagactgcatgcacgtgaggaccgcttgccgagggtcagccgttctcccggcgcatcaccccaggtgatggctgcactgtcgctgtcgcaccttgtcctccagcatggcctcatccactgggggcatccctcccgcaaagggatgctctgccccgggcccgtggccctccatggcgtgtgccgaggggcttaaacctcagccagtgcggcgatactcctttttcgcgccggcaacaggggaagagggtgcagcagccgcttgcgagctgcaatatcgatttgatgtggatgtcgtgatccggatgggaaatcagcaacacccctccgtcccgaggaatcctgtccactccggggcattctgctgtgcgatggtcacagcgcggggcggtacaggaggggtgtaccgcacccacatcgcttgccagtctcggtcgaatcgaagtcgtagttcagcatgctccaacgaccagggcgtataaacgcaacaggacgataccacacatggtcgattacatgccagtaaattacctcgtttctatcgggagtcgtattcagaagctgtggagtgcaccacgctttgaagtgaccatcctcaactgaacccagcagctcattgtgcttcatggctgcgagcacagactccagcccccgggcaccgaaggccctggtcctggtcgggggatacggtacacgtctgagacctctgacgctgaccgtgccaaagccgatcatcgatttcggtgaggtcgaggagccgagccgcaactaccccaagccagtgcattcatggagttccgctgatccccacctcttattctggccccttgtaggaaataaacccatgatatgccatcaaatnnnnnnnnnncttccgccaatcccccacctctcattctggccccttgcaggaaataaacccatgatatgccatcaaattgaggtatgcttcattgttcagtgcgtccgagacgtcagggtccccaaaacgcggccggagcgcggggagggctgtggtgcaggtgactgtctgacggaagcgccccctgagcatgccgctccgctcctccccacaggcgctcaaggaggcggggtgtgacgaggtggttcttgccatcaactacagaccccaggtacagtcgctccctctcagtgaccagttaggaggcctccagcagggcacccccaccgctgcatcattgtgtgtccgcgggagtgagccttggagcnnnnnnnnnnggagatgtatgcgcccgccccacgcccagcccactcacctcccccaccccgcatgcatgcctgcaggtgatgatggacttcctcaaggagtnnnnnnnnnnttttcggtgaccagtcaggaggcctccagcagggcaccaccaccactgcatcgttgtgtgtccgcgggagtgagccttggagcccgcatgggcgcaggcacattgaggtggtgcactgaagttgccacctgtccctctcctgggcttggctggctggatcatatgcccctgagccttgagatgtatgcacccgccccgcgcccagcccgctcacctcccccaccccgcatgcatgcatgcaggtgatgatggacttcctcaaggagtgggaagagaagctgggcatcaagatcacctgctcccaggagccggagcccatgggcacggcgggtcccctggcgctggcccgccacatcctggaggatggccatggcacgcccttcttcgtgctgaacagcgatgtcatctgcgagtacccactgaaggagatgctggaggtgcaccgcgccagcggcgccgaggccaccatcctggtgaccaaggtggaggacccatccaagtacggcgtggtggtgaccacgcccgacggccgcgtggaccgcttcgtggagaagccgcgcgtctttgtgggcgaccgcatcaacgccggcatctactgcctgaaccccagcgtgctggaccgcattcagccccgccccaccagcatcgagaaggaggtgttccccgccatcgccgccgatgggcgcctgcacaccatgaacctggaggggtactggatggatgtgggccagcccaaggactacctcacagggctgggcctgcacctggcctgcgtgcggaaccgccgcccccaggagctggcggcgggcgagggcgttcgcggagacgtcatcatcgacgacaccgccgtcatcggccagaactgcctcatcggacccaacgtctccatcggcaagctgtgcgtgatcggggacggcgtgcgcctgagcaactgcgtcctgctgcaccgcgtcaccgtcaagaactacgcgagggtgtcggactccatcgtgggctggggctcctcaggtgggcggcgggggcctggacgggtggatgactagggtggggggtgtgggggaagcgcttgcccacaaagggaccgcattgtgaggagacgaggagaagcacaaggcagggtggggggcatggtggggtgaggagtcagcgggagcgtgactccagagtnnnnnnnnnntgggtggatgactagggttggggggtggggggagcgcttgcccacaaagggacagcattgtgaggagacgaggagaagcacaagtcagggtggggggcatggtggggggaggagtcagcgggagcgtgactccagagtgtccttggtactttctcagtattgctcactgcgggccacttccccctgtgactctgcccggcttgctcccacacccacccaaccgcgcccttcggccccacccacccctcgcagtgggctcctgggctcgtgtggacaacaaggccgtgatcggggaggacgtggtcatccgcgacgagatctacatgaacggcgccattgtcctgccgcacaaggagatcaaggagtccgtgctggaccctggcaccatcatcatgtgatcgcccccggcccagcagcgcagcttgccccgggagaagagacgccgcgacctgccatggcataccgggtcgccgcggccggatcagaagagtcagtgacgcctttttgcgagacctcccccccacataacactgctgcttgcctttacacctcgatccttgccctgcttcggtggccgtggtccccagcccaggggcgcattgtcctaagaacccctcaccttgtaactcttgtccagtgcctgaagcgggtttagagactggggagcaagcatgcatgcgtggcggggaacggcgagaatgtggggaacacatgcnnnnnnnnnnaaacccctcaccttgtaactcttgtccagtggctgaagcgggtttagagactggggtgcacacacgcatgcgtagtagggaacggcgagaatgtggggaacacatgcatcgagccctatctgccgccctccctgacaaggctgcaagcctcaccacaccagggtgggctgagcggcgctctccctggcacgggcggccagcgactcgcggcatgcgccctggaggccgtccaggaagcaagcccggaaggtctggatggcggggacgaggtcggtggagcgccactcctcgccctgcgatgatcaaaggggaggaaagccatcggtggcctggaggcgtgctggggcatgcccagcaggcttgacggtgcttctccgacgctgcatgcccggttgcccgacccatggacgtgatgttgaaggcggctgtcatcaggccatccttgctgggtcggtctcaggcccttcccccctcctgtacccaccccaggcaccatgaccacgccacaccacacaccgcatcgctccccttcaccccgtctcgggccttgttcagctggtccaggagccggccgactgtgacgacagtctcggggtcaaactcgtgtgcgcggtcggggtcgatgggcacgcacaccttgcccgtcttggggtgcacgcagaacggcgccttcagcaggtggttcatcttcttggacacctccaggtccaggcgtgggtaggcgtgggcaaacacaacgctgcgcatggcgcggtccagggcctttgccccgcgcgtgtcgcgcgcctttgcgagggtctgcgtgcgaggtgacgcgggtgggagtgagagtcaaggcaatgataagggggcggaggggggattggctttggcacggtgtgttcaccagacaaatgaccagtagggtcccttgcatactcacacaaaacggcgttttcatgcacccaagcaacagccaagagcctgtgcttctccccctccaccaccctccgcacgcccctcctttgaccccggacccaccgcctgctccttggccacctcctcctccagcgcatgccagcgggccacgtcgtccccggcctccccctgggcccagcgctggcgagcgcgctcccggacgcgctccgaggggatgtaggccagcagcgcctcctgccgcttgtcgtcggacagcagcccctgctcgggcagcagcctctgcgtgacattgggaagagaactgggaggtacagcacaggtccaattcataccagggtctgcatgcatgtttggctggtgtaccggcgcaccatggctacctccatctacgtgtggctcagtcatcagtgcatgcgttgcgcctgcacttctttcttctcttcccaaaaacaaactgtacctcgacgaacacgggctccagaatggcggccgcacgcgtgacggcggggtgctcctccagtcccaaggccaggcgagcgaggccgccctcctggccgcggtacaccgcaaagtagttggcgacggcggtgcgctgctcgtcgctcaggcagcgcgcgcggtcgtcgcagacccaggcatgcacgccgcgcctccccgaatagacgtacaggatgtgctggaagccaaagtcgcgccgcagaccggcatccaggatctgcatgcgtagtgtatggagggggaggggggtcctgtctgcaagattgggagagtggcacttgcaaccctcggcttcgtccacagaggtatcatcgaatcaaatggtcatgatcagggtgtgtcctcagaccatgccgnnnnnnnnnnttttgtccacagaggtatcatcgaatcaaatgttgatgatcagggtgtgtcctcagaccatgccgaggcctgacctggatggcaactgccatgagcggccagcacttgttgcagatatgcccgccggagccacaggtccgcacgtcatcgtagtctgtgaggtcaatgtcaaagaccagctccctctccactggcgtgaaggtctggccagaacctgataggggccgagtgggcaagggcgtcagggcgagtgaggtgaagagtgccaatgatctggagaacattgcgggtcctcgccgaagctggaagttgggtctgcaattcacccaaaggggatcccatcagcggtggcacatgtacagatccccctgtttccagcaaggggaccgacctgcatacgcagcgcggcgtgcgggattgatgttgtacacgggcccaatgtcaagctttgaagggcaccgctccttgatggctgcctgcagcccgtccaggtcctggtcatgggacggtaccaagatggtggtgggtgtcttgtgatgacaatgtcagagaccccacaagttgatgctccccagcgctccgtgtgtggccaggcaaggaggggctcaatggattacggcgtcacctgtaagccaagccaagctgggcaaaggaggcaccagcaccctgacttgccttgaagctctggtaacgcacaaaaatgtcgccatccagagtaaagcaaaactcgcgtcgctgcatgaagcccgcatcagcctgtggaagcttgctgtctgtaatggggcacaccaaggggttgtcagaagaaggatacgctgttgctgtgaaatctcgattgcaatctggtccatttcatttttgtagggcaaggactgccacatctagnnnnnnnnnncgccttgaagctctggtaacgcacaaaaatatcgccatccagagtaaagcagaactcgcgccgctgcatgaagcccgcatcagcctgtggaagcttgctgtctgcaatggggcacaccaagggattgtcagaggaaggatacgctgttgctgtgaaatttcgattgcaatttggtccacttcgtttttgtagggcaaggactgccacatctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgataagctggcaacaggtctgaaaatagccttcagaaggttcaatgtctcgacgttgcggtttatttccatggtcgcaccgtagtacagcttcannnnnnnnnnagcagattctcaccgtttccgtatgccagccacttgtagaagtcacggtatggaaagatccagcctgcgcaggaacacaggtgcgcgataagctggcaacaggtctgaaaagagccttcagaaggttcaacatctcgacgttgcggtttgtttccatggtcgcaccgtagtacagcttcatcatctcttgggtacccatattggtgaatccctggtcagtctctggacgaccggagggtcctgcaatggcaccgcacaattttggagtctcttagttttgcttattctcccaatactgacaaaaacttcagtccttgcacacgccagtggccatgtacagctgacgacgcgattctgtctgacnnnnnnnnnnattttgctttttctcccagtactgacaagaacttcagtccctgcacacgccagtggccctgtacagctgacgacgcgattctgtctgacctcacctgtatccattctgtcgtcgcccatcttatgtagagtacaactgtgcaggactgtttatcagaacgagaagacccgtttcgatacctggtcgtcttcttcagggtgacagagtagactcgaatgtcgtgcgagttcatctagtggcagggcgcggaactgagggtttttgaaaatcgcagggatgcgtggaannnnnnnnnncgttgtcttattcagggtgacaaagtagactcgcatgtcgtgcgagttcatttagtggcagggcgcggaactgatggtttttgaaaatcgcagggatgcgtggaaggaaaggtcgaccatggcgcgctgggccccgacacgacggggttgggagtctccttggtggtggaaatggtttttgagcctgccatctgggtatatgtgacaagggtcgcccacaaaaagattcaaagcgttggctgtattacctacagcgttcgatcccaccctcctgtccnnnnnnnnnncggtatatgtgacaaggttcgcccacataaagatttaaagcgttggctgtattccctacagcgttcgatcccaccctcctgtcctcgtgaccgaacgctgacgcgaacaccgccctctgacgtcgcacgcactaaaggaggggtccaggcaggaccatgctgtcccgctgtagtcgtctggtggaaagtcttgctccattttcatcagcatgctccgtgtccaggacgctgccgctggctgcgcgtctcatgagtggagagccccagaccagaagcaccaccgtcctctgtgtgcggaaggatggcgaggtacgaggattatgttctgatcgcatcgaatagtcatacgatcgacttgtaggcagtggtgtgtgcgaggtagcaatgttttgcaccctgatccgtgtcccaggtggtcctcatagcagatgggcaggtgacgatgggcnnnnnnnnnnctagtcatacgatcgacttgtaggcagtggtatgtgcgaggtagcaatgttctgcaccctgatccgtgtcccaggtggttctcatagcagatgggcaggtgacgatgggcggcacagtcgtcaagccaaatgtcaggaagactcgcaagattggggagcacgcagtgggcggatttgcaggtgggtcgagcttctgttgatgtctcatataggcttattcacttcaccctcgagcgatgcttacctcatcctcattgcttgactttcccctttgctcattgcgaatcccaggtgccaccgcggatgctttcaccctnnnnnnnnnntgtcaagccaaatgtcaggaaaactcgcaagattggggagcatgcagtgggcggattcgcaggtaggtcgagcttctgttggtgtctcatataggtttattcacttcaccctcaagcgatgcttacctcatcctgattgcttaacttttccccctgctcattgcgacccccaggtgccaccgcggatgctttcaccctgtttgagaggttggagggcaaacttgaggagcacactggccagctcacgcgggcagcagtcgagctggcaaagatgtggaggatggacaagtatctccgacgccttgatgtacgctggaaaccatgtcctggccttgaagagcagctttgtgctttgggttgttgatgaagttcgcaaggaatgggagcctctatggcggatgtagtcctgaaggaccgaactgcgtggaaacccctctccattgcccagctaattcaaggttgcatccactgtaggcggccctggttgtggccgacaagaatcaatcgctacagatcacggggactggtgacgttctggaaccccacgatggaattatctgtgagtttcgcatggtttctggatgctcggtattgtttgaatggaaacctacaaacactatgtcaccgtgttggaccatctgacatgggnnnnnnnnnnattctggctgctcggtattgtctgaatggaaacctacaaacacaatgtcaccgtgttggaccatctgacatgggccagggactttcctttcgcccatgcaactctgccaatattgccaactgagttgtgtctccgacctccctcacttcagctatcggcagtggcagtccctacgcattggctgcagcaagggccttgatcgatgtgcctggcatggacgccctcaccattgcacaaaaagctatgcggatcgcagcggatgcctgcatatacacaaatcacaatacgtccacgctgcgcatcgatcaggatgggaagattacagaactgtctgctccagcggacaaccaatcctcttgaggcctaccagcaccaatgcagattgctctgcagggggccccagcagtgtgttttccactccccagtctcgatggcctgcacaactgttattggacgggagtaaacctcaactgggtgcaagggttgctggaactggcagcgtgtgtcggatgttcaagccatgtgctgctaacatggacgcccctcagaatgattcgagagagctaaaggacatgcatggcacctatgcaacaccannnnnnnnnntggtgttcaagccatgtgctgctgacatggacgcccctcagattgattcgagagagctgaaggacatgcatggcacctatgcaacaccacgacgaagggttcgaggcgatttccatacccgcgttacttcccgaagaatacgcctttatcatcccaatatccagaatgctctagccctccgggaacagatcgaacggatgaagagnnnnnnnnnnattatttcccaaagaatacgcctttatcatcccgatatccagaatgctctagtcctccgggaacagatcgaacggatgaagagcgagctgcagtccttcgtgctcaaagccgaggctcgaaagctcttccggcacttcctcagggtaactcgcagcgcacccgcatccagaggtatgtgcaccgaggaatcttcaggggccagcttctgggtaatcatacctcccgtgagccaggaatgcacactcaccctttgcagacgagctgcgagaccagatcaggcacgaattcctccagcctgtcgaggagagcgacctttatgcacggaaatatcggctgagcgatggaaggacaaggctgaaaatgctctctgagatgctgggcatgcagttgtaaagagagaacaatctaggcatgccttcctggcgctgtgacctctgtttggctgctgagtgcaggcagtcacacggacggggtttggcacacgtagcactgtcaaccaacatagttcaatgctgcaaggaataggacacacattgcgagagcatactcagtaaaagctctctctgtcttcccactcatgtcctccgggtctacctgcatccgcagacacactgcacagagggacatcatggcagtggattggtactcagacattgcagatgccgcccaacatcagcagagtctccgcataccagtcctcagcaacccacctgagagtacaaaggcccctatgcagcagaagaagccagccaagaatgcgttgaagggaaagctcccgatgaggaccgcatacacgaactggtgggggtggcattcgagaaagttactgagccacgtatggattccaccgagcgtgagccacactcgcgacatagattggactacaccccacctgaagtagtgccgtggcgatggcaaggcccgagaaggcgtccagcacctgcgttcagagtgatcgtgggtcggtaggttgcatacaaatctccagcagtgcatgagcatacgtagtcccacagtacatccctctgtgccttcagttttgctggcgtttttgcgtattctcgctgaatcgcagtggcgacctgttttgccgtatgcagnnnnnnnnnnatgcatgagcatacgtagtcccacaggacatccctttgtaccttcagttttgctggcgtttttgcgtactctcgctgaaacgcagtggcgacctgttttgccgtatgcagcgtggccatggctaacacctccttgtgcacttgtcaactttgtatagggcgcccgtgttcggagggnnnnnnnnnnnnnnntacctccttgtgcacttgtccactttgtatagggcgcccgtgttcagagggaaaatttacagcagcggatccgttcgatcttagtgagcaggagtgtcaacaggtcataccgggcgatcagggagttcttattgtgatcgggagaggctgggcgcggggagcgggagggtgggtgggtgggggattctacccgagtccattggcggccacaccagccagctcccagacatcggcatcctcctccttcccatccacgtacaggttgccatacagctcgatttgagccagggaggcatgccagggattctcattccccttttgcatctgcattatgcagatgcggaagcagcggtacggcaccgtcgcggcatgcccagtcacggcccatgatccatactggcctggaagacgcaaggtcaagtcgttctcgtgcctcctcaggtcctcccacccacactgtggaccgtcacgggaggcctgcatggagggcatccaaagggtcagggaagtgcctcaatgtgtggcatcctctactcagttctgtcgaacatagaacaagtccctgtcttcaaagataatcagcccccaaaatgctcgagaggcgaggaacggtcgtgcattgattcccggaaactttcagtctcagagtccccctcaacatcnnnnnnnnnncaagaaaattagcccccaaaatgttccagaggcgaggaacggtcgtgcgttgattcccggagactttcagtctcagagtccccctcaacgtcttcacctgcagggtccagctgcgcagtgggtcgtgtgacttgtcgtggcgcagagtgtaggctgaacaggccagctggtgccgaggcccgaggtccagcgaccaccaggaaaccagcctgcctgcctcgctccggggagccgcaaaattgaggcggggagggcccagcgccacacaagacgccgggttggtgcttcggcatgcaggactgctggcttgcacctggagtggtgggaggggggagaatacgtttggcagcgatttaaaaagacaggcaacacaagccagtggcaacaatggcgcagctgccaccatgaaatcatggcactgtggtctccacagtcccatgggagcggagctgagagtctgcgaccatgtgcaaatgccctcgtcaaggctctcagccaaccagtcgctctgtttcagcgggatgcgcaccttgacccgtccggagagcatggggttcacccactgctgctgaccgccctgggttgccagccagtaggtcaccccgtttttgtcaccgggacacacgaagagcagctcaacacagcctggggtggttctggaaaggaagcgtgctgacagggccgcctcctggcgtgaagggagtcggggcggcccggcggcctgcagagaggacacgagcttctctgggctgcccatcgcagtatccgcctcgcgagcctctcgcacgagttgcctgagcatggagcaggtctcccatagcgggtgctgctgaacgcactgctcgaaaggaaggggggaaggggcgcatgtcatggtcatccttcaagcaattgaattgcttaaaggcaatggagcagcaggtctattgagtctggatgcacaggttcggcactgccatttctacttagggcacaggatgctactccatgaaagccggaggcaggnnnnnnnnnngattgctgaaacgtaatgcagcatcaggtctattgagtctggatgcacaggttcnnnnnnnnnnnnnnnnnnnnnnnnnnnnnngtcatcagagggaatcgcacatgcggcagcaggatgtcaaggtctggggttgcctcaggcccgccacgtgcagctgcccagactgtgattaccttgaagaccagcatctccccgcaactctgcggtatgggaggaggaagtgaggtgacacgagaaggcacaatgtgtgcagcctaaagctttgttgcgcactgcgacactgtggtattgcaacatcgccatggtagtctcacggtcacctcgcctgaaacttgcttaccatggcctgggatcgaaggacttcggacagcatgggggccggcagacccgccacaccctcgggatcctggnnnnnnnnnncgtggtattgcagcatcgccatggtagtctcacggttacctcgcctggaacttgcttaccatggcctgggatcggaggacttcagacagcatgggggcgggcagacccgccacaccctcgggatcctgggccagggcttcttgcaggtgctcggccgcaaaggacagcgcagcttggcgcagcacaggcagtgtcggttccagtgcatcgaccaccaccagcactgccgaaacgcttgaagggcgcaggcagtcacgcagtgtattgcatgccaggtccaggagagaggggagttgtgtagactgtgttcggcagaggtggggaaactcatggtgaacatgtgaagagctgcatataggagttgatgagagccagctgccatgcgtcaagtgagtgcatgnnnnnnnnnnaaacagctgcatatagcagttgacgagggccagctgccatgcgtcaagtgagtgcatgcagaggatggggcctaccttgaggtctgtgccctgctgcatgttcagcacagggagcacccgaatggctcggtacacaatgtgtgtgtcccaggcactcagccctgttggtcggacaacaaacggcagagtcagatgggtgtgtcggcaatgatggcgtcaagatgccgctttgcaacctgcacggtctgcaggatcgtgtcgactcagaagtggtcccccttgtgaacattgcgccgctgacaattcacccctctctgcacagcacacccgcgtatgagatgctctcgatggnnnnnnnnnnaccgctgacggttcacccctctctgcaccgcacacccgcgtatgagatgctctcgatgggatctgggtcccgccaggtgtgactgacgttcgtcccaggatctcccagacccacagtgatgcagcccctatcaaagttgatccaacaccgcatgaacgcttgagatggcagcctggcaactgccacgtcattgacctgggggatccgtggggagcgagtgtgtaagcgtccaatggtgaaacatcagattgaagcccacgcatgcatgtctggagcaatgagcacaacagtatcgaccaaaactcacagagcaacagagcactccatccttctcaatcttgagacagctgttgcggtggctgcccaggatcacggtataattactctctaaattcgatcctgccgcggcactcaaatgctgccagcgccttgagccgggttgttgcttcaggaggacagttacatcgttgtcacctaaccacgtcgtaggaagtggtcatccgacacagactcaaatcgtcttgacaccgcaattcgaggcgtgccgtccactattactgacggatggaacccgatctacaaaggcatcctcgatctccatgtacgcacctctcacnnnnnnnnnnctttgaggcgtgccgtccactcttactgacgggtggaacctgatctccaaaggtatcctcgatctccatgtacgcacctctcacttcaaaggtcagacaacccctgccgccatgcaaaatatactccgggtcggtgagccacgcgcactgaaagggcggcaccacgactaccgcaggattaacttgcatcgcaaaggaaccatactagttgtatcagctgcttcctcgttgcggactctgatgtgaggaggacgctacattgttttgctgttgtgtcgagaggatggaaagatgggcgatgacgtggcaaagaactccgaaagtttcgcttcctcagcatgagccccaaaccgtcttccccagcctcactggcgtgatacattgagggaggctagacgcaggtgaaagtcaggctgcccatccaaggtgacatacaatgtgcattgtgcgggcatgggcgcaggcataggggagagtagctcatctcgaggtccatgaaggttctggtgattgtacacagtggttggtccctcatcgtctagtagggaagcagatcaggtccagagcgtctggctcagcgcatcttccgacacattagctcttggctttgatgtcaggagctgttcgtaggtttggcatggcaaattcgtagacacagttcacctgggagtaagggttgactcttgcttactcccggtacatcatggcgtgagggtgcactggatccatgctctatgctcaccatgtcagcagttacccagccccaacaaggtaccacgctccnnnnnnnnnnactcttggctttgatgtcaggagctgtccgaaggttgggcatggcgaattcgtagacacagttcacctgggggtaagggttgactcttgctcactcccggtacatcatggcgtgagtgtgcactgggtccatactctatgctcaccatgtcagcatttacccagccccaacaaggtaccacgctcctctgtgacacgttcatgccaggaacccctgcgattcacgcacctcgcaaaagcttacaaacctcccactccaccgcaccaggctccagctcacctttnnnnnnnnnnacggttcacgcacctcgcaaaagcttgcaaacctcccgctccaccgcaccaggctccagctcaccttttgtggaaggctttctcgcttagcagctccgatcaccgcctttcctaatttttgagagtaccaggtccacagcagcccgccaacaaaggccacgtgaaggaagatgaggagccagatcacgaaaggggccaccctccgctgcccctgggcctgcatgtgcatgtgatgggcatgcaggtgctcatgcagggctgccgtgtcgtccagcacgactgcccgagtcttggcgagacctccagaggtcctggagtgggcgtccacaaaggctgtgtccactcgtgatagcagccatcgcaaaggcatcgtgaagagtggggtctctgatgaagctgaagcttggaatgcgaatgtgtgcaacacctgagacactaaacgcccccctcaaggacggagagggggttggagcaagagatctgctatgacaaggnnnnnnnnnncacgccctcctcaaggacggacaggtggttggagcaagagatctgctatgacaaggtcgctgactgtcgaagtgcgcagcgtgccaagtgagcacgccaggcgagcagcaagttggtgcttgcactgcatgagggccaggtttggtgggggcactgttgagcatgcaggatgcaaaccaggctcgatcccacatcccacatctgggatcagccatggggccagaacacagcgctgcaaatgcactcaccagcacagagtcttgctttgtgaggacgtcaaactggaaggcgtgacactcgcaaaaatgttcagggtagaccaagtatggctctgaacctgattgtccctggatctgtgcaagcattggagtggggcgctggccaacatgtcctagagttaggttgcagagcaattcccctttacaatccgacgtaaaggagtgcccctctcttacatggtacacactgcgcccgctaggttctccttggaagcaaaagactcctcccgtgtccaaggtcctgagtgccttgggcaatagcttgccgaacacaacactcaagctgtgagaacatcgaatgggaaagtggatgtctcggcatcccaaccaaatcagacgtgataaatccatcatgctcgtcaagtacgccctcgcagactacctgactaggtggtcttcagtcactgcagggtggtagtttnnnnnnnnnnggaacatcaaagaggaaagtggatgtctcggcatcccaaccaagccagacgtgacaaacacaccatgctcgtcaaatacgccctcgcagactacctgaccagatggtcttcagtcactgcagggtggtagtttggaagggtaagcgatgtgcctgtcacggaggacttcgatgtaaacattcacctaacaaagtcaggacctaaccccccggaaaacaccttgatgccttacgctgattttgattggcgatggaggcaaagagcgcgtccgaaattctgcacacggtttagagaaggccaatgagtctcgacggtcgcgacgggtcacaacctgcacagcgacttccggaaggtcatccgcgacacctttgaacacttggaatgtcttcttctcccatcgggatgacgtgccgatgccgggcggagaagatgcggttgaccaataacaggtggataggcggatccccccagtgccccaaccatcgcaaggcgcgctcacggtgatttgaaaacatcaaaggtatcgtgccgcggtggaccgggacgaaacttgctgaagcgccgtagagtggatacttataaaagtatttgagtggtgtcatagatttcttggatccagatggtcccttcaggactcgcagcgcgaaggacataatccctttcccccatcatgctgccggcctaaggctttcgggcattctgcgggggcccatcaccatgaccagcatgccaggcaagcttacgagggaacaagaatacatatgggcacattcttgaatttggcatggcccgtcatgtcatgcaacggtcattttcgctgtgacgcagtggtggccagcttcaagcatgggcctgggacccgggaggtggggcaactcgctgtctggagtgtcaccagcgcgaaaccagggaatggagtggacatgctacgagatgggcgagaggatacgtactggcagtcggatggcatgcagccgcacctggtggacattagcttccaaaagaaggtaccgtcacatcggtggtttgcatgcagcatgtctttctcctggtgggtcgcctgagaaacagcatgatggctagacagatccattgcacatggtcnnnnnnnnnngtgtcacatcggtggtttgcatgcagtatgtctttctcctgatgggtcgcctgagaaagagcacgatggctagacagatccattgcacatggtcacgagagtttcaagactgacagcggggtttacccctttgatcaagtgtgcacatctgatgaccctgccgccatcgctgacttacgcttccctccacacttgctgaagacccgagtaagcacactggcagtgctcctcaactacaagctggacgagagctacacccctcgacaactggctgtgcgaggtggcacatcctatactgacctcaaggagatccgtacagtggaagtaaatgagccgcagggctgggtcgtcatcccattgggcagtgaggaagacccaaggtgagggggagcggcgggagtggtaccgtaatgcaagggatatcttgggaggttctctgcacaggtgattgacactcgacgctggtagtcgtagtgcatgacaagcattcacacttccagcagcaatcattgccggcaagctgcccccaaacgtgtgacagtttctagggtaggatcgaatacatcacatactccgccaactgactgcnnnnnnnnnnaaagctgcccctaaacgtgtgacagtttttagggtaggatgaaatacatcacatactccgccaactgactgcttcttcccaacgctctggcacccccgtcgagtgcagtttgggtgtaaagctcttcctcctgcagctcatgattgtgagtaaccaccagaacggcaaagacacccatgtcagagaagtccgcgtgtatggaccccagcaagccacacacgctgccttatcggacaggaagaacgatggggagctggagctcagtgccagtcttgcagcccaattcgacacggtgcgatgagcttgcttgaatcctttgctcacatttgcagcacatgcacctctgtcctcagagtttggtcccctttactgatcattgaagcctggtctcatctcctgcaccaattatttctctcattcgggctgtaagcttgctgatggcctgagaatcgccctacagtgtatccatggtggaagcaagcagtccaggaaggtcaagaatgta

SEQ ID NO: 22897 - DNA, 1343 bp, Chlorella protothecoides
  modified_base (94)..(103): a, c, t, g, unknown or other
ccacccccccaccccccccttttcaccccggtacctctatcagatgcccttgagatatgaaagcacggtcatgctccactcctcgccggccctnnnnnnnnnnccggtacctttatcagatgcccttgagatatgaaatcacggtcatgctccactcctcgccggccctgtggccacgattcctcgctttccaataccctcccccaaacaattgaaaatcccagatgttcatcccgtccctgctggcgcacgggaccaaggagcaacaggaggcgtggctcccccccagcctgcgcctggagatggtgggcacctacgcccagacggagctggggcacggcacctttgtgcgcgggctggagacggtggcggtgtttgaccctgactccgacgagtttgtggtgcattcccccaccctcacctccaccaagtggtggccggggggcctgggcaagacggccacgcacgtcatcctcatggcgcgcctgatctcgcgcggcaaggaccatggcgtccactccttcgtggtccagatccgggacatggcccggcacacgccgctcccgggcgtgacggtgggcgatatcggccccaagatgggctacaacggcgtggacaacggcttcctgcgcttcgaccacctccgcatcccgcgctccgcgctgctggcgcgctttgcccgcctggagcgtgatggcacctacgtgcccccgccctcggccaacgccaaggccagctacgcgaccatggtcttcgtgcgcgccgacatcgtgaagaacgccggcgactttctgggccgcgcggtgaccatcgccacgcggtacacggcggtgcgccgccagacggctcccggacccggcgcccgcgagctgcaggtgctggactacgacaacgtgcagcaggtgctgctgccgctgctggcgcgcgcctacgcgctgtccttcatgggccgcgccatgttcgggcagtacaaggcgttcgacgccgcgcgcgcgcgcggcgacttctccgccctccccgagctccacgcgctgtcctccggcctgaaggccgcctgcaccgacacgaccagcgacggcatcgagaccgcgcgcaggacctgcggcgggcacggcttcagccagctgtcggcgctgcccaccctcttcacctcctacgtccagaacgcgacctgggagggtgacaacaacgtcatgtacctgcaggccgcgcgtttcctggtgcgcgcgctgatcaccgcgcagcgcggcggccgcctggcgccctccgtgcagtacctggccgacgaaggcgccggcgcccggcgctgcggcgtgcacgacgccgccggctggcgcgctgcg

SEQ ID NO: 22898 - DNA, 61 bp, Chlorella protothecoides
agcgtccttctggcccctgttggctgcctcttccccctcggccggcttggcagggaccagg

SEQ ID NO: 22899 - DNA, 61 bp, Chlorella protothecoides
ctggttatctggatttatggaagctcatgggagttttgtttttaaagccataggcactagt

SEQ ID NO: 22900 - DNA, 80 bp, Chlorella protothecoides
ccagccagtcgcgctccctgtgtgggaagtcagagaagggggtgggggggtggatgcagcacgcggcacgagaatgcttc

SEQ ID NO: 22901 - DNA, 61 bp, Chlorella protothecoides
aagcataatactattgcaagaatgttgcttgttccggagtgaacgcgacattagcctcggc

SEQ ID NO: 22902 - DNA, 77 bp, Chlorella protothecoides
ctccattgctctggggtacctgctcaggggaagggtaagcgcgtgtcgaactgccactggagtgctgggaagacagt

SEQ ID NO: 22903 - DNA, 79 bp, Chlorella protothecoides
aagggaggatgctggggagacgtgctgtgcaacagcttgcgtcgttgtctgtcacccttctgctgtgatgaacatctca

SEQ ID NO: 22904 - DNA, 2934 bp, Chlorella protothecoides
  modified_base (334)..(343): a, c, t, g, unknown or other
cgcgccccaggcgccactcagccgccggccgggccggcggcctccgccccgcttcgccagcgccagctgctcctccagcgcgcgcgcgcaggcgttggccgccgccagctccgcctccagccccgccacctcggcgcggcgctgcgccagccgctcctccaggcagcgctgctcctcgtgcatgtcctgcacgctgcgctgcgcctggcgccagctggcgtgcacggcgcgcagctcctgcatgtgatgtcaaaggacgggggaagggacgcacgggtggatctggatgagcagggcgcggcgtagtgcagggttcggcggactgatcgggcgnnnnnnnnnntacggcgcgcagctcctgcatgtgatgtcagaggacgcggggaagggacgcacgggtggatgtggatgagcagggcgcggcatagtgcagggttcggcggactgatcgggcggcccatgcccatgggtgggaacggggacgcaggggtgcggcacagggtcccctgaacccccagtctcatccccacccctccgatgaaatggacggaggtaagtcggggctgaacgtgcagtgtcgccgggagtcaggcaggctcaccccgccagcgaggagcaccccaagagcacaccacctcgctgcacccacctcctcgcagctcgtcaggcgcaggctgagcaggtcccgctggaggcggtacctggcagcggcgtgctccgcgctttccttgggaacctcggggtcccagcggatctgagccccggagccgcacagtcgcgcggggtcctgcacctgcaagggcttttttgcggagggattggtgaccacatcggaggctgggcatgggaattgtgtacagcatctggcagccagggcgctgaggtgtactttcccagccggtaggagaacaggccgccctcacatctgggtgtgggccatgggcaagcctcgtgtcctcagggagccgcggcgccccaggccgccgccgggtccgcggcctgcagggcgagtggggaggactcgatcgggaccaggcggtgacgagggaggcatgtgcacctctgccccatgccgacctggtgatggtgggtgggtgcccgggatcgtgagcccagtcctctgtgccgtccatggccaggtgctggggctgcatggcatcaggctctgggcgggtcgccccgccccagccgtggctcgacctgggagcgcggggggtgcaggccgcctggtgggcaggcttgatgccagacatgtcgaacatgaggaactcgtcctcgacgtaggtggctcgggggaggggggtcgactgaaagtcggtggtaggctccagatcgtggcggcctggcgaccgcctcggcggtgtctgcagggccggggggacacgagatcaccggcaaggggggtggagggcggcgggaaatggggtgggatgccgtcactccccgacctcacctccaggcaatgatcctgtccaaatctagtgaacttccgcattgtaagatgtgtgtgagtaatgcgcgagccaggcggccgcgccgtgagcgcagtgcgagtcaagcgggcggagaagaccttgcacgactccgatgtagtgaaatcagaggtggcatctgatcctgccctatcattgaagatgtgttgaattgatctaatcttgcatttgaccacgaggcggacagtctggataggttctcgagctgtcaaagtcgctgtcatacctgagtgctgcgctcgtgctgcggccttttgaagggcggggtgagggatcgtgctattgggcgaggagatcggttcatcttcaataacatttcagtccaatattccagtctgctcatgtcgccattcacattctctgtcagcaggttgcgcccagtggactctggacgcttcatgtgcatgctcgctcactatcagatgcatgctcggcacaaagcatcaggggatggactcacttgctacttcctgaacaatcctgctgagatatggtttcttcatgatgcgcatgactcgaggggtgaggtgcttgtataaaagcttcctggcgacagttcaattgttggcagccatctagttgtctggcggtcccccatccatgagttttgggggctgctcttcaaaatttcctgtgattgattatttctgccgtggtatgtgggccgactacccttctaaacatcaaatatatcactggggcgctgataaatgtcggcggtgagtgtaaggagcacacaaagaacccttttccatgtggctgtactaatcgcagggtttcctcttgcgcagctgtcgaacccggccgtcaacaatcctcacatgaattcaagggcatagtccacgatcagaccaccatctgagtcactatgcgtccagaatggtgaccggggcggccttgactggcgggccttcgcccctgcggccccgcccagtggtgcggaggtccagggcgcaaggcccccggcaacgcaatcctcgcactcccacgcaatgtgcaaccggacccgacatcattgtcgtcggttccgggatcacgggcctggccatcagcctcgagctgctacgcactgccccgggcctcaccgtcacgtgcctggacggcctggcccagctcccggggggcgccaccggtgcggggcagggctacctctggctggcgcaccgcacacccggctcccctggctggaccctggcccagcgcagcaaggagatgtggcggggctggcccacgcccggtgtggacgtgggctggcgcggcgccggcagcaccctgctcgccgcggacgccgctggcggcgtgcagctggagcacacagcggccgcgctggccggcgccggggtggcggccagcgtgctcggcgcgcgtgagctcgccgccgtggagccagcgctggcccacgaccgcctcgccgcctggccggcgggcggcgccgccgcgc

SEQ ID NO: 22905 - DNA, 64 bp, Chlorella protothecoides
gacctgcgaagtgcatccatccgccgcgttgcggcgttccaggtgagacctttgagagcgactg

SEQ ID NO: 22906 - DNA, 77 bp, Chlorella protothecoides
ctggcaggaccctgcacctgcctgtgagggtgcaggcgcccaggccccgccggatcgaggagtggccccaggcaggg

SEQ ID NO: 22907 - DNA, 84 bp, Chlorella protothecoides
gctttcggaatgggttgaaatatctgcatgtaagagagatttcctgggaccatgtgaggaccgcatcgaggattgtcttgaaca

SEQ ID NO: 22908 - DNA, 22385 bp, Chlorella protothecoides
  modified_base (4137)..(4184): a, c, t, g, unknown or other
ggcccgtggccaccagcgcggccaggtactcccgcgcgcccgcggcgctgacctccacgggtggtcgcgccgggcccgggcggtcggggccggcgctgccgccgccaccgctgccgccgccggccccttggccgaggcaggcgcgctcaaaccactccacggtgacctcgggctgctggcgcgagacgtgggccatgaccgctgccacctggcgcccgtccagccgccccgcggcgttggccacctccagcagccggaactcgcgccgcgcattcagggccagcaggccggtgcgggccagcacccagcgcaccgcggacagcaggagccagcgcagggggaccaggagcgtgagccgcgccagctccgacacgcccgccgccagcgccgcggcgagcatgaccgccgggtgccggctgggtgccggggcggggtcggcgcccgcggtgtcggtgggagcggaggccgccgtgggggaggaggtggtggaggccactgcgccgggatcagaggcgacgctcggcgaggcggcagaggaggcaatgctggaggcactggggtcagaggtgacgcgggaggcgccggcgtctacatccgtcaccgcctcagcagcggccgcgctcgtggcagacacgtctactgtctcggcgggctcatccaaagtcccatcacctcgctcccccgcctggactgcggactggtcttcggcagattcgccctccagggctctgaggcgcctgggcaccaggagcctgtgctgtcgctgggcaacgccgatccgaggcgggccggagggcagggaggacgcaaggacgggacgcacgcccttgaacagaatattcaaggcctggcgtgacgcagaggtgcggcgaaaggtaggaccctgcagcaggctctgcctgggcagcacggcgcgtgtgtgctgcatgcccccgcagtctcgacagcaatcaccagagggcaattatatgtgcaatttagcgagaaatatgcaattgtttaattgctgatcactacagctgtcaaaggtccccaggaagggtctcgtgtgttagagttccgctagtgccagcgggagaggcaagcaggcctgcaccaaaacgcagtcctcggtattcaataaggagaatataagaaccaagatcctatcaacaaattcgtaatgccatcttgtgggcgtgtgcagggagttcctggccaggcggtgactgggagtttctcaccccatgtcgaccagggtgatatccctccccctttctttcccccctgcctgtgcgcgagtcaaaattcatgcctgtcggaggcaggggttgcgaggcgcgatctggcccctgatgccaacaacgctagacaaaacatacgaaagcacctgatacagtaatccagtcgttgtgtgtagcagcaagattcacctcgcgccctgaccgagcttgaacgccctctccgtgccgagcccgcacctcggttgatctgacatgtgaacacacctgcgcacccctccccgagtagttgcttgattctcctcaaggatttgtctggctggaagtataccttagcaatccagccggagcaggatgcagggcgactccaggcgtcaggtggacaccccgggtgtccgagcagcactcgaggccaaccgtgcgcagctagaggtcatgcgatcccgcctcctgggcaaggtgcccgcccctgttcctggtccagtctccagaccccaggatcgcgcacaggacgtcgctcagacccccaaacaggggtatggggacggcagccggggttcgtgccctgaccccagtggcgccaggagcaatccagtgtatggagaggcaagtgggcgcctgccaggaggggttgtatctaggagtagtggagtccactctgggtcgtctcctggtctgtgtatggagaagccttcacatgcagccggctctgagagatcttcgcttatgttagacaagatatcatcacatcaccgcactcacaatcaccaaggtggccccgcggtggtcctcagactcccattctccaatccttgctgcaggcacagactccgttgccaaggaagctcgcccaggattaccaccccaagtatgccgatgccatccgagccacccctccccacttaacatctccagacggcgacattccaccggtgggcgacctcttcacccccgaccccagcgctcccgagctcgcaagaggtgcggtacagcacttgtgtgcttggcctgctgccctatcacatcatgcatggaggtcacctttgaggtcataggggtgaggatcgccaacctcacgcactccctgcaggcactgctcctccggctccggccccacccacctggaccaagcaacgcccgttcctcaccgggtactacctcatggaggcggcggccgcgcagcaggatgcagccccggcccagctggacattttcccggccgagatccaggagtccctttgtgcgttcttctgtagggctttggccttgagatgtcaggggcatgaattctttcatttgattgaatcagagcacagctcctgcagatatgctcacactccgcacagggggcgatcaggacatgcctgccaaatcctgctccgctctgtgatccttggactttgggaaggctgtcaacctccctccccctacttcctttgccctgtacagtggtggatgggctgctgtcggccttcatgggtctgagcggggagtacgtgtctgccaccatggagcatggggctgggggtcccagtctgcgctaccgcatcacgacccacagccaagtggagccggcgctggcggagatggcggggcgcatgctccccatctggtgggtgggtgcccgccgttgatggggcggtgctcggggtggctggggtctagatcttcggcgacatcacccccttaatgtggtgaggctgttcacaaggccagaggccctgcccggctggcctcacgcgcgagtccctctcccattcgagcacgacccccgcctcccgccgacgcgcagcgaggccgcggcggtggtccagcgctttgccgagacgcgcgacgacgcgcgctggggcctggtggcccaggcgctgacgggggcgctgcgcgctttgatccaggactggcacgtcatggtggcgcagctggagcaccagatgcacaccggcaagctgactctgcaggtgggtggcgtttagaaaggaagggtccgtcggggaggtgggcagtgttggggtggagggatgggaggatgatcagttgggaggaatctcagtcatgcaagtcgacccgcctcacccccgcgagaagatagtgcagtcggcgcctcagcataccgacacgctgcacccccaacttccccctcgcatgccccccttcaccacacgccaggcgctgtggtactatgtgcagccgccgctggaggcgctgcggctggtggcggggctgtgcgccgaggcgtcggcgcgcggcctgcgcggcgcgccgctgctggacctcctgcacgatcgcgcggcgcggtccttcggcgacgcacgcgcgcacgcgctgctcacccgcctcctacgcgccgccgcggcgccctactttgccatgctggcgcgttgggtgggggagggcgagctggccgacccctgcggcgagttcctggtccaggaggacgcggtgcggctgggggctggcatttggggtgggaaatgggggggagacgtggggcaaggggtggggcaggcgagtgttgcatgtctgcgtgggggctgggtaggaccctacacttagcatcccctcctcactgacagttcaacctccgaacacgccctcctcacacaactatacagagtgtgcggcccggcgctctgacgcacgagggccagtccgccttctggcacgaccgctggcggctgcgactggcggaggtcgggcccgacagggccagcccagggggcgccgcgggcgcagcccagccgccgcgcgccccagccatcgatgtccccgtcttcctggccggggtgcaggcggcgatactggacgcaggcaagtatctaaacgtgctcaagtcctgcggccaggacctgccggccgatgttctggaactcggcgttcccctgggtgagcatttgggtagggggggggggggggggcnnnnnnnnnnnnnnnnnnnnnnnnnnnnnnnnnnnnnnnnnnnnnnnnctgtccggccatggcgtatgatgatcagcatcctgcatggcgtgcttgatcctgtcaagtccccttcctctgcctcgccctccagccacgcaccccccacaaaccatgcacccctcacaacatcctccccaaaacccacagagtgggacgagggcgggcggtacctgcgcgccctggagcgcgcgcgggcggtggcggccggcgccaccatgcgcatgctgcgcggcgaccgcgcgctggcctcgggcctgggggtgctggggcgctacttcctcaccgcgcagggcgacctgttcggccacctgatggacagcgcgggcgccgagttcgggcgcatggtggccgcggtgcccctgctccagctccaggccctgctgtcggcggcggtgcgcggcagctcggcggccgccgaccccgccgccgcgcagctgcacgccgctttcgacacgcgctcagtgctcaacatgctggtcagcatcacacagaccgcggccgccaccgcgggggtggggcagccagggtccccgctgcgtagggtgcgtcgtgagggggaatgtcgagggtggggggagtgggaaggttcaggcacacccgcaggtcgagcggtgtgggggcggctgcagcgcagggtgccgccccacctcccccacgcacgatgcacatgcataccgcattcaagcacacccgacagccccacaccatgcacactctcgcgcccacacacgcagggcctgaagcccgtgacgccggcgcccatgtccgccagcgagcgccagacagtcggccggcagaagaacgcgcgcgaatcgttcatgctttcctacgcggtaccctggcctttgagcgtcgtcgcgcccgaggcctgcatggcccagtaccagatgatcttcaggtgccaggggcgggggttaggaagggggaacattaatggcagggtactggcctgcagtgggggtgatggggggggggttcctggcgagggatgcagctgggcccagggtgtttgcgggggcatgcagaggagcgggctcgccgcccggcacgccctcaccggcacgggcctctcccaaagcatggccctggcccctcccgttacgacgcgccactcctgacgcttccaccacccccaggcacatgtttgagctgaaatgggtggagcgggagctgaaccgggtgtggcagctgcacctccagacccgcggcctggccagcgtgcacagcaggacggggaggagcctggcgacaggcagggggcccgcgcccagcctcgggcgcacgaggtcggcggtgtcggggcgcaggctgttggctcctgcatgtcggtggagggggctgcgtgattccattgcgagtcaaggcttctggaggactgtgcggtgcaaggggcacccacgatgatgccagaggggggtgcaggacgcgcgacagctgctgaggagtggctccatgccgtgcaggagagggagctgctgccaagccgcagctcggtgcctgctcgaccgaaattgctccgctgcccatgcaaactcccgaccgctgctcctcccccccataccctgcgcagggcggcctcggcggtcgcgctgtcccgctcctgcgccgtctgccagctggtcacccacttcttccggcagtacctcctgtacatcaccttcgaggtgctggagccgctgtggctcgccttccagcaccgcgttcaaaccctggacagcctggatgaggtgtgtggagaggggtgtggggggagcaggtgtccgggcaacggtcggggctctggagccggggtggctcagcagctgcacgcactgccagtgcctgccggtgctaggcaccggcctggtggcccgcactttggcggagtgcgcgtcgcaggcagcctggggtcggtcactgtgcctgcatgacatgcaaacagtactgagccgaggacttgctaccccccctcgaccttttgcaggtgttggagcagcaccatgccttcctgcgccgggtgatgaagggctgcctgctgtcccgcaaggtcgtgctcctgcgctccctgctggcgctcaaggacctcgctctccagtttgtcaaggtggggtagggtgtccgggaagctttggggggatgagtgaaggggaaggagggagagcaggatcctcacccacatcttcattcggcagcccgctcagccctccacccttctgctgccaccaggtgagcgaccgtgtgctgggcgccctggcagaagccggggagaaggaggtggaggctgcgtatggcgggccctgcgtcgaccgaggtgggtggcggggtgaggatggctgggatgagcatttgattgcaggtcggcggattatgccctgttccggatgtgggctgacccacaccatccctggcgacagtcagatcactcagacttgcagccctcacatacgatcccccaccatcaggccggcggagttccacagccggggagggtccggtgtggggcgagcgggctgtccgggcggcgcgccgccgatcgacgttggacgccgcgctctcccagcccgtctttctcagcaccgtcaagtgcgttttgtcttgacatggccgatgaaacccctgggcgtgtctctgaggccatcgctggtttgaggcgcgccggttaccagagttctccatgttgtttggggtctggaccctctcccccttgtgctgccagtgctctcccccccctgtcttgaccctgctcacccccaaattgtactccaccgccttccgattcatgcagcacgctgtatgcgcgctgcgtggagcgggtgggcgagttcagggcgcacctggcggacgcgcaccgggccgccgccagcgagcggtccgacacgcgggaggatctggagtcgctgctcaatctgcagcagcgcctggactacaacgccttcttccccgaaccgcggtgggttgggagggtggagagggagggccaggaggtcgggcaggccaggcaaacgtggggtgggcttggttgaataagtaggcggctgaggccgaggccccggggtgaggcatcatcggggtctgcctggtcaggcactctgggtgaagaaccaacgttgcccgccatccttgccaaacctctccactcccatgcaggcccaaagcccctccgccacccaggggttgatgagctggctgggggagccctgaccctgcgcatggaatgcctccgcatcccgctcagtgccatgaatgtgcaggaaccttctgaccacgatgcaccttgccaaacgactgaataaaatacacaagagctatggtggcaagtctgtgggaggctgctggccagaggagaagtggatctcttcagccctggcccgtgtctcaccgcatgttggtatccgccgcgccgccttctttcaattgcagagcttgtcgttcgtacagggtgactcccacgggtgccacggctgccagcgcggccccagctgcatccacgtctgcgtagctcgggccctcccttggcgcccccgcagccgccagagccgcaaaggtgccctcctgatacgtcgtctgcgggtgttgcagacgtgaggaggaggggtgggctaggttgcagcgcactttggtgcaccacaagcagcacagcacactcctaaacagctgtgtgcgaggccaccaccaaatgctaagccagggcagtgcagccagcccatgccaatgtgctcccagtccatcttacctctcgcagcaccacgtctggggcgtccttgaaggcgcagaagacgcgagtggtgcggagtcggaccagcacgccgtcgactctgagccaaaacctgaggagggcgtaccagcacctcggcatcacgcggacctggggagggggcgataccatgggaaatggggcgtctgcacgatgcaccggaagcatgggatgcctgtgaagtacccttcgaccgccaccttccctggccacagagggcaggatcacgcgcagcggtggtcgcacagccaacccgcgctcgctggtcaccttgacagacagggaggcgacgccattgtcttccagctcactttcaaacagcgggatgtcggcatacatcaggatggggtcccgggcggtcagcatgccgcggtccatctgcgcgtcggttgcctcccaggccagctcaccgctgctgccgtgggctgactgtggccctgctggccccgcaccactccctcgatacccggtcgtgaaagtcctatgagtgtgcgagtgtgagatgtggcatgccaggctgcaggtgtggtgtgctgtacgagtgctcggatgcaggcaggcagatgcaggtatgagagggtcgcaatgacacacgctaggcgccacaggacgctccaacctctccctggcagacgcaccaatcatactgcaggaccttggccttatgggtgtcgacatcttgggcgtgcgcttgcatccacttccccgccgtcttcacgtgcacgggggcctccgaccccgacagccacgcccgtaaggcgtcctccgcctcaaaggtcaggcgtgtgccggtctcagggtgcaccagggtcagatggttggcaccaaagaactgctcaggccaggccagggatcccagcctctccttcagcacatccacctccgcatcggctgcatgcgtgcgtatgggggcccgatgtgacattgctgcaccagacagtgcagggacccatccaccaaagccctcgctctaaaccgcgtaccggtaatgggtgccttggcacaagtgatctcccacccgccgacagccacgccggctccctcgggaagaaagcgaccaccagccccttccaccgctgcaaagcatgtatgcacgattgtaagacactgcactgaaaggctctgtcacctgggatgcatactatacatacctcgctcgtcgattgtgcagcctgccaccattccaagagaggagaggcaggatactcgaatgagggaggcccaacacactcgaatacatcgatgggttaagggtatgcagcgtggatctgcgatgagaagattgagaccgtcacaaactgacccaaggcgcgcagccggggcattaacatgttacgtaaaaactagcttcctcacatgggaagctgcttgcaaatgcacgatccacagactcacaagttactatgccaagatgttgctcaacaaaacgaatagctatcgagcatagttcctctcacccgtcgtcccatggaggtgactgggaggcccgacaacgcggatgtctggcttacgaagacagacaaagagcagaggctgtcgccacccttgaccagcgttaatctgcgggatctgtgtagtgtgagtgacaacatcaagccagggatgtgtgtacgctcgtcacaagtcatctcccaggaggatgcccaacgtctcggagtgagggtgagtggggtgggagctgggggacatggctgcttcggctggtcgcctggtgcgaacctcaagactaaggacagatgatcccactctcaccacctacagaccgtcttggatctgcgccggtcacctgtgctgtgcaaggcgcacccaaataacacgggccagctgatgaagcacacgttcttcaagggccgcatctggttctctggcattgtgagtgggtggccccagcttgcgacgatgacatgacagcaggcgagcgctcacgacatatgccatcagctatgttatgcaattcagtgctggagcgcagaccggactggctacacacggatgcctcaggctgagctgatactttgcccccactgcaggccaagtgtcacgtgcggctgcggccctccaaggagccggatcacaatcgggcgctgtcatgccagaggtgcacagccgcatccaaggaaacatacgggcaacactgctcagtgtaccatggtgagcaaggccaaggggcacatgcgtgcttacggcagttgggttgaggatgtcccacaacccagttgatgtggccatctcttgagtgtcgcgcctggatgagcacaacacaaacataaagccctcttccctcgcccaatacagtggatctcctgccaacgaacgtggcgctaaacatcctgggcaggctcccccacaagctgcagttccgggtgctggtctgtgccgctcgtcagcagacccccgagcccattgtggcaggtgtgtcaggggtggcaggggacttctaggaggctacatgcggcacccaggagcagggctgggcatgcattcgctggcgtctgaatgcctgctgtgcctcagagagcttgcagcttcacaatcttgtcggtatctcccttgcactggtttctgcagcagcgacaaacactcattccccctttccttcactatacccctcttccttctctgtccggaccccagccgcgatcgccaaccccgacgtgatgggctacttcaagttctacaagatcctgctggagaaggcccgcctgcccttggcccgcgccgtgcgcctcttcgccgacaaggactccgcgcccgtgctggtgcactgcatccacggcaaggaccgcaccggcgtggtgaccatgctcctgctcctggtctgcgatgttgaccctggcgccatcgtggaggactatgtgcggtcggagctgatcctgcgggagtcgcgggacaacaatgagctcgtcagcctgccgggtgagctttgggagcaagagaaagggggtgaaagaaagggggagatgcatgtttgacaagggaggctcctgcagccccatgggagcgcagctgaaaaacctgtcttggtggtgatcgggtggcagggcgacctctaggcgctgcctggtacgcaccccatcacctatcccccctcccatcctcacgaacagggcacctcacgaccaacgaggtgatcgcggcggcggcgtcggtgatagaggcgctcatggactacatgacccggcgctggggcggcgccaagcagtacctggtgcgggcggggctcacagtgcaagagctggcggccatacgggtgaactacatgctctcaaaccaggggcaggcggcggaggagcagcatgtcagcgctgcactgctggccagcagtgggtcccactctgggcggcacaggaagcgagcgtgagaaatttgatcgatcccatgtggaaattattacttgatacctgttttgggagtcctgtgtgacgttttagtgccccattctgccatcatctatctgccttagggtttgcctccgacatcccggggcgcggggcgcttgacattaccaagtacatttctccacagcatagcatgatttaccgcgctgtcccagcatcaattttccatatctctcctgccgtgtaatctacataagccgtagcggttcgaggaagcgggtggcaggcgaccctgaccggtcccatggcaagctcgctcacagtgctgccggaggtggagaacgtcttacgctccgcaaaaggccccggactactcgtgggactggaaggcgatcatggcataattgtgattggggccatcgccacaaagcacgctgcaggtgggcccagttcacgagtgttgccgtcatggggtggggctcattcaagcgatacacacatctcaggcgcatgccctgtgcacaaaacaggcgacgtacaggagcttctccccattcctctggccgtggcgggctcctttgaccgggctggcgctgcaaagacaccgtcaccgacccttggcctggtggcagccgagatcgatgacaaggggtcaataacgtggcgctggctggccacggctggccgaggggatttgctgccgcatgtgcagacagccgcatccgactggagggaggagtgggtggctgtgcgggccactgcttccgccagcttaacttatgtcaggggccaagaggccagcaaagccacactggcagcgctggggggggtcggctctcagctggccagcgcagagaccctgtatttgaccccggacgcatctcagagcctggcaggcgcgtcgcagggcagatgatttgagtatttgcaagcccagcgcctgcagtgggaagggcgacagtgtcgggtcattgcagagatcggatgccgtgggcgttatgccatgcctgtgccgccacctcactcctcactccacccaccaacccatgcagacatgcccagcctgagggagggtgcgccccaggcttcatgggactcccccctccatgtcatggcatacccctgcctcaccagcgagcgccctgccctcgcgcctgtggtcatcactcctcagcacaaggtcaagcccggcgctgagatacacaccgcgcgtctccacctggacgccctgtgttacgttcggagagacacccctggtgcccttgccgcctacaatgtgagttgggaggattggccggcacccaggtggagtctttgtgatcggtctgactgccctcgagcaaatctgggcaactcttgaggttctgtatggggcaccagcacatcagcaggagaccacacatgccatcctaccacatccgaatgcgcaggctgtgaggcagtccattctggagcagattgctggggtgtcgctcctactgagcaggggggagcaggcggcgggggcagcgacgatccaggcctaccacttcctgccaccaggattccagcaccacgtctcgctggtgcgagagtgggggttccaacatctgagcttgaggctaccgggcgggtgctggtgtgattgggtggcgcctcgccctgcagctaccagccaagactatcatctcgaagtggttgtggccacgatctgccggcttctagcgcacccttgagcacactcacaaggccctaccacccattcgcccgcgtcagctgtatccgctcgccgcgtccgcaaggaaggccgaggaggcagccctggccgagaggcgcgccgccatacacgccatgctgggcctccccagtgatcgacccctcctacggatcgcgagggctgtgcccatcgaaggtgtgtcgagcagaaaagctggctgcggtccgcctgtgtgggtgcgcggtcatatatctgacgaggcttcttgtctggagggaggggatgcctgctgcaccgcaccccacctcgctcccacctccccctgccgtgcagcacctggcgccatgctcccggcaccctccaccagacggttggcagatgtgcacgtcggcatcgcgccctccagggtcaagggcggcacccagcacttggtccagggcagctacctgtactaccactacatgcaggtgactacaggaattgggcatcatttgcgagggggatggggggagaatggcttgccatgcccctggtgctcgtcgaccgccgtgccggcaagtggtggtgagggtggcccggcgcctgagtcagtggtcctgggatcagcctccttttcccagcctgcttgatcgtccgtattgatcagcagtgctgccggccgctgactgcttcgctggcagtccccggcgtgtcagacacattctgtgggatctctcgactccaccccactcaaccccacccccactcacatgcatgcccatctacttcgctcaggatcggttcaacgactcgggatggggctgcgcctaccgctccctccagaccctctggtcctggttcctggaggcgggatacaccagcaccccaccccccgaccatgccgccatccagactatgctggtcatgctgggggacaaggagccctccttccggggcagcaagcagtggataggggcggtggagctgggcttcgtgctggacgaggggctgggcgtgcagtgcaaggtgctcccccttgcctccggcgccgacctgccagacaaggcggccgagctggcgcaccactttgacatgcaaggtgggagttgcggcctgggtcccgggaaggggcctggctgaccgagggaggagctggtggcctgggtgacagggctgcctgaatcccgcttctcgagggcttgaccctgggcgggagcgccgcagtgatgcctttcaaaacccaaaccttccctgatgactcatgagcacctcgcatcccctttgcaggaacgccggtcatggtgggcgggggggtgctggcctataccctgctgggtgtggactggaacgagtcgacaggggaggtggcatttttgatcctggacccacactacacggggggcgaggacctgaagaaggtccatgccggtgagtagaggaaaatcccatctggatgccgcgatcaagtgcatcccatgagcaaactccatcataccccatctgcaaaccccttctccaggacaatgggtggcatggaagcagtacggcgacaaggcggcggctgggggtaagctgctgcatgccgacgccttctacaacatactctgcccacagagacccctgggcgtctaatcgtttgggggacgtttgcttgaaagcaggccttgcgttgtatgctgatgcttcatcttgattgttaccagcagatagcttcctcgctaagaagggcaggtgagggtgattgaccataggacttgtacatgcctcaggatgaggtgcttggggtgactcaagatgacatggatactccgctgcttcattggaggcagagagcgcacaggccgtgccgtgcaaaaaaagggattgagtgaggcatgtgcgggccgtcaggcaaagtccgaggggctccacatgcattgtacagggtgccatgccgcactcttggaccccgtaattcttggactcgtgcctggcaggccccaatcaatcaggccatgtctactgagcggggatggcggtggccgcggctgggagggctgcctccgtgccgtagcccttggggcggcggaacagcattatgtggggctctggcttgtggatcgcatagtggacctgtgttcggaggggcaggctctgagggtgtcaggagtgactggcagtccagctcctcccaccactacgtcgggactcgcagtagcaaacctcatgagtctgacacccatgacccgcccttgctttgctcttcaagatacgcatactactgcatcgaccgttcttacacttctttccaactccttcagatccccctgctcacccatcctcgagattgctggacgcctagggccctccattccgtctcggtcagcagcttcccctttggcagctgtgcagcgatgtctgagggcaagaccacgtgcctgtgtgtacagagtgagaggagagggaactattggagacacataccccagaatacaccaggactcacgcttctggaagcttccaaagaggaccagacctgaactcatggatctgcaagggggaagcggggaacatgtcagcaacactggcgctccaggtcatcggaaaaatcatttcaccatccctttgacctgctcacatcgtcgtagtagcgctcgctgtactggatctgactcggaggcatggttatcgaggggcaggggattcggaggattgctctctcagtacgggaccgatgagaccactttccttctcaatacgtcgatgttgagcggaaagtcggatgttcagagtatctgtatttcgtgcgcgaatggaccaacttgccttcccatagctgcctcaccgaagttcaagtgcgaaggaaaagaaaattccattcctgcgcgctaagatcacttcatgcagcagtcctccgtggccgttgcgatcagccgtttggtgatccactccaatcaatgtttctttggttttcgaatcatatcccttactcatttgctgtgagggattaggggacaatcacgggcaggtcgtccaccgggccatatgctcctccgcctgcgctccaggtgagtctctggaattccaaatgatgtgcaactcaaaatcccaatccagaggtatatgtaactgttcactatctcaattgcgtgccagagacggcctggagcgggtcaaggtggcggatgacgccaccgtggccgatcttcgacaggccattgccgctgatctctcgattcccgtggacgattttgttatctcacaagagcccacactggtgggtcgagcaggggtgtactcccttgaccatgcgaggggtaacactgcgccctgcagcttcttcatgaggtcatgggcgttcctgctgagccatcccaactcccccttcacctgctccttagctgactgccaaggatggcgagtccgtgcagaccctgtctgccctgtccaaaagcctcaagggcctgggcatccagcatggcgacaccctctttatgaagtatggcatcaagcgcagcatccccggcccaccccggtcaacgttcgaaaccaggccctttggcgcccacatggacgtgcggcgcatggtggctgcccagacccgcatcgagcgccaggagaccgcggcctgctccagcgcgtcctttgatgcggaggctgcccacgctttccagtcctacgtgtctgctgccctggccttcagcatcaagcgggggggcatcctgtatggagtcggtgggaaagcgctcgcgtagtgtgggaaaggagggtatggtgactgtctggcttgtgcctatactgaggtcggtgaaggtgtgcatctggatgatcagctgctcacttgtcccgagagctcctccgttgacctcacgtgatgatctctgtgtgggtcacggggccgtttgggcttggtgacctctagccagccggccgcctatgcccatgccaatcattgtacccgccatcactgcatgatgcctcatccgcgttcctttgcgtgcagttggcgaggagggcgccgtgcaggtgcatgccatctatgagccgccgcagtctgccacagcagactcgctgcagctggagcgaggcactgaggaggaggcggcagctgacgtcatcgccaccactcttgggtgagactgtggcttctttcattgctgggccgcgcatctgcgcatcggctgccttctgtgtcaacctttgtttgcagcattctataacattgggtgccaaccaaaggactgtcccaatatccctgcaggtggaccaaggtcggctgggtatacagccagagtgtgaaggagcgggattttatagtgagcactgaggagctgtgtcaaatggctgcctttcaggtgtgcacttgtatatttggagaggtagtagtctaaggtgattgggggggggggaggaggctgaggcacctgggataatttgctcaaaaacgcacgagtgtagatacctgtggtcctttcatctcccatgccatgcactgcctgcttgaaaccgcagagtacatgtgcacacctcgtttccactgcaggatgagattggggagacagctgtcactgccatggtggctgccttccccggggacgatgggcaggtggaggtccatgtagaggtgggtagcccacttgaggagtgaggggcatttatgctctggtggcacggttctgggcccagttttggtaggcctcagcgctctatttctagggcaggcttggagcctcgtcgcccaagcccctcacgcgcgctcctgatcataatctgaacctcccgctcctcctcatcgctgactgcatctcctcctccctctgctcatgcactcaggccttccaggtctccaggcagtgtgtgaagctgtggaaggagggctggttccaggaccagacggagccgagcggagtcaccacccttcgaaaccccaaggtttatcagaggaggggtgtgatgggcgccaggttgacccggcccctgccgcacatcccctgcactctctccgtttctgacaccctgttgcaccgctctcacaggagcctggcaacgccacgcccgtcattgtcgcggggaaggaccagggcgaggtggacaacgactacttcctcatgcctgtgtccatcaaagaccatgtgggccccctcgagaatgccttcccctgtgagaacaggctgctgccccaaggtgtgccggctgtgggcagggaggggtcctggtgcctttcgaggagcatacgtacacgcagtggagcctttgtcctgcctcagcctgggcttgtcgaacctgttctcattgccagggaaagcggagctcagggcgcacctccagaagaggagcgggaagccctttgcggagcgcctggacgacttccacctcctgctcttcctggcccgccagcccaacttcgatctcacaggtgggatgccgcgctcgaaggggacgagggagggaggcttgcgggaatgggcgctggggaatatgccgacacatcgatctcagtcgaaagcgtgcctgtcgcctggctttctgcctggtcgagtcaggggtgcgctgtacatcgaaataccctgctaccctgtcctccctgccttgtctcacagaggtcgggcacctcacggcggcggtcgccgccaaggagccggtgggggaagggtacgagctgctcatagagtccctggcggggatgtaaggcaatggtgcgcaatggcaaaggaccaggctgttgagggtagtgtagagaagaagggcaagggtggcacgaaggccatcccatcccccccacagcggagggcggtcccggtgccccagtcagcctggagcagtccccccctggagccaggctcagatgcggtggtacacggggatgaagtactggatggaccgcagcgcgtccctccctgcggtggcgtccagggtgccgagcgtctgccacactgcgtcctgcatctcgtgtcccgatccagcgatcgacgcgccggggcacctcgcatggtgcatgtacctgcatggagattgctggggagatcggggtgggcagtgggtcgatgttgggcgatgaatgcctggcagcaaagcatgtatgtggtgggcgggcaccaaggccacggcagttacctacccggcagggtgcaaggcaggcacgcacgcatgcggccccgccgtggcaacgaccccccggcctcgcctgtccaggaccggcaggaggtggcggtggtagcccagcagcgccacgccagcggcgggcgagctcagcgccagcgcgcgcagcgtgctcagcgcacgcaggacggtgcgcggccggtcggaggaaagcgccgccttcagcgggacaatgagatgggggatgcactgcgggacggcctcccctccccgggcgatgagggcggtggtgcccgcctcggccagcatgcggtacggctcctggcccgaggggtgggggcggggagggggggtcaggagtgtcaccccgcaaccagcatcaccctcacgatgggtcagggcgccaggcagcgaggcagctcaccgtttgacatgtactcatcgtaacctgccggtccgtgtccctgatcctcgcacctgctcctcaatgaggccgtcaacgaagatggggagcagggccggtacgtccagctggtccaggggctgggtccagcgcagccccgtcctgccgggccgatcctgctccaccgcgatggggaggtctgcccgctggtacagacgccggaaacggagggagtgggtgccctgggaggctctgagtggcggtggtgcggcgcttccgacaccagggccccgaagggcgggggagggcgtggcaggagtgtcacgggtggttgcccccagaagcggctggcctcctcccttgcgcaggtactggtctggactgggacgtgacactcgaataggatcgaagcagggcgctagaaccatgttgagggtcgggcagcggggtcaaggagccgacatgtcgcgtgtgctcgacaggacaaagaagctctgctcaagcaggacaacgcgcagcataaggttgaaaaggctgcaacacgtcaacatagtacgattcgataaccactgggctgttgtcgatcgcctcgttgaagattgggagcgagctgcaagatcgaggttgcaccccactgctgtggaggattgacaggtaccctgcatccctctgcaccggatgatgtgaggcatccgacaaacaaagtactcggtcctcttgtcatgtgaagtggctgcgggaagctgtgacagctgctggttgatctaggccgtgacgacgctgtctgagagcaatgccgatcctgtaactcaccacattgccggcggcattcgagacgcattcgacctgcgttagcgacagtgacctgtacttgcattggaaaatcgccacacagcgtcgtatgcccgtcctgcggaactctgctactgtataacgaggcagagcatcttgaagggctccctcatcgtgccgcaggcgcacccggggaccgggagctctggctgtcacaccagcgagctggttggtccctctgaatcgtgtactgcggaaatctgctgcctgcaggccgggttcacgcgatccagctccgtcaccttgtccctggataggcggctgcggtggtggcagggttgcctttgccattttcctctacagcaaatgtataaacacattgtgatcggcattcgtagggcctgagtctgactggaaagcgcgttaagggtgatgatcgttggctgttcaagtccgattcaaaggcctcgggtcaggggtcgatgttccggagctgacgagggttggacgcgagtgtacaccatgcacacacggaacctgtaattgtactgcattgcatgccgagcccagttcatcttcattctgaatatcgtgaattcgattcgacacagcagaggcactctggcatcgcctgctacgtctagcctgctgtcctggctatgtgtactccgaccttcatattagcacgcgtctgagcactggcctaggcccttcacccacaaccagtcgtgatacatccgagtgtgccaagccgggagccatgggaggcccgaacatcttcaagaagatgctggcaaagtcttcggccaacaacatgctgggtgccaagaacctggagctcgccaaacatttccggctgatcaagaagttgggccaaggcggctactctactgtgtacgtccacgggcagtggttttgggggtcggtccttacgacggtgcccgcgtcgggcccggcactcgagccggtgggactccctccccccttcaccgcctcacccgctctccctccgctcccccaacgcaggtacgaggtggagcgcctctcagatagggggcactacgcgctcaaggtcacgaacatccaggagctgaagccctcggtggcgcatgaggtggtccaggagatcaggcgagtccgcactgttgttggggaagggggctgctggcttgtggtggcacggcaggcgaggcgcgcttgctttgccctcagcgcttactcaagcacactgccacccagtggtgacccccaccccacgcacctcccccgccaggctgctggcatccctgcagcaccctcacctggtgcagtaccatgaggcgttcgtggaccacgacaagctctgcattgtcaccgagctcatgcccggcggcgacctggcctccatcatgtgagcgagggttgccgtgcaaatgactcctgcagggggttgtcgacgcggggtctgtgtggctgtgaggagctgctcgcagcccgtcccctcggtgctttcccccaccaaggccttgcaccgaggtgcagaaccccgacatgttcccaactcaaagcatccccccccccaaacaacagcatgctgcgctacgagcgcatgcagcgcttcagcgagggcgccatctggtccatgttcctgcagatcgcggtggcggggcagtacctgcaccacaaccacatcatgcaccgcgacctgaagccgcagaacgtgctggtgggggcggacgggtcgctgagcctggcggacctgggcatcgcggagatcctggaccgcgtgttcacggagaccaagtcgggcacgccgcactacatgcccccggagttctggcgcttcgagcgctgctcctactcgggcgatgtctgggcgctgggctgcgtgctgcacgagctgtgcgcgctgcgcccgctcttcctctgccggcagcagcaggagatggaggccaagatgctgggcggcgcctgggagcgcctgccgcgccgctactcggatgggctccagggcgtggtggacgcgctgctgacggtggaccccgcgcgccgccccaccatggacgaggtgatgcagctgccggcggtgcgcgccgctgcggccgccgcgccggagccgctgcgctcgcgctgcgccagctccggctcgctggccgacgacctggtcccgcgcctgctgtcacacatccccgcgcccctgcaccccgac

SEQ ID NO: 22909 - DNA, 75 bp, Chlorella protothecoides
tcccgttattcacaatttcagcccgaagtatccggtttccgtcacatccccttgccaatgctctgtgagttttca

SEQ ID NO: 22910 - DNA, 79 bp, Chlorella protothecoides
gtgggcgttgaacgcggcatagatgtcacctcccccttggcccctggattgaggagggtcaggtaagactggctgagcg

SEQ ID NO: 22911 - DNA, 61 bp, Chlorella protothecoides
taagaaggacactggcgacacgcgcgagactcctgccatcgacgtctgccatggtctggtg

SEQ ID NO: 22912 - DNA, 75 bp, Chlorella protothecoides
ccacgccggccaatccctggctgcagccgagcgctgtgaatcgccaccatcgcctgggcaccacggatcactgaa

SEQ ID NO: 22913 - DNA, 78 bp, Chlorella protothecoides
agtgttcatcgagcacaatgtcaccgcttttgagtttctgtatcggggtactgtctacaattgagcccataactgcag

SEQ ID NO: 22914 - DNA, 118 bp, Chlorella protothecoides
aggagatcctcactgccatgacggtatgttgtggtccgtagttctcattgtgggccaaggcacatggttgttgcgggtcctgtactgctgttgtggaggcagggtgaccgtgtggcag

SEQ ID NO: 22915 - DNA, 69 bp, Chlorella protothecoides
tcggttgtacaaccacctgtgtacttgttcaagccccggacatgccaagcttgtaatatttgacgagtg

SEQ ID NO: 22916 - DNA, 128 bp, Chlorella protothecoides
gacggcagcacgtccatcgcaccctgtggcaagccgtccctttcccaggcctgtccgtggcttgggatcaggcagggagccggcctcccaccacggaccacctccacaccccacccatccacctgcca

SEQ ID NO: 22917 - DNA, 75 bp, Chlorella protothecoides
cacctccacaccccacccatccacctgccatccgacccgcaccctacgcaagcacaggaccacgactatgcctac

SEQ ID NO: 22918 - DNA, 68 bp, Chlorella protothecoides
attgatggtgctgcgagactcatgcggctgccgatggcggccactgttggaagactacgtcgagcagg

SEQ ID NO: 22919 - DNA, 69 bp, Chlorella protothecoides
tcgcacctctcaacgtctcagcgcatgcgcacattccagggcgatctgctcacccaacgtcaaccttgg

SEQ ID NO: 22920 - DNA, 236 bp, Chlorella protothecoides
ctgccacacatggaatagggtaatatgccctttaaggagaagcccggcttgggtaccggcagtatataccgggagcgttcacaacaccccctcagccacctacggcacccctcgccagtttgtcgctccaaatccgcgtgacgaccctgtccacccttccccatcgtcactggttcaatatattaaatttaaagatatgatgtaatcgtatatcacagtgtgtccaccgtgctatg

SEQ ID NO: 22921 - DNA, 92 bp, Chlorella protothecoides
tccattctcttgtttcattttcatttgttgaaaggccgcccctgcatcgtcctccgcgcggtgagccgatttcaaagcctgcacggccagac

SEQ ID NO: 22922 - DNA, 87 bp, Chlorella protothecoides
tgccactcaagccaaacaccatgtttcagtcagatatgcaaatgcgaaaaattgtcagatggggatccgagaggcccccgtccggcg

SEQ ID NO: 22923 - DNA, 155 bp, Chlorella protothecoides
gcccagcgtcatgacgatgaactgcaggtgtggagggggagagggagggagggtcaccactcagaagaccacagctctcagaccccctccctgcctccagatgcccagaccttggccggctcgttgtcgtagctcaggccattgcagaggtaggt

SEQ ID NO: 22924 - DNA, 2359 bp, Chlorella protothecoides
  modified_base (572)..(581): a, c, t, g, unknown or other
tcctccccgacctccacccccctcctccccccttcatcacctgtgggccgccagaatggactcggcggcgcggctgccgcgcaggagcgcagcgggcgagggcatgcggtacgggtccagggcgaagatgttgcggcccgtgggcagtacacccggcccgtcccgcagcaggtcgccgcccggcgccggctggacccactgcccgctcagcgcgcgcgtcaggccacgcagctcctcgccgttctgccccagaagcgaggcgatgctctgcgcctcctccagcaggctcggggcctcgggatgtgccgcaccgccgacgtgcacgttctgaacggactcccccgccgccacgcgctccagcgcctcgcgtgggaccctgtcgccgaagtaggcggccagatattccaggctttcttcgcggctgggcggcttgccgagcacgtgcaggcccgaggagaagaggcgcccctccagcagctgccaagtgagggtgggtggttggggggtgaggtcgggcatggcgttgctcgtcgccgcgctcgacttgaatcgtgtcatggcatggaatgggnnnnnnnnnntgtgagggtgggtttgggggtaaggtcgggcatggcgtcggttgtcgccgcgcttgacttgaatcgtgtcatggcatggaatgggaccatgaccccccgagccttgtccctgcctggaggtactgggtcaggcggaaggtgaagctgttgaaggcctccagtgaaaggtcgcccacgatgtctgcgtcaaaggtgaccccgtcctgttccagaaccacatcctcctccaggcctgcagagaggtggagtcgtgggtttgcctgcagtacacgcctagactcaaacgtctgcgaccccatgccatcccgcaatcatctgctctcggtatgaatctcacactccccaacatcacagtcccacacctgaggccacgacaagactgacgatggtgccccgcatgtctttgctggacccaggggcttcccgatagtcagccagcagctccctcagctccgccagctgcttgtacagccccgcgcggccgtaggggggcacgttgtggctgatcacagtggcaaaccccctgcgcttggccacgagcgactcggaggggttgttggcggcgtagaggtaaatgttgggcatgtcgccgtgcagcacgtccggccagctgagcgccgaggagcccagaggcgagcccggcagccactccgccgtgccgtgcatgccaaagtgcagcaccgcatgcgccccgtgcgcctcctacagaggggcagtgctggggttgtcgaggggaggctgggggggggtgagtgcatggttcgcggtaggcgcggcgctctctccaaccaaccagggcaatcaacatgtctggcgcttcacacacggcagtttccccctttcccaaaatctggcctgcatccagtcgatctccagccatgcgcagggcagcaagcaggcatcagccctcctggagcacgatcaccaccccagtccacagaacctcgcccatccagggcacctggagccagaggtagaaggcggcgtactgcgggtgcggcgtgaggtcccgatcgaacagcaggcgcattgggtccccctcgatccccagcatcggctggatgccgatccagaccttgccgatctggacgcccgtgatgaccaggccgccggctgagctgctggcgatcccgcggtagctgtccaggggcccccagtgcttctccatgcgccgtaccagagtgtcacggtcgggcaggaaggggatgggacctgtttttttttggggggggggggaagttaacgggcagagcctggtgggtgcacaggtcagagggaagcatggacactgttagcaacccggcccggctcggggctgtgcagggctggggctcgcaaaagagggtgcactttgctgccccgcagcatcgcgctcaccccactcgctgggcccccagtcggcggggaactccagcatacgcttcagctcggagggcgggacctctgcggcgctgatgctcacgccagcgggcaggccagcctccaggtcccgcatgccggcggggccccgcgctaccctgagcccctcggccgcctgcctgagtgccgatacaatggcctccccatccagggcctccaggtccacgccgccgagatcataaccctcctgcatgcgatgggaggaaatgggtggtctcgagcctgtctcactctctgctggtcatgcacaggttgctggcatgggaggacgacggcgaggtcggctgggcaccggcggcgggcactcgggcgctacatgcattccgtttcccagccaaaacttgcatgcccagcacctg

SEQ ID NO: 22925 - DNA, 174 bp, Chlorella protothecoides
gcaggcggctggcgggcagggaggcgggggtcccacgccggcaaaccccgctgcgtcagaggatgcaggggaggaaggactgcacgtccccgtcacgtgtgtcaacctgctgcactgcaacccggccaaggcctccgagctcatgctgtcctcgcacttccaggaggtggggcg

SEQ ID NO: 22926 - DNA, 124 bp, Chlorella protothecoides
gcccatcgagcatggcagcaccccgacgcacggaacacccgcgctcgatgcccgccacccacctcatctcctccaccccttccccaccctctggcagtgacacctgacgtgtcgccccgggaga

SEQ ID NO: 22927 - DNA, 4852 bp, Chlorella protothecoides
  modified_base (1374)..(1383): a, c, t, g, unknown or other
  modified_base (2527)..(2536): a, c, t, g, unknown or other
  modified_base (2828)..(2837): a, c, t, g, unknown or other
  modified_base (3731)..(3740): a, c, t, g, unknown or other
  modified_base (3913)..(3922): a, c, t, g, unknown or other
  modified_base (4276)..(4409): a, c, t, g, unknown or other
  modified_base (4601)..(4676): a, c, t, g, unknown or other
gcggccgcgaccgactccaggcacagcgcgtctaggcggacggcctccgcgcggtggcgccgtctcctcgacgcgctgctcttggcccccgaccgcgccagcagcacggcgacgctggaggccaacaccatggtgcccaggcggcgcatgctgggcatgctcacgctgctcccccgcgacgaccagctggaggcctccgtggagtctgccgcgccatcggcgtcggcgcggggcggcagcgggtgcgcctgcgacgcgacgccgtgcgcctgcgacagtagtagacaccctccgtcggcccccgccgcgacgcggcgcgcgtaggcgtccgggtccggctcgtccacgtccagcttctcagcgcggcgcgccaggaacgcgcgcgcctctggcagcatgcgcttgaggaagccgaccatgccgtggcggatggcgaagcgcgcgacgtgctccgggatgcccaggtcctcgaagtgcagcagcacggtctcggcggcgcggcgcccgggctcccccggccactccacggagcgggagcgccacatggagtggcagtcctccatgcgcacgtgccgcccgcaccgccgcacgcccgggtggtccacggagcgcgtgatgccgtagagcgcgccggtggcagcgtcgcggaagacgcggcggcccaaaacgtactcccggctgctgatgaaggcgaaggggaaagtgcgcagccagcgcaccacctggcaccgcgcgcccgggttgcccgccacggcccggctctccaccagcgagtgctcggagatcatggggtcccacaccgcgcgcacatcgtcatccaggtaaaagtccatcaccgcctccgcgccggcgtcgcgcaggacggtggtggagcggtactcggtgcggccgcagtgcagcgtgcgccgctgcgctgtgtagatgcagtcggggaactccttgcggcacatgtcctcccaccgcggctgcccgggcgcaccctcgccctcgcacgcgtcgcggaacacctgccagtcggactccgtgatccaccactcggcgtcggccgggtggtgcggggcgtggctcccggcggcgagggcgaggcgcggggcgtccgccgcgtcgtcgacgcaggcgacggccgctgccgcggcaaaggccgacacctgggtggagggccacagggacctccaggccgcctggaaggtgccgggcggacacaggcgcagcaggatctccctgcaaaacggtgtggcaatgaacgaatgcttggtgaccttgacattcatggcgtttggaggagggggcaggccctgccagcggcccaggatcaggtggtccaggcgggacagctgcgcgcaatgcgggtggggtaacactgcacccaggctnnnnnnnnnngggggggcaggccctgcccgcggcccaggatcaggtagtccaggcgggacagctgcgcgcgatgcgggtggggtaacactgcacccaggctgtacagcatctccacctacctcacgaccaggagggcatgcagggccagggtgacacgcttgaaccaggacccggtggtggtctgcagggccagctccttccagacgaggccgttctggagccagcgaggccgcggcagctgcgcgagcaagacaggggacgggctcggtaagcgggcccgcagcgcgccttgcagggcttcattcaccttcttactcaccaggtatcctagggagaggcccacgaaccacacaatcagcatttgcgcgccccactggagggcgtggtccagcaccatccccgtgaccttctccatttcaggggtcagcgccgcggccggcctggctcgggcccggattccgtgctgagatcaccgggaatgcgcagggactgaggagcaggggccttccggcgagcaacaggcagtgcaatgtggcaccccctctgtggttcacagccaaatcgggacccaagcactcctcggattggtatccatcgctccggggtcgaatggataccccatgtaaaatggtaggttctcttcagcgctcgacatcgcgcttgcacactgttcccgctctattgagtggccaacatgttttgtatggacagtttcggctggctctgtaacaggagccggccacacgcaccgtctgcatgcctgcaggctctgccagggggcaaaggtcatgcacatcatcctgcatgacacgcggcgctgacgcagtcgaggggtcatttgatgcgctgggccgctccaagcacttagccgctggcagaggctgagctcaagcgtcctgatcacttccttcctcgtcaccgctcccctcgtctgtatggtgtgccagggggggtggtggggttgatgcacattccctgcctggcgatcagatcggcttgaggcagcgccttgatcagcaaaaacatgaaacttccaccctctcaagatatcacacaagaagagcccacctgagatggcttcgtcctcggagggtagcgccgatggggccccagatggcagatccccacctgccgagggcacggcagacccccnnnnnnnnnnttgaactcctcctggtcctcatcaaagtctgtgccgtagtgccgctcggaatctgcagcagggtgcagggaaagacagtgaaggcgtagttgtaggcgagggatggcgatgttgcaaggagaaggggggaaattggtgttgctctggggaaaatctgggtccagagatgctctgctcagcctcgccgccgtgtggcccaccaggcgcgcactccttcccgcccatgcgttccccgactcgcccgagccagagttctcaaactccttggccagctccgacttctgcgtcagcnnnnnnnnnnaatgttgcaaggaggacgggggaaattggtgttgctctgggcgaaatctgggtccagagatgctctgctcagcctggccgccgtgttccccaccgggcgcgcacccctccccgcccatgcgttcccccactcgcccgagccggagttctcaaattccttggccagctccgacttctgcgtcagcatggcccgtcgctctttcttagagctgccgacgatgcgcggcgtggcccggctgacgcccggccgccgcccctctgctgcggcaagggcggatcctcggcccctgcaagataatcggaccgcggatggaggcaaatgtgagagccacgtttcaccggtagcgcaatgggtgacaatgttgggtgtcgggcacagagttgtcacggccgctgctcgtgcaaatcaagactgccgcctgggcgcccgggtggcaagcacaggacccatgctttggcccggtgtcccatagccagccttcgaaccccccttccctccctgggtcacctgccgcggcccctgcccctgccgacgcccttgggccgcgcgacggcgatggaggcgtcgctgttgttgaccacatccctctggaactgcgccaacgggaaggcaaactcctgcggcaaagtagggggttgcggggcggttgaagggggaggaacaatcggtcatacaccaagtagggtgcaacagtggggtgcctttggctccctgaagaacataatttttatgcaccgtgccgggcacccctccgagcacagacgccatgctcctgctccctcatcgatctgcctgcctcccctcccacccccccgcgacccaccctccgtggcccatagagcaatttgtgggggagcggggggaagctgacgggacgaacgcgtccgccgatgnnnnnnnnnnctccgtggcccatagagcattttgtgggggagcgggggaaagctgacgggacgaacgcgtccgccgatgcctgcaggagtcacgtgggggacggtgcgcgcttgtcagtcatgttcatcacgacgtaaaaattcacgtgggctgtgtcgcccacactccagcgctccattgcnnnnnnnnnnagcgcgcttgtcagtaaggttcatcacggcgtagacattcatgtgggttgtgtcgcccacactccagcgctccattgcctggccccctccttcagtacatctccgacacctccctccctccccacccctttttcccaccgagcggctgcccggcgaccaccctcccctgcttcccgtccacgacggcgggccgcagcgcgcggcagtacccctccaggctctgcctcgccggcgcctcgcccgggcgcggcaccagcgcggcgtccaggctcagcacgcgcagcgcgagcgaggcgggcgtggccggcagccaggcgagcgggggctggctaccggcgggggtggtggaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcccgcgctcccagcgcccaccggcagccaggcgcccccgagcagctccgccggggcgcgggggaagagcggggagagggcggagggcagcagcgcggcctccagcgcgcccagcgcggcgcgcaggtcctcgggcgtgccaggggccagcagtctggccgcccacgcccccgcatcgaagcccggggnnnnnnnnnnnnnnnnnnnnnnnnnnnnnnnnnnnnnnnnnnnnnnnnnnnnnnnnnnnnnnnnnnnnnnnnnnnntggcgccagcgcgtccttgatgcgcagcaggtcggccttgagcttggtggcctcctcgctgtcgccggccgcaaagggcgaccagccggcgccggtgcgcgcgcggcccgcgcgcgtgatgccgcaggcctgcagcgcggcggtgtgctcggccgccagccgcgcacgctcctctg

SEQ ID NO: 22928 - DNA, 77 bp, Chlorella protothecoides
ccagggctggtgccgcaggagctgggcgggtggcctagtgtgggtttgctgcaggcctgaggaatccccaccaaatc

SEQ ID NO: 22929 - DNA, 1066 bp, Chlorella protothecoides
cgtgcaggtggggggcggggcgcctagacggggggggaggggggagagcgagggagagggatgcggggtccggcggcccgcagcgctcgaagtgcatgatcgcttgccctggtcgccgtgccacccctgcgttccatctcgccataatcactaccctgcactccctgggcccctgggaatcccctctgcctctcgtttgcctactcaagttccccgcgtccggagtccaccctgtgcccccgctcccccccctcctaggggggccccacagtcctcagcatgccgattcctccctttcctccttccctctcatcaggagcggcgcgtgccataccgccgcggcgccgagctggacgcgctgacggggacgcgctttgccctgagcctgctcctggaggcgctagacgtgggcctgccgctcggccgccgtgcggcagctgcggccggccgggcgctgtcctggatcctggtggacctggtgggggcggtgttggcgctgctggcacggggcgtgcgcggcggcctgtcccgcggcaggcgggcggggggggccgcgcgcggggcacgtggcggagtgtggcgaggtggcgcgccggaggctgcatgatgtccctgcgtggcccctggcgcatgtccaatgaaatcatttcagggtcacccattccagggcaggtaggcgccggcgagtgacacgccgcggtctgcaggccgggtgggtcgtgatcgatcgtcagccagggaaggaatcatcagggggggtcacgggtcaggcagggcgatggtacagcgtcggaccgggggtgccggcgacagcgcgagcgtgcaggcggggaggacgggcgggcgcagggtcggcgtgccggccctggcctcacaccgccgtggtcgtgggctccgaggcggcggtggagggggcgtagaaggagttctccagcgggtccagctcgcgcgactgggcgtccatggagatggagcacatgacgtcggagcagcccttgatgaccatgcggctctggggcgtcaggcggtacagcgcctggtggggcgggggggcgggagggtgggt

SEQ ID NO: 22930 - DNA, 75 bp, Chlorella protothecoides
accgccgctcgaaccctggcccgtctgcgctccagtccgagaacaaccgccgctcgaaccctggcccgtctgcgc

SEQ ID NO: 22931 - DNA, 309 bp, Chlorella protothecoides
tatttcttcatccaactgtgctctgatctcttgtatttgcaggtgtcgggctccttatcaagatgggaggaaagtctggcgatgtcccagaagtgacagtggaggggccatcacgcacgccagaggggtaccatgtgatgaagtgcagcatgaagcgaggcctacgaaccctgtctttcaccctagagtttcacatcaagggcgggaagatccaatatatgcagaacacccggtcatagacagtgtaggacggtcgaatgatcctgaggtttgcattttattccagacaggttcccaatgagatgaccc

SEQ ID NO: 22932 - DNA, 61 bp, Chlorella protothecoides
ctgctggctggggccgttgggcgcggtgagtgtggacgacctgccaccctgattcacggcg

SEQ ID NO: 22933 - DNA, 65 bp, Chlorella protothecoides
ccgaccggagctcatggacagacaggtatgtgtgggctgcctacctgaggcctgatgcatgccga

SEQ ID NO: 22934 - DNA, 69 bp, Chlorella protothecoides
tgcaagggaatgtaatgtcacacgaattgatctcgtctatgtagatctcacgacctcgagtatggccgg

SEQ ID NO: 22935 - DNA, 122 bp, Chlorella protothecoides
gaactttgtttttcgattgggtcgtgcatgattacaggaacattcatcctgccaggtcagggcgcgcacttccgcatccattcgcaatcgacgaatcagattttcaacagaacgaaaggtgt

SEQ ID NO: 22936 - DNA, 66 bp, Chlorella protothecoides
cgatcagaatctctcgtcgtcaatcagaacaccgtgccccccaatgtataatctggaagcccttca

SEQ ID NO: 22937 - DNA, 64 bp, Chlorella protothecoides
ccaatgggtgttggttcgggactctgtgtccaatactatgcgcgggtattgccgtaacaaacat

SEQ ID NO: 22938 - DNA, 134 bp, Chlorella protothecoides
tgcagtccgagttcggcattggtaagagggagcgagggtgtattttgaacagagggaacgttgggtgctgtcccttgacccagtaggactgattcctgctggagtggatgtgggaacaggagcaagaggtctca

SEQ ID NO: 22939 - DNA, 61 bp, Chlorella protothecoides
caggcggggtggatgactttgtcatctgaaacaccgccgatcctgtacacaagatgccctg

SEQ ID NO: 22940 - DNA, 72 bp, Chlorella protothecoides
tgacacaaggcagacgagcgccctggaaggggggggggtgaatcctccaaccagccatccggccagggtgac

SEQ ID NO: 22941 - DNA, 63 bp, Chlorella protothecoides
aggggatatgttgatggtgcccaaccatacatgaaatgtcctgaatactttgtagcctgaccc

SEQ ID NO: 22942 - DNA, 61 bp, Chlorella protothecoides
catgctcgaggtccgacaggctgatggtttgaggcacagggatgcgcatggatgaggtgtg

SEQ ID NO: 22943 - DNA, 61 bp, Chlorella protothecoides
ctcctccttcttgcgcagcacctcctcgcgttgggacttgagcatctggcgagggcgggga

SEQ ID NO: 22944 - DNA, 61 bp, Chlorella protothecoides
gccaatgcgcaaccacagtttccaacccccaccccccccctgctgcgcgtgagaagcttgt

SEQ ID NO: 22945 - DNA, 61 bp, Chlorella protothecoides
gtcatgctatttgcccgcttgcagtggctgggctgcgcagcttaatgccctttttgtgatc

SEQ ID NO: 22946 - DNA, 433 bp, Chlorella protothecoides
  modified_base (127)..(349): a, c, t, g, unknown or other
tgcagcgggaagagcatgcagcaatgagttttatggcttggggcacgagaaatcgccatgtccgaacacttatcgatcccacatgccagtgcattgatggccagctgcaagtgccggctcctggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtacatctgataccctccagatgtacagtttgagatccccaccatagtactcgaaggacagccatcttcagcaccccagaaa

SEQ ID NO: 22947 - DNA, 61 bp, Chlorella protothecoides
gctcaatctgctagtactcggcaggccaccggcatcgtgcggaggatgcgcggcggcaatc

SEQ ID NO: 22948 - DNA, 121 bp, Chlorella protothecoides
tattggggagtttggccagccatggggcttaatgaccacaaaggcgagccatgaggcaaacgcaggagaacactgtgtacacggcctggcttcctctctatcccagtgcgcccagacgaat

SEQ ID NO: 22949 - DNA, 526 bp, Chlorella protothecoides
aaatgaagatttcaagacaccaaggaaattggtcacggtgaattcaaaaggaataaactcgggttactgcatttgtgactcgatacttcggtacttggtaacaaaatcgtgcaacgtctcgacaatgcgtgcgcctgaccatatgatctcctacggctgatcaactatgtctgtttccccgatccaatgatgaactcatcgtgttggcagcgattgctcactttaatatcctgtgccagtagtttcagggagcgagtgaaagagtctgcacaacttgtgctcgtgggcatgtgtgaagattccatgagaaatgaaggcggggtatgcagaattagctgtgcacttctatgcagtcccagttgtaacgtcttaatcgaaacgtgatgtcaatgcgtaacctttacgcctgtaggtagctgcatgggttgcagccccccagggtaagcaatctcaactttagagcacttcctgaacagaggggctgagctgcttgcacgctcgtgatttgggaactcggccattattg

SEQ ID NO: 22950 - DNA, 130 bp, Chlorella protothecoides
cgccaggttgaagtctttggacaatgggaggaatggattcaacgtcacattgtgcttcagatatacacatgggttgtcgctattccaaccgccagtcatggtgagcacagaatcaaaccaagcctttcaa

SEQ ID NO: 22951 - DNA, 72 bp, Chlorella protothecoides
ctggcgcgccttgccccgcaatttttggtgggcacccatcctcgtcttcccctccccctcttgcccccttcc

SEQ ID NO: 22952 - DNA, 66 bp, Chlorella protothecoides
tggtgcacggccctcagcatggttgcgcactccccatacccggcttgcagtccgctgttatggctc

SEQ ID NO: 22953 - DNA, 78 bp, Chlorella protothecoides
gcttgggcagcattggcaccgcatgtgcaagcgttaatccctgtgcctgctcccaaggaccccatcccacctgatctt

SEQ ID NO: 22954 - DNA, 61 bp, Chlorella protothecoides
actcctgggggcggcagcctgcgtgatatgcagtggaaggttgggggccgtccaagggtaa

SEQ ID NO: 22955 - DNA, 73 bp, Chlorella protothecoides
ggatgaggtgcacttcatgtaccagagggccctgaaggcgctaggaccacgggcccagcgcctgcccacttat

SEQ ID NO: 22956 - DNA, 87 bp, Chlorella protothecoides
ccccctcactaaaatttgcaggcgggacccccctttagaggaggctaggatacacaagtatgtcggcatcgaccccgggcggaccaa

SEQ ID NO: 22957 - DNA, 91 bp, Chlorella protothecoides
cccgcagtgatcgctgcccagggttgctgactgcgtacacctcccgctcaccccagcccagcccactccctccccgcctgcagaacatcgt

SEQ ID NO: 22958 - DNA, 61 bp, Chlorella protothecoides
gcgacaggcatcaaccatggctacaaaaggtgcaaacatgtggcatgagacccccctttcc

SEQ ID NO: 22959 - DNA, 73 bp, Chlorella protothecoides
aggtggggtccaagggatatactttcaagtagagccgtggcctcacagaaacggcaggcatgcggcatctgca

SEQ ID NO: 22960 - DNA, 61 bp, Chlorella protothecoides
gcttggacacctgtgctttcatggaagggtgctgtttggcgaatcttgcaagtttgcagcc

SEQ ID NO: 22961 - DNA, 62 bp, Chlorella protothecoides
cactgccgttgcctgatctgcccactggaggatgaaacgctaataggtgatcaaagtatcgc

SEQ ID NO: 22962 - DNA, 72 bp, Chlorella protothecoides
ccccagccgccagctcgctcacaagatcgcagacctggcgatggggatgaacaggtttactttcagcacaga

SEQ ID NO: 22963 - DNA, 91 bp, Chlorella protothecoides
catttctgctcgggagtctttcagaggtctatttccctccttacaaacttgcacagtaaatctgtgcagggcatcgcccttgtgatggatg

SEQ ID NO: 22964 - DNA, 1336 bp, Chlorella protothecoides
  modified_base (510)..(519): a, c, t, g, unknown or other
gatggttgacagtctacacactcaagccttgatcaagtctccaagattgaccaacgtatctcacaccttcggcatcaactgatacggaagacgaattgtcaccttgcacgcctcagcttctaccacacttgctggaccagttgcctgtgctcacaccttccgcatcgattgggacagttggggtgcttgacggtgtccatgccttcagcctgaacaagtcccagacaaacaattgcacgtccacacggtaccaattctgagagagatcccacgattgattgctggccaacgtacctacagctttaacagagatatgatagacgatgggtctgctgtcttcttcccttacgacgacaggttcctgcatgttggcaattgagagccaccattcggcagtgccaacttcttgcatctgagcacgcaggagttgtgaccacggtcttactttttacagacaagacttgataatcccacgttgtaggtcaagtgccaagactgggtcggcttggnnnnnnnnnngtgttccatttggccagcattttgagccagtccaatctcatacttccgtgctagctctgaatgggtgactgttatcaagtatgttgaagtgctccacaagcaaggatggccactttacatggtgcagtccttcgcctagccttcgacacctggtgttggattattgatctcagtcccagctcctcaacagccactggttcacctttcccactgccagttcactcctgcactgactcagattttgagacaccagggacttgagactggatgtagccaagacggagcagacagcaccctctccaagtggaattgaccagtgtgaaaggagactgcaggtcactggacacaaggtccaaccctctgatggaacgcaccgactgacattggacatgcccagatgccacttccagcttctgttcctatcacagatgcatgaaaacaagcatcatggctgggtcctgaaagtgagcttggtatatgttcatgggtagtatgcgactaggctctctttgaggctccacactctgttgctacatgaaggtgtgtcgtgtgtttgtttggtagacaagtgaggtaatggcttgtgcattcctccactgacagtggatcatcacagactgtacgcaaaccgactgaggagactggcgcatcacttctccacccacgttttgttgtccacatcaatgtgtcccatgcacgagcatgtgtgagactgtctactacttgcacatctttccgtctgagtgatgacaaggcgcagttgccctctggacaatgctccacctcggaggagacgtgaccgaggtggttatcttca

SEQ ID NO: 22965 - DNA, 131 bp, Chlorella protothecoides
tttgctcagagcagtgaggtgacggatgtgaagtgtcgatgtgagtgtaaatctgtaacagagcaagcatgtcagtgatcatgaccgtgatgatatagacagatatgatgtcgaggtcagtgagtggtatg

SEQ ID NO: 22966 - DNA, 121 bp, Chlorella protothecoides
tgttgtaggtttcgatgccgatcggcatgagatctcgcgccccgagttgttggtctaataaacacttgcaagttctctacaacattgtatgcaaataatggacaattctcaagtgcttgtg

SEQ ID NO: 22967 - DNA, 224 bp, Chlorella protothecoides
ggaggccgaatttgtacgttgtgatcgaggcagagcagacaaggtggatgctgtaaactcagcagcctctcagtgcatagtcattggttgcagtactgacttcacattaaccgagaagtgcagaggcgtacggcgtcttgtcttcacgccttagccctccttgcaccgaatcactctacactgagagcatctattccaatctcatcatgagcccgtccacctcc

SEQ ID NO: 22968 - DNA, 61 bp, Chlorella protothecoides
atctaaatttcaatcagacgatgcggcaggacaggactcacatcggccacggctgggaggg

SEQ ID NO: 22969 - DNA, 61 bp, Chlorella protothecoides
ccatgtagagtggcaaggagtggcggcagggaaccaccagaattgggcacgattccaatca

SEQ ID NO: 22970 - DNA, 67 bp, Chlorella protothecoides
gccatctgtgagaagtctggggaccaggaccctgggacctggaccggggcgggtgcagcggtggata

SEQ ID NO: 22971 - DNA, 107 bp, Chlorella protothecoides
ctttgtgtcgtgcgtgattgtgagggggaagggccggcgcattctgcacgggcacagccgagattcttgagcgtaccgtgctgcagcccgccgtcaaccctgccatc

SEQ ID NO: 22972 - DNA, 84 bp, Chlorella protothecoides
accccactggtgttattcaacaccacctttttggaaactcaaaagtcattgatttgttagcagtgttgtgaaaataaaccctgg

SEQ ID NO: 22973 - DNA, 85 bp, Chlorella protothecoides
tggaaacgaggagtttgatgtgtagagatttgataacagatcaaatacagcatagtttgttgatcgtcactctagagtaggctgc

SEQ ID NO: 22974 - DNA, 80 bp, Chlorella protothecoides
tttgttgatcgtcactctagagtaggctgcaatgagttgttctgagcccactcaatttaacgagactctttgtaccttct

SEQ ID NO: 22975 - DNA, 64 bp, Chlorella protothecoides
caaatacacagggccccacatatggtgcaaaaacacgagggaaagagttcacaaggtgttgctt

SEQ ID NO: 22976 - DNA, 123 bp, Chlorella protothecoides
gctgagctggcgtggaatcgtttagtggcaaagaaaacttctgcgggtgtggcttaacaccctcggacaagctgctagcgcgcagtgtgcggtatcgccaggtccaagagggccatcatcaca

SEQ ID NO: 22977 - DNA, 5231 bp, Chlorella protothecoides
ccggcggcgtcggcccccgccgcctcggcctcgcgcgccgcctccgcggcctcggccgcctgcacggccaggcggcgctgcagctcctccacgaaggccagggtgttggggtcctccaggctggtgatgtacacgtgctccatggtgatgatgcacttgatgaactccaggttgacaaccagcgcatgctcgcgagccaggatggccgaggggtagctggccgccaactgggggtccagcagcctggggggttgaggacgaggggggaagggctgaggttgggatgttgggggaggggaccttcccatgggtgccaggggtggtgatcgtgtgccctcgtcatacctgcaaccaggccaccttccctcaccctggtcccgccccccaacactccacacacctcagatcccggagctggacccccagctggtgtgtcacgcgcagctttgctagctccaggatgctggcctcgccgtccgtgcccacgctgagccacttgcggagggcgttggccttggccagcaccttggtggcggggttcttgcccggggggcaatgggcgacaggggcctcttggggacctttgaaggacagtacatccgtcagggtggcagcgccggtcaccatgccggccaacccgcagttcacatcggcggtgggggggggggcagcctcggaggctcggagaccgtaccgcacacctgtcgaatgcacaggcagaccggtgcgacgtgactgatgtacgtgaataattaaaggcgaattggatacctatgtctgtccccagcttcttccaagctgggtggctagccggagcatctacgccccgcccgagattcctggtggtggggggacacccgggcccccgggatgaaagccttatgtggaaagatggccacacctggaccaaacccccctccacacactcgcttctcctgtggctatattcacatcaaaaacacggcatggagtaaataaaggaacgtatttccaaagcgaggccctgcatgcgagcgtgcgcgatggggcgatgacatgatgtcgggggagggagacagagcggagggttgacaccagctccagcagcaatgactcaagagcagggtacgtgcgctcagtgcgcgggggcgcagtgtgtacatttaaaagagattattctctggagcgtgaaggaagtgggggtaggggaggggagagggacagcagcaactatggcacaggtcccagagcaggggaagcaggtggcaggggcaggtgatgcgtgggtaggatgagaatggcgtgatgctaaatctacctagcagatggactttacttctgtgcagctgggcggcttggcggggctgccctgctgctggatctccagcatgtgcttctcccagctctcctgcgaggtttcggggttttgtaggttcagtgacgagaagtgggcggcccggtttgcctcccacaagcgcacaccctcgaactcaagcctcgcaccgggctcacctcgaacgactgcttgaggaagtgagtgagccactgcgcgagcttgttggtgaagagccgaagcgtcgggagggtggaagggatgtgcgcctctgccaggctgtacttgcagctgcccagccaacggcctcctgcggccagcgggaggtcgagctgggccagcggctcggtggtggtcgggtgcccaacctcgacgaccacctcgtgggggaggtgctgcaggcgaattctgtgcgagcgagggagtgaggcaggcctcagaggtcttgcaacactgaatccaaggtagccctccagcacaagccactgaggcctcgcaacaggctacctgcggcaaaccccggcacgggactcacatcagggactgcacatggtcggaaatgaggctgacggggagcacgaggttgtcgacgctgctcccgcgcaggatgaggcatgaggccaagctgcaggccacggagcacagccggtcgccccgcatgtcggaggccagctgcatggcgatgctctcctcgagctgcggggggcgcagcgggggagtcttgagcacagactcacaaggcaggcgtcagccccgcgacctcaaacccgggaacgaagccgcacctcgaagctgacacgcgacgtcccgggcgtgaacatggagtgcatgatgtgagctgtggagtacacggacgcgtccggctctccatccgtcttcgaatgggacctcatgctggcaaaagcggggctggggggacgttggccgcaagttggtttgatcaccgacgtgagacaaattcgcaacaaaccagcgtgagaagatcctttgcgataatttgcccgctacgtatctgaattctggtggcctcgggtcccaccgcttggtcagggatacactaggctctgtggccagattcgccttggggctctattatccaagaatcgggtcatgatagaaagtaagaactgcaaaagattttgtccccccttacaggctcgagctgcacgaaaagacgggaagaacgttgtattgccaacgaccgtcagactggcatgtgactttgtcattcgttcctcgcgtaggttgtcgcgatcacctggatggaccgacgcggtcctgtcgggcagaccgaggagggcagcacatgaaatttcggctctcaccatttcataagtgttaacatagcatataagatttttgacacaagacccatttggatgcaatctggtttgaaaggagccagtgtgggatggaaaaccaaggtgcaatgcgctgaagacatataaagccggggggcggcatgccccccatggtgtcaggcatccaggcaggagctgccgtactcggagggaaaaaaagggggaccgccattgcggcggatgtagaggtaggggagtggttcactggaaaaggcatagtgtgcagcatacatgcagttccattgcattcaaaactggcaaaacagagcagtgtactgaccgctccaaggtagattcatatactgtagcggggtaaattggcctgcttaattgttcaggcgggcccagctctcctcccagtgcagcccagagctggccgtggaggatgttcgcagcaaaacattgagctcatcaaaatattcctgggggtggtagggtaacgggttaaaaagcacggcctgggcctgggcaccgtatccctccacaaccaacatcacccgggtggggatgacaccccttaccaacagcacacgctccatcctaagatcacccacctccagcctctgcttcttgaggtgctccatccagcgttggagctcagacacgaacgccttgcacaggggcaggcgaccggcgaggactccctctggcgctgagaagacgcagtgcacgtcaggaaagccttccaggccgtagcacaccctcatgccattggaggggccaggcttgaccacgaatacaatggcaccatcctcagcagcttggatactgcgggcagcatgggggccctctgctcagatccaatcccacaggcttcttgcatccaaccggcagcacagacatgtcactcataattcaatgtctttgggactgccacgagcctctcacctcaacccggtgtccggtggtaggaagctggtgtccacctcctcctgtgcgtcccactcatcagccaacacgagggccaccgcatgcgccaggcagagctgggggcacaaatcactgtatatctcggtgcaaaggctctcttcgtcatcagacatctacgccgggaggagtgggacccgaaggcggagcgtcgagcgtcgggtttgcggggccgcattctcgagcgcacacccccagtcagtgggtacgagtacgaccatttatgtgaaactcaccgacaaatcctcctgcttcaaacaaaagggagatgcgagcccggcccacgacatgggtgttgggtgacgtgccgacgtttctgcgcccttcgcaggggtcgcgctgcacacgacgggcatcgggcgagcacgccccggcccgtaaaggccttgatacacgaaagtggctacaattcaggggagcgcggccgttggcctctcgaataggtctcgtgtgtacggattacaggcgcgcgggggggggcgacgggagctcgcccgtcatgcacagcatacacccttggtccgcccatccacgatagaccatactatccctgcctattccacagtccactcccacctataatttggaactgacttgccttcccacggcaccattactatgtgtttgcgacccactcacatgacaaccttggaccacaggacacttgcccctccctcaggtataattaccccacgacttacttggtaaggaccttattcttgacagtctgtaggttacgttgcatattgacagagtaaggtcatccaagggccacacagaccggaggttaagtgcctttaaaacgctacctctcccacccccctgggcgaccctgtaacaaatcatccacctctgatcggcattactcggacactgaatggccttgatcaggtttgcgcaccatcgcagaggagggtcaatgccgttgagccttgagcctcatgactctcctgcctttactccaagttggtgtgaaggttgtgcacactggcagagatcgtgacctctcacctgctcaaggggtagctgatgtcttaggctgttatgagggttcctcttgaccggaccactttcccactttccacctgttcccgctctgcaccgagtcaatgccgccttgcaacgccaatggttatcgcatcccaaactgcattcggggtctcgtcagtaacattcctaaatacggtcataagcagcggtgcaccgttgcgggggcttgtcagcctccacagcagggaccgaagctccaatcgtcacatgagcagaacctccactgcaggaaaggcttcaggagattgtcaagcattccttcgttgaaagctttgactgccattcgtcggaaatggttaccatgcaagtccaacagtacttttcgttagggttgtactgataatccggggtgttggtataagtatgggagtttggactgttccatgtatatgactttgtaccatttgtataaatttctattatgtccaaataataatcagcagcaatcacagtgaaggtcacttttgtgccactataatttaccacctgtagagttggggcagggagggttcgtactggtggagacggagggggggtaggatgagagggggcaggaggggccagaagggaggggggcggag

SEQ ID NO: 22978 - DNA, 134 bp, Chlorella protothecoides
gtgatgaggcatcggccaaaagtgccatttccatgatgctcaatgccaggattggcatctactgctacttccggctgacgatacagactctttccatttctgtcgtgcacagagcactggcggagcttcgaagg

SEQ ID NO: 22979 - DNA, 61 bp, Chlorella protothecoides
gcaccttcgccaatcggaggttctacaatatatacaatccaatggcatgcataaactggcg

SEQ ID NO: 22980 - DNA, 78 bp, Chlorella protothecoides
gaagtcggctgcgcctcagatggcagcaggggagctcatgccgttggacaattgtcccatgtaacatgtagagctact

SEQ ID NO: 22981 - DNA, 68 bp, Chlorella protothecoides
cccagtgggcaccatgcccgccagggaagcacttgctccatcattcccaatactgaccgactgacccc

SEQ ID NO: 22982 - DNA, 77 bp, Chlorella protothecoides
tcggtccatgctgcactgcaccatttcctttgggttcttcgaagtatgccctgccttggacccctctggtcctccat

SEQ ID NO: 22983 - DNA, 62 bp, Chlorella protothecoides
ggaaaggcgtaggtcttcatgggagaaatcattttgggaatgcatcctgcaagaatgcagca

SEQ ID NO: 22984 - DNA, 372 bp, Chlorella protothecoides
  modified_base (102)..(237): a, c, t, g, unknown or other
tttgggaatgcatcctgcaagaatgcagcaagcatgtgtcttgacacgttgcagggactcctgaccggagggtgtttactgtcgggaaaacgtggcaccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactaacccccttccaacatcataaatcaacgtgtctacttcgtttgattcgcatcaggatttatgaacaacaaccccttgtgtgtttggcctcactggaaagaaacttatctttgccataggttcccgaggga

SEQ ID NO: 22985 - DNA, 73 bp, Chlorella protothecoides
actcaaaaccatggagatgcatcatggtgggtgatgcgagggtggcaccatggtggaccactcgatgattgca

SEQ ID NO: 22986 - DNA, 75 bp, Chlorella protothecoides
gcaacgtccggtgcccatgggcgcctggcttgacaattccggtctcgatcccatcagccggtgcagcaccacata

SEQ ID NO: 22987 - DNA, 61 bp, Chlorella protothecoides
ctggtctgcttctgcagggatggcagggggttgatgggttcgacgactccccctgattctc

SEQ ID NO: 22988 - DNA, 61 bp, Chlorella protothecoides
tgtgtgctgcttcatggccgcgtacgagggtggggcgcctgctgccatgaccacatggcgc

SEQ ID NO: 22989 - DNA, 143 bp, Chlorella protothecoides
ccggctcttctcgggcttcttggagatcttggaatgtgcagcgaatgtaaatgaataaatttactccatcaatgctgtcatcacccggttcattgatattcatgccgggcagaaggttttccacccgacacaatctgattcga

SEQ ID NO: 22990 - DNA, 61 bp, Chlorella protothecoides
ccgccatagaataattcgactcgcatgttagtttccaagtggtctccctgcattgagggga

SEQ ID NO: 22991 - DNA, 2302 bp, Chlorella protothecoides
  modified_base (305)..(314): a, c, t, g, unknown or other
tccggcgtccggacacccacccgtgccagcttcacgcaggagaagaatctcatcgtcaggcaggctccgccccccccgggagcacatctgcacaaaggacttgccaatactgccagctaccactcaaagggcagtcgggagtgggaagaacttcgtcgtgcatgcaccctgagcgtaagggcgaggacgtacgggggtgtcacaaagcagttctagcacctattgcaaggcgaacccatctatatgagtattgcatgcacaagatctcaacttcacgtacccttgcgaacactccgaggctgagnnnnnnnnnnagtgctccagacggagggccgcggttgcggcgccatatcgacacgcacacctagttcacaatggggtaccttcactacttggaacttgaaggaagttatgatggaagagtgagcacccttactgtcgactggtgggttatctttgtacggcgacggcatagtccctcaacacgttttccatccggaaccggaatggtttcctgcccgcccggagctatcttttcttttcccccttcgagtcacggagccggaagtattgcccccgacctggttgcgggtagctcttgttcgagtcccacttcaaagcctcgggggatctcgaggggcctcgctccgtcagaggtgcactgtaacccacacactttccagtatagtggcccttacagcgtcactccaaggcgtcttatctcaaattcgctcgggttggatgatccagcgcgggaggctaggtcaagaggagtgtgctgtggatgaacgggatcctcccgtcagactccggacggacccgcttaacgttggcatattctctccggagtcacgagcatcttttttgataacattcatcgcgacgcctcatcctgcttcggtggtttcatttacaaagatacattctttgaactggacatctcctcatagacgatggcttcggctttcgccgtagggtcgatggatgtctcatctccacaggtactaccctccgttgtcgtcgggatctgtacgcaagcctcgccatcatgactcaatcctccagggaagcgcagatcctgacttgcagacatcagagcgggtcacacaccgctaatacacagttgacttcgtgcatctgtaatgatgaaccgaggctgcctctgcaccccgagacagacctgtcctgttatgaaaaagacgtgcgggtcggccgaatactactcctcgtgaacagcagtagcccaccgacactgccgctgagcatcccaggtaacccagtcttgctaccagagggtcatccagaggttggcgaggatcacaagaacttttgttcaagcctcacgttattcacaggaaaggggccataggaggagcaagttacactccacaaggttgtgctggaagctgatgcgccggtgacgcccgcttggtcggctgaggccatcccctaacagcggcacgtcaaggacagagcatgccgcaccactccagtcctgagtgggggggtggcaagatgcggcagattgcttcttcatggagctgaaggccagggtaacctggttcctaccatgcacatcattttcttgtccacaaagataccagcatgcaggcgggcagtgcgtgcgcggcagcagtgccttccgacgggcaatgaatatgggggagccgccctccccaccccaagacctcgacgggcgggggcactgggcacaaccgatatgtgcaaaatgcgtcccatcgcccgtgcattcgaatttttaccgtaactgtagtaatttaatacaacactctgcctcgtgcggcgcgttcgcaccaacgagacctgggaaagccccgcaagatgcgaaaatcgatcgaccgagcgaggggctttcgcaaccaaacaagcagtaaaagttctaaaaaaagtttgtttgacgagatgtcggtttgaatagcggtagaagtgggcgttgggactcgtcccgggggtccgatactgtggcaaaagacggtaagtcgataggccggctccccaaactatattttaacatgcagagagccctcgtgtcgcacactcctcccagatctataaaacgattccgtgattgaagtgtttcgcgaagtcttccggggtcattcccttcttcatacgcacgaccgctctggccatgcacgcctgctaccatggcagggcaatcgccgggccgtccctgcacacatttttacgaaccacgcaccctcccagacgatcaagatgcctgaatcttaggctgtatgcccagagcgcagtgctgctggatgtacgggacttggaggcc

SEQ ID NO: 22992 - DNA, 72 bp, Chlorella protothecoides
gccagctcagcttgacggagctcgtcctcgtacctgcgcccatactcgcgagggtccagccctgatggcagg

SEQ ID NO: 22993 - DNA, 485 bp, Chlorella protothecoides
  modified_base (139)..(351): a, c, t, g, unknown or other
gtgaccaaatgggaggtcggtgggtgtttaaggggggaagggtggggaagagctgaacggtgccatgccctgatgcatgcccgggcgggccccttgcgctgtgcaactgagctcggctagcatgcggcatttgagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacgccgggcggggaggcggcaggcatggtgagtgacgtgtgcacccgtgcttcccatggaaacacttggaagccaatgccagagcaagttgacgggatctgtaaacaataaggcacactctgaccgatgcac

SEQ ID NO: 22994 - DNA, 80 bp, Chlorella protothecoides
gccatcgtcccatcaagagcagtgtgtggtaaggaagcatggttccggagccatggccactctcacgcagcacgcgaatc

SEQ ID NO: 22995 - DNA, 828 bp, Chlorella protothecoides
tcctcctagctggtgcttttatggactcatacagtccttagatctcacctttggcagagggcgtctcagaggcacgtcctacccaattccacacggtaaacggaagcatgcgatgacgtctcataggtttgggcgttactctcactgcttggtgagcaatgatgacgtttaagcatggaaattttccatagtgaccagttgctcgacttcttgtcatccacccgatgcgtgctgtagcactactcatcaagagaatatgtgtgacattcgaaagttttctgcccacccttggtaagaaatatggctaccagtcaggcaccaactttactgtacattacgattgtctggagaacaggttgccaggttgcagacgccacaaccgacagaagagctgcacacttacttctgaaatcgcacagatgacttcagcatgaagagtaagaattctgcagatatcaacgtgttttcgtgatttgtgcatacttttatgagcttcgctattacaggcatatgtctgagtgcaggatcggtatgagaccagaggactaggataagggctccagtgcccttcgagcgagtgcttagcccctacgaattgcattcacatagttcctcgagatgatgtatatctgttctcaccacggccatcgttttatgttgcagtgggttctttcacgattactttgttagagtgccctgcatgtcatttgctcgaccatgacgagttgagcgattatgtgtgcgaactcatcaattaatgataatgttctctatctcctcatccagtctgaagcagcggacaaactcgtcacaagggacagcgcatgc

SEQ ID NO: 22996 - DNA, 356 bp, Chlorella protothecoides
tggggaaagaacaacataggccacaacaaccatggcaatgacaacaacggtgaggggattgccggtggtgcaagttgcttggaagaatccctctgatggacctcatcatgcatggcaaatgatcatggccacccgctctttgcactcacaccactgcaggaaacgacaaccacggcaattttgccatcggaagcgagaattggggagactatgtggtgtgcaacaacttggatatccagggcggaagcgcttgccagttgaaagacctccagactacggagacagtcttcatagaggctccctcccctgcacctgtggcccccagacctgccccggcacccagcccatcaccttct

SEQ ID NO: 22997 - DNA, 61 bp, Chlorella protothecoides
ggtcccggaaggcaggtgcttgtaaacgtcataagcaatcagttccggggtgtaggccagc

SEQ ID NO: 22998 - DNA, 63 bp, Chlorella protothecoides
ccaggacctcgcgggtttgaatgagcccaactcctgccatatgtctgggaccgtggtggactg

SEQ ID NO: 22999 - DNA, 282 bp, Chlorella protothecoides
ctaatctatgcacagcattggggaatacagtatgcgctgcataagcccctctcttagtcttgtggtctggtaggggtcggaaccacctttgaagaatatgactccatccatgggcagcgacatgatcccatcgcagtgtgtgtgtattattttgtactgcccctcatggccgtctttacacacagacaaggaacattgataccgcaaggcaacttcgtttgtatttcatatttcaccgcaaaacatcctgcgtatggttcgttcataccatccagaacacat

SEQ ID NO: 23000 - DNA, 112 bp, Chlorella protothecoides
cccccccccgattctgccagggtggcttgtcgtcggagcacgctttccagccgcccaatgcatttggcggggacccaaccatgaccatctccacgcatgctgcgttccaggc

SEQ ID NO: 23001 - DNA, 8070 bp, Chlorella protothecoides
  modified_base (159)..(221): a, c, t, g, unknown or other
  modified_base (6918)..(6980): a, c, t, g, unknown or other
gagcaggcggcgggcgcccggctggaggcggtgaggcaagactcagcacgcgcggtgggcgaggaggctgcgctgcgcgtggaggtggagcggcgcgaggctgcgctgcgtgcagagctggcggccgcgatggcggcgggcgcccccccccggggccgnnnnnnnnnnnnnnnnnnnnnnnnnnnnnnnnnnnnnnnnnnnnnnnnnnnnnnnnnnnnnnncgctggaggggcgccaggcggggctggacggcgagctggctgccaagcaggcggagctagatcgtttgctggtgaggaagaaaggtgtcgtgcatctgggataggtgtgcatccttagcgtggggccacgctcgcacctacacgcctcggcagcgtccctgacaaagtttgcggccccacctcgctcgcattccctgtctttgctgaggcctcccctaccccaatccccgtggcctgcccaggcggagagggctgcagaccacgctgtcgcccaggccgaggccgaacaggcggccgcgcgggaggccgagctccggggggcgctgtcggcgcagctggaaagcgcgcgcgccgagtggcagcagcgcaccgtcgagctggagcgggcgcttggggaggctcgggccgccgccgccgcggacctcgccgccgcgagggaggaggcggagcggctggccgtggccgcggcggcgcgcgaggcggcgctggcggcgcgcctggaagccggcctggcggccagcgctgagctgcaggaaatagccgcagagcgcgagcgggagctggcgcacctgcaggccgtcttgtgcggcgtagagcgcgagctggccgaggcgcgggagagaagcggggaagagctgtctgccgccctggtccatgtgagtcgccacagcggcggtgccggcggccgactgtggattttgccgttgaactcctcctggccttgcgctaggcgtcgctgtcaaacagggcagcatgactcgcggtgctcagattgtgtatgtcaaactgcagcacacccttttgcttccccttgcaggccgccgccgagaagacggaactcgaaactcggctggcggctgcggaggctgccagccagcatgtgcgtgatggtggcgtcggtgtaaggaggccaaggaacttgcggtggtgctcatccgcaccggccatgctgggacccggtcgaggtggaaagcacgtcccaggccatccagacccctgctggcactcctggccagcccccatctcataggatttcccccattcacatgcatgcaggagcgggccaggctggaggagcagcgccgagccatcgagcaggagcgcagcgacctgacccagaccatcgcagcgctgcgccgccagcgggaccacttcagcgcccagcagacggagtacaaggtgcagcggggagaggcacgagaggttaggggaagagggggtgtctgttcgcgggctgcatgcatgcacaaaaattgatggccatcagccgctgggtcaccaagtgagcacgcagggggggtgctgacatgagcggtatacacccgggcaccagaatggtcgccacgccatctcaaacatgtattcaagtcgaagcctctgcgcgaggagatggcgtgctcacatgcactgctccctctcatgcacacaccactttccgccacagcctccgctcggcagctccaccacctctcccacttgcatccgtgcagcgcctcatgcgtcagtacttcccgggcatgggggccgggaccctgctggagagggcactggctcgcaaggtggatgccgctgcgcaagagctggacgccctcgtggtgccggtccagatccctgccggcggggtttgaggcgcagacccctccttgccacatccagcttcccccaccgcctgtccacaccccttcctcgcagcctcctgcattgcacaccagccacccaacctctgcacctctgtgtcacgcgtgccgatgggctcgtactgtaacatgacagcaccagacagacacctcacttccccttcttcccctccttccgccgcacgatctcgtccgagtagcgcacgcccttgcccttgtacggctccggcggccgcttggccctgcatgggggtgtagcaggcaggggctggagggagcagaatggagcacgtggcagccatgcaagccgttccagctggggcaccccctcattcccacccagcgactctcaaccacaaaattcgccatcactccctttcccaacccgcctggcccaggagtcctacctgatggtcgcggcaaactgcccgacaacctccttgtcgtagccatggatgttcacggtggtgttcttcaccacagacacctgccggcagatgcggtggggattggctgtggacatcctctgagacctgccccggcagcatgtgtacacagcagggcactcccatgcatgcctacctccacgccgcctggaatagccagctccaccggcttggagtagcccagattgagcgtcagcttcgtccccgagactgcggctcggtaacccactcccacaagcatgagcgtgcgcgtgaagccggtggacacacccaccaccatgttgttcaggagcgcacgggcgaggccgtgctgggcacctgcctcccgcgtctccacattacggaccagacgaatgtcaccattctcctcctgcagcgccactaggaagtggtgagagaagagggtcctggagggtggggagcagagcaccaccgcagcagtccccacgcacgcttgccacagctcaccctcgacaccgtgacgagagtggaaagagtccgcgcgagctcgcccttgggaccctgtggacgtggattcgtggtacacggttcatggatgagagggtagtcacatcttcagccagtgcgggcctttccttgcatgtcctcgcccaggcccaccttcacgacaaagttgtggccgtccagcttcacatccacgcccttgggaacggggatcgccttgacaccgattcggctctctttgcactggatgaggcggctgatgctcacacgcggtcggcccacgttggttttgaaagcgaaagccggagcagaggatagggcggaagccatggctccctgacacgactgagcactccgtccgctggactccacctgttgttcgacaagtactttgcgagtgtatcttggattgggtcttggttgcgatgccaggccacccgtctggctccaaacttgcgccttatcttcacctctggccccgagcgcagcacggcatgcatggtgtctgcgattcggaagcgcaccgatgtcggtacgggaggatgagcgggggcgggccttcgattccccaagtcccctcgagcgatttcttaaatttgcgactggtataatgcaagcagcaggcacagcgtctgtggctgcacgacacctgtgcctagtgtctagcccaggcccagggtgcgccaccccagtactgctgcatctgattcgccagttcctgagccacgcctcgtcaccaccggtacttttcttgtgcgttagacagactccagccttgtgggcccaacacctccgacgagcgggagttggggtgcaggcgcttgtgcaggcacaaaggttgcacatcgtagattatctggctgtgctggggggggttgaagggatgcctccaggggcggcccagggctcgaggtgcgatggcgcagcaacaaatccgcagaggtcgctgctcagcctggtgtctggcctgcgtgactccagcgggcaccttgtactcgttgtcgacgacgtcacggtgagaggtgtctgccttgcatcgacgccccacctgcgcccatcagggctctgtagcttgcacagtggcgcgctcagcaagcgtattccccatccaccgagcctcaccagcatgtgatcgtccatcttgcagttgctggcaggcacattcgaccatgctcttgcctgggcttcgttcctccatgccctgcagacgctgcccggctgtcagcaggtactgtgaggtggggcctgtgcctctggagtgggtggcaaagatgctcagccactgtcgccaatcgcatgatgaaacccactccacttctcgtcacactccacacagcaaaccaccgtgctggggctctcagccctcgagggtgcagcatgcccatgggcggacagccttgaacatgcctcagatgtaggtcgctcctttgtctctcaagaaaccatgcatgcagtagactcccacaggtggcaaccagaacaacagtcatcaatagtagcaagcgtccatttcacttgcgcacgctgagcccacatcccacatcccttcatcgcaggtggtcttggaggtggggccccggccctcagtgggaacccaggaccgagccatagggatcgacggcttctggcgcagagacacgggatctctggcagctgacgcgctggcagtgcttgcaggcaaacaccaggacacgggcgcgcggtctcgggtttccctactgctccaagataacggcttgctccgagccaccctctgagctagggtcgcggggtctctctcccaagcccgtgcccctcatgtctcggaccttcacccctgcctggcccaccattggccccctctccagccttggctgctcactgcccatgccagcgctcgagaggggggtgattacagctgtacaagggtgctcggtctgcagacgcacccggcacagggaggggcagtgcatgcgtgcagacaatgggactcggtcgccgtgctgcacagctgggttctacggcacgccgacgcggtgcggaaggcagcggcctggcgggatgcgaacggagctcaatcagtgatggccaccagaggaaggcaggcgcttgaggacgaagaattcgccgccctcgatgatctgcttgggcggctggccttcctccacggtgccccaccagacctgcacgtggcagggaagaagacatgagagagggaggcgggggtgcgccgcgccacctcgtcgcacatatgcaggtttccagcaagctgctcctggatggcattcgcatcagcaagaggctgacggccccaatctggctgcatcaagtgctgtcgcatctgtcgatcacgccatggttccattcgctcaccagggagtcatcatctgggtctgccactccgacaatgcgctctgagaactcgctggtcacttctacggggttggtctccgtgccaaatggggcatccaacctgcggggagcagatccaccagtcaggatctatgcgcagtcgtgcacccaagtcgcacgagaacggtgagcacgaaggcgctgaagaaggcgtagcctgggctgccgctcacatggcgtgacacggcacgcaatgcagctgagctggaagacgtcccgtttacctaccatgcctcgtgccacggattctcgacaccctttgccttggcctccagctcctccctgcagggtgcacaaagattgagctcgagcgtcggccgtcagcgcagcgagaattgcggaaagcatgttcatcgagacggcgcagtcacaccgacggaggcaagtcacgggccgtgccgacgcacctctcgggaccggtcgcgtgctcgatgtctgggtctgtgacagcggtgctggcaaacccagcgctaccccaggcctggcttagcttgtatgagcaggccaccaaggacgtctgcacgaaaaaatgagcacatgaagcagttgtggtcgccctggattcttctggctggggtgactcagtttcagcgggcgtggcaccgacgggtgtgagcaccccaggaatccaaggagaagcaggcatgatccctttccaatcgtaaacaccctgtaaccgtattgtgtcgtcttttcaggcaccgcgcacctgggtttgcgccgcactagagctcaccgcaggtcccgtccagctggcccttacgagggcagccagcctgagacaccggcttgccatggtgttccgcagtctcaaggtttcaggtgataagtacgggcgtggagcgtcttgtggaagggagcaagggccacgtaagtcctcgcttcaagaacaagctgctgttacgatgcagccttccggggacgaacgtcggaaaagttacagcaggcgagtgccaggttggcggtgttctcgggggggggccatgggtagcagggatgccatcggagacaggtcacactagtgcatgtcaaacaacgatctcaataggagccaaagtgcatgctatggccagcaccgatgctgctcagggcggacgacgactttcggacttgtaaagagatcgtggctgtagcagcttgactattccactcggagtccctcacacctttcccgtccaggccatggggaacccgcaaccatgatgcctttccaacgaatagaacaacaacgcaatcaagcgacaccaggttggtgtgaacctctgcgaggtagctcgactcaggaactgatctgaaaggccagcgaagacccggcgcccccccatcacctcccctgcagatgccctgcaatcaatcctacagcagcactgcctcctcttttctgacgttattccaggtgcttgcacgccatgagtgctgatggagtcgtcacagatgagagcatgtgatggaaaccacatggttgattgcctggacgctaacccacttttgtcggcgaccttgtgtttgtaccctaatctcctgcccagatgtgttggaggtccactctgaaacgcaaagactacaggcgaccctgcagggcttctcacacattcctgacgacttgggtgctctgaaacgagccctccatgcagtcatgtgcgcggcgaaaagttggtgtggtgcgctgcagggccaccgcgagctttgaccatggggttcacacggcctcctaaaccccgccgcccactgcgcagtgacctggtgccggagtctgcnnnnnnnnnnnnnnnnnnnnnnnnnnnnnnnnnnnnnnnnnnnnnnnnnnnnnnnnnnnnnnnatcccctccctggccatcctaaaggacgctgaatgcacatgtgagtcgcttgggggccacatgaaccatgctgccctcccaggccaccccaccctcccttgagtcagtcgctccctctcccgcacagtggctgagggtgatctgcaggctgctttggagctggccctgtcggcggagcggggcatctctcatgccctcatgtcggccgagaggtgcgtggtttctcacagacggggcttgcggtgcagggcccatcgcggagcaggggtgctccggtctgcggcttcccaaaccaacctcccctttgcctgggtcagggatgctgcggagtgcgaggcggcgctcctccgcgtccagaccgtgctgcaggccgtccacgagcgggcgatggcagcgctggactggcgcgatcctcgcccccacctcgtccgcctcatcagcgtggtgacttcgcccagccactttgtgaggtgagggtgcccctgggtcgccgcacccctcgccccagcatggcaccgtgctccacaagggcggtgttcatcgtgagcgaaacacccctcccacagggacctgctggagcgcgtgggggcggacgccggcctgagcccacaagacctgctgtccctgttccacgagtgcgctgtcaacggcgcaccgggcctgctgtctgccgcgcggctcggccaggccctgcagctctacctggcagtgatgaactgctggagccaggtggactcagcggatggcggggaggatgcgcagttggcgacgtgggtgaaagccgtggatgcacggtgcggcacggtggagaggggccgtgtggggcgatgaattgatctcggggtgggttccacagggcacggggcctgcctgtgagggtatgagacccactgcagcgactcgatgccctcccgcaggctgatcctggagctggagcgggtgctgcagagcagcgtggcgacagtcgtgctgtctggcctgcgccagccgcaggtcgccaaactcctggcgagcagctgtgctggcctgggctgatgaggagcctgagcagcagaggggttgttgtgggggttccccttgaccgggccct

SEQ ID NO: 23002 - DNA, 61 bp, Chlorella protothecoides
tgctcgaaaacaacatctccccccccctccacccccccctctcacacacctcgtcgtacac

SEQ ID NO: 23003 - DNA, 469 bp, Chlorella protothecoides
  modified_base (161)..(371): a, c, t, g, unknown or other
tataatcctacgtagtgtggggcctctgctatgatgaattaccaagcagaattggccagtgcagtggcacaaggtgctcgtacgggcaaatccagtgcacccattgcccacacccctccccctgttccccacatgcgcaacaggcgctggatcaggtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggttttggtaaccagctccaggaattgatgtggatgggaggagcgaaggcaagacgggggttgtgcacatctatgcgcagcactccacgacatcc

SEQ ID NO: 23004 - DNA, 19536 bp, Chlorella protothecoides
  modified_base (15539)..(15577): a, c, t, g, unknown or other
  modified_base (18112)..(18159): a, c, t, g, unknown or other
gccgccgcggcggccgcaccgccgcgtgccgggccggcgccgccgcgcgggggcaggcccagcgccttggcggcagcctgctccttctccagctggctccggtggatgggcagggcgtccaaggctggcaggtcaacccgctccaggccatcctccacccgcgaccgggccgagacgcggggcgcggcctccgccagggcctcgtcccgtgcccgctccagctcgctgacgtggaccctgggttgaagggccaatgcggggatgtgggtagtattaggagaagaccatgaaaaagggcctgaagcaaagccaatcggtgtcaccccgggttgcatgccagcgcggccccccgcccccccaatccccaccctccgcgccccacccacttgaggtcaaggggcccaacagcctgcgccgccagggtggtgccgatgtcgcgggcagacacgcggggggccgcctcggccagcgccgcgtcccgtgcccgctccatttcgctgcgcgccagtggtcgtggtgccatgcagggcttggagcgcgtgagaccaggggagcttggccgtgtgctcttgcccctcttctagtcaacgcaacaccaaaaatgcagcatcgctccccggatcgcacctgacgtggatggtgaggctctctgcaaacgtgcggtgcccaaaggccgcggccgtcgtgatgtagccgtcgtcgtcgtcaccgtcgctggtgtaggtctcagaccccgagtcctcctggccagcttcagcccgctggtcaccatcactccccccagcgctgggctgtgggccaggcccgccctgtgctgctgcggttgcgccgtcctctgcgccgccctcatgcgcgacctccacacattgccgccccggtccggccagggccccgctggcactatggctcagctgggacaggagctcaccgccatcctcttcacaatctgcatcctcttggacctctgtctcgccagcatcgaaggaggcacaggccgctgaaccttcagcttcctctccgttcccgttgctctctgcggtagcaaaggctgattcgtcagcctcagcctcaggctgtggctcagtcatctcttcagcatgctcctggatgttttcactcccttgcagggtgatgggcaggggcgtgatggggatggtgacgctggatttcctctccgtcagcagcgacatgtcgtccgctgcaccctctcctgatgccactgctggcgctgctgggctgggcaagacctcctccgggtaggctggcaggtcgaccatcaggtggacggtatggggctgcactgaactgtcggtgctaggagaatccgctgcttcatcgtgggtggatagctgctgcgagttgggaggtccctcctcttcagcagcatcacaatcagtagcgcccgcagcgctgctcgtcaccctggtttctccctcctcactagttgccacatccacccgctgaggatcctcctgttctctagtgatgacttcaggctcgggtgaggctgctgctgcttcctcttctagcacattctccgttgcgtcctgctctgcagcttgcgtgcaggtcccagactgttcagggtcccccaggtcggagggctgcagggtcagtgccgacaggtcctccaccacatcctctccagtttggtctgtactcaagactgtcctagatctggtctgcaccattctccctcagctgccgcacggggatctgtacctgtcgagacacgtatcgaggggagattccgatcagaaacgaagctggctggttcatcaggatcagcaccttgatttcgcatcccgtgagaccaagaattccgctacgagacgcagtactgcgccgcaactcctcaccagactctgacgaggcaagtccggttacgacctcgatcgctgtgccgcttcctcgcgaatcaatccgcctttgcacggatcagagctatttttctgccttgaggacagctgcgatggcatcgggaggggcggtgcactccaacctcttcccctccagggcggatgtgatctgtccctccccgaagcgatcggcgggacgagccctcccctttcatgttatccgagagccgcaggcatgcattacgttcgttggctctgcgcaccgcgtgcattcagacctgagaacgaaagcgtaacgccttcttctcatgccaatccatcgtgaactcgacatcgtcctcagagcttaccgcccttgttgtcggaggtgacctccggctaccgctcgacacccccctcatcgctggaggtttggcagtaggctgaaaccaatgcaacgaccatgtggggttgcttcaccacgtcaaggacaccttttagtctgcaggtaggtcgtgagcgcgggcaatcgctctgaacatctatgaactttgatgctgtttgcgtatggcacgacgttgcacactggcccccctcccaggcccacacaaaggcccttcacaacatcgaggccccgccctcttgacaagattagtaatgcacaacaccagacgagaggcggtagcaggcgaaacccagttgtccaagcggtggtgctcagcccatcagtgcagggcgcagcgccctctgctgaagcaggaaagaagggttatgacgccatcataataggtgcaggcatgggagggctcacagctgcctctcaactggctgtcaggggggccaaagtccttgtcttggaacggtatgttggttgagatgcaaatcggcctgtgcgactctgtgggcagagggtagattgcatcaggggtctgcacaggccctcacccctgagaatgatttccaagccttctcacatgtagctttggccttgactctaggtataccatcccgggaggctctgctggacacttcaagcgggagggctacacatttgacgtcgggagcaggtaggttggatggtttgtggtgaagtgtagaaggtgcaacacctggcacgggacattgcccttcaatcacatggcttttctccttctggacatgaaggcaattcaagtgcaccaacagccttactctcgtccccctcccacgcattccctgcagtatgatgtttgggtttggaaaggagggcacgaccaatcttatgactcgtgcactggagagtgtgggcaagcacctcgacacgattccggatccgacccagatacactaccatttgcccgtgtccaaggcgcatcccgacgtgaggctgcagaggtggcctttgtggtgttggcggagtggtaggtgagcagcagtgcccgtgtggttcagaactctcattcctgaaaatcccatcacactcagggtttgcatgtccgcgtttggcgtgactatgaggagtttgtggaggagctgaccgcctgcttccctcacgaggccaaaggaatccggggcttctatggcgagtgctggaaggtgggtgcttggtggccgtgccagaatggggtgagttgcgtttgtatgcctgatgggcatccattgtttggggccctggtctcccctatgcccactttgaaccccctggctcaaacacctgccgttcaggtgttcaatgccctcaactccctggagctcaagtcgctggaggagccacggtacctgctgcagcagtttgtcagggcccccctcgcatgcctgaccctggccgcgtatgtgggggtgaatgcaggtgacgtggcaaggaagcacatcaaggtatgtgttgagtttgtgggggccacgggttgattcaatggatggatacttgaactggtgcaggaaaacgcatgggctgttggtctctgtttaggctgcccatgacaacaatcttgctcctgcgtcctgacgctcctcacctcaacctcccccacctcaatccctttcccgatgaaccccaagtaggacccggagctattgaagttcatcgacatcgagtgctactgctggtcaacagtcgcagcggttgacacacccatgatcaacgccggcatggtgttctgtgacaggcactatggcggcatcaactacccaaaggtgaccatacaaggagctggaactttcctgctgcttccccttgtggaaacctccgaaggtaacacccagaccccactcccctcctcacacattccctccccaatcatgctgcagggaggggtgggccgcatcgccgagctgctggtggacggcatcgaggagcgcggcggtgaggtgcgctaccgggctggggtccagcgcatcctggtggagaatgcccctgccgatggcgacccaggcgagcagagctccagggccgtcggcgtggtgctcaccgacggcacggagatcaggtgggcgatggcaaccctgtcgcatgcccctcgctgctctgtggacgagcatggaatgtgacatgttgatgctcagggcagcgtgagcatgaccgcgagctcactcacaccgcccagaccaccctgcgatcccacaatccatccttgccagggccaagacggtgatttccaatgccacccgctgggacacctttggccggctgatatctgaggagcagatgcctgaagcaggtcgggcggggaggggctggaggtgggggtgacacaacggattgcatgttccatgctttacatgcgtggctgtgcacatttgggacttgcaacccagcagcaccccccccgtgcaccgctcctcacgaccacctggccccaccgcagagaaacttttccgtggacggtacaagctggcgccttcctttctgtccatacatgccggggtgaaggagcaggtgctgcccccgggcacagactgtcaccacatcgtggtggaggactgggcgcgcatggaggtgagtggctggcatggcctgatggacgctcatgccgggttcaggagggggatcttgccggtgcggctaggggatgccctgggggtgccgtgctggcacactcgtgtcatcgattccctcccgacaggcgaggctcatcgtgacgctctgctcccaccccgctggcaggagccgctgggcaccctgtttgtgtcgatcccgtcgctgctggacgcggggctgtcccccgaggggacccacctcttccacgcctttgcgcccgactgggtggctgactggacgggcctggagcccaaggcgtacgaggcgaagaaagagagaactgctgacgccatcttcaagcggctggaggccgcattccctggtctggcggaggccacggtgtacaggtgggccttggtggaggcggccgcgacaacgcccagccgacatgccaccttccactcgggcctgcgctgggtgggtgcctaccatgcacagtgcccagcccctggcagcacccaccaagcagcccactgatccctcggcacctcatcccactcaccctcccggtccccacagggaggtgggctccccgcgcacccaccgccgcttcctcaaccgcaaggacggcagctacggccccatcccgtcccgccgcccccgcggcatgctaggcatgcccttcaaccgcaccgccatcccgggcctgtactgtgtgggcgactccaccttccccggccagggcgtgaacgccgtggttttctcggggtttggctgcggccatcgcgtggcctgcgacctgggcttggagcagggcttcccagcactggacgggccgtacaacatgctgctgggggccatcagggaccgcgtctgatccagagcgttgtattgcaagggaagagggttgcagcagtgggaggtgcgacgagcagtcacgacgtttgtggaaggccctggcctgagctgtttcaggccggggcgggagtggtgtggcagtcacaggaagcccagggctcgcaggtggtcatggggatggtgaccagtcaggtgggaaccggatggcacgcgctcgctcctgcgccgccagacatcacgtgaagaccgagaggaggaccatgaggagcacccccaggatggtgtaacggaaggctgcggccgccagggcccaggtaacaatgagcagcttgatggccaggttgcccactgccaggcccagcatgcccagtagcaggagcacagccacgtcctggaacctactccttgcgccaggcccgcgctggcgagtggagaggtgaggtgagaaggtgtcgtcagggagttgggcactgctgtgtgccaacactttcagtacagccaaaaagcacgcagcgtgcatgtgggcgcttggaatggtcgagtcagcagcacctcgcccgcaaggcatgggcaccggccaaacaccccgcaatgtaccttggcataggacgcctcatcctctaggaggtcgtcgagctcctgcacggcgttctggttgcgagcctcccagtcccactctgggtccccctgccatcccgccacatcactgtcgagtggtaaggatctgaaaactgtgctgcgagggtgtcgagggactatgggccggtggagggccaggaggtctgacccgggtctggggcagagagagcggcagcccaaagctgtcctgctcaacattgatgcatctgatcaaacggcgaagcaagatattcaagctcaaagagtggtgaaacatgccttcgaccgtctgtcgcctcctcaagttcagaggcagaggctgacgagggtttcaacctccgcgcgcgcaactgtcccgggtgcgctggagctttgagtttgcggcgaggccctggcggaactggaccaaaatgattgatgtgctgtcctcgagatcggggcatgacctgtgctcgcaagggcatggcgttgtgattacctcgctcccccgggatacttcccgggggaggctagcaaccaccaccaagagagaggagagatgagtacctattgaacgccatcgataggatttttattcatgagttcaattaatgccctgatggcatcattactcacccgtcacggaggtgctgatgtccaacatgtccaacatgtggtccgccggaacttctgtcaaggagacgctgggataatgaggacgatgcgagggcagtgggcgctcatgtgaaaccactcaatggaggatagggattcgatcggccttgaggcgctccttcgggctgctcgaggtggaaggggtggtgaagggatatctctgaccacgggcacatcctatcatgccgacctgagcctgcgtgtccgggaccacaacaaagctgatcatcaccgctattgaacagagagggaggaagatgcccgggagagatgcacacagctggaggccgatgctgccgctcagtctgccaaggcccttgcagcgctgcaggttgtgggtggggagcagcagacacccatggtctgcaccaggagcgaggggtatcaaacacatcagaccaacggtattgtgtatcatgcagcgcacttgtgcgtcacaatgctgatccactcccaccaatcaggaggttgatgacgcacacgcaacgattgagggcctgcaaaaagaggcacagaacgcttggaaagccagcgatgccagtctcgagaaggtaaacccgtgcagcatccataggcatcaagtcagattccccccccaccttttcacgaccctgtaggtccacaggtgtaagtttcctgaccatatacactcgccagtcctcgccttcatccctcccgtccactccactccacaggagctgcaggccaaggctcagattacccggctgcaggtggaggtggacagcctgacccagctgttggagcagggcacggctgccacctttgccgacgaagccgaggtggaggagctcatccgtcagaaggatgaggcggcagcgcaacgtgatgcacacatggccgccgtggctgaacagcgttcggaagtgggtggtggctgccggggtatggctgaagctggtcataggggattaaaaaatgaaggaatgacagcggcctagggctttgtgagttgatctgcgcatcgctgcaaggtgaagttgctgatgccgtttcctccgggtcctgcccccgcagatcctcaggctcagcgagcgtctgcgtgcggcagagtcggagcgggcccttctggagggcgaggccgcgaccctcaaggaggcggcagcggagcagcgctctgccgccgagcgggagacacggcggcgggagcgccttgagcgtgaggtgaaggaggcccgggcgctgctggaggcacgccaggcagagctgagggagagcagggcttcggcggccgcggcagacgatcacctgcaaagactgcgggttgggaccaggagggggctcagtcgcgtcatgaggatggggctggggaaaggcatgccttgcccctgtgcatggcctcaccatgacaacgcccctcccacatctcgtcctgcctgcgtcaggtcacgctgagggatacgcaggcaggcaacgagaggctgcagaaggagtggaatcaggcaacggagaggagtgccaggctgcgcaaggacctggacacccagctggccggcaacgagcgggtgggcgctggagactacctttgtatccctcgctggccgtgtctgctggcctgaggcgcatgcgcctcccattgcgtgtcctgggctgttgtgcacgggcgccgagcgctggcgattggcaaatgcaatcatgtcccttggcatctgcaggcagcagcgggactggcagccaggcaagcagagctggaggccaaagtgactgccaacggagcgctcaaggtgaggatcctagctgactggaggttttaaaagagagcagggtacaaagcacattgacaaggtgctctctgccaagcatttttgcaaagcagacccacccatttctcatccccacaccccatgtcgactgcctcacaggctgagctcgaacatgcctgcagggccactgaggtggccgagcaccgactccggctgctggagcggcagaaggcagagctggagaggtcccatgactttctgagagtgagctgcttgggttaaaagtgtgaccattgttttctggttgacgttttgacaagatgagcactatgtcagggcataacagaggcaattacattactctatgtccagacagaggtggcaggcttagagagtgccctggaggcagcccagagggatgcgatgctgcaggcctttaagcaggaggccctgaagaaggagcatgagaggtggccatggatgatcgatgccgtggctgggagaggaggcattgcaacgcagcaaggaagggtgacgagcttgcttttggatcttgaatataataaccactatgtacattgctgggtcccacgccaggctcatgagatcccggagtgcagctgagaacactgcacacgtccaagccgaagctgtcaaggtgtgcgagggtgtgagtttggatgcttttggtagtgtgacaaaactgcgttgtcggggttggaaccagcttgcagccactacccatgtttacctgctggcatagccactgcgtcagaaaagaagagggctccctgcacacattcccgcccactcaactcatcaggcagccgaggtcgacaatcgcatcctgcagcagcaggtggcagttgccacggcccagcttcacgctttggagaaggtgtgtgtgcatggaactcaaggctctatgccttctgtgcacagccgtgacgtgaggcctgccacaaacttcccaaaactggtgtgggatgcgagcactcccgccatgcaccaccctgcacccatggtctgggatgcatccattcacaggcccagcgcaaggcaaagcgtgagctggagggggccgagcacgagctgggcgacgcgcagcgacacagggacgaggtggaaacggcgaacgctttggcgcagaccgagctgaagacgttgcaccgggagctgaaaggtcagggcaagctcttggactgcccagtgcctgctcttatcgtccttgctcatcaacaatcatagctgaagcccagaggggaccccttgccgcgcagacatggagctggagtggcgcgccgccgccaaacggtgcgctgtgctggaggaagaaagagcggcgcaccgcttgcagttgcagaaggcccagcaggagtccacatctgcagagggggctctgaggctggcggtgagatgttacttgtgttgggctgcatgcaggcgctgtccttgtcttcgggtgggcaggtgctgccgcgagaacgtcctggagtagtgcaagcacgaaacccatctccaacacagggcatcgaggctgcgcagctgggcaaggaggtggcgcatgcggaggacgccttgaagaaggagagggcttcgctcgtcatggtttgctggccgagggctgagcactggctggcggttttaccagcagtcctgaccagagcgccagatttaaaggtcgccgctggtccgctgacgagcgcttcagccccttcgcaggcccaggcgaggtgcgcagcggtccaggagcaggcaaatagtgccaagcaggagctggctgccacggaggagagactggcgggggcgaggcaggagctgcaggccacccatgctcggctggcgggctcggagcaggtgggctgcttattttaggcgcctgaacaggccctggatgctgctcgacacactactgtgacccagtaatcaggcacccatgcttgccctactcgtcaactgtcccactttcctcaagcaccaggcccgaatccggctggaaaggacgctcgacgccgccctgcgcatcagggacggcctggcagtgcagctggtggcccagggcagcacagtgcactcgcagcacgagaagatccgcctccaggagagcgccctccagaggtgcggggccggtggggtctgaacgtgtgcgacagatgcttgcacaggcggggcgtgcgctctgtccggcgtgacagtgtgagaaacatgctgggcgccgcaggatcacttgctcaccggtgccgtttgaatcccttcacacagaggtcatgcgcagtaccaggagcgcttggccgaggcaaggtaccttcgcacgcaggtgcctcgacgcaggacgctggtgcctgagccctcgctgcattgcatgcctgggggccagcagaattcttgcaggagagcaggcagggattaacaagtcacccccacttgcttccaacctataggtgtcttccagcatccacgagctgtccattgccaagggggccctcgccagtacatcactgatgaggaaggagctgcagtacctcacgcgctgcctcctccaggtgcgccgtctgagatgcatgccaggcgggtttgtaaaacgatgctggcaggagttcggcgtcacagggccagctcactcatccaaggaccgggattttgggtcttcaacctgtgtatgactatcaatggttgcgacggccaaccccttgccaggaacaagccagagtcaaggctctgaacgaggagctggaccgaccgctgaacgtccacaggtggcggaagcttgcagggacagacccagatgcctatgagctcaccctcaaagtccacgccctgcaggtggtgtgctgtggtgatggcgctcaagcgctctcatgagtgttgctgaatggtcgagatcttcggacaaaatcgctcaaaccttgtgtacttattagagccgcatacctgagccaaccctcatcaccgccttcccccattatagaaacgcttgatcttgaagaccgaggaagttgcacaaaaggagttgctcttgcaggtggagcactatgagtgatttcgagcagtgacagggtggctcgatgctgctgcgtgaagtcctctggcagatatcttacaaaccccgaatcccctccctccccctatgccaactgcaggccaaggagcaaacgtatcaagagctcaaggaggcgcacgccagaatgcctggaactgacgctgctgaacagtccagcatacagcaggttgtttggcagaatgtacatgcagagagaggcttggctcgcaggatagggctagaccctttggtgactcaggatgcaaatactcttaaagttctgtccccttaatcctccaggcagtagccagggaccgtgccaagcagctgaaggtcatcacatctcagcttgctgtagcaaacaaccaggcatgtagtgcagtctttgtctgaggctgccaaggcatgcctccgcacacatctggatgagctgggaatccagcccactcacatgcgtgccagcccggaccttcctgctcagattctggagtacaaactggaagtggagaggttgaaggaggagaacaaatcgcgcaaggggacgtcagaatcagtgccagttgataaacgggaaggggacgcagcggcagatgtcaagacacactcagatgccaagactttgccagaggtgcgcaaatacctgttcaggtgcatataaaacatctgtttcttgcatgcacacttcaagtatctgactttgaaacctctggtgcaggcccgagctcaagaacgcgcgtctggcgctgcaggggcccaaaggccgggcgccttgctgccagccaagcgaatgccaggacacacaagacaagcgccccttgggaagaatggcttggtggatggtaccatcagggtcgtggcctgttgaagggcagagcagtgaatgtggcgatgttttaaatgcagggtgtcccagccaaagcatgctcagcaccttcaagcagactgaccctgatcggcatgcgctggaaatacgaacaagcacgaaagccattccatcagggtgcagtgcagggcgtcattccgtttttgtataaccaagtggatcattgcacctatcacaaaggggcggggttgatccgagccccatagccagggacacccgtcgccgggcatcgaaatcctgagagcgtggagattggcgacatgcaggcgggcccggtagcaccatcccccctcttatcaaaccttgtatcagataaacccctgggggagctggcatatgtcccgctcaacataaagaataacctggatgtcctggccttcaagtaggtggtgcaaggggggtgcgacgtagcctccgattcggttcctcgcaatgctcacagggtgaccattgaccctcttccccgcagccgcatctgggtgtccctcttgacgggagtgctgaccggctgctctggcttgaccgggttccgaggctttggagtgtacctgctgggccacctgctcctcagcatcctcctcctcgtcaagaccaagaacgcgccctccaaatactttgcctccaggtatgtggtgagcggtcgtctttctaactgctctgtagtcgtttgtgtgcttgacgtttggatccatgtccagacctcacctgccgcagtggagcagcatcctccaagcactccacaaactccccctcccccccttttacgcccacagcctgaccctgctgacgagtaatgtgtttgcgcagacggagctcttgacctttgtattattctggacgctgacgaacaacatagtcttcctcttctgatgcctagattggtgtgagaagcttgcaagcccccctcgtcccagatgggatggtttgacaacccaaacagagtgcatagcatgacaccggtacagatcttctcgcgcatttcttccacctggctccgactgcaccccccctcaacccagcttggcaagcacggtgtccagagcagacttggtggagtccagcagtcccagggccttggtctcgtccttcttccgcagggccagatcgagcgcctcggtctggtgtggaatggatatgaattttgaggcgttatcagatgcacagatttaggtaattgcgaggatcgcggaacaagcatcttctccgagagctctatccacccaaggatggtcctgagcagaaaagttaccctctctgcagtgatccctgggctcaaacccaagcctgtccgggacagaaaccactgtgagggtgtggctcacctgcttgaggaactgcttgccggcggcaaacgcctccttcttctcggccttgggcagggactcggccaccgcgcgcacatcgaatcgcagggtgcccacctggcgccgcagctgctccctggcttccgtcctgcatggcaggggtatgagtgggcaagcatagtaaagccatgcccgctccatgatggggggaagggggatgttcgcgctcggctccacgccacccactgggcccatcccatgctccctgcctcccgcttgccgggatccatgcccctcgtatatgtggggaccaatcaccagtgtggacgctgccacattgcggccccaaaccccttccacctcaccacacccacaacacagaccacagggccctcccacttccaatggactacgcaccagtagttcttgcggatccactgctccaggtccttgtcgatgctcttctcagactgctgcaggcgcttgcgcgtggcgcccaggtcggtgcgggcctgggtaagcccatcgcgctcggcctgggtcaggttcaggtcgcgggcctcatagatcaggtcgaacccggtctcgcgcgccttgcggtagtcctccagctccacggcctgggcgcggggggtgccagccaggctcagagccgcgaccccggccagcagggagcccagcacggcacgcctgccctccagggcagcgggtctgcaaggggatgggaagaaatggggctggggggtaaattgttgggatgcaggccgaatgcttcggcttgtggaccgagagctggagcaccgagaccagctgcccctcgagcatggagcctttgatcctcacctgaccaccttggccgggccggcacctgcgtacatgcgatgggaggtatgggcttggcttggtgagtttacaacacatgacaggcaatgtgtaagatactccttcgacagctcaaagtaaccaaacagtatcgcagcccacaggcaaccgtaccatgacgaggtgcgggggcctgggccgtgaccgacagcaccctggggggtaagggtcgaggagcatgcatcggtaccgcgatagaagagtctacgaggtgcatgaattcctcttgccgatgccgatgcctgggggcacccatgcgtgccaagcttttgcaggcaatcccccactccccgggcgagggtccacccaccttgacgcgcacagaacctgcatcctgagaaattactgctggtcttcttaggtgcctcgggtagccgatgtggagaaatacgccgtgtgaaattgcggaggtcggcatctacgagtctatcatggacggtgcccgggtcgatcatacgaaatcaaatccatatctcgagaggtttttcaggaggtcgactgaagtctaatttctttggtaaagctgcaaacatcacggatcttccacaggggcataaatgttagatgcggttgttgtttttaacgcaaaataatttttcgttgccctatttggcacaagtaacttgtccagccgaattcccacctgtaccaaagtggaagcgattcacacacacacacctttggcttccgggtggccgtgtgagatcatttgaagaccaagcacagctgtaaattgacaatctttaccttaagtcgggcgggggggggggggggcaagggaatgnnnnnnnnnnnnnnnnnnnnnnnnnnnnnnnnnnnnnnnaatcgtcgcatgggtctaccttccagctctgagaggtggcgtaggatgcttcacatgccgcgcgcagcagcatgaatctctcgctccacaaaatctttccgctcgacatggaacgacggaatattgctatgcttgctccactcacatccagtaattgaaggcgtggaaagtctgatcagagacggcgtaagcacgccgtgccagaaggttgagcgattccatgcgggtggacacgcggtgcctgcccctatgctggtccagtctccgagaccagatcctcaggcacgatgcatgcaaagcgttccatctcgctggaactgcgggcagtagtgctggttttcattcctctacggatgtagcagggcgcaagagccactgggaggccctggcaaagcaggtgattctcgaccatgttggccgtctgaaagccaggggctggaatgaaacttcgacgagagccacacgcctgcagtccccgggtgacagattgcccgaccctctcatccacctcgtatgcccagggtataccagtcaatgtatgcaacagcaagctgcatccttccgtcaaggagggcatccccccgccggggaagaaggagatcagtctccagcgagcatatacaccggagagcaaatgctttggatgcggtgggtttataatttggtgcaggctcacaagttcggcagtgcagaatggagcctggccggttctagccactgactgtatcgcatggcattgtggtactcatgccaatgattgctcatactgccttgccaggcccagcggcagaaggcggactgcgcctagagtcgtaccggatcaggcatggcctgcaagctagcataaccctggatgacaagtactgcacctttccaggtgggaggggcagggaatgggcctggaaacgagcaactcatcaaccagccatcagagcgtctgcccacagcctttgctcctcaggccacctcaaagacagaatccgatccacaccctccagggatcatcaacggcggcatcatctccaccctattcgactgtcatgggaactggacggctgcgatagcgctgatggacctccacgccacccccaaaccacccctgacgcttacctacgagctcctggtgagcggggagggtggggatggggtgggaatacacgcttctgacgtgctcatgttgtgggtaggaggatatcggcagatcctccaccggcgtgtcaccgcatggtgtgagattgccgtcgcatggtgcctccctgctggtcaaaacctgcttcagtcacaccaggtacccccccacactctcaggtcacattcaaggagccgaccccgcccggcgtcccactggtggtcaagagccacgtgaccagggttcaggatgtccaggaagccggccagaaagccggtgtacaggtgtgtagatgggggcatgggatgtccgctgtgcgccaggcgtgggcgtgactactctcttgagactcaccgcggttggtttgacgctggcctgcgccagggccaaggtaccattgccggggtctgggcgcatgctcaccccctcccccccatcctccggttgacaccaggtcgacatgaagctctaccaggccatgggcgcccacgagaagctgctggccgaggccaacggcatcttcaaaaaggtcggagcgctgcgagccctgtgacagccaagccctggccggcctgccagcacccaacatgaccccccatcaggccttggatcagtcctgtcgtgccatcgatttctgtcaaagtatcatcctgctggaatcacacccctccccttctcaatgtcggagaacgcctgcctgttttctctggaggcctcggaaaccaaacagctctcttgcgtgttacacacgatgcaacgcccgtcccgtctctgggggcgtcaacgttgcatgagcccgctcaaccccttcccagaaatcttcacgccttcgcggcctgcaagcgccgcgtctcgcgcagcctcctccaggccgccacggctgcgtcgtccagccggcgggccagggccagggccgccgccggttcaaggtccagcgccgccgcgccgtccacggcctgggccggctcgctctcctcgacggcaaaggtgcgcgcggtgacaccgcgcaggaaggagtaggtgctggactccggctgggtgggggcggccgccggcgtggtggccggggcagcggtcttgacgatcgcgggcggcgccacgctggcacccgccagggccaggtcgtctgccacgggcactgccaggccgccgctgagcacctccagcagctccccctcctgccctgccagctggtccatgaccgcctgggactcgctgcggatggtgaagcgcaggatgggggcgccggcgggggagcactcaatccccgcgcccagccccgtcagcaggcaggcaacgacgtcgccgtcccaggaggtgccgtggaaggcggcgtgcacgccgtgcccgggcgtcacagactgttttggggttttgtgttggggggggggggggggggggggggnnnnnnnnnnnnnnnnnnnnnnnnnnnnnnnnnnnnnnnnnnnnnnnntgaggcagaggcacgaccagggcgagtccctggcatgcatggggcaacgtgcggtccgggaaggggaaggcggcgatcgtgcagggtccctcgcacaggcggctgggacggggcccgcagaccgccgaaacggtgcgacggccaaaccacgcgacctgtcacgctgtgcggtgactgtccacagccgtgcacagccctcatctgtcgccttggcccgggccgcgaggttcgcagttccccagtgtgctctccctggccacgacagcaaacccctgcacgcaccttgatgacgcactccagcgtgccggaggctgcaaacgccgcgaagagggcgctcaacccagcgggccccggggtctgcagcgatccctggacgctgagcccatacggcagagcctgcgagggggtgcgtcgggccggtgggggctggtcggagcgcctatgcccttgtggcgccgtgtccgagccggatgcagggtctggaattcaggcccccccctgcacactcagggaagccctcctcacctgccagcgctggtagaactggacgggggacaccgcgtgggtgggcgggttcaggaggaccagcggggagatggacagcgggcagcacctgatgacgggcgaccccaggctcacctgtgggagattaatttgaggggttggttgggggaaggtgtggtgcaagctcacaaatcgggatgccaatgtgacatatgctttggctaatgtttcatagcgtcagtgctttggttgatgttacataacgtctgtgcttgggctgatgtttcgtaacgtcaggaaccctcccaccccccccgctcaccagccccaatcaaacatagcttgcagacaaacaaatgcctcaccttgaggggcagcttgatggaggcggcgaccaccggccagccgaacccagacacggtgcgcgtggcagaccaggcggtcttcccccccggcgccagcggcttgagggggaaggccagtagcgcccctccccccaggggaccgcccagcgccagctctacctccaccccacgcagctcgtccaacgtgcggttctgcgcgcgcacgtgcacggtcaggctgcgcgcggcggggctgggctccacgcgcacgaacaggcccagcggcgagtgccctcccgtcacctcccgctcgcggcaggaggggcgcagggcggagggcgcgccgcccctggtgctgctgtccacgtcgccgccgcccagcacatccagcagatcggccagcgccgggagggagggtgggcccgcgccgttgctggccgcgtcgtcgccgccggcgctcggggcgtcgccgcgccacaccgcggcctgaagcgcctggaggagcccgcgcgcgcggcgcgcgggcgcg

SEQ ID NO: 23005 - DNA, 2702 bp, Chlorella protothecoides
  modified_base (438)..(447): a, c, t, g, unknown or other
  modified_base (998)..(1007): a, c, t, g, unknown or other
  modified_base (1132)..(1141): a, c, t, g, unknown or other
  modified_base (1508)..(1517): a, c, t, g, unknown or other
cagggccaggtgcagcgcctccacctcgccctccaactcctcgcagcgcgcggagcgctcggccagcgcgacgcgtgcggcggcggcctcgcgctcgtgccgacccgccgcgtcccgcgcctcgaacaccgcgcccggctccgtgttcttcctggccgcgcccagcgtgatctccgtcacgcccttgccgaagttcagcgtggacagcgtctcgctcaggctggaggcctgcgcagtggagtttgggctcgaagccggcgcgaacgtcccagtgagaagccatccccagcgccatgcctggccacacgcactcagcatcacgaggtgctgggcgcgcgggggagcatccccagcgcctcgctccctcctccttgctgtgctggccccatccaccccacccaacctcctcgccgccacccacctcaggcgccacgtgcnnnnnnnnnnggtggagtttgggctcgaagccggcgcgaatgtcgcagtgagcagccatccccagcgccatgcctggccacacgcacacacagcatcccgaggtgctgggcgcgcggggggcatccccagcgccccgcgccctcctcctcgctgtgctggccccatccactccacccaacctccatcgccgccacccacctcaggcgccacgtgcacaaacatcatggtcttggcctggcccgccagggagtcctggagcagctgtgtcagtttggagtcgcggaaggggatgtgggccgacttggaggccagggcgtgcattacgttgcctgtttcagggagagggaggaaagagggggtggtgggtttgaggggaccggaatgccaccaaacaagggcgagcaagccttgcacagcccatcgctcagcgtgcaggtcggccggcaggagcctcaggacaggccgccggcatgccaggcgcagcgctgcacggtcgaggcgctgcatcagcctgtctgtcggccccacgcctgcaccgtctccacccggccccactcccnnnnnnnnnncacgttgcctgtttcagggagagagggaggaaagagggaatggtgggtttgaggggaccgggatgccgccgaacaagggcgagcaagccttgcgcagcccatcgctcagcgtgcaggtcggccgnnnnnnnnnnttgatgtgctgcgcctccaccagctgctggccctccgcgccgctcttcccgatgcgctccgacccggccaggtcgatgaggtggaggcaggcgtgggtgcgtgcacgggtgttcaggtcctcgccctccaccaggatggtcagcactgtttgaaggatttgtatcggggggagggaaaggaaggggatgcagggtcggttcgcggcgcctgcgatgatccagcagccatcccatcctggcgccggcatgggcggactctctactgccgcacgcagcctccctgccatcgcaagcctctcccccctcgcacagccctcccccgccccctctgcacgtcacgtcccaactccccactgaccctggtgcnnnnnnnnnncaaggatttgtattggggggagggaaaggaaggggacgcatgcttagttcgcggcgcctgcgatgatccagctgccgtcccatcctggcggcggcatggccggactctctactgccgcacgcagcctccgcgccgtcgcaagcctcttccccctcgtacagccctcccccgcccccctctgcacggcacgtcccaactccccactgaccctggtgcgagcggctgctgcgctcgttcatcctcgtctcggccaccgcacggtttcgtgcccccagctccatcacccgcagcacgtcctccgtgcactccaccgtgaccttgggtgcgggggaggttgtggatgatttgggagtccgtcgaggagtccagggtgccacaccagctgctggcgaagattgcgctactggattcgctccggctcgctccgtccccttgcctgccgggctcaaggtcaccccccccttcccttcatcaccacccctgtccacacacgcccccccccgcccacctgcgtggcgtcggggacgttgacccccgagcgcgcggtgttgttcagggccaggctgcgcgcctgtcccccggccgccgcgccctccaccagcaggtcgcgcagggtctcgttgtagatctccagcagctgcacgcggatggcgtagcgcgcatcggcggcgcgctccgcgcgcagcgcgaacaggtcgtccagggtgcggtagttgacgccgcggcccgacaagcggcccacgtccgtccctgacatggtgtgtgtcttccccgacccggtctggccgtaggcaaagatgcagacgttgtagccgtccaggacggagcggaccaggggcgcggtctcggcgtacacctcctcctggtcggcggactgaccaaacaccgcgtcgaagcggaagtggtgccagcggccgtggcgcgcggagtacacgcccagcgcgccgtcggggcccggctccaccacgctcgccccggcgtcgccggtggcgccggcgggacgcacgcggcagtacacgcgcagcgcgccgcgcgcgtcctgcaccgcgttgtacagcgcgcggttctgcgccgccacggcgtcgtaccgcgcctgcaggccctcgaaggccgccagtctgtcccgcagcccggccagctcggcctcggcggccgcagcgcgcgccgaggcggctgcctgtgcgt

SEQ ID NO: 23006 - DNA, 61 bp, Chlorella protothecoides
aggggtttccacgcagttcggtccttcaggactacatccgccatagaggctcccattcctt

SEQ ID NO: 23007 - DNA, 172 bp, Chlorella protothecoides
ccccttctctgcagcttccgtccagctgcccacctccaggcgcaggcgcctggtgtcctggagctcagagacggccgtggaccagcgctgcacgccctgctccgcaaggcccagcgtgtgctgggcgtcgaccgccctttcctccagcaggcgcgactggagctggagatcg

SEQ ID NO: 23008 - DNA, 72 bp, Chlorella protothecoides
aggatgcagagcaatgcatgggcgaagtgttcccccccccccttccgtatcacacgtgggagtccccacaca

SEQ ID NO: 23009 - DNA, 105 bp, Chlorella protothecoides
aagggaaactgatgagaacttccgacatgtcgacggccgggcgcccctggtgaacaacaaggatccaggagcctcacacaaacagaacggtgcagttaattccga

SEQ ID NO: 23010 - DNA, 61 bp, Chlorella protothecoides
cggaccagggcttgcgggccatggcatctgggaagtaagattatggcccgtgcgagaaccc

SEQ ID NO: 23011 - DNA, 61 bp, Chlorella protothecoides
aaagcagcaccgagcacgaactgtcggcggtggcagaccagatcctggtggccaccggggt

SEQ ID NO: 23012 - DNA, 79 bp, Chlorella protothecoides
tgtccccacctccttcaccaccacattgttgtcctgcggggtgtgtgaatgagtgggacgaggtcaagagggtgcggcc

SEQ ID NO: 23013 - DNA, 61 bp, Chlorella protothecoides
tgtacctaaccaatgctcgcacatgcagacgtacagtccccatcaagtggtgtcgtgatct

SEQ ID NO: 23014 - DNA, 78 bp, Chlorella protothecoides
cacatgagtggcttgattgctggtcatcagcagagctatgaccgattcctggcagccgtgcccaccatcacatcacaa

SEQ ID NO: 23015 - DNA, 348 bp, Chlorella protothecoides
gtcccccacagtatcgaaggagtcgagccggggcgcgcgcagcagcagcaacgagtctccctgcaaaatcagcgtgacaaatcgccatctccatattcccaaatttagggcaggtacctacttaaaaactgtttgtcatgtatatgttttagtatttgagaagatgtgcatcgggatgaagggacctatattgttgttgcttctttagcctggatgattgcataccaatgccctggaccagtttccagttgaaggagatgcacctacttctttgggtaggccactgcttcggtcatctgataccaaatcacaagccatcagtctacttgctagtcaagtcaaggagcc

SEQ ID NO: 23016 - DNA, 61 bp, Chlorella protothecoides
cagtctacttgctagtcaagtcaaggagcctgcatgacatcttggacggccctgggaatgc

SEQ ID NO: 23017 - DNA, 153 bp, Chlorella protothecoides
ttgcaactgatttaatatttttagatgtgactcaacaatctggggtgcctttgcgatctgtcatgtggtgttttctgatttatgtcgcgcgcgatctgggacccctggagcgtgaactgcttccctgcgcatatcctcgcccgagacttttta

SEQ ID NO: 23018 - DNA, 61 bp, Chlorella protothecoides
agaccgagacccagctccgcgaatggctggtcgcgagccagcgcgaggtccaggacatcct

SEQ ID NO: 23019 - DNA, 61 bp, Chlorella protothecoides
tgcccaggatgtgtaccccttcttggtgtgaatgaggtatgccatcctgtgtcaggtgcgg

SEQ ID NO: 23020 - DNA, 61 bp, Chlorella protothecoides
catgtgtttgggaggtggcagtctccggacacctatcccctgccacactggccttcccaag

SEQ ID NO: 23021 - DNA, 21070 bp, Chlorella protothecoides
cccgcctcccccctaccccccttttccccccccagcgcctatcatgcatggcactggacaggcgatcctggctggtggtgaccgggagacccgtccagcggccccaccccgacgcgccagggcacaccaggaccttcagcaccctggccgaggcggtgcaggccagccagccggggcacaccatcctcttgcagggcggccagccccaccgcgtgagcggccagcccgtcgtgatcagacacgcgctgcgcctgctgggcagcggcggccgtgcggaagctgtggtcctgcgcggcgacccgggcctagagaccgtactgctcttccactcgctagcgcagctgctcaacctcagcgtgcacagcgtgcgcggcgcctgtctcatgcacctggccggcacgctgcgggtcgggggctgcatcctggagagctctgcggcggggctgccccacctcgtgtctcagatcgctctggcgggggacgcagctgagaggcggaggctgcactttgacgagactcgcctcctggtgagggagttgggttttgattcattggtaccgcaagccaggaccgaaggatgaccaggaagtccagcgaggtccctgcccgattccatccttgatgggcacagtgtgcatatgagatgtttggatgggtgcatctgacctgatgcgacgcccaaagcaccacagcatgaggcgacatcccgctcatcctccacgtgcagggtgattgtgcgcggcctgtggccacagggggcatggggcgagtgctgaacgcgcgggccatctacctgcggcaccagacgtatgcctggttcgatgtgcatgagctcggccaagagggtagcagggctcaccctcccgccggcgcgcccgccacggccaaggagaaaagtaccctgaagtctcccgtgcagcagcccaagtgggcagcagcgatcgaccccgaccgattgcggggtgctgtagcccaggcaggggcgcacgcaggccgacgttctggctctgcaaggcccgacgacatcacgtggcacaatgaggccgatgctggaccagcgcagacggcgatccctttcccaaagcgccagcggagcagcccagctcagagcggctggactgactggatggcatcatagtatgctgccgtgtaacatacatgtatcaccttggacccctccttgcactctgcagcggtccctgtacccagtccttccagtgtgccacttgccatcaatgaggcacctgcttgattttcctcgtagacctgccctgcttgtgacatgctgtgcaagagaccaggtgcacacttgcatgtcgacgatgtccacagtatgctagcggataggttgcttggacgtgctcacaaacgccaagagtgtcaatgaggcgcacgcttgggttctggaggcgatatataggggaatgacgaccaaatgagggccgcacccatgcccacggcacagtagcaggacaccagagccagggggaggaaggggagtcggctgccggggaggtacggcaggatccagctagaagctgcctccacccccaccaagccccagaggtaggcgccaggaagggtgtgcagccgggaaggcgtgcccagctgccagctcagcagctggggggcgctcgcagtgtagagcacgaggagcaagacctgtttgcagggtaagggagggggtgcatggtgatcatacagctattccatagacatcgtggatagaaccccagcactgtgtgtgctcctggcaaactccaatctcgtgctcctgggcttcagttcaacaccctgtgggagttgatacttcacgagccgcaacatcctctcaaactaggtaggccaccttgatgctgtattcctcgggtctgtagaggagggggaagagcgagtaggttcccagcgtcgtcaggaagaagaaccggtttgcaagcgccggatgtgcctcgtgcacgacaaagacggcaccgggcacgagaaccatgaggatggccttctcatggacatggtacctgcaggaagttggagaagaggttggccaagcagagtgattgccaaatgaatatggatggaatcatgcacccctcaaagtacacgttcaggttctccatgcaccccgaaccatcccaaacgaccctcacccaaagaagaatgataccagggtgcagtgcagagcagcctgcgggaacctggctgggttgggaaagcgccaggtgtgcaggaggcagggcgccatggccaccagggtcacaagggctgtggccctggagcctaccggtggcagcacctcgaaagctgccgtccccaccaggccccctgcaggacaaagggggtgcctggttgatgttgcggtcgcagagtggggtattttggattgcttccatgtggttgttgctgcgaccgcaaatggagtgcaccccagccacaccacccagtcctgctgaagcccccgacctgtcatccgcgcggtggggggcagccagcgcccgctgcgccgtacagccgcggccagcaccttgtctgctgcggcgtacagcgcccagaagttgggggcccagtaggcgtgcaccaggccccggtcaaaggggaacagcctgctggcgagctgccctgcctggccacgagtgacaaagggtcccaaggaaagtaggaacacagctgccacgatgcagcccagcaggaggaagcgggatggggccgagcgacccctgagatatgccaatggtgaggaaagggtgtggagagagcgtggcgcatgcatgttgggccatcatctattccaatgtgctgagggtgtgccttcatgcttggaatctgcaagggttatgaagtacctggcaccctgctctattgtggcatcctgtgcggcctggcatgacgcctggtccagtccccccagagcatccctcatgtcccctcccacaaacacctgcagtagtgtcgcagcaggaagacaaagtagaccggcgcggcatagaggaagatgtgcttgaagttgaggagcacagcaaagagggccgcacccagcaggtgctgcccatctctcagggccgccatagacgcaacaaagatccctgcgtgggggcagggatgtcacaagaatctggccgcctcatgttgctcgtcagcgcacacctgtcgcaggtcagtcaggagtagaccatggggtgcctggcctttccatgcgatgcgtgccgtcgcaacctaatatcatgccagcacccatggtctaccccatgccccacgcctcgtccatcccacccagcagtatgccgttgtactggaagtggatgtggtccaccatgatgaggccggggtgcagagccaccagagccagggccaagctctgtgctctccttcccagggacctaaggggtgcaccctctgtaggctcagtgggcaatcaccagagcagctgccagggcaggcatggccacagtgggcccctgccgcagatcccaccgcacctgcaggcccaccaggccgccgcgaggagcgccacctcgctcacgatgacgcttccacgctggaatgccactgtggcatggctggcgtagttcaggcgcggcacctccagcatggcggggtccgcccaggaggccgcctgcgctagagcccactcgaaccaagcaaagaagggggggtagtccagagtccactcggaggtcgactcagtgtaccttttgtacaggatgacgtgaggagtcgatgtgcagtggggcaggatggcaatagttgagccgacaggttggcctctagcacatacctggcggctgcgctgctgctgttcaatgcactggtgggtgcaaggcagtcctaccctagattcaacagcccaagtactcaccacttagaggtgggcaggctgtaggtaatggccatccagttgcggtgcacctcgaagtccgtgctcttataggctggtaccagcagcaccttgatcgcggtcgccagtcccaagattgaccagacgctgggcatcctacactccatcagattgaactctgctctaatgtctgtatctctgaggttgccagctgtctgatcaagccgaagccaggctaggagtcgactcagatcacttgtcgacctcccagcacagtagtgacggtgcaacgcagcatgattccatccgatgcacaatgtgcagttgaattataagagcacataagggtccttggattggattgctttggtggcatggtctgtacttctcatgtggtgatcggggtggggactgcatgcaccgcaggaagcaggcggtgctctcattcctagggtccctgaaaacaggctagcgtaatcaggacccgctccatctaagagctttacgtatagcgcaaattttcgaaggattgcagtggttcactgaaaattgtatgtgtgcacatcttatatacccagcactccctgcaggtttgccgtctgcctccagcacaacttgcacccaccgcgacgaggatgcatcgatagggctttcgaatctcttattaagaagtagactggccgttcttgccagttccacagccattgtcattatctgatcgaggaggaggaggcaacccggtatgagctccgaaaccatcatcaaggccatcttggatgaggagcacagggagaagcagctgaagaagaagaggaagggccaagtcggtgagcctggaggggcgaggtaccagctttccagggtcgacacgctgcgccgcgcctctacatcaccccacacactttcacagaggggaccaggaagaatgagaagaagggcaagacgctggaggagatggagaaggaggagggtggccccgtccaggagtcgctggtgcccatggcgcagacccagcgtgccgccaaacgcaagggggccaaggacgccggtgaggtgtgaggttgggcagcttggaggatattcttggggatttgaccaagaatgagacatgacaaaacaccatgtcgattcgacacccccgctcagacaccagcatcctggaggtgagcgagctccagcgtgccgaagaagagctggaggcccaggaggacgatggcgtgaagctggaggcgttcaacctgaaggaggagcgggccaggggccactttgatgaggcgggcaattatgtccaggacgccaagggcagcgatgaggaggaggaggaggacgcctggctcaagtctgaagaaggtgggtcgggtcgagtagagtcaggggggcaatggggtgacagacgttccgattgggaccctgcagctgtcatccctgcttgcagggagccaggatatgaaaccctctgtcgcatccatcatgtactgctccctgccaccctgccactccccgatgagcttcccatccactcacagccacggtggtgtctgaggaggtccgtcgtcggctgaagcagcaggaggcggacgacgcggccgccgccatggcggcggcccagccgctcaccgccgcccaggtcgcgcggctgcagcatgaagcagcggcgctgctggagccgggggagagcgtggctgccggcctgagacgcttgggtgtcggcctggggcgccggcccgggaagcaggcggccaaagcggcgcaggcggccggtgcgggggcggtgcccgacccggacagtgccgccaagttcgagcggctgaccgcgctgggcgtatcgctgatggaggcgggggagacggatgtctacacccagtccaaggtgggcgacgcatggggttgtgcgccgtgtgaggtctcctggggtggcgagcttgcatcgcgtcaggagaaccctcgacgctggccagtcgcacttctgaaacacgccaggtgcgagaaccccaggcacccgcgggcactcaacctccacttggtaacccacgctaggagtactttgcgcgtgcagcggccgtatacatcgatgccgacgaggggccctccagcctttttggcggctctgcgcccgccaccaccgcctacgacgacgccgatgaggacatgtttgggggagggtccggtgagtctgcattcgggcgtctgggaggatgctgcgcctgaaggctgggggagtgttaccagaggtaccaccaggaatggggggcggggcatgggacgggtggcttcgccggcacctcgcacatctgttccccctgttctccgagcttgcaccttcacccgcaacccagacacggagggagctggaggtagaggcgatgcacagagggaaggcgcacggaagggaggcgggcaagccggcgaggcggcgggggagcccaatcgagctgaccacccctcttcacgctcgaagccggcggcagaggcgtcggccgctgcgcactatgcggcatggcccgtcaaggagctcaggcgcttcctcaccgaacgagggcaggtgggattgggcgtttgggcaccagcaggaaggtgaacgtcgtgtacctcccccactgagtcagcatttgttcagcgctcactgacaaatgtgcctgttgggatgtggggggcgatgtgacccctctggtgtgcccactgccaaatgtcaggcatattctccaagacccaccccgaccctcttggtatccattcacatatccccaggaccccaggggcatcgtcgagaaggatgagctggtggcgcgtgtggccgctgcagctgctgagatggcggctgcggtccccacaccaccacagggctatgtttacgaccctgcctccaagttctggtacagcgctgcgtcaggtgactaggaggtggtttgaggggtgttcagagggattctctgacgtggacatgctcactggagggcctgaatgcaagaaaggcatcgcatgaaaatctacccgactcccaccggacaggtatgcactgggacgcaaagtcgggaggcttttatagcggtgaatcgggaaagtggtacgtctgggacgccagcagtcagcagtttgtggagtggaccaagtgagacagacatatcttttgctgctggcccgtgtgtctctttgcaagaaccctttcttcataacgtaaccacggcattcgtcatgtgatggagactaccctcattgccgcaagtggaaagacagtgtacaaacagagcgccgatatcatgccatcactgccctcgaagctcaaggacgggtcggagcggttgtgcttagggagacttctgatcatctctgaggagacagcttcggaaggggtcccctacaacacatgacgtcattctccgctgaagtggtcagagggtatcactgccattccactcgcatggatggttcaaccctctgtctttttcgtgtttctttgtgtcgttgttgagcacgcgtcgcatcatgccctccatcaggctcttgggtgggccccgttccggatcctactcctccttcataaggcaagctcagtcccggccaccagccccggcatcatctcgccatcctttgaccgtgcgagctttgaaggaggttcgaactcgtcgcgaggaaaatgttcctggtgatgtgtatgtcgatcacacctgtataggtgagaacgggtgggcaacccgcagcgtctcatggagatcaccaagctccattcggtgtatcaacatccttgtaatgcgtcaaaaatcacccttcaatctctcatgaccccccagactgcgacacatgtcgctggatggctccctccgtcttcggcagagtcggggacatgtccgcagtcacgcgacagccggccaccccggaggagcggcagcgtgccctagaggccaccattagctgtccaacgtgagcttgtgtgttctgtcactgtgatagacttgcttacggatggtgtggggttgcgcacagttggtagatttggtaggaatgcaaacattgaagacacaggcgttccccatgacgttcccccccaagcacaccacccccatcacggcgacgcaggttctccatccacatgccacgccagtccccggaggagacggcgcagctgatgtcctccttccccttgcccatcaccggctgccgcgacgtcttccactgcggccaccatgccgagtccacgtttggcggcgcctcctacttcatccgccgcccggacggcaacatcctggtggacagcccccgctggagcccgacgctggcggcgaggctagaggcgcttggcggggtggacaccatcttcctcacccaccgcgacgacgtgggcgaccacgcgcgttgggcggcgcgctttggcgcgaagcgcgtcctgcaccgccgggagatgaacgcgcgccagggcacagagtgagtgtgtttgggaaggaggggcggttatagcttgcctgaggcattcatcttcccaatgtacaggttggtgcttgtatcactgtcgtgcttggaaagacctcgtctggcgtactccccagcccaaggccatctctctgtgcgggatcttgcccacactccccccctcactcctcctcctccacccgtgcccgcagcaaggtggagcgtcccctggatgagacaggaccctggagcctgggggaggggctcaccgtctacttgaccccggggcacaccgaaggacacgccgtcttattctacgcccctgatgccgcgttgctggccggcgaccacctgttcctgtcgcggcggctggggcggctagccatctccatcacgcacaactggtattcgctgccccgccagctggaaagcgtggcggagctggtcgacctgcccgtgcgccatgtcctgccggggcacggcaggccgatgcactttgcgagcgcaggcgagtacagggcggcggcgctggaggtcctgcgctgcgacggccagtgggacgatgggaggttgcgggcggttggtgggagaaccagggagctgcaggtctagaacaggtcccggagacgtggatagggtgcacgccgcaagcatcgcagcagcaatgagtgtttaaattggcaaagctttgaaagatgcagtcattgtgagtgccctactccaaagccgatgtctgaatggtgtgggcatcccccacacacatgccgagtatattgcgatctgaataacatccgtgaggaattgatccattcaaatatctcgcttgtatccatcgtgagtgaggtttggatgtgatatgaacctggcccaatcccccagctcagaaagagggtagcgaagcggaagtcggatgtgtttaacaaagcgtgttacccgaccgggagctcaagcggaaggtgctagggggtgatctaggcgacgggcaggaatatctgcgcgcatgcatgtccagcacattaagatttcctttttccaatctcccgcattgatcgaagccggggcttcgaccctctgaggcatcgagccttgttgcacacaccctccacgccgacattctcgatggttttgcttgccctgctgaccaccctgaactccgcctcgccatgtaaccaccccaagttatctttcatttcatcttggctggcacccctggccgaggcgtgctgccggctgctgcgtctgggcgggtgcgggcaagtcacggagcaggtgctgggctgccagggtttctggggctccatcgccttccccatcgcgctggcctgcctcggcgccgtactcctgtccatggtgctgaaggcctgctgggagctgcgacacgccatgtccagcgagcggggcagcagcgcggcgcagcaggccggggatgccctgtcggctctcaaggccgcggccccctccgagtacccacccgcctcccatgcctggacccagctagaggtcgacaagggtgcggcccaggtgctgtactgcacgggctgccacaagcccatcggctcccctaccttctaccacagcgccagcgcctgcgcggcctgcggcgcggtggcgcacgactcctgcctgcggggcctgggggactcctgccggcccctgtgcttggccaaggcaacccactggtggcaggtccccggcgcggttctgcagaccgcagacaaggtattgaggctgccaggggtttgcgagggttgttatgagttggtagacgcggcaggtgtatgatctcagatacatgtagcagcctgctgaatctgctaccccatgccctcgcccaatccaatctgggccacccatcacttgctgctcaccctctcgcagggcacaccctctgcctccctgccctgccatttgtgccagcaggggtgcggccttgcgcccgtgacgcccgagcccacctggcagtgcggtttctgcgcagccgccgtgcacgtgcagtgttggtgcaatgtgcacggcgccgctgcacccggggtcgcgggggcgctacggagccggggggccgatgcgcaagcaggtgggtggtcgtgggccgtggatcgcttggatacatatggatgtaaaggctggaaatccgatgtgcaggcctcgaggttgtcactcgcagcaaaccggctctgatcctataatccactccactttcccagacgagacccccagcgattcctgcgctagctccctggctagcacaggtgaggtttgagaagagattcggggatgctcaggcagcttactgaactccttgccgcgacagcctgtccctttcttgcgcatgacccgtgctctgatgagtccgggcatccaccaaccttctcaaatcatccttccctcgcccctttcctcctaactcagacaccgaggatgaggagtgggccagccccgtgaggaggcgcacgcgggagctgcggcgccggcagcgacgcatcgccgagcgcgacatgcacccccttgacgcgtgccggccctccggccccgcctccggcgcggtgctcctcccttggtccgtggaggccgcccctgggcatgacggcgctgaccccagttcggacgcggagtcgctgcccgaccgggggcgcgggtggtggcggccgcgccgccgcccaaagccacgcccgctgcggcgcgagggcctgagggtgtccgccgcgcggctgccggctggctgccgcccggtgctggcattcgtgaacaccaagtctggggcgcaggccggcacggccttccgccagcgcctgctgcgctcgctgcacccgctgcaggtggtgcagctgccgcgggaggaccccgtcgtggcgctgcgcccgctgctgggcctgccgggcctgcgcgtcctggtgatcggcggggacggaactgtgtcctgggtgctgtcggccatcgacgacgcgacggccgcggcgaccggcggggaggccgacggcgacgatgaggcgcccccagcgccgccagtgggcatcatccccctgggcacaggtgatttggatgggtaatggttgggacgtgctgtcttcgcatcgtgcgtatgggaggatgtatatgggagtcggggttgagggcggtgatgatcagcgtgcaccagtgcttgttgccgggcctaccgccactgagcaggggtggacaggcccacctgcttgtggccgcagtgctctacccaccctgcccagcaatgcacatgccagcatggtagagtcagctggagctgtttgtgtacatcaagtgccctagcttctcacgggggacccctccaggtcccacgctgcgagacagcccacccacccactcttaacatgtccctgcccggcaggcaacgaccttgcgcgcgtgctgggctggggcgccggcgcggccggctggctggaccactctgcgttggggctgctggaggcggtggagcacgccgcacccgttcatgtggaccgctggcggctgcgcggcgagcgacgcgagggggagggcgggtctggcggcaagggcaaccggccggccaaggacggggagggggatgacaccctggacaaaaccatgaccaactacctgggcatcggcaccgacgcgggggtgggttctcggaggaggaggggtgggagaggagcgttttacatggtcggcaaggcagcaggttgcttgctctgcatactggcctgagctcattcacagggaggtgcgggggtcctccttgtcaaagagcctcctagccacagggctgcttgggtgccaggcattgcaggctgggtctcttcatgatgggtgcatgcatgcttgtagatgcagcgatggtgatatttagcccgccgccactgtctaatgctcccttccccatcatcccctccccccccccaccaccacctccctcaggtggcgctggggttccatcgcatgcgggagggctaccccaacctgttcgggtcgcagctggggaacaagctgctctacacctggctcggcgcccagcacatgctgtccatccccggttcggacctctccgacctggtccaggtcgaggccgacggcaagccgctggagctgccggccggtatccagggcctcatgctgctcaacatcaactccttcatgggcggtgtggacctgtgggccacctcatccgaggctggtctggagcagaccctgcagccccagcgcctctgggatggcaaactggaggcgagtggagggaagggaggatgggagggcgtgctccctcacacgaggctgccgggtttggagtccagacaggacgtgatctggcgggcttgcaggagcaacgacggcatcctcccccccaaccccttccacccatccccgccccactccaagcagctggctgcggtgtttggcatctggcacctgggcaagctgcagatcggactggacagcgccatcaggctgtgccagtgctcggagctgagcatcaccctgaccaagtccatgcccatgcaggtgccaggcctggggcactggcctcgtagttgaagatgcctgggcggcttggtggggaggcaggtttgtgtccattgtatcctccatttcgctgctggctttcggctgagaatgctgcaatatgcgccaacccctctccctccccaaccccccatcctgagcaggtggacggcgaggcgtcgcagcagcccgccggcacattcaccgtttctcgccagggccaggtgcccatgctgcagcgcgtccatccggcccttgccagcgtggtcaaggtgggtggcagtgtggtggggatggtgaggggaggagcgtggcgtgtgggcagcagccaggcagttttgtggccttcaagatggcgctctgggcatggatttctgctcttctccatttccccctcccttctcgctctccatacaggcggtgacagacgtgctggacgatgctcgggaagacgaggggatcagccgcaagcagcacgctgccctttcctctgccatggccacagcgctgcaggacaagctggaccccaacaactgaggtgcaggcaggtgcctgagtgcaggcacatacggacttgcacatggggccacaaccgctttgcaggtcgcaggcatgcattctacttcttgcgcagaccattctgccatgcttgtgtgcacacttctcaacaacctatcctcgagacattcattgcgtttccccccgtttttctactcagttgcatatggctggcttttctatggtactcgttacaccatttggttgattgcaactttggcttactacagatcaagatacacgaagttgaaatgggaggtactcaacgccatggcagcacagatgtgcatcacttcttggccttctcctcgctctccttagccttctttgcagtggcctcgccacccttctcgctgatctcagccatgttgtatcctgtgtgaggaaagacaagcacatcattgctattcgacagggtgtgctcgacctcacaatctgggcccatggtgtacaccagattgcagtacacccacgcagcccttgatgtctcatgccaaactgagccacgccaccactcttccccatgatctcctcacctgctccctccccgtcattctcagaaggctcgccggagcgaggcgactggcccgacgtcgagctcttgtcaccttccctcttgtcagcgcccttggacgcactgtgcaggagtgaagggttatgaacatcatgtatacaggcctctggagagacaaggataatctatggcatgtttgtggccagggagcgaccaaaccatgcaggaagacaccgtgatgcaagctcccaacacacccgctgctcacctgtcggttcctcctgccctgacaagtgtcatgggcgccgtcctctggaccatgtgcgctccatgccggacctacggcatgcgagatagggatggggtcgatgctcatggagttacgttccaaattgagagccttcccatcccagatggatcctcacgtttggccttgcttgcgtggtagtgccggctgggcgggtgttggcccggctgctcagcatgctgacggaggacatcgaagcggtcatcatcgtgctacaagtatattacgggggaggcgatatatgattcggaggggaagccaagatgtgcttgcggagttcctggggtgcattagaggggttgggtcgaggcatcataactccacggcgacacgggagtcttctcgcagctgcatggcagctggggattcaaacccccacaaaagaattcagcaccgaaaatcattctggattctttgctgaggtcatacccttcattgtcataccacattaaaaatgacagtgcgtggatgttgagcactggctaatgacccagcgcccttctgtgcaaaatcgttggaactcggaagcgtcaaggtggccatcaggtcaagacaacacctgttgcactctcatcttcaacagctgcaccagcaaggtatcaacacccaggtgccctgcaacccggcactccaccccagggtgggctgacgctgcctcctccgtcagtctggggatgtcctcctggatatgacggcccggaccaaggaacaagggcgcgacgacgattttggttgcgccctgagacacgcacgagtcgaccgcctgcttaaggctgggctccgtcagctccatgtgggccgtttctactatggcgctccctgtttctcgcctgtgtcaagggtggggggaaatctggatgaagctggctacctgttgtatggcatggcatgcacctgatattgcagagcagcatcagtatggcaacttcttctggtagatcacgtggcatactaagcattgcagcttgagctggtggaggctgattagctcaaggtaaaagagttgcctaattctaccactgtttacctttggcaggttggggagactccaggccaacagatcaaccatgcaaacccctgccactacacatcgatgaacagcataaatcaacaatactcacctgtacagttgtgcaacatcctccagcatagcattggcttccttccgtcgagagccatggtctatgatgaccacagcccactggtcctctgcaccaagctgagcattctccctcactgtttcagctgccaacgttaatgtcctcgaattagtaaaccatcgctttactctatctatagagtttgtttgtgtatgtcgtggaagatatccaacgtccgttctgcgtttcgcaagaacaggaggacagtgaaagtgtgaaggaggtcgtgcagcgaaagagccaggggcgtgcgtggccaagagcatgaccatctaatacattggcgtactaaaccaggccagcagaatatgcggtgctcccgtcggaggtacatgtctatctatcggagtgatggagggcgacgcatgcaagatgtgtggaaatcttccaaccgggagcagcctgcgcgcggtatccatacgcgaagaaaatgcatgctccgcctcagcgcgtgaacccagacttggcttcggtgagtgattctcctctgtcgcttcggcgctcgtcaccctggcatgcgcccgtggcatagcccctacctccccagctccccatacctcggatcagcgggtggtacggtgccctgctcgataccgacccctgtcgtcgtttccgggttttgaatgatgcaggaagcatctgtggcagcagatgatagcctgcggcccggccccgtgcctgcggaggagcccggatcacccgatggcgtgagggcggtggcgtcagacaaggccgaggatgtccccgacgacaaggattttttcagctgcaacatttgctacgaggtgggtcatgtacggcgggtttctcccctgggttccctggtgctcgtcgaggtgtgcatgccaacccggaattctcgctcctcacctggccttgtgatctcactaccggccccgtcgcggcccccaccgcccagacggccgtgaaccccgtggtgactctgtgtggccacctctactgctggccgtgcctgtaccgctggctccaggtgcagcgccactcccacacctgccccgtctgcaaggcaggcgtggacgaaagcaaggtgcgttttgggggggttggtgggggcgacatggtggttgcaggcgctcgacattggcctcagtcattgcatgacatccttgtactgccgttcctgaccccccgccccgcacccccttcatccaaaggtggtgcccatctacggccgcggccgggagggtgtggacccccgcacccagacccagccccgcgagcctaccaaggccatcccctccagacccctgggccagcgcacaccccccgtggtccgtgccgcggctgccgaggcccagcaggcgcagcacggcatgggtctcatgcccgcgctcttcggcctgcagcccggggccggggggggcagcgagcccctgacccaggagcagcagcaccaggccttcctgtcccgcctgctcctcatgctgggctcctttgtgatcatgtgcctccttctcttttgagccagacgagcccccttctcacctccccaagcactcccaggactcatcttgcgggcccactgacggccccgttgcccccctccctttggttgcctgcatccatcccgcagacacccctcagcttgactgggcttgttactgcacgttctctgcaaccctgcagccccgccagaggcttgcctttcttgccccaccacttgcttacttgcccgttgtcagatttctgggcgccctttccccaagctactgcatggacatgcctgccaggatcagggtgccacgatgggcgccattcggacatacagctgcagggccaggctgccgggcagtttgacggagcgcacagggatgagggcgggggtgggctggggctggggcgcttccgcctcgatccagctgcattccgggaccgggcccataatcctggcctgcatgcgccacgtggcatctgccggaagagggcccagggcagtcgtggtgtgctgcaggcgcagcatggcgctgcgcagcacagcgtgcatgttgcggaccgctgcaggcgagctgagcccggtttctgagatctgggtgggcggtgggtgtggaggggatcacctgggatgagttggtcatcaggggctggtctctgaaacacagcagcagccatccaaactccctgtacctcaacatctagggagtattcctccagggtcgtgaactgggccgggtgctggatgattagcgtagcgctcggcagcactccctccatcagcggtgcctgggtggggtgaggagggtgcatgggcatccacccgcatgcatactctgcaccccaccgacaatgtcgacaggactcagcatccccacggtcaacccgcaactcctcagcagcattaccctgagctcctggagggcgttcgcgatgtaggcgcagaggcctgggtgcctggcccgctgcaccgccagcccgtacagcctctcccgtgtgaagagatccggtcgatacaggccccttgccgccaggattgcatgcaccgccgcctcccaaaactcgagtagcatgtccacaacatcgacgacggttgggtgggcggcactggcctgcatctggctctgacctcgaggtgctcgagcccgtcaccggctgccggctcgccgcagccccggtcggtgaggcatcgatccgaggagcctgatgctacattcggctgctggaatggctctgccgatcccggattgctggaggtccatgcttacaggccaggacggctctcccttgatccgcaccatgcagcgaccatgatggcatggcattcttggcgggggcatgcagcaccatcaggaagtgattcccccgatccaggcacccagcacaccgccccctccccgccgcaccctcaatccccccagcactttgtcaggaatgccttgaggcggggcacgtacagcgggctgtcctccacgttgtcgtggtcggcgccctccacccacagcgcctccacggcggcggggcacagcgtggccagcgtgcgcccgtgccccaccggaatcacggagtccgccgtgccgtgcaccaccagcgtgggcgccgcgatcctgggcgcggcggcgtggttggggaagaggtctgcccacgccggccagcgcgtccagcccgggttgagcacccgcatgcccgacaggaagggggagtgcagcacgacgccggcggcgcccgcgcccgcgggggaggccgccaggtggcaggtggggccggagcccacggactgcccgtacaggacgacgtcgcccggtgtcaagccctcgtcccgctgcagcgcggcgtacaccgcgtgcacgtcgcggttgatagtggaggcggcggggacgccgccgctgcacccatacctggtgggggtgaaggcagggggtaggttgtgagattgcgatgcagagaatcgggaaaggaaggggaggttgagggaggggttcgcagcccctcatcgcactgagaacccacatcatcggcagatgctcgaccttgcggcatgcccctgagaaccatcagcaggcaatggtctcacaaatgtcgcccccccttcccccgcgcacatgagcaggccccacccccccggctcccctacccgcggtagtcccagcccacgacgttgcactgcagcaccctggccaggctggcgtagagaggcagcatctcccccaggtccaccgcgttgccgtgggagtgcaggatggtgcggcgcgtggggttgggggcgggcacacgtaccaccaccagctggtgggaggaggaccccgccgccggcacccaggtcacgcgcccctgcggcaccttccgcacagccctgaccgacagaacatcatgcatgggaggcgggttggggttggactagggctgcacgacatctggtgaggaagccctggtgactgtgagcgagcgcaacctgccccctggaatcacaaggcatgatgacgtcttcctcgcgccacccaccggctgaggggcttgcagtacagcgcgcggtcgccatcaccatgctctgccacggtataggtaggcacgggaggaaagaatgccagcctgccgctgatggagtcgaccagcttcgcgaggaccatggtccccacagcttcactcccacgagaccgatgcctcacatggccctcctaccaggccttcacatacgacatgagggtgcatatttgcaacttgggtcggcaatcacccatcgttctacctcaggcgagcggtatgcaccttagggtggggtttcgtgaacctgggagggcgcgacaatatatcgatatgatttcaaaacctccagacacatagcgccaggttgccaaaacttgcagcaccacgccgcagttgcattcgtcagtaaacaaaaatggctgaagaggacctcctactcgcactggcagaggagatcaccccggtcgacccacttcgcgaaccatgccggccagaacccactcggggcccaacggaggtagtatcgcgccctcgcttcgccggcccccccagccagcctggatgcattcccatacttggcgaacgaggcgatactgcattcggagacttgatcagccgggggcaggtgtcggcaaaatccacctccaccagccggcccccgggttatgcagaagccggccaaggctcgtatgtgcagcgcatcacgggactcaaggtgaggggccaggtacaatgaccagctatgacccattaaatttaattccttcagcaacatcaccccctacccaatggctgcagatgaagaaacccctggtgtccagttctcagctgcagtccaggttgcaagacaccgccgtgctgaaactgtcacagatcaggtattgtacaggaaaaccgggcgattcagccctttttgggttctttcaaagttcctcaaccttcaccgtgcccattggagcaccggatcttccactagtatttgcgtcatgtgcgccatcttcagatccagtgtggtgctgatgcaggtctcggttcacatccacgggcctcgtcgggtcatggaccaccctgtgtgtgctgggggagcgcagcaaagccatgcagtcgtccactggtgcgttctgagagtggaagaaagaggaggggtggagtgcatgtgtttgggaggtggcagtctccggacacctatcccctgccacactggccttcccaagttgacgagtacaagagggtccttgagcctacaccatcaacccttccattcaccccacaatcctggatcaggcagcacatacagcatctggaagctgacagacctggatcagaccacgctgtccatctttctttttagcggagcacacgacgagctgtggaagcaggcccctggcaccctgatcgccatcttcacccccaaagtgaagaatgacagggagctgtgtctgacagcaatttcaggagaccaggtgtgggtcctcggcacggcagccgagttcgggtactgcagggctcagaagaaggtatggcgcagggaggagtgcatgtacattccgaatgctcgacacgaatgtcctcttggcccttgcgatgcagaaacgagcacctcagtgggcccctccccatcccgtgccgagaatgttgccacagtgccccatcgtcttcctttcatcccctcccaggatggtcagccatgccgggtccccgtaaatatggcgcgctgccctttctgtccctaccatgttcaggtaggcattcttctggagcactgtgcacagatggtagcacaaagagagagttggggatttctcactgtatacttgggtcgcaggtctgctctgttctccagtccacccctaacggacacccccccc

SEQ ID NO: 23022 - DNA, 80 bp, Chlorella protothecoides
gctccaatacttttctgatggcatcttgagtgccatcagcttttgcccaacaccggagctgagctttggtggcggcgcca

SEQ ID NO: 23023 - DNA, 96 bp, Chlorella protothecoides
gccgaggtgcacaaagagtcacgaagatgagttttgagctggattcttggcatactaagagatagaagcgcatgcaaatataagtcatccgccggc

SEQ ID NO: 23024 - DNA, 61 bp, Chlorella protothecoides
tcgggcttcagagccagggacatggctgggtgcgggccaggggcgcactgccgccgctggt

SEQ ID NO: 23025 - DNA, 76 bp, Chlorella protothecoides
cctccccccaacccccattgctcaaccattcaagtacccccccttccccctcccacaggacttcaagcccgactac

SEQ ID NO: 23026 - DNA, 118 bp, Chlorella protothecoides
atcttctatgctctacgcagccgcacgaccatccatgccattaggccaaaagtaattgcggcaggggggtcgatgtcttgcttaaactgacagttctgaacacatccatatcggaagg

SEQ ID NO: 23027 - DNA, 79 bp, Chlorella protothecoides
ggcggcggcgtacatgagcttgtccacgtagcgcgaggaccagtacacgtaggtggcggaggagtatgccgcgttgtac

SEQ ID NO: 23028 - DNA, 72 bp, Chlorella protothecoides
gatggtgctcaggactgtggtcaggctgatgtatactctaaggattattattcacgtccccatcgatccatc

SEQ ID NO: 23029 - DNA, 89 bp, Chlorella protothecoides
gcacatatttggcacatgcatagactgccaatcctccaggatgtaccactgcagcaggggctgtcctacctctgccacccagtcaacaa

SEQ ID NO: 23030 - DNA, 134 bp, Chlorella protothecoides
catctctcagctggtatcacggagcaggtcgccagcaagtgcacacaaacatatttttaaatgctaccataaacggaaggaccatctggtgctgatgtttcgctgctgttttaacgctcttgacctctggaggt

SEQ ID NO: 23031 - DNA, 157 bp, Chlorella protothecoides
cactcatacgccgctgacgtggctccagctcgtcgcctcctcgggcagcgatgtctcctgggtgtcgcagaggaggcccggtgacgtgtggttgttgtttgaggccgagtgctcaggctgcagccaccgccacccccacgtcgcctcctcgctgtca

SEQ ID NO: 23032 - DNA, 78 bp, Chlorella protothecoides
cctgtcgccgccctgcaccaccgcaaacctgcacccctctacacctaacacagcgcctggagcccaagacattcctgg

SEQ ID NO: 23033 - DNA, 63 bp, Chlorella protothecoides
gaggacagggcagcagctgcagaggaggcgctctcggccgtagaggagagggctgctgctgca

SEQ ID NO: 23034 - DNA, 61 bp, Chlorella protothecoides
gctacagagcacgccgcaccatgcacaaccaaagctgcccttgggccataccttggctgcc

SEQ ID NO: 23035 - DNA, 79 bp, Chlorella protothecoides
ggtggtcttcaccaggagcatggccagcgcgcgcagggaagccctctgccgccggttctccagctccttgcaggggcgg

SEQ ID NO: 23036 - DNA, 77 bp, Chlorella protothecoides
atctgtctatacgcaagcttgcaaggaccttaagtggatgtgctggacctccgtttcaggccactcacaggaaagtg

SEQ ID NO: 23037 - DNA, 61 bp, Chlorella protothecoides
gcagtctagggtgcatcctctacccagtttgtgactcctcctttgatgccagtggcctctg

SEQ ID NO: 23038 - DNA, 2675 bp, Chlorella protothecoides
  modified_base (2065)..(2074): a, c, t, g, unknown or other
ccccagccctcctcctccttccccgccgagccccccaccgccaccctcgcccccgagccctcctccgtccccacccaatccaccgtccccgcccccgagccctcctgcgccgccgcctcccaactcactgaccggcacagtctcgttcaacaatctgaacatggcgggcgtcaatattgtcctagatatcacccagtcgggatttgtcggctatacgtttatggcgtatgtttggacgagttatttgggcaacgccgctaacgtcgcgaacaccatctcacagtcatccatgcagtttgttcagttcgtccagtataacgcatgcaccgaatatggctacaccagtgtgttgatttatgacaagaccttcaagatcgtggcggttcaagcgctgaccctcatctccaatccccccccccctccttcctccattggtgtgtgcggtgactccccgatcgtgttgagcagcagcgggacgtgctccgaccctacccccgtcgtggtgatctgcaccgtgtcaggagtgcccaccgccacctgccaagctgggactcagcccgagattcctggctgtgaacatatgccagtccttccgacagcgggtgtgtgctcaggcagcacgcccaccctcctggtttgctctgtcgagggcgtggtcagagcaggctgcgtgtcagccttccaaccacctccaccaccgtccatcccaccacccccaccgtcactgcctacagtttctggcactgccgtcttatcaggcaccacagtcacctttaccatcaccgcgtcggggaccctgccagatttctataaccttgggttcttcacgaaggaaggcgcaatggcgacatccgctcagaaacgcctcacaactcagaccaaccctcaaaaatgggatcagaagttcaaagccgatatgacatcattcttcagctacgtccaagtggtggcgggaacaaaggcaagggcctactctctgcccaccacaataatgctctgatctagaatgttcctccgtactgggtctgcaagaacccaccctcactgcatatctttatgtaactcaccatgttagggagcttcctctgcagtgaagtggagccaggggaaacagagatgatatgggaggaacggtagaatggttgcacggaagggtgtccagatctcaaaggcttttgcccttccccgttacgccagcaccaggtctatggacacatgcacgtcacgcacatgcctgagcgcctggcagagcgcagggtcctcggttgctgtgcagcggcagtgatgctggcccagtcggtcccggtcgtgcagcaggcgccagtggcacggggggattggagtctggtgagtccaggcacccctccaaggatctgtggaggatatgagatgttgagaagaaatgcgcttggcagaggcgcacagccgacatcttgcccacgagcacaggcgcggggcatgagcttgatcaggctagtagccaggcaaggccacacttagttactctgccgaccaaccgtacgaccgtgtatcgaggtcgccgctagccagaaaagacgcatgagggaccccgctgttggagacatcccttctttgcgagctggtgggcacctcgccaagtggcacagtcggcgaggcaatcgaaggagtgttgggcctgctgaggtcccacccgggcacatcaactgacgtcaagacttggcagcgtgcgaacacggtcaccattgcagatggtagagtgttggcagggctgaccactggcgccaccgccgcccgtctctggtcgcagcttgcaccgggttggcctggcgccagagtaacaagcatgtggcgtgctgtacgggtgggtaggagcgcggaagcaacaacaaccgtgtccagctcctcgccgggtggggccccctcgctgggtatgcgcttgtcgccccatctagatggaggtgaggcgtctttgcaacctgtgtgcatcttggagctggtctgcacggcgagtgccacgcaggatcccacggtgcgccatacgccgcaagcacaagcgcggacgctgctgggcatatcaatggcnnnnnnnnnncccccggccccttcaacgctgcgcaccagctcctcttgacccagggtttgcaagcctcttccatggcacacattccccctgtcctcgctcttcacagatgcagtgctggtgctgctgctgctaccattcctaggcgagctggtgtgcccctcgcacgaaggagtgctggctcaggcattggtaggcaaactgtgcatgctcgcgtctgacctcggcgcatccacaacgatgagatctggcagcgcaagcgtgttgcactggcacccatcattgctgatagcgacgtgttgccggagctgaccacggcagcctctgccgcccacctgcggtcggagcttgctgcgcgtgggcctactgccacggcgacgagtgcgctgcgcgcttgcgggtggctgaggggctcatatgccagcgcggcattggccagcgctctgctgtgtgctgggccgacactaggtgcgtggtcggcatcaggcttagatggaggtgaggcgcctctgcaacctgtgtgcgtcttggagctgatgtgcacggcgagcgctacgcaggagccccccgctgcgccaagcgccgcatgcaatggcgcggatgcttctaggcg

SEQ ID NO: 23039 - DNA, 75 bp, Chlorella protothecoides
aacttcctgcagccagaccagcaatcatgatgcctccaagcccctagcgcctacatcaccaaggtgcacccttcc

SEQ ID NO: 23040 - DNA, 81 bp, Chlorella protothecoides
cctttctctatgatgcagggaatgccgcgccactccctagctccacctgttgggtggattgtgcatatcagtgatccgtag

SEQ ID NO: 23041 - DNA, 102 bp, Chlorella protothecoides
aggctggctgcaagaccttcactcgactttcgtcatgcaatggatttgcacatgagcccatgggcgtccctctggccacaccggatgtcctccaatggaatg

SEQ ID NO: 23042 - DNA, 61 bp, Chlorella protothecoides
gggagaaccggcccatcacatacaagtatattgaccgcacctgcttgggagcttcctgcag

SEQ ID NO: 23043 - DNA, 91 bp, Chlorella protothecoides
gtagcagcgtctccatggtatcttcgcatgacagtgatggtctgcgtgtattcaccaaccatcagccgttgacaatggtgccgccgttggg

SEQ ID NO: 23044 - DNA, 64 bp, Chlorella protothecoides
agatcacgacatttcaggcgaggtccctccctctatatagaacttgcaccctacgtagtacctt

SEQ ID NO: 23045 - DNA, 32749 bp, Chlorella protothecoides
  modified_base (1667)..(1676): a, c, t, g, unknown or other
  modified_base (1852)..(1885): a, c, t, g, unknown or other
  modified_base (2317)..(2326): a, c, t, g, unknown or other
  modified_base (3222)..(3231): a, c, t, g, unknown or other
  modified_base (3572)..(3641): a, c, t, g, unknown or other
  modified_base (3992)..(4001): a, c, t, g, unknown or other
  modified_base (4528)..(4537): a, c, t, g, unknown or other
  modified_base (4889)..(4898): a, c, t, g, unknown or other
  modified_base (5136)..(5145): a, c, t, g, unknown or other
  modified_base (6081)..(6090): a, c, t, g, unknown or other
  modified_base (7245)..(7254): a, c, t, g, unknown or other
  modified_base (8012)..(8021): a, c, t, g, unknown or other
  modified_base (8878)..(8887): a, c, t, g, unknown or other
  modified_base (9394)..(9403): a, c, t, g, unknown or other
  modified_base (9774)..(9783): a, c, t, g, unknown or other
  modified_base (10182)..(10191): a, c, t, g, unknown or other
  modified_base (10594)..(10603): a, c, t, g, unknown or other
  modified_base (10807)..(10816): a, c, t, g, unknown or other
  modified_base (12549)..(12558): a, c, t, g, unknown or other
  modified_base (13371)..(13380): a, c, t, g, unknown or other
  modified_base (13696)..(13705): a, c, t, g, unknown or other
  modified_base (13956)..(13965): a, c, t, g, unknown or other
  modified_base (14298)..(14307): a, c, t, g, unknown or other
  modified_base (14769)..(14778): a, c, t, g, unknown or other
  modified_base (14871)..(14880): a, c, t, g, unknown or other
  modified_base (16108)..(16117): a, c, t, g, unknown or other
  modified_base (17454)..(17463): a, c, t, g, unknown or other
  modified_base (18341)..(18389): a, c, t, g, unknown or other
  modified_base (18576)..(18585): a, c, t, g, unknown or other
  modified_base (19499)..(19508): a, c, t, g, unknown or other
  modified_base (20323)..(20332): a, c, t, g, unknown or other
  modified_base (23057)..(23066): a, c, t, g, unknown or other
  modified_base (24750)..(24759): a, c, t, g, unknown or other
  modified_base (25006)..(25015): a, c, t, g, unknown or other
  modified_base (25693)..(25702): a, c, t, g, unknown or other
  modified_base (26558)..(26567): a, c, t, g, unknown or other
  modified_base (27408)..(27417): a, c, t, g, unknown or other
  modified_base (29136)..(29145): a, c, t, g, unknown or other
  modified_base (31255)..(31264): a, c, t, g, unknown or other
  modified_base (31867)..(31876): a, c, t, g, unknown or other
  modified_base (32029)..(32038): a, c, t, g, unknown or other
  modified_base (32200)..(32209): a, c, t, g, unknown or other
  modified_base (32263)..(32272): a, c, t, g, unknown or other
  modified_base (32565)..(32638): a, c, t, g, unknown or other
gcggccgccgcgctggccgcgctggcgctgccggagacgctgggcgcgacgcaggaggtactgatcgccgaggcggtggccgcgccgcacatgaagcgggcgcggtcctggaaggtggcgctgcgccaggtctggaggggcggggcgcgcgggcgggaaggggaaggccagcgcgggcgggaaggggatggcctgccccccggcggcgagtagagcaggggtgggtgtgagagccctggggctttcagacatccacagggaccgagggcgagggtgcaaaggccgtgccgtatggtgcgcccagcgctgctccagcccgacgccaaacccccatcgcatgaggcctgcccgtgtcaccatctcaacgccacccgtcagcattccttgtacccctacatgccgccttcagggtggctgctctgtaccatgtcgttgtctcttcccccatcctcttgtgattccggcacatcagctacatccgcaaggtgaagaacttatcctgtacccgatcgcgcggtgcctctctgtggacgacgagggccgcattgcaaaccctttgtttcccatcacgaacccacgaccgggcagggatggcggcgagtgcgggactcaccccggccctgacggtgccggcggcagcacggttgcgcctcgccctcccacgccgtgcgcgaggccgacgcaccatctgctgcgccgcgccgatacccagggaaaccctgctcgaggtcgctcggaatgccgccaaggcaggggccgcggtgcgtggggaggggcctcggcgtggtggggagtggcaagatcacttcgccggcacccacacacacaccctgcaccccacccgcccccgcaggtggtcctcgccaatgctgacaagccccgcatcatcaagcacaaggggacgacggacctggtgacagacaccgacagcgcgagtgaggaggccgtgctccaggtgcgcggctccggggcccccttggggaccaggccctggccccaagcagtgcgccaggggcgggccgatggatcggttaccccccggccagaccgccgtgctgcatcttgcacagtccccacccccaaccccgcaggccatcacccgggcctacccggaccatggcatcctgggggaggaggggggtgtcatgggggacgtcacctcagactacctctggtgtgtggacccactggacggcaccaccaacttcgcgcacggctacccctccttcgccgtgtccgtaggcgtgttgcgccacgccgtgcccgtagcgggtgtggtgatcgagttcaccggcggccccggcggctggatcacgcgcacttacgaggcagcgcgtgacatgggggccacctgcgacggccgccccatctccgtcagccgggtgaaggtcctggagcagagcctgctggtgagcgttttggtctttggggcaaagaaaggggagcgtccgcagcttggtgctgcgctggcggcaggctagggttgccaaggcgcggggccgcgtgaagggagcgcaggactgaacaacaaacgcaccggcaaggggctccggacccctagtacatcactccactcctcccttgccgctgacccccctccgtgcctattacttccatcccacccttgagtaacaccccccccccccgggcgcgccagggggcggggnnnnnnnnnncagggttgccaaggcgcggggcggcgtgatgggagcgcgggcctgaacaacaaacgcaccggcaaggggctccggcccctagtacctcactccactcctcccttgccgctcacccccctccgtgcctattatttccatcccacccttgagtaaccccccccccccccccccccccnnnnnnnnnnnnnnnnnnnnnnnnnnnnnnnnnnaccacgacgagtgctgggcggccaacatggacctgttccgggcgctgacggacgtgacccagggcgtgcggcgggagggggcggccgccgtggacttgtgccacctggcggcggggctggtggacgggtactgggagttccgcctgaagccctgggatatggccgccgggctgctcatcgccgaggaggcgggcgccacggccaccaccatgggcaacggcgcgctgtcaggtggctagagtggggagtgtgaggggagtttgtgggggctgggtggaggatcgatgaccgtggaagacaggaaaagggacaggcggaggggctcctgcgattgattactcaagggtgaggcgactgttcccacaacacggattgtagcaaggctgagcaccctctcggctggtatcagctctcccctgcccgccatcactnnnnnnnnnngggtgaccatgggagacaggaaaagggacaggaggaggggctcctgcgattgattactcaagggtgaggcgattgttcccacaactcagagtgtagcaaggctgggcaccctctcagtcggtatcagctctcccctgcccgccatcactgagcctgatcactcccacgacttgcatgcagtgttcgaccgcagcctgttggtgaccaacggcttcgtgcacgagcagctgctggcgctcacggatcccaaggtcagcgccctgctggaggcaggggtggacctgagccagtggtttgtcccggaaggcttcaagctgcacacaggggcgcggctggcatgaacacccgctagccagcctcccgtgcagaatccccttggcctgcttgcttccgctcacgttcaacagatgttaaacttgagtacaggcgagtgacagaatgaaatggcggctgctggggcaggcctcccgtgtgtcatagggttgcgttcgtggtggcagggtggtggggaccagagatggctgcagaactggcagtatatgtaagtggtgaggcaaatttgttggagggggtggtcaggggccagtctgcacgccgacgaagaagacgatgccggcggtccctgggatggtggtggcgccggcgttgcgcagctgcaccgccacctgcaaggagtgagggcgtggcatttgtgaggcaggaggtgctggggacgatgcggaggcctgtggtgagaccccgcagctagtcgctggtgaaggagatcgacaccgcaggctggcactggccagtcccagcgcgcaaaccaaagtcccctcgccggcccccctggcctggccacgcaccatcatcttggggttgctcttgacggagaagccgacgcagacgatgcccgnnnnnnnnnnccccctcgccggggtccactggcctggccacacaccatcatcttggggttgctcctgacggagaagccgacgcagacgatgcccgggttgtaccagcggccgtactcgcaggacagcttggcaccggtgatccccgtccccgcaaactcggagtagtagtacaccgtcctgatggcgccgggcgcccaggatgacgtgatggggaaacggagccagtctagctgcaagaaatttttggtgggagcactgttgattgtcaatggggagaggccagggagggttggaggacactggctgtgttcatgcagggacgtgtcccaaggatgcagcctgcagcacgnnnnnnnnnnnnnnnnnnnnnnnnnnnnnnnnnnnnnnnnnnnnnnnnnnnnnnnnnnnnnnnnnnnnnncctccccattgttgaaggtggaaaggctggtgggggaggtcagaaagttgctcacgaccccggcggagcccaccgtgccgatggagatggaggtggctgcgtcgcccgtcatgctgaagaacacctcgggcgccatcccgcccgccacgttcagcatggcgttcaggcccctggagggttgaaaggtggtggtggtgggcgagggggtcgtatttgggagatgtagactcaggaacggtgcatccgccttgtgtctgccgatcgtcacggccttccagatgccctgcccctcggcaaagcatttcccatcccttcctccgctctatcaatcctttgaagaccactcacttnnnnnnnnnnttcccagacgccctgcccctcagcaaagcatttcccatcccttcctccactctatcaatcctttgaagaccactcacttgtaggcgccggtaatcatgttccccggcgtgaccagcccgcccagccatgtgtccacggagaagcggacaccctggaccgcagcgctggcgtagttgttcacggtggaggcctgggtgacagtcaggaactgggcagggtcgtaggcctggaaggtgacggtggtgctggacagcgtgccgggaaccccaaagaaaccgaggccggaggcggtgagcgaggggtaggtcaggccgctggtcagcacaaagttgatgttgacattgacattggaaaaggtgtcgctggagctggcggcgcggaaggtcaccgaatgctggttggactgcgcttgttgatgaacaaggggggagggggcaggaggagggtgtgatgctgcggctatttcaagaggagatattctagcatgggcgggggtgtccagcacctgcaggcgcaggttgagcgannnnnnnnnngtttctagaggggatattttagcatgggcgggggggtccagcacctgcaggcgcaggttgagcgacctcatacctccttgccctggggccctccgctgcccctgtgaagggtcatccagcctcacctgcgccgcggcgacgtggccgaccaccacgttgctgatcgtcctcggggtggtggtggtggtgtcaaaggagatgccctcctggcagtaggacaccgtggagatctgcaggttcaggcccctcacgcctccctgcgagcagaatgaggaggggggcacggagcctgaggctgcgaggcggctgccggtgttgcccaggcccaccacatctggagagcatctccatnnnnnnnnnnccacggagcctgaggctgcgaggcggctgccagtgatggcgaggcccaccacatctggagagcatctccatcaaggtaatccaatgatggtgccaccattgggaccagagttgctcttctggatcgagttgccaacccgcaccggcaacgccgaatggcagaagaggtatgcccttctcccgcttggcctctccaccccatttacgcctccccctgcccaatcccttcacatcgacannnnnnnnnngcggcagaagaggtacgcccttctcccgcctggcctctacatcccatgtacgactccccctgcccaatcccttcacatcgacacagccgcccacccacctggaccttcacgcagaagccggtgaagtggcggacggagggcaccacaaagggcctggtgtactcgcccggtctgaacatgacgcccctgccatagttgttcagggcgatgatcatgctcagccgggtgccaaacacctcattctggtagttgacataccattgctgcgtggtgaggaggcgggggttgggggttggccgaggattcaggcgaagcgtttcatgctggtcggagcaaggggtcctcgcggcaccacagccacccagtctgggcgcaggccagggtcgggtgggatcgccccaggccatggccagcctgactttttgcccgcaccctggcgatcagtgcaccccatcccagccggggccccctgcggccgccaccccgcccacccgagagaggtagaagatcctgtgcaggaggagggtgcaggtggtggtgcaggagtcgccggcacgctgcaggcccacccagtcggactctccgccctggatgaaccagtcggggtagatctgccgctttgctgcaaacttcacggcgcctgtgtgtgtgggaagggtggtggaaagcgagcgacttggtgccagtgccctgtcaacatgactcccatgctagaccaacgaaaggctgcgcacacggcgcctttgccagagcccccctgctccccctctcccgacacacctgcgcctgtgaagaaagcatcacccacgattggggcccggtacacttgtgcggtcaaggtcagcgtgacgcccgggcccactttgagggaagtcccagagcctgatgggttttaaatgagcaggtgtgagtgtgagggagctatggaggaggatnnnnnnnnnnagacttggtgccagtgccctgtcaacgtgactcccatgctaggccaaccaaaggctgcgcacacggcgccttcgccagagtccccctgcccctcctctccagacacacctgcgcctgtgaagaaaggatcacccacgattggggcccggtagacttgtgcggtcagggtcagcgtgacgcccggtcccactttgatggaagtcccagagcctgatgggggttttaaatgagcagatgtgagtgtgagggagctatggaggaggatgagaatggatacatctgcgctggtgcatttttattttctctgcccagggccatcaggcagctcctcccttcccccgttcaccgcgaacggttctgcttacaccatcgggatctggccttttcagttccccttttcccccacaaaatataagaatcacatgcacctgctaggatgggcttggtgagggtgatgctcttggcgatgaggtaggtgcccacggggaggtagacgtaggactgggcagcggcggtggcgagcagggcggccgagtcgtcggttgtgccgtcccccctggcgccgtagatgcgcgcgctgcgtgtgccggggcagcccttgcccaccccggccatggtcttcacacgtggcaccaggccagctggcagctgactcagcgtggcccggcccaggggcgtataggtggtgggtgggggcggcggggaggccgccacatactcgggcgggggcggggaccggggctggggaggggaggccgcagcgctgctgggggccagtgtctcgtctggcatgctgagaccctcgcccgagctggactggctgaaagcggcgtcctccatggatgcagcggtcaccctgagttggcggccaggtggagagggtgacactctgcggacagccgctttgaaatggttcacatcgtctgacggcgagctgcgccggcgcccatatccaatagcctcgctgccctgcgtcaaccctgccctgcaacatcggtctgccgcggcactcagcatcatgcacaggttccccccccccacctcctcttcccaatcaaacagaaagcgtggtgtagacgcaccctgcggtggccttttgcatgccttccagggcccgcagcgtatcgctcatggtggcctgcaggatgtccaccnnnnnnnnnnctggtctgccgcggcactcagcagcatgcacaggttcccccccccgcctcctcttcccaaccaaacagaaagcgtggtgtagacgcaccctgcggtggccttgggcatgctttccagggctcgcagcgtgtcgctcatggtggcctgcaggatgtccaccgccacgatgcgcgagatctggttcacagtgtaactcagcactggccccgtgtcggtgtcgttgatggaagaggaaggggcacggggtggggagggggggctcgtggaggcgcggatggccgccaggtcggcgaggtaggcctcccgggtggggttggcggacgctatgccgtcctgctggagtgggacgtagcccgcgaccagccccgcggtggccagcaggtacaggctgagggctctaagacccatgcttgagttcaggtgtcctgggaaggggaaagggggggccccgtagggcagatgggtcgtggtcaagctggaggggtgggcgcccgtgccggaactggcaaaccgggggtcgacatcgggccccgacccatcatccagatcttggggttcggccacacttatgcatggttttaccttgatgggtgacgctgggggtcagccggacatgcgggcggggcagggaggtgccagtcgggagatggcccgtggttccacctactcctccagtccacagacgttcttactggggagcaaacaccgagaagatccagattctgcaccactctctgctccaaccagtggaatccgannnnnnnnnntacctactcctcgagtccacagacgtccttactcgggagcaaacaccgagaagatccagattcgacgccactctctgctccaaccagtggaatccgaccactctccctggtaagtctgtcggccggtgttcgtaacggcttccggggcttccggggcttccggacgcaaccctttcccacccccctttcttcctgggcagcttcctgggttgttggaccgcaccgccttgccaatggcatctggtccccctcataccgcacccggtccccttttcaaccacaccatcatgtacaatgggttacatgggttctgtccagcctgtgcgtgggtatcaatattcagaagatggagggcacggccccatggcacggcctgggggccgttgcctggcctcaggcgcctcccagagtggcaacagagatggaaaaggggataccgggtccggaggccttcaccgtggccccactcatgttgatgagggtcagtgctacctcgtacttgacattggtgccggtggccgagttgtcctgcacctgggtgcaggacagcgctggaaggccggtggccttgagcacgggcgcgctgcacttgatctggtacagatacttggtggccaactggctgtagatgtagaaagtctgagtggtgccggcggcccagtctgtggcggcacagagtgagagggtgggtggcgtgaaggggggcctgggggttctcatgcagtggaggtcgtcttgaggatggcggccttgccagggacacgggggggaaacccggcaacgatcaaggcccttctgggtagaagtgcccaatttcagaacacccccagctgcagtgtccagcaggcatcgtatgnnnnnnnnnngggggggcctggggggtctcatgcagcggaggtcgccttcaggatggcggccttgccagggacacgggcggcaaacccggcaacgatcaaggcacttctggatacaagtgcccaattttagaacaccaccagctgcagtgtccagcaggcatcgcatgccacacttgcacaattccagaggcagcttgccccaccagagtctctcccatacctgtggcggggatggccttgagggagaagaagttgcccaccagcgccttaccaccgttgaactttgccttggtgttgctggatgtcattgccctgaaaatgtgcacggggtggggtgcgggatgagagtggtgaccatacccgctgcaggctgagcctgagtctgagcgacctcttgaaccaatcacaaggtgcacgctgcaaccggggcggccatccatgaccctaccacctcacaccgcttgcaccgccgaggctgttccccaaacccccaccccctccctcacgtgatgacgnnnnnnnnnnatggggtgcgggatgagagtggtgaccatgcccgctgcaggctgagcctgagcgacctcgtgaaccaatcacaaagtgcacgctgcaaccggggcggccgtccaagaccctaccacctcacaccgcttgcactgccgaggctgttctcccaacccccaccccctccctcacgtgatgacggtggaggtgctggcaggcgtcagctgtccgctgagctccagcaggttgagctgccccaccaggcccaggcccccctccttcagcgcggaagccaggcccagggtgtactgcccgatgttgtgctcgccggcaaagatcgaggcgccgttggccagcgcgccgatggacccgatcctgacagggaggagggnnnnnnnnnncgccaggcccagggtatactgcccgatgttgtgctcgccggcgaagatcgaggcgccgttggccagcgcgtcgatggacccgatcctgacagggaggagggttttgggagggttgtttggagggagaggacaatcgccagggggacacagtgagtacatacatggtggacggatggcttgggatggcagggggtggacagtggtgaggaacagtatttcctcatgcagcggtttacagcctgcgcccacaggacagtctggtcgctggttggacaggtcgtgcagacgctggtgtggccaccataccccctacccctctcaggcacaccgccacgcacttgaccacggcgcgattggacaggggttccgcccgaaccaccgcgtagcgggtgttgctgnnnnnnnnnnagagggttgtttggagggagaggacgatcgccatggggatacagtgagtacatacatggtggacggatggcttgggatggcagggggtggacagtggggaggaacagtacttcctcatgcagcgccctacagcctgcgcccacaggacagtctggttgctggttcgacaggtcgtgcagacgctggtgtggccactataccccctacccctctcaggcccaccgccgcgcacttgatcacggcgcgattggacaggggttctgcccgaaccaccgcgtagcgggtgttgctggcttggggggagatggtgccaatgttccactggttgctgtcccaggcgggcgtgctggaggaggatcctccgtaaaacatgccgatggcggagacggggatagaggcgggnnnnnnnnnngcccagagagatgtcatgcaggtccctcaatcaacacccaagcgtttggttcttgatcctgtatcgtgatcagtcaccgtcgcaatggctagcaatatagaaaagggagattcttgatcttgagagggggcccgcaactttcccggcccccaccgatgggtcctctctccaggtcatgttccccatccgatctcctccgcagcnnnnnnnnnncgcaatgcctgccgaagcggtgagaggggaggtggagagggaacgggaagaggacatggcataaaaggccaagtgcctggagtacaggtgtagttactatgcagcgtcatctgaagaccccctgcgtaagtcgagccttccctacaagggatttgctgtgccaccggccatatccctcccggtccttattcccatgccggccatgccaggggagcctgcctccgactaatcacccaccgacaagactgttggtgatggaggtgaaccagatggtgttgtccaggcagttgttgatgtcggacccgggggtgactgtgaggcgaatggcatccccgcagttgctcagtgtctgagtttgggaggaggagggtgagggaggaggattaggcggtacccagagagatgccatgcaggtcactcaatcaacaccaaagcgtttggaacttgaccgtgtatcgtgatcagtcaccgttgcaatggctagcaatatagacaagggagattcttgatcttttagagggggcccgcaactttccaggcccccaccgatgggtcccctctccagttcatgttccccatccgatctcctccgcagccagttctcctcccttcccgacccacagaaaacgcacctgcagctggagggcggccaggtccgtgcctgccaggttgaggcagtaggaggagaagccggtgaggtggggcaggaccatcttgaaagtggccccaccctccgtgaagcgcacgccgcgcgtggcggcgccaatggccttcagccgcgcccctgtctcggacatgatggtggccgtgatgccaaacacgagctcgctgccgatggcgtaggtcttggaggagaagtagagcatggcggattggcccaccgagacggcacggtacgccgcctggatggcggccgcgtcatcggtggtgccgtcgcccacggcgccccaccactccgggaaagcgcgcaccgtgcccgccaggaagtccaccctgccgctccctgtttgtgggtggatgaggggttggggatgcaggtcgtgcagggctttaggggccaggctttttgatctcagggacacccctgtgcctgggctgcggtgcgcagcaggcactcatctcccttgcaacacggacaactcaaggcggcgcttgaaaccagtgatcaagctggctgctccccaaggacccttgatcagccacagggagtgtcgcccctgtgtcccggggatgagcgaaggcaagcatgcagtttgagacgtctcgaaggcaaccccaaacctcctgatcctgcacctgagaagaaggtgtcgatggagtgctctggctggttggagatgctcagggtgacgccggaggacagcttgaagatcgcgccatagtcggccaggatgggcttgctgatcgtgatgctggtgccgatgaggtacgtccccttgggcatgtagatgagcccgatgctggacttggagttcatggcggcaaacactgcggcatcgttggtcttgccgtcggccttggcgccgttggagatggcgctgatgtcggagcaggactgggcggccacacaggcgctcagcgccaggaggagcagcactcccctctggagcgacatggagttggacccccgggaactcctcagaagcggacctggatgggtttcgttcgcaaggatgagtgccggagggtgtccagtggccgccaatccagcgattccgtggtgggctgcggtnnnnnnnnnnagttaagttcgcaaagatgagtgccggagggtgtccagtggccgtcaatccagcgattccgtggtgggctgcggtctctcactccccagacaacgaccgcccaactgcgcggcaaccgcgacacccatcgagccgagtgccgacctgtgagattcactcagaggtgtcaaccagtatactatacctcctgcacatatattgaggcgctctgtgccttgatgcggtcagtcgcggccagggggcctcaagggctgaccgcactcgtgggtggtgaggaccggcaggagtagatccaaaggaggtctcgttcttctaggttcagattttgcagccgcacaagagtttggcccaccctcctgttaaaggggtgtcgtgccggaggtatgcggaaggtgggacccaaaagttcatgcgaaagtgccgccgtacccccctgcggggtacctttgtaaccgacagtccgggtctttgagggggacgtgggcagacccaccttccgacttcaacgaatccatatcttggagggggctgaatgaatcttataggtgcagtgagggtggaagacactcaggttatgactgacagaagcctcgtcccctgcagagtggctctcctcattgcgtgaggaatatccgcgagcgtcggacaacaggattcctcacctcggcatgcacagtccacattcttgggatgggttttataggacggcggtggttcgataggcacgcaaattcgtggcccgttttatgtttacggggctttattgatgcacgattttattttgagcctggcatcctattcgagcagctggcnnnnnnnnnngtcgtggcctgttttatgtttagaggtttttattgatgcacgattttattgtgagcctggcatcctattcgagcagctggcagttagcctggttctgttcagcttctctgatgggagtacctctatcagcgagatattctcgatgggaggtggacgaagagactcagtaccaatgggactgggcaaaaccgtatgggtacggcgctggctgcacacatagtactcttcgcatgtgcctgtggagaccatttaggcccaccaggcgactacacctgatgcagaaagtttgtctcccattcgcctcccgattatggannnnnnnnnnggaccagtacggcccgccaggcgactacacctgatgcagaaattttgtctcccattcgcctcccgattatggagtcatcagaaagcattgtttgggtcgagcgaagatagatctatcgtcgagtgggacagacacctcaagctagaatgcagtgcggcaagggaaacgcttaccttgagacttccacaaatgagaggcttcgaaggcatctgtagcagggccaaatcggtctttgatgtgtggtccttgannnnnnnnnnagaagatagatctatcgttgagtgggacagacacctcaagctggaatgcagtgcggcaaggaaaacgcttaccttaacacttccccaaatgggtggtttcgaaggcatctgtagcaggaccaaatcggtctttgatgtgtggtccttgaaggatacgctcgaaggaatgggtacgcatcctttagggggaggggggcggggtaatgtgcactttgtcattggtcgctgcgctatgcagagtctgatctgcaaaggatgaccttgtattacactgaacagttaaaactagcctgacgcaccagtttaaacaatgagtagtgccgagctgtgttnnnnnnnnnnaaaggaatgggtacgcattcttgaggggggggggggggctaatgtgcactttgtcattggtctctgtgctgtgccgagtctgacctgcaagggatgaccttgtattacactgaacaattgaagctagcctgacgcaccaatttaaacaatgagtagtgccgagctgtgttgtctcggatacaaaatgctgctcctcccgcaccctggagagcaaggatgagaagcccctctcatctaccggtgcattaccatgcgtcagtgtccacatgctgagcccgatctccgtaaattcggatggatggacgtaatgttcaagtctttgggaattcaggtagcaagcttgtggagccgctctagctaatctgagaggacggcagtgagctgtcattgagggtgctgcctgtgaacattcgtcatctcacgcactgtgggaattgctcccaaggctcaaataacttttgnnnnnnnnnngaaatgctgctcctcccacaccctggagagtaaggatgaggcgcccctctcatctaccggtacattaccatgcgtcagtgtccacatgctgannnnnnnnnntttgtggagccgctctagctaatctgaggggacggcagtgagctgtcattgacgttgcggcctgtaaacactcgtcatctcacgcactgcgagaattgctcccaaggctcaaataacttttgaatcaatcagcaaggcagcgcttttgcattagcatgtaaaaggggggtgaaagggcaggaggttgcgaaggtgagcaccctgacatatctcgcgggcgccaatcagattttcctcagatgaaccagtggatggggggcacggaacgtacaggttggtgaaactgcctcacattccagcttgcacagacgactcgatggcctcataccctactcgataggcagacgagcaaactctctacacaggcatctaaacccaggggaaagagcgcatgacgcgtgcggtgtctactcctgtcggtgtgttgctcagctgcagaatttagagcatgccgagattcatggcacagtttgccttcggaatggagtaggagacaaacatctgaatccatgctgggagtgtgcgagggactaggcgggctgtgcgctgttggcctgcggaccacacgctccccccggcctgccctcgccatgaggccccaggtgcgtcgtagaggatcgctggcaccctccatgttgcgccattacaccctacgccgctcatgatattcacacattgcccatgtccccctttgcgccggacaggctgccctgttctccaccgtcctgttctccccctccaagctccgcgtggccctggcgcccgacatgagagcgtccaggcctcatcccgactttccctctcggaagtacacgctcacgcacaacgacatcactggcaacctcttcctctccataggtaggcgggccctgacgggaaagtttcaacactgcatgagtttgagcgcatacttgcatgacccccaggactggctttgtggtgtcctgcaccgctcctccgatatcatcagccctcccacaccctgggacaggtccctgttacaaccagaggcaactctccaggctttacacccggctcctgcgtgacgaggtgctggcagagtggctgccgcatggcggggacctgcatgcggtggcgggcccaggcaccgcccaaccccgccaggccatgagcctgcacgtccactgccatgtcagcgggggcacagcctggacctgggcccccccgggcctgcggtcggccatcttccgccgcgagatgggcgtgnnnnnnnnnntgtccactgccacgtcagcgggggcacggcctggacctgggcccctccgggcctgcgttcggccatcttccgccgcgagatgggcgtggtactggcggccctggcctgggcggagcgtgacctgctctccacctgccccgccgcggcccaggcgcacgtggtcgtgcacctgcacagccaccagccggcccacgaccgcacgctggcctggggcaggctgggggacccctccagctggcccaccatggagggaaaggggctgaccgcgctgctgcgagtgctcctgcctgcgatgcaggaccgcgcgcgtgaggagtctgagcgggcggggggccagggtccattcccttcctctccacacacgcctggagagcctgctgggcaggggcctgcggacgcagcacagcccggcagcgcagagccggctgcaaggacccagcaggcagaggacctggtgatggtggagagcgccaccctggagctgaggcggccgcccccggatcgagacccggatgactgcgtggaggagctgtgcatcgtgcctttgcctgcccatgagctgaagcgtagtgcatcagaggtggtggcgaggtgactgccattctcctcttccaggcgtggcacgccctcatccagtcaaacgactgtcgtgaatggcgggagcgcccctcatgctgcaatcaaattcgctcccaatgcgatgcaatctccctgaagctgtgtcgcagtgggaaggaggttgggtgtgcggtgctccatgtcctcacccgctcgcaaccagctccagacccacccagaccaaaattgtggattttggcgggaacgtcgcacagccgcccgcccgtgcctgttaccatcggcgtcgccctgccattaaagcccgctggcgcaccgcaaactccctctccacagcaaacacctagcaggttaaatttacctgccggtaacgaaccggtttggtcctgctagacccccgtcaccatgccttccgccaagcagcttgtgaagaaggaggcggtgagctgggctgccagggatggggcttcggaccctggagtctgatgtttcggaaggcttactgtctgaagcagtggtggcctgtccatcaacgcgcacatgacgcaccctgcttgccccccgccccctccccccgcagtatgacgccaagctgtgcgagctgctggacacgcacaccaaggccttcctggtgcacgccgacaatgtcgggtccatgcagatgatgaacatccgcgcggtgagttggaagacgttggctggactcgcccgggctcctgcgagtcgcggtctcctccgctcgccatgccctcctcctgccnnnnnnnnnnggggctcctgcgagtcgcggtctcctcccctcgccgtgccctcctccgctcgccatgccctcctccgctcgccatgccctcctcctgcccccccaccccttcctcctcctctcgccccactgattccccctcccctcccctccactcacgaactcccagggtctgcgcgagaactccacggtgctgatggggaagaacaccctgatccggcgctgcctgcgtctgtacgtggagcgcactggcaacgagcagtggctggtgctgctggaccatctggtgggcaacgtgggcctgatcttcacccagggcgacctgaacgaggtccgcgacaagatccaggagttcaaggttggcgccccggcacgcgtgggcctggtggcccctaacgatgtgacggtgtacgctgggaacacgggcatggacccgtcccagacctccttcttccaggccctgaacatctccaccaagatcaacaagggcaccgtggagatcgtgtcggacgtgcacctgatcaagccgggcgagaaggtgggcgcctcccaggccaccctcctggccaagctgggcatcaagcccttcacttacggcctggtggtcaagcaggtgtacgacaacggctcgctctacgaccccaaggtcctggacatcaccgacgagaccctgggcgacctgctcaccgccggcatccgcaacgtggccgccgcctctctggccctcgacttccccaccatggcctccgcgccccactccctcatcaacggctacaagaacgcgctggccatcgcggtggagaccgactacaccttccccctggccgagaaggtcaaggcctacctggccgaccccaccgctttcgcctccgccgccgcgcccgccgnnnnnnnnnnnnnnnnnnnnnnnnnnnnnnnnnnnnnnnnnnnnnnnnngcgacgcgcccgccgccgccgctgccgccgccgccccggccgaggaggaggaggaggaggaggaggacatgggcttctcgctgttcgattgatcgcctggatggcgtgtgcatgcgtcggagggggtcttcctgggcctcgctccggggaaaggctccatcccggcaccgtgcgtgcctgtctgccnnnnnnnnnncggtcttcccgggcctcgctctgggaaaaagccccatcccggcaccgtgcgtgcctgtctgcctgccctgcatgttgacacacagagcacagctgcagggggagaagcatgcaagagccaggcgagcagggggtgggattgcagggcacaaggggaaggcttgggtgaccagagcgttctcggccatcccgagctccgcaccggtgggaggcgagaggatcgacgaagagggatgcggagcggaggccccgaacatcagaccgtgctgggagtggcacgctggccggtccccggcgcccgggcgtcccaggctccgcccgcccgcgtctgcgctggcgcaggcgggcgccatactaccccccaccaccaccaccaccacgccaccccggctcagtcgtcgtcgtcgccggcgccctggcgcggcttgggcccgcccgccgtcttggccatgatgatctggtccacgcgcaggacggtggtggcggcctccacggccaggcgcaggccccaccaccgcgcggcaaagaggtccaggtgcccgtcctcgcccaggtcgcgcggcgcgcccgtctccacgtccagccccgcgcgggcctgccctgcggcgtgcgccgcgtgcagcgcggccaggctctcctcggcgggcagcccgctggactcggccagcgtgcgcgggactacctccagcgcgtccgcaaagcgcgcgatggcgtactggtccagccccgtctcctgtgttggtgtgcatggtgtgttcaggggtggggggggtccgagggtggcgggcgatgccaagatggagggcgggcgtcgcgtagcatgggaagcaaaggaatccggcgagcatgcaggggaggtggagcacgccccgcagtcccacacaccgcgccagaccgcgaccccccccccccccnnnnnnnnnnattcagggttggggggggtgagggtggcgggcaatgccaagatggagggagggcttcgtgtggcatgggaagcaaaggactccggcaaccacgcaggggatgtggagcacgcccgcagcccctcacaccgcgccagaccgcgacccgcctcccccccctgcgccagccaccttgcgcgccatgtcggcgaggcggcgcgccagctcgatctccaccgcgccgccggccggcagcgcgcgcgcgtctttcgtcaacgcacggaaggcgttgacgccgccgtccaccgcgcgctccacgtcgtccaacaactggtccgtggcgccgcgcaggacgatggtggcaatgccggcgcgggaggcctggccgccaaacaggacggcgggggtggagcccacctcgcgcagctccacacagcccgcatggcccagctcggcggccgtgggcgcggcggtgcccatcagcgccactgcgcctgtggcacggcacacgcggcgcagatcgaacttggacggcaccttgaccgccatcaggccgtacttgtccaggaagtgcagcgccatctcgccaaagttgccgccggagaccaccacggtggcgccggagtctgttttggtatggtttaccgtgtgtgtgggggggggtggatgtgagggtgggtggtttgcgtcgcgtcgggtatggatcgtgggtgggccggtgcatggggggggacgtgtaaaggggtggggagcatggcgtctggatcatttgaagacactcaaccgcccctccacccccccaaaaacacacagcacccacctgccacagccttgacnnnnnnnnnncggtatggatcatgggtgggccggtgcattggggcggacgtgtaaaggggtggggagcacggcgtccggatcacttggagacacccaatctcccctccacccccacaaaaccacacagcacccacctgccacagccttgacgacctgctcgagcttggcctcctcgcccttggcgtagccctccagctcccccgccgaccggatgagcaccgtgcccttggtctcggtggacgaggtgtcgaagccctgcgcgtacaccgcgacgcgcgcgttggcggcggaggcgacgcggccctccacgccgcgacgcagcaccaggccccgctccacgtaggagtcggagagggtgccgccccggatcttgaccacgcgcacgttgtccacggcaaagttggcagggttggggggcagcaccgcgacgcaggcgcgcgccaccagcgcggccagcgtggcctccacgccgtactgcttggaggacagcgggcccagcaggcgccgagccacggcgtcggcgctggtcaggtccaggtcgacggagccggggacgacgagggactccagggccgccagggcagccttgccggccttggcgtagccgtccgcgatctccactgggtgcaggccgtcccggagcagggcctcggcgtggcccagcagctccccggcaaaggtgagcacgaagttgcacccgtccccgacctccgcgtgctgggcctgggcggccaggacgatgagacgggcggcggggtgctggatctccagctcgccggcgatggtggaggcgtcgctggtcacgaacagcttgtcgaggtggttgatcaccaccttgttcatgcctggaagggggggtcatggggagggacatcggggttggcagccggagtgttcatgcacctttaaatatatgtcttggaacattgcatgcgccgggatagagccccccgcgggtacgcaccgttggggcccaggctggtccgagtgatctgtgtcaggcccttgcacgcctcgatgtttctgagcaccgcctcctccagcccagacataattttatgcccgtccttcaacatggactgcatgccatacggcatccccatcgccatggtgggtgccggggctgggccagggaccgatggtgcgcagccagcagtgggcttgggctggcagggatcccgatgctctacttcttgtcgaaatgtatcgttattgccgatgtgggaatgatcgctgggctttcttgtgggcctctcgccaccccttccaggtcaggccgtcgtgtcactccagagaggggggcctccggcaccgcttcgttcaattttcccgcgagaatcgtaattgatcccccgtggggttgcatggatggagctgtgcagaaggttccccactatcttccgggcataccgtagagctggttgccagacctccgcagttgattccccgttgcactacatcactcatacaacacttttctaccaaggaaggtaataaagcggcggtcttcgacaaccctcgcggagcgcaacccattaccaattcgacgcctatatccgagattaggtgagcccacggcagaaccgcatgcgaaggggcaactgcgaccaggacgcctcccagcaccttggaacagctaaaccagacccggcatggcggagactgagcccgggggggttctcggccgcatgcccgctcccgcgacgctcatgagtacgagtgcccggcccccccaccccattccctgcagacatgacgtcctgcgcgatctgtcctcgtccggccgtattgtactgccacaatgatggcgtgcacctgtgccaggcgtgcgatacttcggagcacaacaccctgctgatggcgagccaccaccgcaccgccctcgagtccagccccggctcgcccaccttttccgggagcgagagctgggacaacgggagcctggcggtcgttccccagttcgacgcctctttccctcgcgaggacagcatgttcccgggggccgcggatgcgctgttcgatggcttcgggatcccggagtcccaggatgacttcaactgcctcatgggcgacctcgagcccctgaagagcgactgggactgggagaccgacaccaagaaggatctgctgggacctaaggtcaagtctgaggtccagcttgtggtgagcctacggcttggaggtgatggtgttggagtgtcttgaggcacacgaccactgcatgaagcaagcacaagcctttggcgtaaactgtcaaaaagccttgagtagcgcatgcacctcaaacaagagtttgtagagaatgatctgaggactgatcttctccccaaccaccaccaccatcaggatcgcgtgcaggcgtaccagttctctgccgcctatgcggacgacatgcagatggtcccccaggcgcctcctgcccccatccacacgcccacttccaatgagtcgttgtccctggaagtccccctcacccgccgcgatcgcgtagagcgctacctctccaagcgccgccgccgcaacttcaacaaggtggtccgctaccagtgccgcaaggtgtacgcggacgcccgccctcgcatcaaggggcgcttcgtcaagcccgccgagctggaggcgtacaggcgcgacgcggccgccgccaagggcagcccccccgccgacgcgatcagtgcccccctggtgggggcctaggcttggacgcgcggggggggggcccacccgctgccggccnnnnnnnnnnggctcccccgccgacgcgacgagtgcccccctggtcagggcctaggcttggacgcggggggggggcccacccgctgccggccctcgccaggtgatgctgaggccggcctgcaagaagcaataatgccaccccaaccctcttctccccgccctttggtgacaaagcagaattcattctgttcctgatatggtggctgcccccttgcggcttctttcaggcagtttttcatcgccgctacccctcctcacaaattctttgggtcacgacccgctcaaccagccactggtctgcatccagcccaagaaaccttctcacactgcaattattttggggcggggtgcacacccctcccccccgcctcagcccgatccattcttttctaataggctggtgaaggggtaggcctcagatgtccccctccacctgccaccacacgtcgtctaccttgcttgatgagaaatgatagatctgtcgacagatctcttgcttgagccctggcccatcatgggtggcacaccatgccaacgatcccattgctccccatgtcatcatcccttgggcgctgctctcatgcatcatgcgtgcgattttgagtggaccctgcccattatttttcctacaggggagcctggtccacaccagctcccctcccccgaattctttaggcatggcatgcatgtaacagcgaaggtggatgatgaggaagggaatgttttggttggttgcaggctgagtgggtaggtgtcgagaaggagatgctgggggatcaatctcctcctgaggagggagagggaaccccccaggtactgcctgcacctgtttcagcacgctccatcccctggcctgcgccactctttgagcttgcattgccagcccctgccgtgattcgagctattgttgttacacacagtgtggggcctgcagcgctcgcttcaagaggaccccatcattcattgctcccgccaccctcgggtcctcagaccacagtggtggcgcagccctcggcaaacgcacccagccctggcaggcagcactcggcgtggctgccaaacgcctccacgcctgcggactgcagcctgccggcctgggcgtcacggcgcacggccaggctggcagcggaggcgtgctccaggcacacccccggctgctgctcgcagcggttgatgcccagcgcgctggtccccacccagcactcggccgtgcaggtggccagcgcgggggccgtgttgcggaaggccttgagccgctgggcgtgtccgcgcaccacgcggaaggtggaggcctccggggtcacgccgtactcgcccacgttggtcacatcccaggcgttgaagccccagcgccagaacagcgtgcccgccagcgccgagccggaggcggtggacatctcgctctcctcgtacaccgtgcggaagccggggtcgcgctccgaggccactgcctggctggtggcggccgacagcttcttgccaaacctgggaagggggggggggcggcgaggaggtgcgaggggctgctggtcgaagaggaggttgggaactggagctatcgatgtggcaacagttgaaattagttgatggacaatgctgattgcggactgggtggctgttcagtgtcgattggagccatgccagcaacacaccccgcatcacgagccgccaagcagggacgacgcttgcagggnnnnnnnnnnaaggtatcgatgtggcaatggttgaagttagttgatggacaatgctgattgcggaatgggtggctgttcagtgttgattgagccatgccagcaacacacccagcatcacaagccgccaagcagggacgacgcttgcaggggcactcgttcaaaggatcacgggattctagcccggcatcgttgccggagttgggaacaccactcacatgccgccatgcatcacatccatggccccgcgccactgttnnnnnnnnnnacacgggattctagcccggcatcgttaccggagttgggaataccactcacatgccgccacgcatcacatccatggccccgcgccactgttcaaacctaccacctccaccgactgctgccccctaccgccattgcaccacccccgccgaccactcactcctcgagcaggacgggcttcttgagcaccttggtgctgtcctcgatgtgcttgtggatccactcggccacaaagctggtgttcttggtcagccagttgtccggccagaggtgcatggtggcaaagtccaccacgggcatgttgtggtgatgcacaaagtcttgccccgccttggcggcccagtccgagccctccgccgcgccggggttggcgatctgcatcttgtcgtgcaccccccagaaccctactctcagcgaggggcgatgtggttgggaaatggctggggggcgatgggagggaggtcgacacgacagagcgggggggattgcgccttgcgtgcaccgacaagaagggcacggcacccgtgacacaatcacatgcgccaaatgaagcccaatttcggtcccctgtatgtcctccatggcagcctccatcctgccacaggaccatcgacaccgaccttccctgaaggacccccgcacattcgtcagcgcgcctcccacacgcaccttccgccccgannnnnnnnnnaacaccggccttccctgaaaggacccccgcacattcgtcaacgcgcctcccacacgcaccttccgccccgatggtgacaaggtggttttgatccagggacttgaggtgggtcgccatctcgtacacccactgctccaccagcttggtgcagtccggggtctgcaccagggtaggtggaaggggcggcaagggggctgagcccgtgaacagacgcatcgcttgcgaggcactgagtagccgacggatgcgtgcgagtcgctgacatccactgcaccgaggcttccgccccctcctgtacatgcagacacccttccctctccctgccgctcacataggagacggagcagcggggctcgttcagcaggtcaaaggccatgatggtggggtcctcgcggtacaccttgccgctcacagtgttcacgcgctccaggatctgggcaggatgaaagagcggcgggggtgatggtacgtgcggcatgggggagggggcggtgccacacggggtctgagatggcagggcccatacggcagtccatcgcgcccggtgcaagctccattcctgccacatcgccatcccagactgcaggggcactcaccgcacggatgtggttgcggtacagcgtcttgaccccggcgtcggtgaagaagagcaccttgcgcaaggcctcgtactgcttgcggtcctcgctccactcctgacgatgtgaatttggagtggcggatgctggaatgagtgtgatgagatgatgttcctggggatttatgcatcacgaaagcaagccgggatttgagctgaatgccgacatagcgcaggaaccgaggacagtggagccacacaaccctaccacttgcatcnnnnnnnnnntgacagcaggccgggatttgagctgaatgccgacatagtgcaggaaccgaggacggtggagccacacaaccctaccacttgcatcccagggccgtacaacgtagtttaccaccatcaagacattgggagtccacccaatacctggacaaaagccccacagtgcagccccacccatcaacacagctctgccttgaccaccctaccatatcgttcacgtcgccgtcgccgcccgtcgccactgggtacttcttgtcgcgggccgggaccgtcttggcccagtccacaaactcatcaacgccgccctcatacttccagttgtccaccaggctcagaatgacacgcagccccttcttctctgcctcggcgatcaccaggtccagcgcctggaaggcgttctcgtcgtacgcgccagggctcacctgcatgagacagggcagggggggagggatggagaatggagagcaagcttcctcgccatttccaagactcgaacaaggagcaggggtaactgacagaggtactcaagcgagataatatactctgaaacctccaaaagaatgcagcgttaaggctgctcacaggccacaggcaacggcgcccacatctgcacagccctccatgctaattgtccaggcacacaaacgctgagactgacaatctgcggaaccaccgctccaactcgcctggaaaggttgtttgggatttgtggtgtgggcccaggtgcggacggtgttgaggcccgctgctgcggcctggttgagcacgttgacaatggcagcagctcccaccgccgtgccagcggctccggcccgggacggcgaccacgccagcatggcctccnnnnnnnnnnccccacggccgtgccagcggccccggcacgggacggcgaccacgccagcatggcctccgccaggttgtcgacattgaagccggcaatgtaaaaggggcggcacttgtgcaggaactgcatggtgggtggtccggaaggatgtgggttggagtggggattgaaggggagttccaccggaggccagcatggccatgcgcccgagccgacgattacctacctgggtgccttgaactgtgatgaaggagtcatgcctgtagttggcggtggtcttgctggagtatcccaggcccagcagggtgagtgtcagcagggctgcagcgccaaacaggatccacgtccatgccggcacccgacgccgcgactcggaggtcagcgggctggacgagggggtggcagcgaaacgagaggaagtcagatgctcgccctcctcgcctgacccagcctccttggaccgggctctcacactgcccatggtcgacactggcgcagcgcgctgaggtcgggtcccagggggtggggaagctcgtgcgtgaatgggtggcgcccttgtgcgtgaaggggcctgagtttggtgatcgacgcgacccgcttaacggtctcaggcccttgtaatgatctcgtctgccaagaaatgaccagtgccccgcccacaccgctttctcggacgtgcccacaccgcgcgcgagcatgtccgggagatgcaagggtgttcatggggggcattcggcgcaggacctgctgatgcagtgacgagtcgccccctcccactttcttgtaagcgtaccctatttaatgccgtacatacatgtcttccctcccaagctcgtgatcagggatcgtaccctcggcggatcctgtaccttgagcccgggcggaccaggtgcgcctgtcgcatgctgggcacatgagagagtgcatgcgcccgcaaggacatcttcatgatgtaggtacacttatactcaattcacctgcaaccatcgtgaggatctatgcaagtggggtgaagtgccacaccaggtgggcatgctgcgccagactcaagattcaggagtacagatggcagtcagtccaggagcggcagctctcgggacacatggtatccccagaggttagtcagcaggaccaggcaggggcggggatcctgggccatgcccagcgccagctcattttgtcggagggaggccggcatcaggcgggccgggagcagtgtccacccctccagtcctgcgctccactccaacccagtggcgagctcctctgcgtcgcacccggccagcctgtgtggcaggttgcacacgtcgctcaggcttgccgcaaagtccgggtcggccagcgtgaccgcctctcccagccccgcgccctccccgccccacgccgtccggcaggcggcgtcggcggcctgcatgccctggaccaggcccagcaggcggtggtgggaggcggccgcggcgacgaggcgagacgcgcagtacacgcggcccagggccgccagctggcgccgccaccgggcctccagctcggccgccagcgccacaccgggcgccgagaggctggccagcgccggtgcggcctcggagagcaattgggcgcatgcctgtggcagggaggcagggcgtgctctcaagaaaacgcgaaccaagtttcttgacgacggtccgacacgccatccagggccgggagggccatgctgatgcggcacctggggcgcaaaacacggcnnnnnnnnnngaaaaacgcgaaccaaatttcttgaggacggtccaacacgccatcctgggccgggagggctatgttgatgcggcacctggggcgcaaaacacggcgcagtcccccatgagggagaaacacgagtggcctttggcctccacgcacacacacacaccccaggtcgccccagtcctcctctgcagccctcacctgcagcagctcacaccacgccacgccatactcggcgacgcagggttgggtcccagtctcccgtgaaagggcaggcggcgctgtgggagcggtcatgacctgatcctgctcggctggaaagtatggcctgccaatctcctcgtgcactgatctgggggaggccgtcccgtcctcagcctgtgcgccgagactgtctgatgccgtggcgaccacagcagcacccaggctttgggtgggtgtgagaccttgctcccggcccctgccagcatcctcagcggtgggagaggcatgggaggcctccaagggaggggtggtgggctcaaaggggtggcgggtttctcggcagccaggctcaggcccctcctcagcactctccggatcaggggacacccaggcaacccaggcatctgccgcaccccagtctgcatccggagggtggggcacggggggggcgctctcctggcccagctccgcgtcgcggaccagtggctgccaaggcgcgaccggtgcatcggaggccggggcctcggcgcatgctggcgggggggtgctggcggggtgctcctcctcgcggggcgccgcctggggcagaggatgctttgcagacgtcaccgaggctctggcagccccactctcaggccaggagctatcgaccctgggatcaaagcccctgggctcaacttgcagtgtgtccgaggcaaggtcagtgcgaagggggtccagctcccgagacgcagcctcggcttcatccaccgccgcccctccaaagaggtcctcaggaagcggttctgacctgatggttgatcgtggggtgccgggcataggctcttttcagccgagcacagacgctcagaccctacagcaatgcgatgctgagcctgcatgaagagccacgggaccctgcaccccaccgcagacccaagctcaccagtcgtggtttgcagccgccaccggcgcgctcggaggtcccatggcatccagggccccagtgtgcatggcggtggcttcagtcgggacgagcacagtgctcacctccagccccgtccactccccaaacgaaaagtcagcactctcggtacgcagctcgacggctgcttctgggctgcagcacctctcgaccccaccatggctcagaccagaggggatcagcgtctgcgggtacacctcctgattcccagcaccgtcgcccgccaccctcagccggctggcctctgtctcacggtagttcccacccagcaggatgccgtagctgtatggcaggacactcctgtcaacagacaccacctggaacgtgaaggatatggggaggggggtggcagagcatggaccggctggatgcctcgcacagaaaggcctcgcacaggttcctgacagccaacccctgctgttgccccacgcacctgcacgggcagctcgcccccgtccctcccaaggtacagcacctccatgcccggctggagggcatcctccgagcctatacccttcattccacgccgtggctggctccacgaggggtcgctccggccgtcgtcggtgctcgggcccggctccccgccgggtgccgactggaactccccaaagccccagtcctcgtcgtcaagcatgcatggcaccctgatcgaccggtggttgagttgtagtgtgctccctcatgctcttgtatcggatgtggacacccctttcaccctcccgacaccagctcccgtcctttcgcagcggcgtgggaattacggttggaaacaaccctcgacatcaaagcccatgctcctcctggcgtgctggggtccagtacccactgacatgtgatccctgccaccccccgacttgcccaacccctgatcgtgatatccacatgcagcattacagggccgtggtgcttgtggggggggaaggagcatggtccgcccctggcaccccaagnnnnnnnnnncgcagcattacagggccgtggtgctcggtggggggggggaggagcatggtccgcccctggcaccccaagtgcccacacgcacgacgcagggtcacaatcgctccggcggcatcgcgccgctccgggggtggcaatgcaacgtcagacgggtgaggcggcgaggtgcacggatacgcaggggagagcgggggcggcggcgcgtcggcgccgtgcgacccgggagctgcaagcgcatggtacaggcggcaccccagggggtgggtggggaagtgcgccgcgccccccccttcgaggggagggcgcggcgcgggtaaatagtgcggtgactgggcgcggggcatcagctcgcggcggtcggcagggacaggcgtgtgggtgggcatggacagagcacggagagctgtgtaaatgggcgccgccgcaccgccgccgcgggtacccgggcctcgggctcgggcacgcgaaaatcgcggggcggaggggcgtgctggggtgcaggcaggggcagggggagtgctgggagcgtatggtacagcccggcgcgggccagaggggtcgggcgaccggacggcgcgggaactagcctggcgaacagtcggtgcnnnnnnnnnnagactcgcgctcccagtcaaaaggaaccgccccgccgcgcggggcgccagggtggtgtcggagcggcccgcctcgcctcgcctcgcccgctcagtccaggagggagaggagggagagcagcgggtcctggctgcggcgcgggacgtagccgcnnnnnnnnnnagggaggggggacccctccgcacacctgatttaagcacacggtctggaaaggggatagggtggtgaaagggggaactcgcgctcccagtcaaaaggaaccgctccgccgcgcggggcgcgagggcggtgtgggagcggcccgcctcgcctcgcctcgcccgnnnnnnnnnncgccggacgtggcgcgggcgcgcttggtggtgggcacatagtccgagtcctcgnnnnnnnnnntgccggacgtggcgcgggcgcgtttggtggtgggcacatagtccgagtcctcgtcctcgtcgcgcctaccagacctgatgtagttttttttttggggggggaggggggtgatcaggcaagggcttgggttggggtgtcggcgagggggcgtcgccgactgcatgcgagtcacggacccagacacacgcccgacggatgcggggcgaggtcgcggcgtgggcatctcgcggacccaggcgcccccgtccacaccccgaccggccccagatgctccttcctccacccccatccgnnnnnnnnnnnnnnnnnnnnnnnnnnnnnnnnnnnnnnnnnnnnnnnnnnnnnnnnnnnnnnnnnnnnnnnnnncacaacacaccgctcccccacactccagagcacacctgccggcgtgctggctcgcgccggagcgcgcgcggcggtcggcgcgcccgccctgcggcccgccgccggcctcgc

SEQ ID NO: 23046 - DNA, 66 bp, Chlorella protothecoides
ccgcatgacgccgcccgtacgcgcgcgcacacatcgcgtggaaaacctagcagttgcgctcctggt

SEQ ID NO: 23047 - DNA, 70 bp, Chlorella protothecoides
cagcagggagatgtactccttgttgtcgttcaacagggcctgtagagagggtgtgggttccctatcaggg

SEQ ID NO: 23048 - DNA, 76 bp, Chlorella protothecoides
tggtccgtggtgtgattctggccaggggataggcggtgtgtcatgtgggcgtgattatccgctatgcaggactcct

SEQ ID NO: 23049 - DNA, 61 bp, Chlorella protothecoides
ggcggcgggcgccctgtcgcagctggcgggtcccggctgccgcgacctggtcctgtgtgtg

SEQ ID NO: 23050 - DNA, 72 bp, Chlorella protothecoides
acgccgcgggaagctgcttgatcgtgcattgcaccccctgcccgcagagaccggcagcgggggccgcctcct

SEQ ID NO: 23051 - DNA, 76 bp, Chlorella protothecoides
gtttgtgaagtgctgcgagaccggaagctgcaagttttccatcttccgctcgtcaacaagcctgctcgacacatcc

SEQ ID NO: 23052 - DNA, 76 bp, Chlorella protothecoides
ctcctgcggcgatgtaaggcacatttggtttacgacccgatctgtaacagcagggtacgatcggattggtgggatt

SEQ ID NO: 23053 - DNA, 96 bp, Chlorella protothecoides
ggacgggcagactcgcccctggcatgtgtggtgtgttggggggtccaggttcagaagggatcacagggtcaaggggtccacaggctgggctctcta

SEQ ID NO: 23054 - DNA, 84 bp, Chlorella protothecoides
ctccgcgccgcgctgagcctggcgggcggcacgctgcgcacgctgggctccctcctccgcgccgcgctgagcctggcgggcggc

SEQ ID NO: 23055 - DNA, 87 bp, Chlorella protothecoides
ggcctgctttatttattctcgaagacgcatcttgcaaaccaagtcgatggaccgttttggccgttttggcctacaagatcggtacgt

SEQ ID NO: 23056 - DNA, 79 bp, Chlorella protothecoides
ggccgcaccctcttgacctcgtcccactcactcacacacgctgcaggataacaatgtggtggtgaaggaggtggggaca

SEQ ID NO: 23057 - DNA, 69 bp, Chlorella protothecoides
gatgacctgtgctcgtccaccaccaccaccacgcacccacgccgcaggcgccgcaagaacttgatccag

SEQ ID NO: 23058 - DNA, 74 bp, Chlorella protothecoides
taataaagcagaagccacggacgtgggtgtgggtgttgggcaaacccccgttttggcgccagccgcgaggcgaa

SEQ ID NO: 23059 - DNA, 171 bp, Chlorella protothecoides
gtccgtcacctccacgctgcgcgaggaaggtgcggcggggtcaactggaggtgttggcactgggtcacgcacgggcccccacccacccagatgccacacataccagagacacaccggtttcacaatgcagaatgacaggaggcccctccctcggacctggggatgaggaag

SEQ ID NO: 23060 - DNA, 78 bp, Chlorella protothecoides
gacaatgtgcatgccgcttgaccattgacatataaaacccaactgcagttcgtcttttaaagaggtgcattgaggcga

SEQ ID NO: 23061 - DNA, 63 bp, Chlorella protothecoides
ctgggattccccgacctggggcacgtggtgattcatgccggcagcatgagcgtggcttgagcg

SEQ ID NO: 23062 - DNA, 69 bp, Chlorella protothecoides
ctgtgccaagctgtgctgatgtttcctctttcaagctgaagatgcatctatcactcccactcccctcca

SEQ ID NO: 23063 - DNA, 64 bp, Chlorella protothecoides
tgtggatgcaatgcattgctgtggaacatgtaagaccacctggcggcaggcatgggctcaaatt

SEQ ID NO: 23064 - DNA, 156 bp, Chlorella protothecoides
cctgccatgccttaatcactcctcgccacttatctcgcgccctaagattcccagcgtgggcgcgttgatctcgggaggcagagcattcctcagcagacgatgggccacagcatggcagagtctctacatactgtgacgcctggaacgaaatgccta

SEQ ID NO: 23065 - DNA, 111 bp, Chlorella protothecoides
gcactccagtctgctcgctggcaacatcgagcggtcacccatcccccgcggcaagtccaccgatgcatgcacctggcagacccatcccggcttccatcctcccaaccatgc

SEQ ID NO: 23066 - DNA, 277 bp, Chlorella protothecoides
tagtggtgacaaattgaacaatgaataattccacactttatgggaccgctttctgattggtagcttcatggattgacgcacacttgaagtgaaaacctggagccctacgcactgctgtgcactgcagaagcagaatgtacaggggtggttacgcactcctattttatttaaggaactacacttattgcgaacaagtaacggagttcaagctttttcgaacattgagcttgcaaaggatgggaggtgccacgtcctgccttatttacacctccgccca

SEQ ID NO: 23067 - DNA, 112 bp, Chlorella protothecoides
gttttcttttgcggagatttgaaccaggtgacgttggtgggcacagccataccctttagcccacggagaccgtccttgcctggacgtgcagacctcatcacgaccagcaggc

SEQ ID NO: 23068 - DNA, 147 bp, Chlorella protothecoides
atgtggtggaggcaaccttcggtcgccgcggttatgtcatcatagcctggtaggtcatgcgccggtgtgggaggtgcctcgggctccacacccctgcacaccatggccatctgttgtgggctcccagactggccatgcacagcagga

SEQ ID NO: 23069 - DNA, 77 bp, Chlorella protothecoides
ccgagtaccacccgcagccctcgaagcggcaaaagttgaacaggagagcgaagaaggcccaaccaacatgcacgaac

SEQ ID NO: 23070 - DNA, 61 bp, Chlorella protothecoides
gaccctgcgcttgggtgagtgcatggcgggtggcgaagtgcaaggctgcaagcaggttgat

SEQ ID NO: 23071 - DNA, 61 bp, Chlorella protothecoides
gcgacagctgaaaacaccgaaaccggggagaaggtcgcacaccgccatggagtcaccgcaa

SEQ ID NO: 23072 - DNA, 70 bp, Chlorella protothecoides
gattgggatggtgtgggcatgcctggaaaacattctcagcagctcctcgccctcggcccagtcctccccg

SEQ ID NO: 23073 - DNA, 512 bp, Chlorella protothecoides
ctcacacatgcaccttcccactactagaaatgtcgacaatctgaagaacattctccaccttggacaggtccttatcctcatgcgttggcacttgggcactcccaggtgtgtgtgcacgtcttctcacagcaaacgtacgtcttcgctctcaaatggatgtaagtctccactgtcacatatgcccccacgctcaggtccagcctcccactcatgtgtgcgtccagcctcactcccactacatgccctactgttatcatccgccagggcagatcctgcaatcataccaacagccgatctcaactccaccctcgacgacaccatcactttcgtaatgatcgaatccccgactctgatgaaaactcaaacacacacctcacaactcatccttgtctccacacagctgactgtccaacctgagactcaatctcacacctgggactcactttcacacctgggactcactctcacacctgggactcactctcacacctgaaactcacattcactgataa

SEQ ID NO: 23074 - DNA, 148 bp, Chlorella protothecoides
gttttaagttgaacctttaatatgggattgttcgtggtaagcagcttaaatcttacaaacagtggaagtggtgcgatgaaattggggctttcctctccaaccgctcgtcaacgaccgaaaggccacagccggtgtgccacttgcaaat

SEQ ID NO: 23075 - DNA, 61 bp, Chlorella protothecoides
tctgcagcttcgaacccatgcacatacccaggtgcatgcatgtataaccatcgactcaacg

SEQ ID NO: 23076 - DNA, 61 bp, Chlorella protothecoides
gctcaccacgaagaggggcgtcagtggctgtttccctgtttgctctgctagggcggacaga

SEQ ID NO: 23077 - DNA, 61 bp, Chlorella protothecoides
tgcgaatggcgacgggtgacatggcatcacaacccagccgtgcgttgggttgcgtgggggt

SEQ ID NO: 23078 - DNA, 84 bp, Chlorella protothecoides
cctctccctatcaggatgatcctttcattccagagcttgatggaggtgcgtcagtgtgggcacattgcccaatggaaagcagtc

SEQ ID NO: 23079 - DNA, 69 bp, Chlorella protothecoides
agcccccatctccagctgcgcctgcccgtgttctgtgaggggagcgcatctcaatgcaagctgccagcg

SEQ ID NO: 23080 - DNA, 61 bp, Chlorella protothecoides
ccaccgcctgccccgcgacttctatgacgctgacatggccggcgcggcgctagagcagggc

SEQ ID NO: 23081 - DNA, 73 bp, Chlorella protothecoides
gaagctgcattgcaactactcatagcggttttgatgaagctgtaactgaatgggatagactgttccgagcggt

SEQ ID NO: 23082 - DNA, 73 bp, Chlorella protothecoides
ctgagctcaggggctgtgcaagaccatggtttccgcagactttacccttcatcactccacgaatggcagcaac

SEQ ID NO: 23083 - DNA, 61 bp, Chlorella protothecoides
gctcattgccatccgaggttattggcagagatgcatcacctccaccggctctgccctgtgc

SEQ ID NO: 23084 - DNA, 559 bp, Chlorella protothecoides
catgctgcactgccctgcaggtaccagaacgcaacctatctcacaaactcaagcaacgttgatacctactgccggtgagcaccatgtgtcaggaggggaggaccgggtcaagacacctctgcatggatgggcggcacgccgcatgaggacacttgtgtttgcctctgcccacgcgctccgattcgccatggacagcctgtcgcccactgtccatggagtgcaggctacaaggctttgcaggagtgggggcggtgagggaggaacgcatctaccaagcgacgcccttcccccagttcaccatcgatgtgctcgaccctggcactcgggaggcgtgcacgcccacaaatgacaccccatgccacgccatcgctgttgtggagtgtctgcacgagggcctccccaaatgcacgccagactccaatggcaacattggcaactggaacagcggcatgaacaacgtcgggcacaacaaccacggcagcggcaacaatggtgagccatcggtgacgtcggcctgcagaatccaatgtgagccgccatctcagctccaacccccccc

SEQ ID NO: 23085 - DNA, 61 bp, Chlorella protothecoides
gactctccctcacccagccctgaggactcctcaagccccagccctgaggattctcccagcc

SEQ ID NO: 23086 - DNA, 67 bp, Chlorella protothecoides
gaggagcaatcacctggacaacacgtgataagggaggctgtgctctctcattacacaggagcggagc

SEQ ID NO: 23087 - DNA, 74 bp, Chlorella protothecoides
ctgccctgctccaatcctgcttgctgtgagcacacacaatgcacggtgacaagcctcaaatgaaaacagatcaa

SEQ ID NO: 23088 - DNA, 106 bp, Chlorella protothecoides
atggaacatgccggctcttgcgggcatgagcgaagcccgaggggcaggccaagccgcacggagcagggggggtcctccatgccagcccgcacgccagcatgcacgc

SEQ ID NO: 23089 - DNA, 98 bp, Chlorella protothecoides
gagagcatatttgtgtccagccaggcctcaagagcccttttcatgcccctcctgcctctccgtgcagattgaacaactggatgaccccatcctccccg

SEQ ID NO: 23090 - DNA, 71 bp, Chlorella protothecoides
tgggtggttggcgggtgagcgggtggttgcgtagggtggcccacttcgctgctggtaaacaccacaaccac

SEQ ID NO: 23091 - DNA, 73 bp, Chlorella protothecoides
tcaccccatacctactgtggaacccaagtcgcaccaccacgcttctctctcccgatggccacacacagcctgc

SEQ ID NO: 23092 - DNA, 61 bp, Chlorella protothecoides
ggcagccacagggtccggcatgccacttcaattacaatgcccaggcacacataggaaagac

SEQ ID NO: 23093 - DNA, 64 bp, Chlorella protothecoides
cggatggctccatcctgcaacaccaatggtttttaccagttgggcgtcccacactcgccctgcg

SEQ ID NO: 23094 - DNA, 61 bp, Chlorella protothecoides
gaaggagacggtgacgccgccgccgttggtatagatgtcgggcagcgcgacgatgccgcgg

SEQ ID NO: 23095 - DNA, 1253 bp, Chlorella protothecoides
  modified_base (501)..(599): a, c, t, g, unknown or other
cccccccccccccctccacactaacacacctggaagtccaggacgtagtcgccgtcccgcgccttgtacatctgcacctcgaacttgacctcccgctcgccgcccgtcggcgcatcgcgtggcgcggcgacgtgccggcccccctccccaccgccgcccgcggcgatggaggtgtccatggcctgcgcgccgtcgccgtcctcgccgtcgccaggcgcgcgctcccccgggcgcacgctgctctcctcctcgccctccatctccacctcctccccgcacatcatgccggaggcctccatggcaacgccgtccgacacgctgtcggagcgggaaggggccgggccctctgtcgtaagggtagaggtaggtggtggtggtagtgagggaggcattcgcagcgtgggagcagggtggggcgggctggatgcaccgatgtgggcaggggcacaggagcatgcatgcgcatcctcttttcgcgccgccactgaggcgcccaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggaaaacatgcagaaccggaaagcctacccatggtcggtgcgggagccagcgccacccggcacttgtatgagtagggcgccagcttcttccaggccacgcccgcggccgccagcgcacggcatagctccgccacggcggtggcggggcgcgcgcggcagctccagcccaggcgccactgccgcgcgaccacgaggcgcgcggcggggttggcaccgggcgccggcggcgcgcgcgcgccgccggcgccgccctcctgcccttccgtcatctcctcgcgcaggtaggcagaggagggcatgcgccgccggttgtcggccagcaggtagtaggtgaccgtcgccttgttctgctcgcgccgctgcacgctggcggccaggaaggagggggagaagccgaggcgcgccacctcgcccaccacctcctcgtccagcgcggcggccgaggccacggggtcggtgtgcatgacagccaggtagcgcgggaggtgcaccgagaaccaggggtgctgcctgatctcggggatggtgatgcgcttcaggggctccaccagcagcatgcgcgggatcaggtcgcgcgcgcccggggacaggtggctgggcagcgtgtagatgccgccctgaggggtgtgtattgtgtgtgtgtggggggggg

SEQ ID NO: 23096 - DNA, 177 bp, Chlorella protothecoides
tcctggccgacaagaacagggtgtgttttgtgtggggggctgttctgggggtgaggcgggccgttgatggagtatcgttgttgtgtgtgtgtgtgtgttgtgagtggggttgttctgatagccctgtgcgagcaatcgtcgaggctgggcctgggaggaatctgagccagcctgtcc

SEQ ID NO: 23097 - DNA, 61 bp, Chlorella protothecoides
cagacccacccagcagacgtagagcggcggtgccagccgccagacctgcgcccatcaccga

SEQ ID NO: 23098 - DNA, 62 bp, Chlorella protothecoides
catccctcttgaggaggggtttagaactgcttccaggattcgacaggctgcaagacgttcgt

SEQ ID NO: 23099 - DNA, 121 bp, Chlorella protothecoides
attcttttgtaatgttatcacccggcgttcagaatcatccgcagacacttttatgcagtgttccttcctcctacttgcagtaggcggtggcactgtcctcagtcagaaactcgacatgggc

SEQ ID NO: 23100 - DNA, 154 bp, Chlorella protothecoides
tgaagcagctggcaggtcgaaagaggccggcgcacgcacagagctgatgactgacgtctaccactagcggctgaccttgtcgcgacgtgtttgttgcatttgctgtacaaacagtttgtcagttcatgcattaatcagcgcagcttggggacat

SEQ ID NO: 23101 - DNA, 121 bp, Chlorella protothecoides
atcatgccctgtggacaccttgcaaaggatgacgacgagattgtctcagagtgttcttgtgatgctcccaatgccgttgagcaaatccttcagctgcacacctgatgtcacttgcccctcc

SEQ ID NO: 23102 - DNA, 112 bp, Chlorella protothecoides
tgccagccactgtagagtgcaggttgagcagagggcccagtcgtcgccgccagaaaggtcgacctgtacaacacccacggcgaaagttccccacccaccagtccaattcagg

SEQ ID NO: 23103 - DNA, 61 bp, Chlorella protothecoides
cagcccgcagtaagtaaataggggtaaaacaccctttgtaatgttcctttgctgactcagt

SEQ ID NO: 23104 - DNA, 94 bp, Chlorella protothecoides
cactaccctctcatggcttcaccttgcctttctattggccccatgcccacccctcccccaacccccttctaggttgggcctgacctcggtggag

SEQ ID NO: 23105 - DNA, 141 bp, Chlorella protothecoides
ggagttgagagtggatgggctgtcacacagccagcgtcctggagaggcactcctcggcactggccacctcggttgacaggcgactgggctcctcagaaagcagcaaacgtggtgttgttcctctacactgctcaccgaggg

SEQ ID NO: 23106 - DNA, 79 bp, Chlorella protothecoides
gctttgtagggagtttcacgtctgaatgtgatcttcaggacgagtggctaatgcatgcatgtggcccgctaaccagaaa

SEQ ID NO: 23107 - DNA, 73 bp, Chlorella protothecoides
ccactcacagaacgagtcgctctcggattcagctgtgccaaaaccgcttccttgcgcagatgccacagctcct

SEQ ID NO: 23108 - DNA, 61 bp, Chlorella protothecoides
ctgggcgccggctgacacgattctcatgatgaagccagcatgtcacacaccatgctcgtca

SEQ ID NO: 23109 - DNA, 61 bp, Chlorella protothecoides
gggctgattctaggaatccggcatggtgggtacagtgcgagccagactttggggatgctgc

SEQ ID NO: 23110 - DNA, 62 bp, Chlorella protothecoides
acagtgcgagccagactttggggatgctgctgcatttgcttgcaacaatgaaacaacgttaa

SEQ ID NO: 23111 - DNA, 73 bp, Chlorella protothecoides
tccatagggtgcgcactgctgctctgttctcaaccattacacgatatgctctcagtattgagacgaagacagt

SEQ ID NO: 23112 - DNA, 160 bp, Chlorella protothecoides
caataaggtcaagagaccgatgagagcaatgcgcctcatttccttgtatctatggatcgaagtgctttatgctctgcaataccggcgggacactgccgcatccactgtggactggcctttttatactgttgcgtcgcatggagatctcgacccctccacg

SEQ ID NO: 23113 - DNA, 63 bp, Chlorella protothecoides
ctatggggtctcgaacacctacccccccccttccacacatacccacacctacacccacctccc

SEQ ID NO: 23114 - DNA, 147 bp, Chlorella protothecoides
cccccaccgccctacaggagcggggcgcggtctacatcctaccgcctgcacaatctgcaggaggcgttgtccctggcgttcgaggcggccgcgccctccgcgccaggccagccgcctgcccacctcgggtaccgagtccacatccac

SEQ ID NO: 23115 - DNA, 484 bp, Chlorella protothecoides
tacgagggatatacgtggaatctgtctggacgttttgctgctgtaggatctgtcgcaacttatgaccctcaaccacccccaaactggcacagattggttgcctgggatgtgcagtggcaaaagtggtgttggattactgtgcacgatgcctgggaaaggggcattgtccgttcatcggatctcgcgctccaggaatgtcacgcaattgccctgagagatgcctgggtggcaggtttgacaagcgcactatccctcactatacctcctgctaatgctggcctcggataccgcaatgagcttagcgtcagagagtgcaatgctatatatgttggggccacgttttgatggacattgatcaagtggctctaaaatgaggttcggaggcaccaaagtgtgaaggatgatccttctccaggtcacacctggtcagccggatgggtcatggtctccaatatgccactgccagagaatgactcgctccttc

SEQ ID NO: 23116 - DNA, 79 bp, Chlorella protothecoides
atgcttccagctggttcatcacctgcatgaggcgatcgagggaccctttacgatcgacttgtttaccttgcccagtccc

SEQ ID NO: 23117 - DNA, 87 bp, Chlorella protothecoides
cccggtgcagcagtgtgcggcccacacagctgcaccggcgctctggcttccagcatctgcacagcagtccgacgtcggaccactcat

SEQ ID NO: 23118 - DNA, 66 bp, Chlorella protothecoides
ggtcgctgtcgacgagtgacctaggagtcagatggcccgggcacctctatcgagtggagtgaaaag

SEQ ID NO: 23119 - DNA, 65 bp, Chlorella protothecoides
tgcaagcacagcatgaagggctgggtacatcgtatgccagcccttcatgctgtgcttgcatggct

SEQ ID NO: 23120 - DNA, 116 bp, Chlorella protothecoides
accccgtgagcgcagggtgtccacatgatacgtgtatatctaccataatgtaggctactcagtgtcgaggcatggaggagctatgttgcagtatctgcttcgaaagtgatctccag

SEQ ID NO: 23121 - DNA, 144 bp, Chlorella protothecoides
catgaatgaggcaggctcgtgagggcatgtggtgagattggagggcggggtggcgagtttgtggcgtgaggtggagcgagtcgggtccgaccctgctgaacgggctggaggagtcgagcggcgcctgatgtttgcagcgcttcg

SEQ ID NO: 23122 - DNA, 76 bp, Chlorella protothecoides
agcattgggaggcatcgggcggtgacatgcacgggcgcccaagccaagaacacaaatctatttaggcatgcgagcg

SEQ ID NO: 23123 - DNA, 79 bp, Chlorella protothecoides
agcgcctgcggtgtatggatgcatggtgtggggccccagacacacagttctggtccagtggctgtttgatgctcacgtc

SEQ ID NO: 23124 - DNA, 61 bp, Chlorella protothecoides
cataaactaagggcaggacctctcctgaagaccgccggtcaggcctgccctgaggcagttt

SEQ ID NO: 23125 - DNA, 67 bp, Chlorella protothecoides
agttagggtcgcatggaggtcaggggtctgtcaggctgagacacaccgacccctctcgtctgtgccg

SEQ ID NO: 23126 - DNA, 63 bp, Chlorella protothecoides
ggtctttctggagggagcggagggtctttcgtcgggccagaagatgggtggcgaccctgcgct

SEQ ID NO: 23127 - DNA, 130 bp, Chlorella protothecoides
gcgttgaatcgcacgttgggcacccgatcctgtgcggattggcccaaaggggggaaagggggggaatgggtgaatggagggtgggggttgatcggcacctatacatccttggtgggttggccagggcaag

SEQ ID NO: 23128 - DNA, 67 bp, Chlorella protothecoides
ggccagcaccgcgcgcgcgccgggcgacggcgacgccgccgtgccggggcgctccagcgtctggcgc

SEQ ID NO: 23129 - DNA, 80 bp, Chlorella protothecoides
cagcgcccagatcgagatattctccgcggtacggtccagtcaaggtttcgagtggtggggccaatggcactcagggagct

SEQ ID NO: 23130 - DNA, 7776 bp, Chlorella protothecoides
  modified_base (740)..(749): a, c, t, g, unknown or other
  modified_base (1357)..(1366): a, c, t, g, unknown or other
  modified_base (2617)..(2626): a, c, t, g, unknown or other
  modified_base (2879)..(2888): a, c, t, g, unknown or other
  modified_base (2945)..(2954): a, c, t, g, unknown or other
  modified_base (4697)..(4706): a, c, t, g, unknown or other
  modified_base (6151)..(6160): a, c, t, g, unknown or other
  modified_base (6836)..(6845): a, c, t, g, unknown or other
  modified_base (7488)..(7497): a, c, t, g, unknown or other
gtggggagggggtgtggtgggcgggggatgaggggtggaggctgatgaacagattcgaggagggggtccttgtgcggcaagaccatgtgcgagagtacctctcccacacaagcacgtagatgctcctggactggacgccccatacccgcaccgtgaaacgccggctgcaggcttcctccacagcggggcggatggtctggaaggtggtgcgagccccccgagccttcatcatgccgtgcaccgtctggacggccactgcgggatgtgaagatcgggggttgatgttcaaggatgatccttggaaaggcacagatgtgcagatgtgagagttgcagtgccatcaacggagagcggaggtccaggacaaggaatacctgcctcgcgggccacagccacttcctggtcatccccccacgtcccaaaccctcaccaaacatgtccttgtagacagccagcttctttgggagaggctgctgcagggatccagggtccgccccccgcttgcgtggggacttgccctttgtgggctcggggctgggagactggggcgatggagccaccccctcatcaccccgtggggagggactgggtgccttgtactccacaccggctgccgccaagagggctaggccgcggcgtgctcctggggtgatgagtatgggccgaggtgggagtgggaggacaggggaggtgtgggtgtgtgtgggatcccgaccaacggatgcgacgcagcagctccnnnnnnnnnnaggtgatgagtatgggccgaggtgggggtgagaggacaggggaggtggggggttgtgtgggagcccgaccaacggatgcgacgcagcagctccctcacgaacctcgtcgaatgggtgtcttggtcttccccacatgcacaggactggcgactggactgagacagggtttgggctgctttgaggcagggacgtcgccgatggcagcgacgtccagggctgtgggtcgagccttccgttttcgatagaagctcgacactgtggggcccccctccccattggattgacggcgtgtggccgtcataccaagctctgattgagcagtctctgtgcagggtccagcaccgtctggcgatgtagggtcgaacctggctacaagtactcttgccgaatcacggagcttgtccgggacgggctcccgccacggaatttgaattcgaagcctgcgctcgcgccttccagcttaagggagggttccttgataaccctgacacataaagaattgcttctactgcgccgtaatttcgaatttttaacatttcaatggatacaaaatattagccccgcctatcagttgtttgctttgacgactccactttccaccaggtatnnnnnnnnnntcgccgtaattttgagttttaaacaactcaatggataaaaaaaggtagccccgcctatcagttgttggctttgacgactccactttccaccaggtatggcacctccgccgcaagccaaggcgccagacccaggcacagagcatgtgcaacgccgaaatgaggactacggtagggattgtggtgtaaaatgtttatcgacattacaataggaggtaagagagtaggagattgtcaggcttcaaacagaaacaatcatacatcagtacccagagcatgtgctgcatccacccatgcctccccacctgttcttggcccataagggcttgaagtggatggtgaggcagatcttcccccctcggtacatctttgctgttttgccgtcaagttctgggagctctatctcaggcgcggtcgtcggataggtggctgggatgtcaaactgtggtgtgagatgaggtgtatgggggggagtggtagggaggtgccggactatgcaagaaatgggggatgccacgatgagcaagcctcccatggtaacataccgccaggggcagtataggtcgccagcatggctgtctcccatctcttcctcggcacctggaagttgaactcatacttgaccagctcgtggatgtaccagcactttccctgccagtgggtgccctccttgttcgtgggcttgatggtgaaccagtccaggtcacctcgtttgttgatctcgatgtacttgatgagggcttgaatctcctgtgtgagcgtgaggatgttggacaggatttcaagaggtacctattccactctcttgggaactttcctcgagcacacctaattcgaactcaatgtacctccttgagtcgggcttgccatgcatccttatcgcgtggcccggctttgactgtgagcagggggatcttctgcacagttgcccgagtggatggatcccaagactctgccatgctcggcgggtgattaaaagtctcaagactgtaataacttggcagctatgaagtacgattgatatatactgagtgggtggcaacggaatggaagcaggagtggtccacgcggtcggcaagctctgtgagacactagccactatgccacccggcgaatcaggctccgtatggatcacgtcacttttcaagtttgatgtgtttcggtggctagttgtctatatactgcaaggtggtatgccaacgttgtatctctcgcgcgctcaccgttcaccaaccaagctcatgtgatcgaacnnnnnnnnnnacagctatgaagtacgattgatatatactaagtggtggcaacggaatggaagcagcagtggtccacgcggtcggcaagctccgtgagacactagccactatgccactcggcgaatcaggctctgtatggatcacgtcacttttcaagttagatgtgtttcggtggctggttgtctatatactgcaaggtggtgtgccaacgttgtatctctcgcgccctcagcgttcaccaaccaagctcatgtgatcgaacnnnnnnnnnnatgccactcgccgcggtctggcagatctgagcgcgtgccgggctgggaagagctcgnnnnnnnnnnttcatccgtcggaggaacacatccggtcatgcgcgcagccttacaatgggccgtgcgcgtcaaatgtacatctaggcgctctaaggagtttcgatgtgcgctgcagcctacaaggcatgcttctcagcgggatgcatgtcacatgcgcatggttggacatggaccggcctaactcccactcgccgcggtctggcaaaactgagcgcgtgccgggctgggaagagctcgcctgagacacgacagaagcttgaattgaccatcaggtggggtccctgtgcaccaacaaagtgctggtggaaactatagacctgtagaacctgaaactaccagccgtcacaactttgcagggatttgcagggacccgaggagctgcaagcggttgcgctcctgcgcgctcatgccttttacacttaccctccagagagggcctttgccgggcaggtgtgaggctgtgggagcttttgaggtggattctccaacgcatcagcccatatgcctctgaccccccaccagcatccccaccctgcagttgcaccagctgatgaaggtggaggaggaggtccgagaacttgggcatgcgatagcatccttcccactggaccaggccggcctcgatcttcgaatgaccagccttgtggctctggctgacgccagccggcacgctgacctggacccgggctaccacatccccagcaaggacggagtggtgctgtcaacactagatctctacattgcatcggcccttcctggggagtacctcattggtgaggaggagagcagaagggaagcatccctgattttaggggggaagacgatgcccctgggagcagtaccggagtcctgcctgtgtcgctgtggtaccatgtgcagctcggtccagcatgcatccaccttcacttccagtcaagatgctactcctgggacggagcgtgcccctccctcaattcccgcaggccgcaccaggaatgcagcataccttgcaaacctggcgacagccgagggggtgaagaggcgaggcatcgggcgcagcctggtgagcgctgcgaggcagctggcgcgagagcatggcgtggatgccctgtacgtgcacaccctggcggtgaacacggtggcgcgcgacttctatgccagctgcggattcgtggtggagcgggaagagagcagcaacaccgcgcattacagaggaaagtgcctggatggggtcgaggggaagggtcgcaccgtcctcctccgggacacccagttgtaatgacaagcctatggttggagaagggaacatgatagcctccgacacctgtggccgcagcatggcaccgtttccaaaaattcaacagcgcgccttatggtcatgaggccacctcggcatcccgaccacacagcgccttgaacaccaccattctctgtatctcaatatggaggtccggctctcatgatgagcgtcttcgccaccccgatggctctgtcgaatgcgaggcggggcgtgcccgagtgtgctcccctcgggagctgtaggccggaaaggacctcctgtaggcacatgccggcccatcgagtgcagtcctggaagcctcagcgcaggggatcggtcatgaaatccaaggccaaggactcgttggaatccctgcgcgatcaggctgccagggattacgagctgggtgagagggcatctggttgacaggcatgtgttttgttgtgcagtaggaatggccaccatgcatagccgtggagcttacacctcggcannnnnnnnnngtgtggttgacaggcatgtgttttgttgtgcaataggaatggccactatgcatagccgtggagcttacacctcggcatgaagttgttggacacagtccccccatccatgacttcccatctcgtggctacagggcgccaagcagggcgggatgcagatgacctggtagcagagcaactaggcctctcctcaagccgagagttgtcgggcgtgcaggagcgatacaaggacaggatcaaggagtccctggaaaaggtcaggaggagagaacgactgcgttgggtctgctgcgagcctgtatggtgcacctgctgtcccattgcaagatgccattgtcccaaggccagcagcttatcctttcgcaccccccccccaatcactaacccctttagagggcaaaggagctgcagagccagcaggcgcagcgtgaaaggggcatgaagctggggaagattgcctacggcaggggacgctactctgcagctgtcacccttttcgaagccgcgctggaagaggagggccccttctcccacctgggaggagacatccaaatgtggcttgctctctcctaccaggcaagtttattttgggttaaatggccactcatctctagagcctgcgaagggattatactgtgccaccacagtacagtctggctgtcaggctgcctgtcgtacctggccacagcggccccctctcatctctccatgtcctcccaatcactttgcaggcatgtgggcgggaggctgagtgcatcgacgtgtacaagcgcctggaggagtcgcacccgctcccatccacgcggcgtcgggcggccgacctgcgctacatcatggaggcccccaagctgcccctcagcgacaaggacagggtgcacatccctgtgctaaagaatatggacgtgaacaggggcgtccgggcacccacaaaccggcccagggccccgccgacgaccgcgtcgaagcgcgagaagacgtgggacgagcggttctgggagacctatgaaccgccccaatacctgaccaacaagtacgtttggtttgcatccagcctgctggctgtggccgtgagtatctacggcaacatggcccggcatgggctgggcaggctcagcttgtgatgcccgttggaggtgtactttgtgataagatgcatttgaagaaccgatgaggggtgataggtgtaccaatgttcctctgtacatgtacatgctagttactgttcagatcaacttcgggaacacgatgccttgtggtccgggggcagtaccagaacggtgtcgatggccacctcgtcaccgctgcgatgccttcgtgcattcgacaatgcattcctcgaatcatgtcatgacaagagacgacccgagaataagaccacaccaccagatcactatgcggcacgcagttggtgcccccattgttacactgaccggtgcgtggatgccggnnnnnnnnnncagacgacccgagaacaagaccacaccaccagatcactatgcggcaggcagtcggtgcccccgttgttacactgaccggtgcgtggatgccggcatgacctcgctgatcattccctttagtattccgaaatgtcttttaatgctccgttttacctaccataggtatcaccggacccctgcgacgggatttgagggacatcgtggagcggctaggcggcacgtattgtggagactatcgagctggacacacgacgcatttggtgtgttgcgggctgctcatgggctccttcctcaccgaaaagcttcaagctgcccagcactctgccagtaccgcgatcgtggacgcacagtggctgagagagagcgacgcctgcgggagattcgtgccttgtgccccctaccagcgtcagtacgccgcctcggtagaggacagcaactccacctcggagcgtccatggtcggtagagaagccacgctgtgaacctcccgctgcagcctctccgagactgcaggacgtctgcgatctcctattcgtcgctgggcagtcccatgcacacggtaggtgcgcatgttggcaagccttaggcggtccacagtatcttgattacagccaatcatatacaaaacctctctagcaggcaccagggacgacgatccacgagatagcttgagcgcnnnnnnnnnntcttaggcggtccacagtatcttgatcacagccaatcatatatacaaaacctctctagcaggcaccatggacgacgatccacgagatagcttgagcgcatttggcaagctctccctcagccccaccctgctgggtcaacatgaagagcaggggcaaccctggacacctccagtcagcctgcctgcccataatggtgatgaggcaccagcggcagacaaacacgtcacaagaagtcccatggaccctgaagcacagggagcctcatcttttgctgccaacgatggtgacctgtgcccctccccggtcgcacgtgctgtcccaggctcgcgcattgagctgcagggtcagtatgccaggcacagggaagggaagaatgcgatgctggcggccatccaacagtaccatggcgttgccaccatggctgatgcaaggttctggcgtggggccggaatcactgcacccagtggagctacctgcagggttcgaacaggtatgatggcggaaagggagtggcgggaggagcagaattcgtaccaccattccccgataatgtctggcctctgaccccttctggccctcaaacaaccttgtgctgcaggtgatctcactcatggggccaccatgctctacgatgtcagccctnnnnnnnnnnccacacaaccttgtgctgcaggtgacctcactcacggggccaccatgctctacgatgtcagccctggagggagctttcagtatgccaatgtcttggtgagtgaagtggcgtctgtgcacatcatcagggctctccacatcagcactgatttgccgtagaggtcagggtgtgcatgcacgatgcccagagcctggcatgaatccacatgaacaactgctcaccattcatatcatcgtccccaggttcactccatctaccagctggcaccggatggcgagg

SEQ ID NO: 23131 - DNA, 61 bp, Chlorella protothecoides
gggctgacattacgtgatgggtggggagggtggagggtcgggcatgtgggttgggcctgtg

SEQ ID NO: 23132 - DNA, 75 bp, Chlorella protothecoides
cataccaatctgtggcgccactccctccctgctcttttcaaatgtgctgcacattgaccttgagccatgcatagg

SEQ ID NO: 23133 - DNA, 61 bp, Chlorella protothecoides
ggcgccaggtggcggccgcccccacgtgacacccgccgccgctgcgtcccccccgtgaaac

SEQ ID NO: 23134 - DNA, 117 bp, Chlorella protothecoides
caggactggcaatggcgaagggtgagccaccaattgccctgctccgatgctgcacgccttgcagggattgccagtcggcaacaggggctctgcaggccacagccatcgggatcaagg

SEQ ID NO: 23135 - DNA, 80 bp, Chlorella protothecoides
tcatgtcccctatgccagccctgctgatccccttgaaacatgtccctgccccgcagggcaaggatgccatcccctggatc

SEQ ID NO: 23136 - DNA, 102 bp, Chlorella protothecoides
gaggaggatgggaccctcattctgcgtgccgccctccagggtgaaaggcctgagagacaccaggtcggcgctggacggcatgctcagcagggtgtcgatgga

SEQ ID NO: 23137 - DNA, 165 bp, Chlorella protothecoides
ggaaggtgtacagaggtgaaccttgaaagggttgaaacacgttgctgtgaccatgactgcaaacaaggtaatgcaatgagtataagtttctctgacatggagccccttggaaagggcgtaaggggggaagggctataaggaaacgagaaaccctcacagatggaa

SEQ ID NO: 23138 - DNA, 107 bp, Chlorella protothecoides
agcctgtatgcctgctgcgcctctgcagggtaaccctcgatgcatggtgtgtgatcggctttcggctttcccccaggcccttcaatgctgtgcaccagctcctcatc

SEQ ID NO: 23139 - DNA, 61 bp, Chlorella protothecoides
aaagtctggaaggtgagcctccagtggcggtgtcatgagaagctggctggagggtggcaca

SEQ ID NO: 23140 - DNA, 76 bp, Chlorella protothecoides
tgcgcggcgggggcgcagcggaagatatccaattccatcaacgccgagatcaacgcacgtgaccggccaagggggg

SEQ ID NO: 23141 - DNA, 72 bp, Chlorella protothecoides
agtattgcagcatgggcacctgtgtgtaaatcagtcgtgagcggggttcaaacttcccacctcatgcatcca

SEQ ID NO: 23142 - DNA, 64 bp, Chlorella protothecoides
cggcatgactgccctgccgtggggagccggacatgtggccacatggcacccaccaggccattga

SEQ ID NO: 23143 - DNA, 61 bp, Chlorella protothecoides
gtcgaagggctccggcatgggatccgagggtggcgcaagacgtgggaggggtggcgcacga

SEQ ID NO: 23144 - DNA, 75 bp, Chlorella protothecoides
gtggctggttgggcagcgctgcagcggcctctgtgcagggcaaaaaccctgccggggtgccctgggcagcctggc

SEQ ID NO: 23145 - DNA, 61 bp, Chlorella protothecoides
tattgagaatgcacctcgtcccacagctttaggtggacccctgcttccccttccattcccc

SEQ ID NO: 23146 - DNA, 78 bp, Chlorella protothecoides
cctggctccctcacaatctttcggattgttttggcatacacctgcatgatggcacacagtgggttggtccattcagac

SEQ ID NO: 23147 - DNA, 61 bp, Chlorella protothecoides
cttgctggtccaccgtgagtccgaaagcccacctgccaccacggtgccttggtccagctcg

SEQ ID NO: 23148 - DNA, 88 bp, Chlorella protothecoides
caccaccagtccagaaagaacgatctcatttgaggagcgctgcagggaactgttcatgcacgactcaacaaaagtctgaaaacaaaac

SEQ ID NO: 23149 - DNA, 71 bp, Chlorella protothecoides
gcatgccaaattgtttctgatcctccaacagttttgttgatctcatcgtgccaccctggcccctgccaggc

SEQ ID NO: 23150 - DNA, 61 bp, Chlorella protothecoides
ttctatctgcttgcgaacaggggacgaaggtgttcggagccggaggatgatcgtacctgtc

SEQ ID NO: 23151 - DNA, 61 bp, Chlorella protothecoides
gcagcaggccctgctgcccaagccttcggaccccaagctctgggtggtgcggtgtgcagag

SEQ ID NO: 23152 - DNA, 108 bp, Chlorella protothecoides
ctgcccgccccgaccgcttgggcgcactagtttcccgtgctgctcagtttacggagcacatatccataaacaggctaggcctagtccatttaggctagttgcgacgat

SEQ ID NO: 23153 - DNA, 2121 bp, Chlorella protothecoides
  modified_base (734)..(809): a, c, t, g, unknown or other
atgccagtgggcaaacacacgaatgcacacaggtgagctagcggattactccatgttcctgatggccccacaagtgttgccgcgacgatcgtcctcctcaccaaggctttcaatcattctgtgtaccagtccaagcctcctaattccatatatccggcaatgggttccatgatgaaaggtcgagaaacctgtctcccatagacatcgtgccagctctacgattcaatacacaatcactgcgagaacttactcgttcaagtcataaagtaagcgaatatccaccgcagccaaggccttctaagaaacattttggcgtgatttgtacaacatacaatccacctgtgaatcgccagcattgaaatgatattgtgcgtgacaaactcatcaagggcattagcactcgtagtgcttctggtgcccgagtctcacagtactggtataacaaatggagcgcccctccttatcaaacgcagttcttgtggacctggggcatcaaagcaacttactgaaggaccttcctgtgggctccgtctcagtccaagatgtaggataccatataatgggatttaaaggctatcagaggataccactctggcaactttacttgtaatggagctggacgtccttaaacgaagcgatgccattaataatattcctggcatggaattatatctctctaggaaccgagaatcaaggtgactccgaaggcaacctttatgccaaagctcttctgnnnnnnnnnnnnnnnnnnnnnnnnnnnnnnnnnnnnnnnnnnnnnnnnnnnnnnnnnnnnnnnnnnnnnnnnnnnncttgggtatccagaggaagcaactgtccgaatctcatgaaacagctatttctggcatggtgagacaggaagtacacagcatagactgacacatctgctgtgcacggaagaaattatgcaagtatggcccattatcaaagattgatttgacatggcacggaccctgtgctcaacacgggatgagtataagtcacgcattcctggtaagctgcgatagatttgccttatagattggctcccaggagcaggtgcatcctgcactcctgtgctcaagtcaacttcttattctccattctttcaagagttgccacattggctttacaatgccaaccacattaggttgttggtgacccagccctcatggacgatggtagcgaagatttatgattccgttcgctatccacattacactgagtgctccgtgctagaaactaacacaaggtacgggtttaaactgtccagagagcgcttgatgtctctagagaggctcatggatacccatgtcaagtgtgcagagaccttcacaatcatgaaaggttgagtctcctttcccacctcttaagcagacgaacgagtctctgcgacctcacagcataaacccccaatcaacccgccatacgcttctcgcaatgactgggagaacaggtctgcctgtgcgtatggacagaagctgatgcccttgaggttggcagcgattcgatacaggttccgcacgaaagagcatggtcatttgctattggcatatgtcttgatcttgtattggcaagcacaggcattcctttacttccgactttgttggaccgctttgggaaatattcggcagatggtcatgagacactgtttcagcatgatcctgtacccctgtatggaacaggatcatcaaagagactttcgtgtgccttttctttacaatacatacacgcccctgcttcatctatacagaggtttcgaatcaaaggtgggaaatgtggtgcattatatgtgacatggttgcacacagagaaggtgtgcgcacatttgctagcgatgagagtacaccatctttcaactatctgaaaagagcggtgacgttgtgtaatcgacatgggaccatggatagcggcatccctgattattcaaaatcaatctttccatgatgtacaggggtgacgctgagtggtccttacaaagactccgagctgtcccatatggaatccaagccgaatttgagtgcctccactccagttacaaaacacatttcagaatattattcgcgcggagaagtttcttgttctttaggttttcgatgtacgccttataataccagagcaacg

SEQ ID NO: 23154 - DNA, 76 bp, Chlorella protothecoides
gagactctgccgtgcactactccagggcgaatcggagcaagcaatttgtaccctgcctcgtctgcaatgcgcagag

SEQ ID NO: 23155 - DNA, 1708 bp, Chlorella protothecoides
gggtcgcggcgtgcggcgcccggcgcgtgcccggccaagggccccggccccgtggggccggccgcgtccatggggttggccaggcccgccaggcccatgccctgcgccgcgccgccgtggcccagcagggcggggtggtgcgggtggttgccggggttgagctggcccgtatcagactgggagcgcttgccatcggggtagaagagcagaatctgggcgggggcgagggggttgagggaaaggggggatgggtccaggaaccaccaatgccatccctgaaaaggtatcgagtgacctgtcagcgtgagagtgtgcttcccggcgcacccattcatgcccgccgacggtgaagcgctccgaggcgatgggctcgccgtcgcccacgcccttcacgaggctgtaccccacgatggtgtgttcatgctcccctgcacggattattattggtaaattgaattcgctgggcgctggggggccctctcggtggtcgcatcggcgtgacgaggtgggggcacacatggtccagggtgcggggtcccaccctcccaaccttgccttccagggtctcggtcacggtccggctggtgctcttcatcgcatcttccttttctttgggttttgcagtgggaactatatagtccagggtacccatgctgcagggggccccctcctccctcctgttgtggtctattcacgggcttggaccgggcacttcaggaccggcacgaggacgcagggagggtatgggtcattggtggcatgggtgggatagaatgcagggggatggcatgcgcagcgtcgtactgcctctgagcaaatgggaagaggtgtgcgtggtccatgctgtgtaagttctcctttcgattgcgagacattgatttccggggacctggcgcgttctttccaccccaggcctgtcgcctggcttgtcacaggggctgatggagagctgcttcctctagggccgcaatgcgccaccatcactgctcccaagtgaccccttgcaccatgatttggtgatgaaacacgagaccttggcgagcagccgattctttgtctgtacagcaggtatgtgcacagcaagcaatgggattgctcaagcctgtttgggccaaaatgtacggcaagtctgtttcattggagggatcacgatacataaatactctgcgcattgcagacgaggcagggtacagatggcttgctccgaatcgccctggagtagtgcacggcagagtctcaccgccatgacaccggccccctaccacactgcccgctgccggatggactccagcttcaggcgctccacgtcccagcccgcggccaccagcgacgcgcggaaggaggggaaggctctccgggcgatgcgcagggtggtggcccccggtaggtgctggttggtttccatgcgctcggccatgttgcgagccacgcaggcgtgcaggcagcccagcaacgcgtcggcggcgttcgcctcctcatgcaggagcaggcgctggaccctgcgcccctccgaccacccctccaccagcgcgtgcagcccgccggcgtactcgcccactagtgcccggctggcggcgggggagagggccaggagggccttccgcggcacgccgacggggacggcggtggccgcgcgctcgcgcagcgggtcgcacggcgccaggcgggccggcgagggcagtggcaccacgcgcggcgcggcgcgggc

SEQ ID NO: 23156 - DNA, 61 bp, Chlorella protothecoides
ccgccatccaggcgggggaggcgaggcagggggggtccatgcccgccaccacgccgcggta

SEQ ID NO: 23157 - DNA, 62 bp, Chlorella protothecoides
ttccaggatacttcatggacatggccccactcggcgcaccaatgactggatttctgttgaac

SEQ ID NO: 23158 - DNA, 23867 bp, Chlorella protothecoides
  modified_base (3025)..(3034): a, c, t, g, unknown or other
  modified_base (3989)..(3998): a, c, t, g, unknown or other
  modified_base (4127)..(4136): a, c, t, g, unknown or other
  modified_base (4664)..(4673): a, c, t, g, unknown or other
  modified_base (4840)..(4849): a, c, t, g, unknown or other
  modified_base (4911)..(4920): a, c, t, g, unknown or other
  modified_base (5036)..(5045): a, c, t, g, unknown or other
  modified_base (5367)..(5376): a, c, t, g, unknown or other
  modified_base (6295)..(6304): a, c, t, g, unknown or other
  modified_base (6784)..(6793): a, c, t, g, unknown or other
  modified_base (6901)..(6910): a, c, t, g, unknown or other
  modified_base (7314)..(7323): a, c, t, g, unknown or other
  modified_base (7766)..(7775): a, c, t, g, unknown or other
  modified_base (8683)..(8692): a, c, t, g, unknown or other
  modified_base (8999)..(9008): a, c, t, g, unknown or other
  modified_base (9231)..(9240): a, c, t, g, unknown or other
  modified_base (10692)..(10701): a, c, t, g, unknown or other
  modified_base (11154)..(11163): a, c, t, g, unknown or other
  modified_base (12862)..(12871): a, c, t, g, unknown or other
  modified_base (13115)..(13124): a, c, t, g, unknown or other
  modified_base (13427)..(13436): a, c, t, g, unknown or other
  modified_base (14362)..(14399): a, c, t, g, unknown or other
  modified_base (15321)..(15330): a, c, t, g, unknown or other
  modified_base (16051)..(16085): a, c, t, g, unknown or other
  modified_base (16167)..(16176): a, c, t, g, unknown or other
  modified_base (17459)..(17468): a, c, t, g, unknown or other
  modified_base (19209)..(19218): a, c, t, g, unknown or other
  modified_base (20006)..(20015): a, c, t, g, unknown or other
  modified_base (20260)..(20269): a, c, t, g, unknown or other
  modified_base (20566)..(20575): a, c, t, g, unknown or other
  modified_base (21112)..(21121): a, c, t, g, unknown or other
  modified_base (21571)..(21816): a, c, t, g, unknown or other
  modified_base (21983)..(21992): a, c, t, g, unknown or other
  modified_base (22071)..(22150): a, c, t, g, unknown or other
  modified_base (22442)..(22451): a, c, t, g, unknown or other
  modified_base (23743)..(23752): a, c, t, g, unknown or other
ccacccccccttcccccacctgtgtacaccaccaccttccctcccggcaccacgaatgcattgacttgtggggagtcgatgacggcaaactgccactccaggccctgcatgtgctcctggaagccgccgccctgaccccggttcaccgccgcagcgatctgggagcccacgcgctgtacccgcttggtggccgggtggtggctgggcaccagactgccctccgccctggcctcctccagtacctggcggtaggtctgcctgcccagctcgcgctctgcggcctgggagatcaggatggcgtgccgccgctcggtgtagggcacctcctgctgggccaccacatacaccactagtccgccgccacccagccccgccagcacccgcagggcattggggttggacaggctcagcaccggcctccgatttccaaagtactggtactcggtcctggcagggaggggggtgcagggctgcgctctcgccatgcttgcatggatgttcctgtccccactttgagccagtcaagcatcagcacgtcagcggcatgaagcctggcatctgtgggtgctttcatacatccacaagaacatcctcaaccgagagacctgcgactccatgaccagcgtcgagattcgtgggccaaaggtgcagggagtcctgcagtcttgggtataccaacagggccagcaagcctctgggtcaacttcctgatgctggacagaccatggcgcaacatcagcgccattgaatcggatgcaggctatgaattgtggaatgcgcgatctctaatgtcgagtcatggaatgctctcaatccctgatggagacgtctgggacttgtgaagggcggagtctgagtgccctcgaaatggagaagcccatgaccttcttcataaatatactcataccaatcaaagagattcagaggcccttttaccagcataggaggtgatgctcctgggcgagggtcgctaaggcctacccttccgggaccgcgcgcgttgtttctctcgcccaacattggaaggaccccctgacaacagcttcggcacgtacgcgccgtattgtcaacgataaaccgatgacagccaagtccccccaaagagtctctcctgtgacgtttaccgctaaggttgaaatttgtgtccatctgcgccctgcttttcgttcccatcgggaaggagagtgcagcactcccctccgggaggcagaaattgtgcatcgcgtggcatacctgcgccccggtgtgcacagttaattcgtaaaatgcaacaaagcggaagtttgtgaccaccagaatatttaatgcgggcccaaacatcccgtgcctcggtactccgcgtgccacactcagggggctcgccaaggttggtgcagctactcctggccgtcccccttttcctcgcattctttgctgtggtgctgcgctcgtcggttggaggttcgtacgatcctctcgacgcggaccagaggctggacgcgagcattttcaggtaggcagtcggtgtggaggtctcgtgcataggtgtccagcgagggatctttccccgcacgaccagagctatgagtctgcgatggtgcatgccgaggcattcctgcccacttccactgcagcgaggatcacctcgtggccggactggagcggcgcccagtcctgttggagcgtgccactaaactgacggggcgcaaggaagtacgcccccaaggcttcgacagtccatggaaggggccaggtcctaaccccaatggtgtcaaggtgaggatgcaggggaggagccagtaacactttattggaaggatgggactgcatcaacatggatgtggctccacagaggctcaagtcctggaataatgattgaaagacaatggtggatgcctgcctctactacaagtggtgcagtgtcgatatgaagcccagcgttccctgtgtatccctacgccccagatcgcgttctgcgtgaccacctcggagcccctggctgacctcagactctggttgcagtacaacaaggcgataggagtcgcacggttttacctttttgtccagggcagggtgcgtcggtgtgttgtactcccctgcagatcggtacatgccgaagtcagaggagggtcttcacgggatctgtgcctggttgactttgcatggaatgcatgggctctcacatgttctccaactaccgtccaggccgccctcccggagaacatcgctggccttcagcatctgccagaggtgactgtcgttccgtatgacgataagctgaaacagacacatgccaccagcaggtgggtgcaaagctgcacagcaccccatgggcatttgtcatgatgagagggggcgcttccttttggctgtaacgcatgcacccttgtcctcccacctgcccactgtgctactcagctgacatgccctcaacgacgcaacgcatcatgtcaaggatccacctccatcatgacaggatctggaaagagcagtggctggccgccttcttccacaaaccgtgcaaccacgagctctttgtcctgcagtcgctcaacatggaaggtgggatcaagtagtagggatttaccatgtgttgctcatcccccaacagcgacacgatcacgttgcacagcaccctcaacatggctctctccttccatatcgacagaggccatcaaactggcaagaaaggatgacatggactggatcttacacgtcgacaccgacgagctgatgtaccctgctggatctccaggcttctccctgcaagaggtcctgggggcggtcccaagccatgtggactcccttgtcttcccaaactatgaggccctgccggagagggaggatgtactcaaccccttcttggaggtcacccttttcaagaaaaattttcagcacatcgtctcgggtgaggcggtgggggctgaagcgctggcctcctgtaacttaccgctgtgcatcgccgtgtcatggtgattgttgaaattaaggtgcccaagtcccacacactttttatcatgggacagatctgttcctttgtgatccnnnnnnnnnngaattgaggtgcctaagtcccacacacttttgtcatgggacagatctgttcctttgtgatccctcgggctcccctttcccatgccatgccggtccactcacgcagacctgtacttcaagaactacgtgagcgtggcgcacggcaaccccaactactttgtgacctatgcaaatgggaaggccgccgcccggatccacccaggcctgaggcccaacggagcgcatcggtggagcagctacgagaagagcatggaggagtggacgagcgaggtggcggcggtgctgcactacacctacaaccggttctccgacctcaaggggcgccgggatcgctgcgactgtgcgcccacggaggaggacgccaagaggtgcttcatcctgccctttgacaggtgatccatgagccaggggcatgtgtgcatgcttgttggtgcgtgaagatccagtgccccctggggcagtgtgcatgaggagggaatgtgtaccatcgagatgctggtcgaagccgatggggctatgtggtatgcatccatgcagactgatctgaggaccgcacccggtgagaatgaatcgttgatggaaggctgccctgctcctcttcactgatccccaggttggcattcctggagtcttcgctgagggatgacaatgaactgaagcagtttttcagggatcacctgctctggaaacaggacaatgtcaccacagacctcctccaccagggcctgctcgctcggttgtacgagcctcaggtgactgagtggtatttgcatgggaagtctcggtttctcatagcacatggcttatgctgcgctcccctgaggatgcagaaggcccaatctctggaggtaaaacattcacgagggagacgccaagtgcttgaggatcacaatgacttgcctgctggatactaacagaatagcatcccaacacccccaccgcaaagctgctcattnnnnnnnnnnggggaatgtgtaccatcgaaatgctggtcgaagccgatggggcaacgtggtatgcatccatgcagactgatctgaataccgcacccggtgagaataagtcgttgatggaaggctgccctgctcctcttnnnnnnnnnngtgcagaagggccaatctctggagaaaaaacattcacaagggagacgccaagtgcttgaggatcacaacgacttgcctgctggatactaacacaatagcaccccaacacccccaccgcaaagctgctcattcgtggcttcctggcagcaagtgcgaccagtgatggtggcagcgctgtgccacagctgcaaccatctccccaatcgagccgcgatccagaggaggcttctgcccaggcaggggatgccaatgtcgatgcggcggccgtgaagaaagctgccatggtggctgctctggagagaagcagcgtggagatggaggctgggggggaaattgctgcaggtgaccctgccgtcaatagcacggcgtcacgggaggagccgcagactggtgtgcagacagagctggcgcccttgcagcatgtggtggccggcacgaacgtctcggcgattgtaggcccaggggaccccgcagcggtgagaagcaacactgtaccacccagtcctgaaggtgggcgacaggtggagnnnnnnnnnntggctcggcgattgtaggcgcaggggaccccgcagcggggacaagcaacactgtaccgcccagtcctgaaggtgggcgacaggtggagcaggcagcgcatggcccaactgcatccaataccacaggggccaacctctcacaagcagcatcctcatgatgtatgcttnnnnnnnnnngactgcatccaataccacaagggccagcctttcacaagcagcatcctcatgatgtatgcttnnnnnnnnnnacaaccactgtacaatgaactgggtgttggatcgaggttgacctcgaaggggaagcaagtactccgtcggtgaggggaagggtggagggggtgagaatttgtatcggtagttgccnnnnnnnnnnctcagaacaagctgtgccctcatcatactctgccactcccatacatctgatgaatctatatacctcgtgatgcaaccactgtacaatgaaatgggtgttgaatcgaggttgacctcgaaggggaaacaagtattccctcagtgaggggaagggggtgagaatttgtatcggtagttgccatctaatttcaggaaagaatcggagccgaaggcgatcggcccaagtctgctgattcgcacatcccgtctaatacgcaccttggttcccgatggctggagctataaggatgaaatcaccgcatacttgagccacggagagattnnnnnnnnnntcttctgattcgcacatcccgtctcatacgcaccttagttcccgatggctgcagctataaggatgagatcaccgcatacttgagccacggagagattcgctggcttcgaaatttgagcacgatgcttgctcggcggagcaccctgcccgagcagtatcgtcgcgcgatccgccttgcagttgggatatgcattccctgcatcgttggactgggtgttctgggtagagaattgccccgaaagagggaattcacgcaggcatgcctctggtgtgccatcaccatggccgtcgtaaacgccccccttctcggcaaggtgctgctggtgaaagtcgatggctttattcatgggaaagcattgtttgcctgaagtgtgactgatgcaccttgatctctgcttgggtgggcttgtgcacgcatttcatgcttgctccgtcttggtctccatgctcgtgggtgtgtcagggacaaattcctgacagaaccctgaaccccccccccctgcacttccccaaggctgctactactggcatggagcgtgcactgggcaccatcctcggaggcttttccgggttcctcgtcttccagattggggagcttttctggaatgaggtcagtaccctgtgatatggaccatgcccttcccatgggttgtaaagtcacggatgccacttgctcagctttcctccctacctctcacatgcagcaaacggatggcatggtgctcacggttggggcttgcgttgtgtcctttgtggccattctcgtaggccacaaactgaagctggacacatctgcgcgactctacatcatcacattccttctcgtcatctttggtgctgaccgtggttcaggtgagtgattgagagccatgcatcagcagggatttatgaccttgaccttttaacgtgggggggggggnnnnnnnnnntcgcggttcaggtgtgtgattgagagccatgcatcagcagggattcatgaccttgacccttcaacgtgtgtgtgtgtgggggggggatctgatgtccgtgggcttccgctcctgtagttgcagcattgaaatctgtgtcgcgagagggaatcctcgatgctttctgtcatatcccaattatcaattgtacaatgtctccagggatagcctaaagccaccttaccccccctcgccatagatgctggcttactggcatggaaccgggtgtgcggcatcctagcaggcgttgtcctcatcctcattctgtccatcctggtcttccctaaatccgccagcatagaatgcatccggaagtaagttggaatctggtgtgctgagcagtggggaatgcgcccagagcacggtggacagtggactgtatgatcttgggtagggagggattagcaatctgttcccaggattataggcagccctgcacannnnnnnnnnaatgctttctgtcatatcccaatcatcaatcgtacaacgcctccagggatagcctaaagccacctgcacccccctccccatagatgctggcttactggcatggaaccnnnnnnnnnnaagtggactgtatgattttgggtagggagggatgagcaaattgttcccaggattataggcagccctgcacaatctccctaattccctctagatccctacgcacgagatgtcgctgtgaaattattctcgtccgcgaggatcctcgtttcatgactcctgaatcacgcatcttgcactccttgcagcgttgaaactgccctggagtcactcaaggagctaaacagcttggcttggacaagctacatcctgggtcctgagctgggagaggcctctgtagatcaacaccccctgccctggtgggtggcggggagtcgcttgcattgtaggaagtgccagacaacgatgtcttgttgattgctgctggtatggtgaggggtctgtgttctttgcacaggttgtcgccnnnnnnnnnngggaagtgccaggcaacgatgtcgtgttgattgctgctggtatggtgaagggtctgtgttctttgcacaggttgtcgccagaagcaacccccacttccaggtcaaacaaggggtacatgtccattggcgctgaggatgtggaggcgcaggtcccggggtctgctgcggccgctgctgctcgtgcggccgccgaggacgcctttgagtccaaggtcgagaaggtgcggtcagcacgttgatggcaggggcaccctgtgctgtggagcaggcaacatcaggacccctgcatgcatccgccgcatgcaggcttgggccatccattttagagcttgagctcgagaatgatattgccgtctgtcctcatccccccaaaccaaccaccttcaccatgctccttcttgcttccccacccccacaaccaaggtggtcacctcggtgtaccnnnnnnnnnnacctgtgctgcggagcaggcaaaatcaggacccctgcatgcatccgtctcatgcaggcttgggccatccaattttaagcttgaggtcgaaatgatattgccgtctgtcctcatctccccaaaccaaccaccttcacaatgctccttcttgcttccccaccaccacaaccaaggtggtcacctcggtgtaccagtcctgcttcaagctgatggacaacatggtgctggcagacgcggagtggtatgttggatcctacgccggtcgacccttcttcgcccctggtgagtgtggagaacctggcagggaccggggcagtggcggactgcgagcgcgtcattcggaggcgtcgcgatcacagccgcgtcaaggcccaccggcacccccggccccctgcaccagatctgcccctctgcctggcgaccaagacccagatgccgctggaggagttggcagctgtgggcgtcggcattcgcagggtcgcacgcctcctctcccagctgatcaacacgctggggtatggcttccgggccgagctccaggtgaggctcgggtggggcggcgcagggccacgggtgttttgagtgcgcctgtgaaggatgtggggcgtctgtttgaacacgcgatcgaggatggggcagacaggcagggaaggccgaccaggccatgcttggtctgtcccaagcatgctgctcctctcctctctcccaacaggagatgctgggcgagcagtttccagaggagatgatgaggaagctgggtctgagttgccaggctgtgaccaaggtgagcaatgagggtggtatacacagggggatcctcgatgcatgaggggaaagagcgccggtcatcctgtgcacccgcacgaatggggcgctcttacggtctcgatcccaagcagggacatccgnnnnnnnnnncgcatgaggggaaagagcgccggtaatcctgtgcactcgcacgcatggggcgctcatacggtctcgatcccaagcagggacatccgctctggtgctttcttcgtagccttcatcccacccccctactctcataaccgccaggaaatgacgaatgcattccctttctcgccggccatcatgccgggtcccctggttgcctttgtctctacggtggcctccctggtgtccacctctgacatgcaacgccggcaaatcatccgtgccctgaagaagtacaggtggggtaccacagggtggcagctgcttnnnnnnnnnntctggttgcctttgtctctacggtggcttccctggtgtccacctctgacatgcagcgccggcaaatcatccgtgccctcaagaagtataggtggggtaccacagggtggcagctgcttgaggttgggcatgagggcggcgttgttctgtggaatgtgtgttgttcacttccaaatgtcgcgtcctgaggagtgtctgtcgtttgcatccgttcacttgcagannnnnnnnnnggttgttctgtggaatgtgtgttgtccacttcaaaatgtcgtgtcctgaggagagtctgtcgtttgcatccgttcacttgcagacgtgtgtgtcgctccatgcctcaggctgtctgctggcatggcatgttgcacctttggaccactcgtctcagccccaccctccctccctccaccgcacccctcgcacaggacccagcgccccgaccggctggggtgggaccggctggtggacgccatgctgtcgcaccggtcctaccgcccccccggctcccagggcgaggggcaggtggacgtggccggggtgcagagcgcccccgcccaggtatcccccttcatgcgcgccctgcggcgcgactccccgcccaaggccccgcgccccaaggagggcgcggagggcgtcggcgcgggcgcggcggggccgacgaccggccagtcagcgggcgcggcacgcaggggctccctgcccagggtgccagaggaggagcgggcagcggagggcgaggcgcaggggcaggaccgtgcctcgtccagcgaggcgggtgtgaagggggccgaggcgcctggagccgaggaggaggagggggcccggacggcaggctccctgcagctggcggagggcacggcgccgccggccagcgcctttgctccctccagcgacaaggggtggagggaggaggaggggcaagaggtggagccgtcctcgtccctgctcttccggctgtccctgccgcgcgccccatcccccgagccggccggcgcgtcggagtctgggctgcgcgcccccctcatcagcaaggagcccggccagcccggccccggcgcgggcgcacccccactgccgctgccccactccagcgggtcacccaagctggtggactgggcgagggcgcgcgtgggctcgctgagcgagcgcctgccctccagcaggctctccgtgcacagcggcggggccgggtccaccgccgccgaggccaacgccatcggccgcagctccctgcgcgcggcggccgccgccgagtcgagcccgggcctggccgccctgctcgggcccgtcagcggcctgggggagcggggcaaggggcccactgcgcggcagctggccgcgctcaacgggggggcgaccgacccccggctccacgtgttcctgttcccggagacgcccgagggacgagtcgcgcaggtgggcttttatggtgatgggtgggtttgggcttctaacgctgtgtcggtgaaggatggtcgaggggatcagtgggtgtgccagctcggcgatatgcaatcgcaaagcaggggtctgagcgaggcaggctgaccagccatgtactgatgtgggacgtctctacactgccacatcccccggatgctttcaccctgaggaccccaccgccgtgcgcgtgcttaagaatgccctccctctatgtgagcgctgccccaggtgcggtggtactnnnnnnnnnnccaggtgtgccagctcggcgacatgcaatcgcaaagcaggggctggagcgaggcagactgaccagccatgtactgatgtgggacgtttctacactgccacatcccccggatgctctcaccctgagggccccaccgccgtgctcgtgcttaagaatgccctccctctgtgtgagcgctgccccaggtgcggtggtactcgttccagtacctcctggaggaggtcacggaggagctctcggcgctgcagcacgctttgaacgacacgctggccaagctgccctgatggggactcgaggagtctgcattgcatcgtgtggcaatgtgccacagtttgaactggtgacccacacctcagccgtgcatgcatgtgtcagaaaattcaggcgtccatgcatgaggtccccagtcctccggtctttgtctcttcacagccttttcattgcaagagtagannnnnnnnnncgacccacacctcagccatgcatgcatgtgtcaggaaactcaggcgtccacgcgtgaggtccccagtcctccggtctttgtgtcttcacagccttttcattgcaagagtagaaaatactcgccgtgccccatgataaaaacatcacgtggatcatccatcactcgagtctcgtgtcctgaatctccccgtgtaacaatcttcctcttcatacagggggcatgtccaccaagccttcacatcgccaagcgtttagacatgctcggggaagagtgaagggggccacgttccgcattcgtttcggtcaccagggggtcgctgcagtgatgtccccatccgacctccagctctgacatcagtgcctgcccagactcggtttgaatatcgcagcgtgcggcgagcgtgctgcgctcacctcatctcccggtgcttcgattcaaatatgatgggcgtgccgctgtcctgcacctactccacgtccattttgtgtagccacataggactcatagccaggagagcttgatatctctcacccgtggaccaccccctgctgccgtccgcagctgttgcacgatgttcgtagtgaagagggacggccgcaaggagcccgtgcattttgacaaaatcacggcgcgcatcaccaagctgtcctatggtctcaactcggacttctgcgacccggtgcgggggacagcgctggtgaatcgggacccaacggacgacggccaccctcacccctcacgagcaagcatctcaccgagtcaatccacgccctccggtcgcaggtcctcgtggcccagaaagtgaccacaggtgtctacaagggcgtgacgacgagcgagctcgatgagctggcggcagagactgctgcctctctgactgccacccaccccgactatgcccaggcaaggttaatcatgtgggaggtgatgtacttgtgggggagcacaggtagtactgttcagggtggggcattctcgtgagtaagactttcctggtgtgcctcctgccaggtgctcatccctttcctttctccctccacagcttgccgcccgcatcgccgtctccaacctgcacaagaacaccctcaagtcctttacggaaacgtgagtctcgtggagttctgacaagggaccaagggaagcaggtgtctgagatattcgaatagcttctctacaagagcttcttctccccagtgctgcattctagttcaaaccttcttgggctcctcactcccgccatgctgtacatctgcagaatcaagatcatgtacaaccacatcagccccaagaatggcgacagggcccctctgatcgccgacgatgtgtttgagatcatcatcaaggttggtaccacccgcacagtgtgctttgaaggggtgctggatctcgtcgacctgcacctggttgtgccatatgtagtccgtgcctcgtgccaaccaacgtacatgagaaatcctccaatccccctcctctctttcatccacacagaacgcggcccgcctggactcagagatcgtctacgaccgtgactttgactacgactacttcggcttcaaggtgtgatgcacatcagttacactggatgctacctcctcggtggttggtggtagtatgtgctataatatgcgtgcttgcctccacaacattctatgagaactggtcaggaggaggaatgatcacactcgtctagtcctgcacnnnnnnnnnncgactttgactatgactactttggcttcaaggtgtgatgcacgtcatttacactggatgctacctcctcggtggttggtggcagtatgtgctaaaaaatgcgtgcttgcctccacaacattccatgagaactggtcaggagcaggaatgatcacactcgtctagtcctgcacatatcctgcattctgattcgccctaccaccgccatccccaccgccccttcccccccctgaccggcagacgcnnnnnnnnnnatcgcccttccactgccatccccatcgccccttcccccccctgaccggcagacgctggagcgatcctacctcctgcgcgtcaacggggccgtagtggagcgcccgcagcacatgctcatgcgcgtggccgtcggcatccacaaggaggacgtggacgctgccgtggacacctaccacctcctgtcccagcgctggtaggctgtggatgccgttttgttctctgtctctcatggggtgcagcctctggcccaccacataggttgagctcacgccgccgcagtcaaagcgactctcgcccacgcnnnnnnnnnnttctgtctcgcatggggtgcagcctctggcccaccatgcaggttgagctcacggcgccgcagtcaaagcgactctcgcccacgcgaaacccgccacacctgcgcgcaggttcactcacgcctcgcccacgctgttcaacgccggcaccccccgcccccagctgtcctcctgcttcctggtgtccatgaaggccgacagcatcgagggcatctacgacacgctgaaggagtgtgcggccatctccaagtccgcgggcggcatcggcctgagcatgcacaacatccgtgccacggggtcctacatccgcggcaccaacggctccagcaacggcatcgtgcccatgctgcgcgtcttcaacgacaccgcgcgctacgtggaccagggcggcggcaagcgcaagggcgcctttgccatgtacctcgagccctggcatgccgacatcttcgactggctgtgagtcggagtgatgagttggtgttgcgggggagttggtgtcggggcggccgagtgctgtggcgggggtgtttgtcgcagagtgttgtgcgtgcggtggcatggccggcatgcagggtcggcgctctcgctgcatccagtcccagttccctcctggccccccactcgagctcatttcaaacacccacgctccgccagggacctgcgcaagaaccacggcaaggaggaggcgcgtgcgcgcgacctcttctacgcgctctggatccccgacctcttcatgaagcgcgtcgaggccaatgagacctggtccctcttctgccccaacgaggccccgggcatggcagactgctggggccccgagttcgaggccctgtacacacgctacgagcgggagggcaggtgagggagttgggttgttgttggtggtgaacttgattggcgtggggggggggggggggcgcgggggggggggnnnnnnnnnnnnnnnnnnnnnnnnnnnnnnnnnnnnnntgcagggtgggttggtagacttgtggcggagggttgggccccagctggaagcatggggagtgagtgatgatggtgttgggggtggcattgtcagagactgcgttggcatgggttcctcttggcaaggcgctgggatggatgtggggtgtggatggttgccttgcaccacacaggttggccttctttgttgaccaggatgtctccctcgtgctgttgctaagcccccagcatcccatccctctgcaggccgcgccgcgtgatcaaggcgcagcagctctggtttgctatcatggaggcgcaggtggagacggggaaccccttcatgctgtacaaggactcgtgcaactctaagagcaaccagcagaacctgggcaccatcaagagcagcaacctgtgcacgggtgagggtgatgggaggggggagtgtgtgcttggtttttgtggcacagagtgtgacgaggatgggagggtgggagtcaccatgaccagcccttgtcatggcgcagcgtccagcagcttgaggcatccccccgtccacccctggttcctggcccgcagagatcgtggagtactcctcgccggaggagacggcggtgtgcaacctggcctccatcgcactgccgcgctacgtgcgcgacgccagcgggcgcgaggggcgcaagctgatcgggtccctggacgccaagggccgctactttgactttgaccgcctggtggaggtggtgagcgccgccacacgcaacctcaacaagatcatcgacgtcaaccactacccaggtgtgtgtgtagggtggggggggtagttaaaaagggggggggcttctgggacaggaggcttgtgtcatgacccttctgcagagctgatctcaggcgccgtgcactcagacaacgaccagacctgcgtcagggggttgggctttcnnnnnnnnnnttttggtggggggggggggggggggtaaaagggggtccccttctgggacaagaggcttgtgtcatgacctttctgcagaactgatctcaggcgccgtgcactcagacaaccaccagacctgcgtcagggggttgggctttcctgatttctgaatcaagaccatgagcttgcctggcagcgctcagttgaggggactggctccttcctgtgcagcatcatgatcgaccaggaactgattcagttgcacatctcaaactctccccccccccgtccgtcgctgctcacagtggagaccgcgcggcgcagcaacatgcgtcaccgccccatcggcctgggggtgcagggcctggcggacaccttcatcctgctgggcctgcccttcgactcgcccgaggccgcccagctgaaccgcgacatcttcgaggcgctgtactttgccgcgctctccacctcctgcgccctggccaaggacctgggcccctacgagacgtacgaggggtcccccatgtcgcgcggcgtgctgcagcaggacgcatggggcgtgaagccggacagcggtcgctttgactgggacggcctgcgcgagcagatcaagtcgcacggcgtgcgaaactcgctcctggtggcgcccatgcccaccgccagcaccagccaggtgggtgtggggggtgggtatacgatgatgatgtgtgtgtgccggggggggggggggggggggggnnnnnnnnnnnnnnnnnnnnnnnnnnnnnnnnnnntgaacctggtatggtgctcctccgtcaccctggtttcctcacacacagcacaccccaccccacctccccccccccaaacacnnnnnnnnnncaaccctggtatggtgcacctccgtcacactggtctcctcacacacagcacatcacaccccaccccacccccccacccccccaccttccagatcctgggcaacaacgagtgcttcgagccgtacacgagcaacatctacgtgcgccgcgtgctgtccggcgagttcacggtggtgaaccagcacctgctgcacgacctcacccgcctgggcctgtgggacggcgacatgaagaacgagctggtggcgggcaacgggtcggtgcagggcctggacatccccgacgcgctcaaggcgctgtacaagacggtgtgggagatcaagcagcgcacgctggtggacatggccgcggatcgcggcgcgtacatcgaccagtcccagtccttcaacgtgcacatgtcggaccccaactttggcaagctcacctccctccacttctacgcctggaagaaggggctgaagacggggatgtactacctgcgcacccgcgccgcggccgacgccatcaagttcaccgtggaccagcagcagctggcgcggaagaaggaggagcgcgcggcgcgggccaacgtggccgccaccctggaggagctgtccctggccgcgggggcggcgccggccaagcccaagccggtgctggacaccgacgccgcgcgcgaggcggccctggccgccatggtctgcaggtgtgtatcttttggtcgtgatggtcgttggaggggggggggggtatatatgatggggcgaaggatttagggatggtggatggtggtggcgtcgactgcctggctgggatcatgggtcattgaagccatgatgtggggcgagggtgtgatgtcgccgtgccccaagcgccccacacctgctccaccccacatgcatcctccccctcttcaataccacagcatcgagaacaaggacgcctgcaccatgtgctccgggtgaagctggcgccctgccctgtcgctgggggcctcctgatccccacactccggcacacaccgaaccccagcgcctcggtgcgcacctttgggcaccccgcccgaccctgtacccaaacatttttctaccgatataaacgccaacctggaggtgtaacaacaagccacatgaggatcaggggtcaggagggatgcacgatgttgtgtttgggagtggggtggctggtgatcgaacgagggggttctgaggcatgatttcaaggacaagcgtctcaagcataacaattcatgatgaggacgacaccacttgcttgaatgtgggcatcgcactggccaacagagtnnnnnnnnnnaaacaaaggggttctgaggcatgcattcaagtacaagcgtctcaagcattacaactcatgacgaggacgacaccactcgctggaatgtgggcatcgcactggccaacagagtggatgggaagctgaaaatgatggcatcatgctcgttctcgtgtggaaacacttctgagggaagaaagctctcaccctacgatgacagatcaccggatcggtctcaaagtgggagacgcgtaacgtcatagccatgcaaagaacaataccaactgcctatcgtggccctcacaatcacatgtccaaacgctgggggccttgttcctcttattctgcgcgcagacatacacgcgaccgttgcagaatgcccagcaccttggcctcaagcgaggctgcggacagcaagtatgtgcagacggtcaacaagcaggacgacttcgcaaggtctctgtttgcagagattgatgcggggggaaaccctgacctggaccagctgcgtggcacgagcggtgggtgtcccgattgttgagaattggggttgttgcacatattccacataaggaggaaccacttgcggtgagatgatcgcaccgacttgctgatgagcagagttgtcccaagatggcccccctctaattatcttgttgtgatcagtctccaagccatccatttatgcaggcgtacgttttgagcccaccacgtggagtgagctcctggctctgatcgaggatggcagtgcccccgctctgggacagctaggaaggagcccactcggtctcaaacattactgggaccgatgtcgggagatcaagaccaaggagttcgtctccatgctggactacctgtatgtgcatgtctttggagtgcccagcataaagacaggggatgggcgactgcaagcccagctaccatctggcttccttgagactgagaaaatctcatggatggaaaatgatttcccgtactggtacgagccgggcattgagcatcactgtctctggagcacgaccccactgagcgaggatagaataaagcaggtgggtgggaggttggaggcaggccagaatgcacatgaggaggtgcatactgagcaggagtgtgcacggaaaggcttacacaacggctgacccatgaagctgatgtcgtccgaaagcctctgcaccagatgaagcaacccaccaaagccaatcttgccacccatgcaggagattgtccggcacagaggagcaggttacgagaccgcatggtttcaaaaccctgtggtcctcatgtcctgcccacaggtgacagttagcgtgtctgacatcttttcgaatgtggtgggccatgtcactggcctccattgtctttgctccggtgcctctgatgctctacagcaccacgctgctgggatgtgtattactataagtaataactaaagtatctgcccccggcccaccattgcagatatggcacgtccacattctttcaagaccagtccagggctgaatgtatgcaggaatataagcttgcgcttctgattttaaggctgtgtgcttttactaccccaggcttaagagttgatgacacactgggggcaagggttaccagccgcattttcagtttgcctgaccagccttgtccgggcgcgggaggtggcaggaagccgtgggcctcaaagggtccgcacacacattacggctgggtttggggggcataaataaccctcttgacaaaatttgcatacaattacataagtccctcacatccnnnnnnnnnntcgcattttcagtctgcctgaccagccttgtccgcgcgggggaggtggcaggaagccgtgggccttaaagggtccgcacacacatttcggctgggtgtgggggcaataaataaccctcttgacaaaatctgcatacaattacataagtccctcacatcctgtatcgtgggactctcaaagcaacctcccacatgcagcgcacgggttgttcggaccacccctgcgaacgggtggagctcagccccgagtcaattgctgaacatgatcttgccgtgaagagaggcaatgctcgtctgcggcatctttttgatgagctcagatttggtcacaatgttgattgggagtcagtcaggggtatcccaggtgcgcgaaacccgcagggtcggtcggctgtattacaaaagtgggtgacaagacgaactccctcaaccatgttggcttacaagcttgactcttctcaccacacatggatgctctccttcaggattgcgtcttgagccactttcctgggaggaactccgggaaataatcctggatgggagtccctcagctcttggccggctgggtcgcgatccgattgcccagcgagactactggctcttcagagagcagaagaagaaagagtaccagtccatgacagactacttgctacacaccgtcttcaaactcaagaccaaggaagctgaaggtaagcattgtaatgcgaggtgtcaggctgttgagggcatgccagcctttcaacgtgcaacccgaccacaccatgaccacgcactcgacagatggaaaannnnnnnnnncgagggcatgccagctttttaacgtgcaacccgaccataccatgaccacgcactcgacagatggaaaactggaagctgtgataccgcctggattcaaagaatcagaggatgttgtctggcgcccaaatgtgagtggatttctgtcatgaaataggggagcttgaaggattctggtgcagggtgttcttgtgcatacgatgggtacaattcatcccacttcagcgtgtccacacccttccacctcnnnnnnnnnngtgaaataggggagctttaaagaatttggtgcagggtattcttgtgcatacgatgggtacaattcatcacacttcagcgtgtccacacccttccacctcaaacgattgtgcaggattatccctacgatttggaacctggcattgaacatcacaatctgtggtcaagccactgcctctcagatgaacgaattggaaaggtgagtggaggcaaaaggggcgttacttacttatgagtatccatcccatcacgcttggcctttcaaaatagaactttgctgacataacggtattcctgannnnnnnnnnagtgagtggaggcaaaaggggcattacttacttatgagtcttcatcccatcacgcttggcctttcaaatgagaactttgctgacataacggtattcctgacccccacaagaaagtacattcttatgtcaaccgaccctgcaggaggttcggaaacacagggaggggtacgacttcctgtggttcatcaaccccagtgcattgatgtcagtgcccacggtgagcctaacaaggctgcattgcgttggttctggagttgagaggctgtacgtgcgtattgtcagagggtgcgagtatggattcttgatcggattcggcctcgatgtccttcaaaaatcctcaaacaaccttgtggacctaaactgtctgattgtgcagtttgcctcattggatgacccgttacttccctttcctcgaaaccacctgcagatatggcacgcacaggtgttgtctcgtcgaaagaacggggccacccattaaagactgagtatataataattgcttaattaaataagcagacggtcgattgcacgtctttnnnnnnnnnntggggtcacccattaaagactgagtatgtaattattgcttagacaaataagcagacggtcgattgcacgtctttccagcagttgctgcgtcactttgtttagccaacgcttgacttgtgggtgattctttcgtgcttgaaccagagaagtggttacacaaataccccacaccgagtttgtactgctcgagatgcgcgcggggctcggcaggcagcgcgccaaacccaccacccacatttgatattgtgagtgcatttcgcgaaaaggcgatgtgtagaatgaggcaagcattgtactgatgtgaaaaaacagggattaataaataagtaacgccatgttttcgaaatcgcagctcgccaagatggccggcaagtgtcggatcactcaggtacgggaggaagcaggttgactgcaagacaccccgatggggtctccagacggatcaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatctgtctcagggggcaacacatcagggtgggccatggcggctattgttgtgcgtttcctggagagcgttgcaaccggactggattccaggctcgcaagggaacctgtgtctgtgaccaagctgtgattgatgatggattgcagtggtcaatctcgcgctatgnnnnnnnnnntaatgaggcaagcattgtactgatgtgatcaaacagggattaataaacaagtaacgccatgttttcgaaatcgcagctnnnnnnnnnnnnnnnnnnnnnnnnnnnnnnnnnnnnnnnnnnnnnnnnnnnnnnnnnnnnnnnnnnnnnnnnnnnnnnnncgacggaggttgactgcaagaagccccgatggggtctccagacggatcaatacataagttattgcctatgatgcgcgtgcaggaaacttttgatgaggccgtccgagaaaacatcgtagaatttgacatggaggggagtgtgctcgaggagcacatggaccggcgccgctttcgatgatcaacaatgtgatcttagggtgcccgcgatctcaatgtgctcttctcaaaagctgtgcaacgacgtcaccacaggcagaggaggctctgaaatcggccattgccgagtttgagnnnnnnnnnnggggtgcccgcgatctcaatgtgatcttctcaaaagctctgcaacgacgtcaccacaggcagaggatgctctgaaatcggccattgccgagtttgaggatcagaacgtggacctgtccaacatcatcaaatctgtctcagggggcaacacgtcagggtgggccatggcggctaatgttgtgcgcttcctggagaacgttggaaacggctggattccaggctcgcaagggaacccgtggctgtgaccaagctgtcattgattatggattgcagtggtcaatctcgcgctatgcctgaagacccttggccctacccgcgctccaggcacccagcggcggagtgcttggcaactgtgaagactgcttcaggtgccgagtttgtccaggcctgtcaccacctggtgttgctcttggaggatccagagggagaagcctccaacatcctgcttcagcggggagcagtgggcgctctcctgagcgtactcgaggccggcgggggcgctgcggacgccgagggtgcaagcgcggggctgcgtgtcctcaaggccctcttcggcacacgctcacaccagacagcatgcctggaggctactggaccgcccatcctccaagccatcgtggcgagaccgggtgaggctggaggtgtgggaggaatggttttgccatgctctcgggtccaggctgctcaccggcaataacaatgaggcagtgccctgtctgatgacgtggtgggttcccgctggacctggggatgccgggcacgcctctgggcacctgcacgagcattttctgagggcgaaaccacaagcaaagcctgcattccccccaactccgctcgcacagaaagcacattgggtgtaaaagcacttggcctggaggcggccacggccctggcgcgcaagcatgaggccggcaaggtggcattgctggtggcgggcatggcctctgccgccctgcccgttctggagtctgtgggcagggcgacaggggaagatgaggaggagggcctcgcagcgtgctgctcgctgctctccgccctgacatgcgccgacgatgacacgctgcccagcagcaggcgagtctatgggccatggggtggatattgcctctgtgtgtgtgtgtgtgtgtggtggcgaagccatgctcatcctcgcacagcgttgtcgcttgtgctgctggggagctgctcccctgttaaaatgcatggtgtcgttggcccaatgatctcgcggtcatgattgctcgtcacccatcacatccagcgcagcacccggccccacccctctcccatccnnnnnnnnnnactgcttccctgttaaaatgcatggtgccattggcccaatgatctcgcggtcaagattgctcatcacccatcacacccagcgcagcacccggcccccccaccctccaatcccccc

SEQ ID NO: 23159 - DNA, 246 bp, Chlorella protothecoides
ttcgcttctatattccacaaggtgacaggatagggagggctactggatggtcacctttatgaacagccgggcaggagtttaacagcggccttgtaggcaaccaaacatgacggctccataggatcgccctaagaataatgcctgagttccattcgaatgcgtctggattcaaagacaatttgaagctcttgatgcacctattgtatctccagaaaggcagacttcagtctcgaccgcccagcaaca

SEQ ID NO: 23160 - DNA, 68 bp, Chlorella protothecoides
cccgaccgcacatctgtgctcgatgcccatgccacgcagatgcaccaaccggcgccgacactcaccca

SEQ ID NO: 23161 - DNA, 75 bp, Chlorella protothecoides
gaggcaatccaggcccgggtggccgacgagtggtgcgtgggcctgaaggggctgggtggaaagggggaattcaat

SEQ ID NO: 23162 - DNA, 228 bp, Chlorella protothecoides
ggtgtcgaatatggagcagtactcctttggctctgcagccatctacgtgggtgctaacctcaatgaggtggcgtcactgtctctgctcaacccttcaccccctcctcctgccatctttccccctcctccaccatcacttggaacactcagtggacatgttgctcatgtcggtggtgtcttctcaacctcggttgcgttcagcagccaacctccggacaccttcaacta

SEQ ID NO: 23163 - DNA, 160 bp, Chlorella protothecoides
gcagcgggctctggatcgccgcccagccctcgccgcagctccatgcagcgccgccacgagaccgtgcgcacatctggccggctgcaacatggcctccctctctccctcacattcccccatctccccctcaccccttacttccccaacaggtaccctggtc

SEQ ID NO: 23164 - DNA, 77 bp, Chlorella protothecoides
gcgcttctgattttaaggctgtgtgcttttgctaccccaatcttaacagttgatgacacactgggggcaagggttac

SEQ ID NO: 23165 - DNA, 77 bp, Chlorella protothecoides
agggtataacaagaaaccgggtgcaaagtctgccaggttctcccctttatctattgtgggtggcaagggcatgtgcg

SEQ ID NO: 23166 - DNA, 3622 bp, Chlorella protothecoides
  modified_base (987)..(1021): a, c, t, g, unknown or other
  modified_base (3434)..(3443): a, c, t, g, unknown or other
gggggggggcttgaccgggcgattgcggggctgcagcatgcgacccgactgtgcccaacccgacctgagccgatggcggggctgtgtgtgccgtgcagccggggcggaggcctggtggggggggcgaggtccgcggggacgcccgctctcctgctcaccgacctccccctgcgcccatggcagtcggcgtgaagctggtttcctttgacgaggccctggccacgggcgatttcttctccctgcacatgccgctgacccccaccaccaagaacctgtttgacgacgcggctttcgccaaggtaggcagcgacgcgctctgtgctgggtgaagtcgctggtgaagcggtgcggtggctggggtccatactcctggctgttttggaaatacacggcgacctgtctgatatctcagggttcatgggggggggtcagccgatgcccatctgcctcacgtttccctgcagatcaagaagggatcccgcatcatcaatgtcgctcgcggtggcgtcatcgacgaggctgccctcgccagggccctcgatgccaagcaggtagggtgtgaggttgtgaagagtgtggggatgaagcgaggcagcactgttccgctccaaggtacacaccggccgcctcatgcccatctgtggacgcaagggcgcgctgccgccctgagcctgttgtgcctggctctgccacctgccccccggcgtcatgctcctctgtcccatcattgctccctccaggtggccggagctgccctggacgtatttgcccaggagcctcctgcagcggacaatccgctggtgaaccgcaaggatgtcatctgcaccccccacctgggcgcttccaccaaggaggcgcaggaggaggtgtcgtacgagattgcagaggccgtcgtctccgccctcaacgtgagctgtggtgccaggagttgtctggcaaatggtgtatggcatggcatggcgcgcatcccccccccccccccccggnnnnnnnnnnnnnnnnnnnnnnnnnnnnnnnnnnngatgacggcctgatccaccaacggcgcacccctttcccgagcactggccatgccccccccccgccatacccctgttcccagggtgagctgacgagcagcgtggtgaatgcccccatggtgccccccgaggtgctcaaggagctggccccctacgtcggcctggcccaggtgggtcggtgtggcacgaggtgatgccctgccccactcccgaatgtgggacgtgcgatgccggcgcagcgtgatcatgggcggggtgaggtgccgatgtctttggtgtccagcttcgcgcctccagatgccttgggcgtgtgcttggcaagggcctgcatgctcattcccacactctggactggccatccggcccctgtttgcagagcctgggccatgctgccgtgcagctggtggacgaccacgggttctccgaggtgcacatcacgtaccacaggtgagcatgatggggggtgcccagcagtaccactgcgcagaggatcagggtggtgtgagggacgacgcagtggtcatgtggagaactggcgacaatgccctagtcacctcacctgattgtgaacccatgtggggtttgaaatttgcctcgcagcccccgcggagatctgctggactctcggctcctccgggccaacgtcgtgcgtgggatcctgcagcaaatcaccacttcccaggtgtgcggactgtggccctggcagtgatggcaaggcgggggtccacgggccagcactgcgtgactctgctgtcgcgctgatggcgagctgggtgtgcctcagcgtcctctgatccagggacccgcatgatgcttgggtggtcacccgccgcccaggcgcctggtcgggataatgacacatggaatgtcgagcactcctgtcttcatccccctttgctccctcacatgagaccctgtcgtgcagtcccaccatcccctcctcgactcgaatgcacatccgcccaacccctcgcacaggtcaacatcgtgaacgccgacctgctcgccaagaagcgcggggtgcgcatcgtcgagactgtggtgccctccgagggcgcagcggtgctgaacagcctggaggtggccatcgtctcccgcgcctcccgcttctcctccgccgtcaacggccggggccagatcagcgtgtcgggggcagtgaagagcggcaagcccttcctcacgcagatcggcgactttgatgtcgacttggccactgaggtgggctctcctggggtggaaagggggaacagggcgttgtccttgagatgatgagccgtcgggcgttgtccattggatgaaaaggcaccgggcctcgtccccaggcaccgccgcacgaccagcatgccgtgtgactggccagtgtggtccttgctgcgacgctgccgtgcctgaggactgccccactcatgccagccctgctgacactccctcctcgtcaatctcactgcacacccagggcgaggtactgctggtgcgccagaacgatcagcctggaatcatcgccactgtcgcctctgagctggccaagaaggagatcaacatctccttcatgtccgtggggcgcactggccgcggcgctgacgccatcatggccatcggcatcgacggctcccccgacaaggagctgctgggggccatcagctccgtgcgtggcgtgcaagagaccgcagctctgagcaacctccgtgcgtgatgcaggagcacaagaagcgaacaacatgtgggactgtgcctcttgggttgtgcatagtgtgacagatagagatgttggtcgggagcgaggctcacaagctcactcaagtgtgagagtatgggctcgagatcatgccacactctccagactgtgtcgctgcaggcttgctgacaaatcaggtccgctcgcatccataggcagcccaagtcgacgctctggctctctcactgaggtggcaatcagtatcgcatatcaaaagatagacgctaccaatgccacaagaacccctgctgggcttacaccagttgcatgggggcttctgcagatggcagcccctgcgcagttcgttttggtcagccctgatggctgactaatggggggaagggggcaagagggggaggggaagacgaggatgggtgcccaccaaaaattgcggggcaaggcgcgccagccaggaagagcttgaacaacatgagaatgctgatcgccccgttgacatcccggttgacgaccctgacgttgcacgcccggttgtcgcagcgcttggtgccccaggcctccttcatctcctccacgccctgctgcacctgcctgtagcggtgggtatgcaaggcggtgtggcagccgcagcacatctgcgacgtcatgtgctcgtctaccaccaccaccttgcataccctccgcaggcagtgaaggaagggtgcaaccggaagaagcgcacnnnnnnnnnngggacagcgccaggtcgacactgttgccatagttggttggatctggtctccacgaaaagtaacggcgatcagctgtacaggtataacaagaaaccgggtgcaaagtctgccaggttcacccccaaatccattgtgggtggcaagggcacgtgcgactacgccaaaagaaccacacattc

SEQ ID NO: 23167 - DNA, 241 bp, Chlorella protothecoides
gcatccagactggggagccagggtggtgtatggcgacacaggtatggactcatgggcatgtaagcactgtgaagtgatgtggcgcaggggccggcaaggcgggggagtgcatgctgttggcccgatgcttcgggctctcaccctaccaagggtcgttaagtatgattagagcatgtgctaggcatacccctacaactcaagcatatcaccccatcctgttgccgcagacagcatgtttgtg

SEQ ID NO: 23168 - DNA, 61 bp, Chlorella protothecoides
gtgggtggtggggccgaggggggggaggggtggtcggtgaagggagaaggaggggtcaggg

SEQ ID NO: 23169 - DNA, 75 bp, Chlorella protothecoides
ggacacatcagacatggcctccagcaaatcttttccccccctctcacagaccagttcatgtcgtccgaccacaat

SEQ ID NO: 23170 - DNA, 79 bp, Chlorella protothecoides
ccgccccacccctccattcgcgcgtgcggcctacgactgcacatgcgagccctgcgcaggtactgcaagcggcccgcca

SEQ ID NO: 23171 - DNA, 77 bp, Chlorella protothecoides
agagagagtgagagacgtcagggagtgtacagcttgaagcacaataccagcagcagcaccaaaacattgcaacgtgc

SEQ ID NO: 23172 - DNA, 80 bp, Chlorella protothecoides
gcaagcacaaggtctcacagggcaggtacgaagtcatcttgtctcctatcaaggggcccctgctcaactccaggacccct

SEQ ID NO: 23173 - DNA, 78 bp, Chlorella protothecoides
aatcccgtcattcccctcgtcctcgactccttgcacacactcacccccccgaccccttgcagggcggtgatcgaggcc

SEQ ID NO: 23174 - DNA, 165 bp, Chlorella protothecoides
gtcaccctgctgccaggcagtctgacgggggcaggaacaaatcgctcaggcgggggggggttctctgacacattctaatattccacccaagccacactcacacactcacccgctcacacaaccataccccccacgtccccgcagatgcgtgtggggctgttcacc

SEQ ID NO: 23175 - DNA, 61 bp, Chlorella protothecoides
acttgccctctgctgtgccaagacgggatcaggctgggaagatgccttgaagttcatagaa

SEQ ID NO: 23176 - DNA, 61 bp, Chlorella protothecoides
ggctgggaagatgccttgaagttcatagaagctgcaccagcggtcctcaggtgcgtgcgcg

SEQ ID NO: 23177 - DNA, 61 bp, Chlorella protothecoides
attgacacaatccacctttctgtctgcaggtggagacccctgagtttgtccagatggtcaa

SEQ ID NO: 23178 - DNA, 70 bp, Chlorella protothecoides
gatcccaagccatcagccctgcctgaacctcgaacggtacacccattcctgtcatgttacagtgacctgc

SEQ ID NO: 23179 - DNA, 65 bp, Chlorella protothecoides
ccaaaattgttcttgcccctgttgccggagccgatgttgccatcgctgtctgccgagcacgcctt

SEQ ID NO: 23180 - DNA, 64 bp, Chlorella protothecoides
cattacgattgtctggagaacaggttgccaggttgcagacgccacaaccgacagaagagctgca

SEQ ID NO: 23181 - DNA, 62 bp, Chlorella protothecoides
agggtgattggaaggtgcaggcagactttggaaaagtgaagctcaaagcagagactgcccct

SEQ ID NO: 23182 - DNA, 117 bp, Chlorella protothecoides
agcgtcaacaggaagacggaaagcttgcacgcagccacaaggcacactgtcagaaatttggtgaggatggatgccgaagcacctgcacagggtccacggggagatgcggcagttcct

SEQ ID NO: 23183 - DNA, 79 bp, Chlorella protothecoides
gagtgggtcaccccatccccccatatggcatcgtctcgttcccactgatccgtctcgaaatcacgagtccgaacagaaa

SEQ ID NO: 23184 - DNA, 449 bp, Chlorella protothecoides
  modified_base (94)..(280): a, c, t, g, unknown or other
gcatgcaccggaaaatacttcacctgcttgccgttttctaagcaaacttagcgtgtgtatcacctctcggtacgcagcaggcattcggtatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgaaatgttatctgccgttcgggctctggatgtgtattgaaattgaaacattctggtgtgggtcggctgccacgcggacaccgggacgcatgggtcttggggtgtcactgccctcgccagcctccctcccagatgtggacataagccaggtacgtacattaaatg

SEQ ID NO: 23185 - DNA, 61 bp, Chlorella protothecoides
gctgaggtctgtctcagctccaggctcgcaggggccctcgctgtgcacgtttggtgccgtc

SEQ ID NO: 23186 - DNA, 72 bp, Chlorella protothecoides
tcctcagcacgcgacgggtccccccatgcctcggcatggagagagcatggccccgattcgcactcgactgcg

SEQ ID NO: 23187 - DNA, 77 bp, Chlorella protothecoides
gccgactggaatcgtgagtgcaaagagttctccctggaggccaggggttgagaatgtcggcctgggcttggtccagt

SEQ ID NO: 23188 - DNA, 116 bp, Chlorella protothecoides
attcctgttggacatcatgtatcgtccgcatgtccctgccctcattgtctaagatgctgggccttgcatgcgagtctaccggctatgccaactgccagaatgcgccccccccgtcc

SEQ ID NO: 23189 - DNA, 79 bp, Chlorella protothecoides
acataccaccttggggcagattcaggcaggcgtcttgggcctgaggcccgtgcatggagaagggaagctggggcgatgg

SEQ ID NO: 23190 - DNA, 85 bp, Chlorella protothecoides
gccgccgaccccagtacagccaggacgtcccggtcgtcactggttcctgcacagttttgcctgcagaatccacaccaggcatggg

SEQ ID NO: 23191 - DNA, 146 bp, Chlorella protothecoides
atccacagttatcgctggaaggctctctgtcccttgtcgagcggcgagcttgtattgcaaaatgggacaatgatcccatgacgtgtcactctccgttgcagcaagcggcaggcgagtcgcctgacctttcaactccttgacgtaat

SEQ ID NO: 23192 - DNA, 75 bp, Chlorella protothecoides
atgctagtgaggtcatgcatgctcagtagatggtcgaatgtaatctcacgtcgacgtccttctgacgtggcaaag

SEQ ID NO: 23193 - DNA, 61 bp, Chlorella protothecoides
gctgtgcatgcgccatgcgcatggctggggtgcaatcatcggatgttgcagccggtcaaga

SEQ ID NO: 23194 - DNA, 77 bp, Chlorella protothecoides
accgtatcaatgacgaacagacggggtaatatgccctgtggtgcgcattcacacccccgtgagccgggacagggtca

SEQ ID NO: 23195 - DNA, 136 bp, Chlorella protothecoides
atggccctgcagctcccaactcccgggcacagcgatctgtgagttgaagagggacggagggattctcccatgaggcacagcgcggcagtgcatatggtggccgcgcctggctcctgaccgacgaactgaggtcatc

SEQ ID NO: 23196 - DNA, 141 bp, Chlorella protothecoides
tggcctcgtgcgaggggctggcggaggcagcggccagcgcaggccttggtgagggggccgtcgaggaggcaggggaggggcacgccgcctcggcccccagcgccgagggcctgggcaccgctcgccgtcgctccttttgca

SEQ ID NO: 23197 - DNA, 61 bp, Chlorella protothecoides
tgggcaccgctcgccgtcgctccttttgcagggccgcaaagtgctggcgggccgccttctc

SEQ ID NO: 23198 - DNA, 128 bp, Chlorella protothecoides
tgctctgccagaggacggcgcatcagatccaccagcctgcagagggctcgagctttctccaggtcctgcagacacgctgccggggctctccaccagtgacaggctggcagggaccagatccagggatg

SEQ ID NO: 23199 - DNA, 62 bp, Chlorella protothecoides
gggtgtgccctgccagaactctcctggtcgtctttgtgcaacccagcagctcaaccctacgc

SEQ ID NO: 23200 - DNA, 75 bp, Chlorella protothecoides
ctacttctatcgtgtgggggatcttaagacccagtactggagcgaggtatctatgtgttgcatgtggaaccctgg

SEQ ID NO: 23201 - DNA, 71 bp, Chlorella protothecoides
gcgccggccgaggtgtccaccacctgctgcaggccctccttggacagctggcgctggtacaccttctcctc

SEQ ID NO: 23202 - DNA, 114 bp, Chlorella protothecoides
ggtgctgggcgttggccttgccatgaggatgggaagcatggaagtggtggtcggtctgaattattagcccatgtcaagcgtcgagtgtatgcaccacccatacatttgtgtgaa

SEQ ID NO: 23203 - DNA, 72 bp, Chlorella protothecoides
ttgaagatacactccgagttttagcctcggtgtgcaagtgcaggagggtccatgtcgatcctgggatggacc

SEQ ID NO: 23204 - DNA, 85 bp, Chlorella protothecoides
cttggacagcatcgccattgcatcaaagcacgagagttgggaggagggggggatacgcaagagcagggacacccactgcccggaa

SEQ ID NO: 23205 - DNA, 87 bp, Chlorella protothecoides
gaggagcgcccacgctatgacgaccgcccccgctacgacgatcgggaccgctatgagcgtcgctactgagggagagggagcttgcga

SEQ ID NO: 23206 - DNA, 78 bp, Chlorella protothecoides
ccagggcgaggatgctatcaaggggtgagttccaaggatcgagagggtgggcccaagatatgtgtcgtcccccgagag

SEQ ID NO: 23207 - DNA, 209 bp, Chlorella protothecoides
gcatggggttgaggcggtcacaggcgccactgctccccctctcatccaccacacccaccccgcaaacaggtagaccggctcacctgcaggcccaggaagatgtcagggaggaggggctggatgcagacccggaagcgcgaggcgttgcgcacgggggccgtggagttgtgcaggatgtcggacaggaggaagaggcgggccaccttgag

SEQ ID NO: 23208 - DNA, 78 bp, Chlorella protothecoides
caaggctctgtaatgacaaattgcccccccgtccccccccgagttccctgcagctaccccaggacatcaacctcagct

SEQ ID NO: 23209 - DNA, 145 bp, Chlorella protothecoides
gtttgcaagcctctcccctgacacacattcttgctaccctggccatacacagacgcagtgctggtgctgctgctgtgaccattccaaggcgagctggtgtgccctttcgcccggaggagcagtggctcaggcagtggtaggcgaa

SEQ ID NO: 23210 - DNA, 80 bp, Chlorella protothecoides
caccaccgcgcacatgagcttctccttcctcgtgctggccccctttgcattgcgcacgccttgggaggcccaccgcgcca

SEQ ID NO: 23211 - DNA, 75 bp, Chlorella protothecoides
tcattcagaaagaatggaccctcacttccatagccattgggttttgacccttcctttcgaatccggaccacttgc

SEQ ID NO: 23212 - DNA, 76 bp, Chlorella protothecoides
tgaacgacacgcatgcgcactttgcctggtaccgcaaccaggacgccgatacatgtgagctgacttgggtgggggt

SEQ ID NO: 23213 - DNA, 117 bp, Chlorella protothecoides
gtggcaaggggtgcatccttccccgccaggttccatgtattaacaagaatcgcggtgtgacagccgggtggagggtcgggtacccatgtgcctcagacgatgcattcaggagctcag

SEQ ID NO: 23214 - DNA, 146 bp, Chlorella protothecoides
ctccttgagaggtcgagcgcgactcctgggtacggacttctgatgtgtagcggcttaccagggttctctttgggaacaatacaaataataaaaccctggcatgagatcggttgtaaactggctcacagggcacgcctgagtgccat

SEQ ID NO: 23215 - DNA, 68 bp, Chlorella protothecoides
cctgccggctacgcagcgcacaatcaacctacgtaagggcagcacaattgcacctggaggttggaggc

SEQ ID NO: 23216 - DNA, 77 bp, Chlorella protothecoides
ccctgccgtgtcccatggtagaacgatgcagaatgaaagcggcgttggatccattcagttgactcgcaagggagtga

SEQ ID NO: 23217 - DNA, 72 bp, Chlorella protothecoides
gctactgctcggaagatacttcaacaactttaaatcaattcgacaaacattggcaggcaaacagttgatttg

SEQ ID NO: 23218 - DNA, 62 bp, Chlorella protothecoides
gaaggccaggaccttgggatgggaaggggggggggaggagaatgatccgggaagtaaatcaa

SEQ ID NO: 23219 - DNA, 1097 bp, Chlorella protothecoides
ctgtcttataggtggggcacctgtgggaagggatggggggaagggggtttgagcaagagggttggtggtacggttggagcgatgtgggaggttgtgacacagtgcccacccctgcaaggcatacccctgcattatctctacaaaccaatcaccactcactggtgcagcttcttgactaagggtggggcgtccgcgtgccagttcgcaatgaccccctcccgccgctttgaccctgacatggagtggaactccttggagggacaggatgtcacgttggcatgttcgtcaatagccgtgaacatcttggtccgcccggggtcgatgccgacatacttgtgtatcttggcatcctatggaggggggtcccgcctgctgatgtgtgtatagggggcccccgtaacagctcccgtctctgggtgacgggagcgcctgtttgagtgtcaaatcacgccttgtcgaggggccctacgccgtcagaggtgtaacgtgacccacaggctctccagaatatggtcgttatggcatcactctaaggtgtcttatctcagatcagctaggattagatggaccagcgcgggagactaggtgccccgggagcatgcgacggaaagcgccccgaaagtcgtatcgcatccggggttcacctttcgtccagcgactcctgtccggacagggaaggtgggaaacaggatgccaaagccgaactgggtgtacgtttcccagacatttccttcatgaagctttaagtttccaaggtacatcggcgaacccatctggttgacaaaacaatcctgctcgggttcgtgcggcaccatggcgtcgcataggcggactcctatactgttcctcacgcttctcgttctgagcctcggtgtgctctcaaaggtaaggtctacggagatttgtgatacaggaggcttgcgctgcacggggaggttagcgggatcatcttccttacagacacggcgcccgcacaccctcgttcactccaccagggcgcgtgcacttccaaggtcttctcactcccggcagtcatgtgagttcggcgagcagacttgggtgtacgtcgtcccggcttccttcatctgcgtgtgcgg

SEQ ID NO: 23220 - DNA, 66 bp, Chlorella protothecoides
ctgggcggactaggcctctcggccggcaagcgttttttccggggtcgaatccttgagcacttcttt

SEQ ID NO: 23221 - DNA, 275 bp, Chlorella protothecoides
aactggagagctcggggcgattcagcctgagggagaaccgcgttgccctggtggacgagtaaatgctcacccgcgcggacttcccattgagggcgcgagaaaaatgcgctcgcaaaacagtggcattttgaattaagcttatgctgcgcttgaccacacgaatggaacaacaactgctcatgatctttatgctgagcgaggtttgagaggcaactacattttcggggaggtgccgaggcccgacggccgactgtggtcttcaggtcaggagggac

SEQ ID NO: 23222 - DNA, 61 bp, Chlorella protothecoides
gggaaaatatctggaccagacgtcacctggatacttcttcccccaagcatacagctgcttg

SEQ ID NO: 23223 - DNA, 79 bp, Chlorella protothecoides
tcaagtgggaggtctgtttgtgatggaaaaaggggaatgggataggtccaggggaatggacacagagtgcaggacgaca

SEQ ID NO: 23224 - DNA, 110 bp, Chlorella protothecoides
aggggaatggacacagagtgcaggacgacagcgaggaagcagggttacgtcgactgcacgatatgtgagcaagcaggacccaagaaaggccggctagataccgtgactcc

SEQ ID NO: 23225 - DNA, 61 bp, Chlorella protothecoides
gtagtcgcaccttgaatgtatgcaatttggtctccaaagtgtgcgtaacggaggctcagga

SEQ ID NO: 23226 - DNA, 100 bp, Chlorella protothecoides
cgtgttccggaacaccctggacttcgacgtcaacctcgttcccaccggcttcacgcccatcgtcggggacgattccgacttcctggaccccgtaccgtcc

SEQ ID NO: 23227 - DNA, 10996 bp, Chlorella protothecoides
  modified_base (672)..(681): a, c, t, g, unknown or other
  modified_base (1374)..(1383): a, c, t, g, unknown or other
  modified_base (2102)..(2111): a, c, t, g, unknown or other
  modified_base (3152)..(3161): a, c, t, g, unknown or other
  modified_base (7049)..(7058): a, c, t, g, unknown or other
  modified_base (7136)..(7334): a, c, t, g, unknown or other
  modified_base (7476)..(7713): a, c, t, g, unknown or other
  modified_base (7801)..(7859): a, c, t, g, unknown or other
  modified_base (7947)..(7956): a, c, t, g, unknown or other
  modified_base (8466)..(8475): a, c, t, g, unknown or other
  modified_base (9060)..(9069): a, c, t, g, unknown or other
  modified_base (9468)..(9477): a, c, t, g, unknown or other
  modified_base (9558)..(9567): a, c, t, g, unknown or other
  modified_base (9642)..(9651): a, c, t, g, unknown or other
gtcacaatcagatgtggctgcaaaagtttcgcttggataccataagccacatttataagcacggtaactttaccagccagagtctcaaactacctgcatggcaatttcttggctgtgtgcgatgccccatgatgtaagagattatttgactcttgtggctgggcattcacacaactgcaagatgtctgctgcgcttaacccgatggccagacagagccaataggcgtggactgtccacaccgcttagttctattggtcaagccggggtgacaccagtgatacacccagcaacttcgtgggatgctatatgcgaggatgatgctgccaacttgatgcatcagtgggcgttgtgctgcgaaaacctcctacatatttgagcataccatagcctccataatcggtgagcgtgcgccgcaattattgttcttacagaaactacgatcgagcttgcatgacattgagggaaaagacagcggtcactttcggatgccaggctttattgatggtgcgactcaccacttcgaccttcccaggatgtgctatatcccgtcacaaaaggacgtggtaatcacacaactactgtagccacttcactcactgacaacgccttgcaaatcataatttgagagttcccaatgtttttggatcagtgtactcgagcacaacaaattnnnnnnnnnnacgactcaccacttcgaccttcccgggctgtgcaacatcccgtcacagaagaacgtggtaattacacaatttctgtagccacttcattcactgacaacgccttgcaaatcacagtttaagagttcccaatgttattggatcagtgtactcgagcacaacaaatttgtaagctcgagagttttgccttttaactatctgcagatattttctcttgagaatcgatcccgagtgactgaatgaatgttctggcccgtcattgcagtgtcactcagtgatgcctgcacccaacggatcgaggtgctgctcgtgctgcgatgtttccctgaagaaaattacctgcctgctcaacaaaaagcctgacaaccaaaactcccaatatctgcgttcacaggttttgaggaaatgtaaagatctcaccggttggctgtgcactcgcacagcatggggtcggtcaatgccgatggggtcccctcgccaccccagagtgccctgcgaggggcgctgttcaccttcgagcgacccagggaaaggctaacagcggcagtgagattattgtccaggaatcttgattgctttgtaacattgaaagcaatttccctggttatagatgagactctcgaggattctttgcgagtttctattatccctacacactcggccggacatacaaaatccgaacactcgccggacggnnnnnnnnnntgagtttctattatccctatacactcggccggacacatacaaaatccgaacactcgccggacgggttcgcgtacctggttgctcggtggagatagagtacggccgggatggatctccaaaagctacacgtgcctggttatgtgagttgttatgttgctggagttgttgtgatgtctctcctcggacaagacggggggcagatgtgctggacatgtcgagggtggaccctggagaaggaaagcctctgaacactcgacaccgaccagacagcccaaaacataaccccgtaacagacaggctaccatccgggcgcacgggatgccatcggctgcacccctgtcagagtgcagctacagcctcgcgccggaccacccgctcccctgcccctcacgctcggtgctgccacgaaacctgttgttgaaccaaatttatggcccttcttgcagacaacaggtatgcgggattggagagggtgggctggtgaccaaatggtagtctcaagtcactccgaagtctgctctccttgccaggtcatcaagagagtgtcagaccgccggcaagcaccatcatactgggagacaagaggtgagccagcacctttgaagtgccaggtgactgtgcacctgccaccccgacttgacaacccagctgtcggaatggggcaaacggctgccaatcagcccttcgttccattttcctctctttgcagacagtccaannnnnnnnnngtgtcggaatggggcaaacggctgccaatcgtcgcttcaatccattttcctctctttgcagacagtccaactattgcacacagtatgctgctgcttatgcacctccactccctggaagcgagaacatccgttcacccctcagaatcaagaacctggacgcagaggacgcgagtctcaaggcaatgtacagtgctgcgcagggccggatcagcaggtacgcctgatagggcagacgaagtgttgcagctgcgctgcactcccacggtatacagctcggtgaccccgagtttgcaccaatgatctctgcagtcagcagctcgagaggatccatgagcatcttcgggagagactaagcggaaagttgggatcccatggcggcaccgcctttaagctacgaaaggtgagaacatggcaaagcatgggacgcagaagtggcattcgcttggtatgccttgttttactgttgtttgtcgatgatgcgctgctttattttccattcatgcagctcttcaaacgatacgacatgcacaagactggttttgcgcaaattgaggagttcaggtgttgtgcgtatgtgttgaacaggaatgggagattgatcaggagggcacgaggcgatgcgacgaaggtggccatgcagtcttgtgggacaaagatggacatttgccacatttgttcattctgaccccctcaccagggttaccatggaggcgtttggtattcagctggacaatgactccctgctagccctttttgccaaggtatgtagaagtctcctttggtgggcttttctgctgcagagatgtgcagctcaggccaacatcaatgcatgcaggactcgaccacctactgaacatttccctgttccacatcaagtgcgcagtatgatccagagtgcaaaggtcgcatcaagtaccatgatctgatgaagaaggtcctggatgccgacgatttcaagaaatacattggaggaagaggggcttgaggagaatttatggtcgacagctctgtgcctggaggtaagccgacaagcatctcccnnnnnnnnnncggaggaagaggggcttgaggagaatctatggtcgacagctctttgcctggaggtaagccgacaagcacctcccgtccggcctttcgtgacgcaagttgtccggcagagacgctgcgcaaatcggatgccctcgaagagtactgcaccccggcaacggttgcatttaactttgtaatgtatgcaaggcatcctgcggaatcggggggggcgccacttcctgaagggtcttgtggaattgaaatgaccaagcccagagcagctcggcacgcctagcatgatcccgcttggtcgttcgactgtcttgcctttgagaaatgttgtgccgagcccgcgaccatcacgcccatgccgatgcgcaccctcactcttgcttattgagttggcagtgaggatccgatgggggatgcgatgccgtaccctgcacccttcgctaggcagctggcaccgggtgctggtgttggtttctctgcaggatggtgctggatcctcgccaggacacatgtgtccctttgggatccgagagactcctcttcggtgttgactcggcgcctgccgatccaagtggatcctcgtcattcgcacgtcaaagtggtacccctgcccacggggctctgcctcctgctcgtgactggaaatggggaggccttactgtacgagtccctgagcaatgaccaggatccctactgtagccagttggaggggagagtgactgcagcggcagccagcaggacagcggctggtggagtcatcgccgccattggcacggacgagggtcaggtccacctcctccgatccttcccaggtagtgcaacgtgccccatggttgtctagggatttaatgcaacgtggatgcactctggtgtgtatttcgactgtcccgcagatcctctctttgaaggtcacatctgcatgatcctctcgcgcacaccattcaggcctcgcaccggtgtggagtcccctgtgccaagcaagagacccctctccaggaccaggcacagcttccccgtccatgctgcagaggctgtcagcacttgtgacgcctggcagggccctggggcagagtcctgtagggcaaagtccctcaggagtctctgacacaccagaagacttggaggaggatggggctgtggtctccctgcacatggaaccagcaggggatcgcatcctcctgctcctcgcacaggactcagctctgcaaggctggctgctggaccccagcacaggttctgatcgactgtggaggatagcattccttgaggtgggctggccaggctggtatgccttttcactttcctgcattcgggggccacaggctgagccgatgctctttgcttgctgagtatgcaagggggctgacctctcctccgtattgccaattttggagatcttgaatcccttgccataacgcaggtccttccctcagctgggaaattcgtggacctggccaccgaccctggcacaggacaggatgggttattggagctgtttgttctctccagcacgggatctctgtcggtcctccgggctccaagcaagcgaggcacactgagcgccaccccagtcgtcactctctctgtaccggcaaacagcgtgcctgtcgccggccggaggggtccatcctgcaagcttctcgcagccctgggcctgtgggcgcctcagcagggagctctgaccctggtgggcatggaaagtgaatcctcctcgccagccgtcaaccactggccccagcgcgtcctggctgtctcctctgaccccttgggtggttggctggtggcaggggaggctggcctgcaccacatcccaccagactggaggtcgacgacggacggacggcctggcacccctggcgccgtgctaaggacaccggctgtagataccagcagagatggacagggcaaccttcttgtcaacagcgagcaggcggtgcttgcccttgtcgacatgatgcaggcagcctgccagggtcacatgtctaccgtggagcttgcttccagagcgagacacatggggtagggtcagaaggtcgcagaggggtgtgatggacctgtcgatgccctgagggaccctcactccacgagctatgaatgacgacatgcccggtttcttctgtgtgcagttcggtacaagccttgggcagagcagccacgacatgctcagaccacatcgcggatgcccttccccgcatcttccagggccttgctgattcaggtgggatgacctctcaatggtatggcatggatccggattctcacccgtgagggcttcaagtcatccttctcggtatcttcaaccagcccctgcatactactctcttcctcgcaggcggtcaagcgctggagtccaagctggcgtctcatggcgtcttcctccagatcctggttgaatctggtctgctggaggccatccctctggctgccagccggtgcgtgatgatcatgagggtgaagatgaatctagcagctgcacacctgcaggacaaggcagtgcatgaggatttggacgacgtctgcccattctcgccgcctccctaccctggcgcagagaggtgctggaggacggtcagcggatagccgctctgctggccctgtacgatgcgctgtctgagatccagcagctgagggaggagggccgggaaccggctcgggcgctggaacaggcagtggagaaggctggcagcgcgtgcctcgcggcccgcagtaccctggctgtggtagtggacgaccgtgagcctcgtacggtgagcgcatgcgcagctggcgaggagcacgcggggtgctttgaggtggacataacctctccgagaggctttgtgattaggcttgctcgaggactgcattaccacaggcatctcctagcctcttagagatgttgggtccccctttgtgcagctcttctttgcctgcccatcgctgtcaagctcggccttcctggatacagtcgtcgagatggtagctgatgcgccgtcgtccttgggcggactggagcttctcgactgggctgggcagctgtctcatgccgtgcaggtccgtcgtggcgattgagtctttgagcgccgtccctggtgctcgatgtggactaagatatttggtataatctctgtttcccaccttttgccatgcttttgacgaggggcccttagccatgcactccattgacatctcatgcctcgccttccccatgcacaaccaggcctcgctggagcgagcctcgcagtatgcgtcgcagcagtctgtgctggtcgggcccattgctgtggccgcagtgtcagctggggaggagccagcgtggactgcaggcccaaaggcattggcggctttgctgagcctcacccgctgtcttcagcagtgagtagagggtgagaggctgggacagcgaatggcttgcatctgcagaatatgggcgtggctggcatttagacgcttcatctgcagctcacagaagggggcaatcacggcgtgcatgtctggctcctggccaagccaggtagtagaggttctccggtaataaatcttgcacaggctgctgcccgccctggcctcatcagggccagccctgacccgctgcctcgagctgcaacttggcacaggagaggcggccctgaacgcagcggcagcggcggtgtcggcggccgaaacacctgtcaatcgtcaatctcgtgccgagcagtatgctgcaagcagggacgaggtcttggacccgccactcctcgccctcactgaactttggcggaagggtaggggcgacatgtggctttgatattgctgattgagtatgaggctggtatggagcacctcgacatccctcgaggaaccgtcaaccactgctgatcacctcgttgcccatgctttgcccccttcaggtgtgcccgagtctcaggccctgctggnnnnnnnnnntccctagccatgcactccaatgacatctcatgcctcgccctccccacgcacaaccaggcctcgctggagcgagcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggctggcattcagactcttcatctgcagctcacagaagggggcaagcacggcgtgcatgtctggctcctggcaaagccaggtagtaaaggttctccggtaataaaccctgcacaggctgctgcccgccctggcctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgaggaaccatcaaccactgctgatcacctcgctgcccatgctatgtccccctccaggtgtgcccgagtctcaggccctgctggnnnnnnnnnnnnnnnnnnnnnnnnnnnnnnnnnnnnnnnnnnnnnnnnnnnnnnnnnnngttctggggcatgtggtgtttagctgacgggattgtgtgccgaccattggtacttgatggttgattggacccaataggcaatagatgnnnnnnnnnncgaggatggaagctgtggctgaggctcataacggctacagccagctctttgcaatctctgagatcattcaagacaggtgaaggggagaattgtggggcatgtggttttagctgacgggattgtgtgccgaccactggtatttgctggttgattggacccaataggcaatagatggagttgaataccaatgaccggctgaaaatcactttgtccttttatgacaggactctgacttgagtatgtctttccgacgtttcccacaaaaatcacccaaacctcaggcaaaggttgtatgacttcatggaccgtctccaagatagcataacaggggagagcatggcagagtttgcgttccagaagtgagctctcggcagtgtcatggtgggatgcaaggctagcattgcgtgtcaccaggtgcatcgcatgtgcaggtctctgggagtcctgtggcttccctcaccccatcccatgaatgcatacctgcaggttcttggaccttgaccggccagnnnnnnnnnncagagtcctgtggcttccctcacccatcccatgaatgcatgcctgcaggttcttggaccttgaccggccagctgaactccttgatcttcctggagcgtttgatgagaggcttgcggcttggctgtccctcgccggagctccagacgcagccaagcgactccagctccagtgagtgtgctcattgctagcatttgcttgaggagcatgtgtatgaacatctgcgtaccattgcaataccctagaaaccaatgaggcagccgcagctgtcctgacgagcgcccgagtcatccctctgtttgcaggtggcttcaccatgtgcacacacggtcataccctcaggcagctgaaagtgcaggggctctggctgccgcagaaaaacacacggcctccgacatgctccacttgctggccatccggcgcctggctaatcttgcagggacgccgagctggcccatcagtgctggggccgacacagaggaggtctttgcagatacagaccgcaaggcagcgctcgtccacaaatgggtgcgctggtagtcaaggtgtactccctatctgaccagtgatgctcctctctctgcaacnnnnnnnnnnttttggagatacagaccgcaaggctgcgctcgtccacgaatgggtgcgttggtagttaaggtgtactccctttctgaccagtgatgctcctctctctgcaacctgcggcagactatctttcgcatagtaagcgcttactattggtgcaaatcctttccaagaccgggcgcaacaccggttcccgttcctcaccatgcagatgcggtgtggctttgaggacaccccgctcagtttgaatgggagggacatcctgacgacgctcctggcaaaggggggagtcgaggcctgttcagctggcgtcgaggcgttttctctctttgaccccgccgagcaggaagagaacaggcgtgtagggagtctcttgccggcaggacgttgttgacaaggttggtgcatgannnnnnnnnngaaccccgccgagcaggaagagaacaggcatgtagggagtctcttgtcgacaggacgttgttgacaaggttggtgcatgannnnnnnnnncgtcgcagcacagagaggccctcgcctcccagcccctctgtgctgtcgcggacgctgctttcagcagcgctactnnnnnnnnnncagctcagaatcggattccttgctcactccatgcccctcttgtcactctccaggcccctggcactcgaggcctggaaacagattgcactgtcctctgactgggaatctcttgcccgggactgctccacagcccagggcaagtcgcagcacagagaggctctcgcctcccagcccctctgcgccgtcgcggacgctgctttcagcagcgctactgcgggtgtggatcgttcccaggtagattgtggtgcatgtgcgggggagagaagggggaagggaggtgggcaggggttgggggggcacataccagtcgtgcctgagaacgggagttttgtgacagtgatggtaacgagaaggccgtcgcacactccttgcaggtggaagaggctctgcagcaggccgctgcagacctctcggatccggcacgggcatgcatgctgtatgcattctccatggctgcgcaggggtgagcctctcttgtatgaggttgtgggaacgagcacggctaggcatgtagcttctggctgaataattaagtcaccacttgatggttgccatgaggaagactcagtgttgctttgcagatgggtgatcaggcaggctgaagggggatacagtggcaaggaaatgaggggcctggttcacctgcgctgcctgagtcacggcaaagactgtggctcggcgcagtcctgtaatcagtggcattagatggatgcagggatggtgaatgcctgagttcctacttgggtgtggtcccctgttattggggcccacttggatctcgatgtacagtggagcggaagcattgcactggtatgaatgccacttgtaccaaggtacttgaaggcagctgggcccaacggttggaagaagaaacgtgaaatgggaactagttgtaggggaatggggcagagacacacagttcgtagcacataacacaatgggtataggtagggttggcctgtcaagcagcttcggggtcgattggatgaagtttcacggttgcagacctttctgatgtggtcaaggagcacagggtgttgcaggtgttgggcaccaatgcatgtatagggtgattgcactgaggatggcactcaggaccccagcagggcttcaagaaacacaggctgatggatgcgctctgtagcgcctcgcggctgcttggtgaaatgatgcagctccgcaaagtggcggcgcgggagacacacaatgctgacacgggactcgtccatcatccctgtggagcccctgcagcagccactcgcatccaggagcgatcctcttgcccacattctcctctccaaaaaagcgaggctggaccagttcccgaatccaataaggaggtcat

SEQ ID NO: 23228 - DNA, 63 bp, Chlorella protothecoides
caccctgttcgttcagaagtcgcccctgggtacctggccgagaagctcccagaatctgccccc

SEQ ID NO: 23229 - DNA, 117 bp, Chlorella protothecoides
gcatcaaaggcaccctcaacaggtttaagagtgcatacagatggattcgtatattgtggatggtacctatgcccttgctatcgtaagaaatgtcgccagcagtgctctgggcgcgag

SEQ ID NO: 23230 - DNA, 109 bp, Chlorella protothecoides
catattgagagcggtgcacggacactgaatccctcgcttgtctgctcagtttctggcttgtccaccttcacaataagttaaaaccgcatgcttgcatctctccccacct

SEQ ID NO: 23231 - DNA, 75 bp, Chlorella protothecoides
gaagaaggacgcgtcttccacctcgatgcctggccggtccagtttctccacatgctcgatgcggtcttcggacat

SEQ ID NO: 23232 - DNA, 78 bp, Chlorella protothecoides
ggccagcccggccaggggatcttcgcgactgaagcatggggaagggaaggaagggagtgggagattcaggggcaattt

SEQ ID NO: 23233 - DNA, 61 bp, Chlorella protothecoides
catggagcagagcacgagcgttggggtgtgaaggcggatcccttgtgcaatgtaattacaa

SEQ ID NO: 23234 - DNA, 61 bp, Chlorella protothecoides
ccagccccggccgccgcgcccgaccagccggccccagcctcggtcaccgacagcggcgcag

SEQ ID NO: 23235 - DNA, 79 bp, Chlorella protothecoides
gacgtgagcgattgcccgcgttctttaattttgacaaaaatatgtattatcgacttacacaagttgcagcaattttcat

SEQ ID NO: 23236 - DNA, 86 bp, Chlorella protothecoides
agcccggtcacatacaagatatgagcagggctatatactacgaaaggagctctcctcccatggttcgttcataccatccagaacac

SEQ ID NO: 23237 - DNA, 37958 bp, Chlorella protothecoides
  modified_base (1303)..(1370): a, c, t, g, unknown or other
ggggggggcttggagtggggtctgggggtgggaaaccagaaatctgacccagcctgccctcgtgctggagctccgcacacacctccgtggccacctcccccaccccaaacaccccgactccagggtccctcccccgacgaggtggcgctggtggaggccgcgcgccagctgggcttcgagttcgtcagccgctcccagacggggctggtgctgagcatgctgggggaggaggtggagtacgaggtgctcaacatcctggagtactcctccgaccgcgggtgcatgagcgtgatcgcgcgcgcccccgacggcaccatccgcctgttctgcaagggctccgacgccaaggtcatgaggaaggtgcgccccggcaccgaccccgtcctgctccggcagaccgacgagaacctgcacacctttgcgcgccaggtggggttctggcggggcgctcgattcccgagcgccggggctcgaggggtggtggaatgtggcgatggggataggcccgggggggggggtaatacctgggtgcctgaacctggggcatcgagctgcagagggggcgcggcgtccagaccgcagctggcaccccggcccctcggcacacgaccgcggggccggggcgccagttcctcgacccctcctgctggccccgcagcgggtcgctcctcggctcgcctgggcgcgccaccgccccccctgcgcgcctgaacactccccactcgacagacccctgctcgcacccctccagggcctgcggaccctggtgctggggacgcgcatcctggaggagcagtggcatgccgcctgggacgcgcgctaccaggaagctgccagcagctttgaggaccgggacgggaagctggacgccctgggggatgaggtggagagggagctggagctcgtgggggtcaccgccatcgaggacaaactgcaggtggggctgggaggaggccgcagcgtgctcggcccgtcggtggcggcgccccagagaggcgcgggtgcaagggatcgccggtcgtgtatggggcaaggatgcctgtgcgctgtggggtcagcgtggagctgcccgtgctccctggcctcaccccccgggcccttcacccgttgggggccagcacccaccacccccactccctgtgttcaggatggggtgccggccgccatcaagaccctgctgacggcaggcatccgggtgtggatgatcaccggggacaagatggagaccgcggtgaacatcgcggtctcctgccagctcgtcaaggaccccgacagcatcatgatgctggtcgtggatgagaannnnnnnnnnnnnnnnnnnnnnnnnnnnnnnnnnnnnnnnnnnnnnnnnnnnnnnnnnnnnnnnnnnnttgtgtctgggtgtggtgtgcagggaggggatgtgtcctggcaggccaaccccccggcgtcgcagatcctgtcgtccctgagaatcgcgagcctcgcgaggcacaatctcttccaggaccctcccctgcggatgccaccccacgccgtgacgactccccaccccgccagcaatcaaccctgcatgaacccctgcagacccggccacagaggcggaccgcctgctggactcgtgcatgaagcgcacgctggagacatacgcgcggagcagcggggagcgtgtggccaccctggaccaggtcccgcactcctggcaggctgaggagatggcggtggacgggcacacgctgaactacatcctggtggacgaggcgctgtcgagcaagctggcgctgctggccgcgcactgcagcggcgtggtggtgtcgcgctcctcgccctcccagaaggcgggcgtggtgcggctgatgaccgcctacgagatggagcgggtgacggggacccggcgcgggctgcgccgctggtacgcgcggtacaagcgtcggctgtcgggcaagatgctgagcatcggagacggggccaacgacgtcgccatgctgcagaccgccgacgtgggcgtgggcatcatgggcaaggaggggcgccaggccaccaacaactccgactatgccatcacccagttcaggtgctcgccgggagggggacggggagggtcgtctcgaggggtgtggggggggcccgggctgatgatcgagttttcgcctttgcagggctgttggtcggggcggggcttctggcgcagaggaatgggtggggctgggaggcgcagacgttgtgcaggggattggcatggtttgtgtgtgagcatccatgcacgtgcatgtcactcggcagtggaggctgggattgaaggctaatgaaggagtgcctgatgggccagatgcctctgcatcctgttgccctgtcaaccgcgcacgccctcccgtgtcatgctgcagccatcccagcccacctgccggcgcacccattcaggacccccccctttcttcctcagattcctggtgccgctgctgctggtgcacggcaacctgtcctactaccgcattgcgcgcctgatcaagtactcgttctacaaaaacatcacctttgcctttgtgctcttctactaccagttctacaacggtttctcgggtgagcagagcggggtgtcgggtgggtggtggagggggtggggagcccagtgccctgcatcgcgatgctgcagcgtggagggtcgcagcctgtcccccccttgcgttacttcaccaccaaggcccccctccccccgaggctcttccgaggacgacgcactccctcgacacctgcgccccccaatcagtcgccatcacactcccccccatcacccccttcccccacctcgcaggccaggcgctggtggactccatcacggcggcggtgttcaacgtggtcttcacctccgtccccatcctgctcttcgcggtgctggaccgccccgtggcggacctgaagacctacatccactacccgcgcctgtacgacaagtcggaactgcacacgctgaccaccgccagcttctggaagacgggcgtggcccaggccgtggtccacgccgccgtctgcttcttcatcccctactacagcatcgccaccagtgggcgccacaacatcaccgacgtctacagcctgggcaagctggcattcgtcgcgctcctgggaaccgtgaacctggaggtggcgctggtggcgcgctactggaccgtgctctttgccgtcttcgtcgcgctgtcctacttcctggtctacccctacatggccatcttccccctcatccagctgggcctgaacatctatgaccctgccaacgtgggcgtgtcggagaacgtgctggccagccccaccttctggttcgtcatcatcatctgcaacctgaccacctttgggctgcgcttcgcggaacgcaccgccgactggtccttcaagccccaggatactatgatcatggccgagcacgaggaggaggcgcgcaagcagggcaaggtgagtgggtgtggatgtggggtgggggggggccgtcggtgaagaaggagaggagccgggaaggatggtgtataatggcgggggtgaaggtggcaagggagacggaaggcatcgacgatggagtgctgccgaggcctttgccagcttgcgcctgggtcggtgcaggccgcaccattcaacgagcatgccagagtcgcaggcgccaccaggaggcctccgggggtgcacgcaatcctccactgccgccatctgttcgtcaacacgctccctaccgacccagccccccacccctcccacgagcagaagtggctgcagcagaacgtgagcgcggagtcgcgcctgcggctcagttccctgggcatcgagatcccggaagaggaggaggacacgctgcgcgcccgacactccccgccgaggccgacggcgcccggcgcggcacaacccggactgcccccggcatgatgcaacctcccctgccttggccccagggtgagggtccttggtatacccatacagcactctggaagctttcttgaaggatataaatgggaagggagggggggggcaagggcggttagggcatatctgacagtcagctaaagagctcaggcagggcccaagggtacatgcatcaggcgcccttcaggcgcttggcggcgggggcgtcgctttgtgggcctgcatccggcacgcccacgggtgcgccggggtctgtcgcctccaggtctgccagggggaggcgctggtgcagggacgaggggtctgagagaagggtgacgccctcccccgcgtccgccgacagctcggcctggtgcgccttgcccacgacgtgcacgctgagctggcgcagcgtcgacgcactgggcgctatgcactcctcataaaaggcctttgaggggggtgaaggggattgcaggttcctcgggagtgataatacaatcgacacgtggatctgatggatgggcagggggcttatcttccagaccacttccatggcccctacaaggccgtgcatctggacgatccacaggccctctctctatgcgcacactccagcggcccgattggctggccagcccacctcccgcacggctcatcccctgcccccacaccttgacttctggaagggtgagctgctggagcacctccacctctcgagcccgagcgtcaaagtcgtacttttggctggtcaccgcctcccacatcccatcggcctcctccaccatgctccggtgctgcgccatgaggaacgtgtgaacgagatggggcacagcacgatgcacgcccctgcgtgtccctggtaggtaccacgtgtgtctccttctgcagcatgccatcggcttgcaaggcaaactgctggagcgcctcgcccgagcgatcaccgcacactcgcctccccaacacacacacacaccttgagcatctttgcgctgatgaccgcggcccggtggttctcgaactcctcctcgggcatgccccgcagcgtggagacaaagccggccaagaactctaggatgcgagactccaggtaggccggcccgtgcacacctggcggtgccggcaatggagggggcgaatggtggggaatgggataatgtcgccctgaggcgccgcgcatcgggctgcaaatgcgtaccaaggcccctattcttctgttgtccccaggctctttctcaggctgggagtgtcatgaaccccgatgcctcgccgacctcccccttccccccacagcctccccacctcccaagaagacccatcatgacccccttccccccggtacctgacacgaccaccacggcaaagccaagcagaccgtgggtcaggcgcatgccggagtgcacgctgtagcccagctgctccttggtgcgcagcgtgtcgtagcatggctcccccaccagctgctccaccaggtcgatgagagcgcgggcgcggaccccgtcccgccccgcctggcggtacacctccgccacgctgttctcctcctcgccgttgcgcacgccggcgcgatggagcagaggaccgccggcgggcaactccacggcgcgctccaggggccgcgccgaggccggcgtcgcgcagggtcccagcacgctgcgcacgctgcgtgccaagtccagcgtggcacgggggggaacgttgccgtgcacaagggcctccaggtggcaggtgtgggacgcgtcgcccagcagggaggaaaggaaggcccgcacgtcggccagggttgttgcgtccagctcctgaggtgagggtgatgggaagacagtgggatgatgattcactcaacgctgcttgatgtggctgagggtaagaccatcacagtctgcctcagaccaaggaatggacccccgatccgacttgtagcctcaagtgcaagacatatgtcgctgttcccatcctgctcgggctcttctggcccatgacattctctgtccaatactgggcccccgctaattttcccaacacaactcagcactccctcacggaagaccttgaggatgtcagaggcctgccacatgctctccttcagtgacagcaggcgcagataggtggcatgcttgtgaggcttcatgttcatgttgcggtactgcattcagcaatggggtggagcggagatgagacaccgagacagacaaggattggcaagggctggcaggtgtgtcttggtttgctgccacgctgccttgtagagagccctctggcggcatgcattttcatgtagtgcataggtacccagatgacaaggtcacgaaaccgggcagcaatgtcttggtgtacctaaagagcacagcatggatgccaggaaccccacaccagagcagtacctttagctgcagcccctccagaactctggcgaacacttcctctgtgacatccagctccctgagcgtgccaaacaccgcatccacaagggccggcagccgatggctaaatccctccaccttgatgtcgatgcctgtttgaggtgggagggggggccgtcgtgctttctatcctgggggacccagccgcaagctgctttgctggacgttggagaggctccagggtgagagtcatggtattctcgcccaggctgaacagacccacctgccagcctcatacagaagcccttgatacagtgcaaacagcctcacctgctcgcccctcaaaccaggtgttgcagttgaggcctgccacctcagcgaggtagctggtctcgcacagcctgtcctccagaagcttcagcaggagatgggcccgggctgcagatgccggcgtatcatacagggccggggaggaaagccggaaatgggctgtcgtgcgtggcagcctgaacgtcgagtccgtcttgctccacagcctaaaggagggagaacggggcgggttgcggcagccaatgcatgctcgcattctggcaccgtgcacgcacagcctgctgctcctacacaatgcaacctcactgcttgcaggccttggtcagggggatggacatgctcgaggttgctcgtcacccctagaaatcctccacacacctcaggccaggctcgtccaccaacagagcgggtggagcagggaaggggccctcctcggcgggcaacttggcctcctcacagcacagggagaagtcggtaggaacaaagtggttgggaggggggaggctcatgtcctctgttgcgcgggccccctgccacctgggatacaatgcaggggtaagggtgagggactcttatcaaatccacagccctggtgtgagacagacctaatgctgtgcataggtttacaacgctgctccagcatgctcaatttaagctacatataccaacaacatgagagctcgcaagcacccccccgccgcatgaggcgctctgtgccaccctcttacctctcaaggaggtctccagggatgacggcttcaacatactggaaatcaaaccagggttcgacgccctgcttcatgtctgggatctctgcacattgaggcgtggtgggttttgggtatcaacatccagatttggtgcgacgcttgctgaagtcgccgcaaccttcccgaggagcatccccggggcaggagtcttcctcattacaaaccgccaccatgcttgcaccacttcagccggacaagctgcatgctggtctcaccgcttgccagggccttgcacacttcttcatacttggaggtctggatgtcaatcctcactgtctgcggggtcatgctgtccagcagggatgcaatctgcaggtttgaaatgatgtgtgctcaggtatcagcttcattgcaagctgcggtggactcccagtgagcacatttggcacatagaagcgctgaccttgatgggaggggagtcatccacctaggctccccggcaccatcgctcctggcctattccctccaaccgtgcgcctcagcctgattccctcctcaccagcttctcgtcccagagctcgtggacgtagtccccgaccagggtgtgctccggtgggtagcgatgcatgtccattgacagatttgtcacaaggttgctcacgtcatcctcctcctggaacctggaaggggttcaaggttgcaggcgcagagggccttgactagcagccttacaggggaacggcaatgcctctgcagcacatgcctatcaagctgaaataccacctgggaggtcatgcatggatccgtgatgcagccctccagcaccccctcacctgaacttcatggctgcgacattggccatctcctcccacgcccacttctggggcccgctctttctcagcagctccaggtatgcaaacaccagctcgacgcaggccagaccggcgcctggggcaacggtggagggcaattgtgtgtagcagggcgtgaatggcagagctgtcgcatgacggtgtgctcccgaggtgggaggatgctcagccactagtccggagtgctagtgcttacaagggcatcctgaccctgtttccatcctccatgtacctgatccgtgcgccagccctgcctcagtgagggagatgacaatgtcaaagagataaaatgcggtgctctgctcggtgacgccgccagacagctccgaagcccagccccggctcttgagggctgacagcagtgaccccctcccttcatggccgatgaggtgggacaggtagtcgtcagccttcttcctgtgtaaggaggggtgctcgtgttgttaagagaaggagggctctctacatcgtggcccagaggcacaatttgcacagctgggactttctgatggtgatgctttgggggatacaggcctttgatcattgacacactgtcagcatagtccatgcataatgttaggcatgctgcggaccatgcatgcaacacacctctgatcttaaatgcagcctgagcagtgcccccaaagcaaacctcattgctttctgaggcatcaacggctaatccccctcatagtcgcactcacctgtactcggcatgcaggcatgggagctggaaggtgagctgcaggtgatgcgcctgccgtactgcctgaaggcagtagagtctgccgccctgtagggtagatgatgcaggggatggtgttgtcatcgaggccgaggatgcacctagatgcacaattctgtggctggccgcagataacgtcccatggcgagagcaaagcctctccttcctttcctcctcccccccactgacaaaagagagacaaaacctgcacaacagtcacctgaaatgggaaccccgcctccgcatagctgggccggggccctcttccccccggcacccctctgaactcatccctgacccaggcctccagctcatccagggtctccccgcccaggagtaccaggttcatgcgctccgcgctgtactgctgcgtgtagtgccgcaccagcccgcccctgacgtccacccccgccgccgccggctcctgcgccaggctcctcctgttcccccagccaaacttggagagctcgtggccggggcgcgcggtgtgcgcccgcagctgctgcgccctgcaaccgtcgctctgggccacgccggtgaactcgttgtccaccgcctggacctcccgctccagcgcatccgccttgatcaggggggccacaaagaactgggagaagcgctgcagcgcaccctgcagcgcggagggcttgcagtcgaagtagaacgtggtggcctcctggggagaggaggggacattgggtggggacaggcatggaggggaagaagcatggaggggagagggacggtagcgctgggtttagggggagatgaagggaatgtaggaggaaggtgatgcgaaaggtgggggaaaacagatgctgccagcgatgctacggcttgagcagtccttagctcggcaacatttaaacccatagccagatgccagtcccatcaccctttccgtcttccatctcacgttttcggtgcatgcgttggaggcgccgccgtgagcggtgaggaacgaatcaaagtcattctcgtccgggaatttctcgctgcccatgaacagcatgtgctccaggtaatggctcagcccctggagggagagcaaggaatggggtcgagggacctaacacggggcattttgtgtgtttgtttgtgtgtgtgcctgctggtactctatggcatttgcctggtaagcgatgcagtcagcgcacctgctgtgtctccagcgcacccgaacacagattccaggacacccgaggcgctcagcgcaatgcatgaccttggcctcctcttcactcgatctaccacactaaatcagacacactcacatacctgcagctcccaagggtccgagaagctgccgatgcccacactgagcgccgctgccgccttcttgacaccgccggccggtgcctctgcctcaatgtccccctccccctcagcgtcagatccctgcattataatgagacgatcggcttgtgcgtatacgtattgtacggcgttgcacaggccgcaggggacgaggtcatcaatccaacacccagcacaccaccacacacccagctaccggcagtactcacctcactctccgagcccgactcgctgctggagcccgagtgagacaccggctccgcttcctcagcatcctcctgagtagtatctactatctcaccgtcgtggatgagcaatgcacgcaagccattgtccaaaacaatgtatcggtaatccttcttgtcggcgggcgacttgataactgcgaccatggccctcccgagcctgcgcagttgtgaggtgatacttgagaatatgggatatatctgtgagtgtccggatgatctcctagccattggtctgcagcgtgatcactgtgacaaaatgtcgtgctcgcgcctgcgcccccggctcagcttcacttcagctaaccctgcctgccttgatggacgcccggcgtgtgaatacagacatactgcaagcattgtgtccatggatgtcaaaacagaccacagtaagggccagcattatttttgcaagaagcatcaatgggatggtcttcgccagcctttgatcatctgtcaaacaagctcggcaatccaagtgcggggagctcaactgttgaccgtcttgacagcaaatgcgatgatgcctgcagagatttgtgcatttgatgtatgaggtcctggatggcatattatggatgcaccatgtggctgctatcacaggtgcacagcatatggaccatggtgtgaaggaggggggggccccctttcaaagttgacctcaacctaccagcggcaatggccaggaaagacaggccttcagcagcaccgactagtccgtaagggccagcagggagcccagatccactggagatcttagtcttcacagaccatgccaccatggccgtcacgaccaggtagctcaggccctctggcaagacagggttgggggagtggtggagagtggtgagatcgttgctgtggaagcgtcggatcatgtacaggatgcacttttgaaatgccaatatgtgatagttgcatgcttgctggacagagtcctgtcaacccgtacctgcagcaccaaggacaccactgggtcctggtgggaggcctgaccctgtcgtcgccagtgtgtacgagctccataggaccagaggtgcagcaaagacccctgccacgcccgcagcaagctgcaatttggagtcggttcctcctcccagctcggcgcgtgctccgacatgacgttgacgcggagtgggatgggtgatgcctgtggtggtgggtgcagcatgagcgagaggggaatgatcagagagctctaaacttcacgccctgccccatcatgcgaatgaaatcgtgtccatgcccagcatccgaccatggaacggacctaggctgcgaatgccacctctgctgggaaggcggagagtggcatgaagcactgagaaaccaggtcgagtactggccgaggatgcgattcggaggctcatggtggggtggatcacaagccgccaagaccaagtaatgaaatggatatttagtgaatgttgttcaggctcattgattcctgttggcaccgaaacccacgctgcatgatccgcaaggcaaggtgggtctcagggaggacggaacagatttcggggaagcatgctggccaggtgatgatagcatgctggcgcgccattcctccctcgcagaggtaaacttttgcatcgtcaccttcaatacatgctgtcttcaaatcaaatgcaagggcattcacagcagtgctcttgtgtagattggcggtcaagaggttggggctggagcagggattcctcactggcagctgccaggccccaggggtgcagcggggatgcccagcctgagcagccagcatcggaactgtgcgaggcgcggccccgccgcagccagactggtgatcgtccccggggaccagagccgttctgcgacggccgcggcggccggccagcccctctgcagcgcgttggtgtcgtcgatgaactcaccccacaggcaggcctcgccgcccagcactagatcgcgctgcacgggggggagggagcagggcaggtggggaaggctgggcgcggggtgttcctgccattgtccctggggaaggaggggcggtaaaaggcctggccgggatttggtggctcctggctgccgcgtgagtgcgccgccacgccggcgccacaccagcttccctgggtgccctcggccagccacaggtctcccagccctcacctgggtggagttccttgccgggaacgccgtggggtctgctgcgtagtaccgtttccagtcctcctccgcaaacgtccccagattcaggtaccagggggcggagaggagggcgccgtgccccgcagcggtcacggcgctcagcttggcggcccagacgcgggggtcttcgggtcctggggacgccaggccgggccccagcggcatgctccgagtggtcgtggcctctgctgcccaccctgggccttcccacgccatgcgccccgccatcaggcgccgggccgaggcgagggccgccgcgccttgctcccgctccctgccctccccccaccacttccagacgtgcaccagggtcttggggtccaggcccgcgcctgccctgccaaaggcctcctcccaaaccacgggcaccctgcccagcgcgagggccaggccctgcatgcgcaggagccagcgctgttccagggcagctgagtcgtgggcgatgccgtgatccctcatccaagcagtgatgtttgggttgctctgcgcaggcgtggggcgtgggtgagaaagagttcgtgttggagcgaaagccgtgcccaggtgtgtttcgggcacgttcctggcatgatgagggccgcggaccagaaggtcgaaggcgaatcaaactcttacaacccagactcctccctcttccatctgaaaggacacgctcaggcactgacctcccagcaggaggggtccacctcgtcccctcccaggtgcagagcgctgtcggggaagatgcgggcagcctcacgcagcagacgccacatcagcccgtaggcctctgggcgggtggggtcgatggggccccacctgccttccagccgccgtccatcgtcgccatagcacgctgccagcaggcctgggaaggccttgccccatgacagggtgtggccaggcgtatcaaactccggcaggacacgaatgccacgctggcgagcgtaggccacgatctctacgacgtcccccaggctgtacacctcagactgcgggggggggagggcggggggaaggcatggtgctcatccgtatccaattgcagactgatgccttcgcagcagttgagccttctttcagagagcgtgctgcttgccttacagaagccgtgcagcagttaccatcgccaatgctccctcgtaaagaagccccaccttgctgaaagctccctgcgcgggcagctctgggagggcctcggagccatagccaaaggactggtcatccacgaggtgccagtgcagcacattcagcttggaggcagacatcgcgtccaagtgtgcctggcaggaaagggcgacgtgaggatgcacagcagtggagtgattcaacctcaccgaatgtcccacaacccaacatggagaccgtacgaccgcaggcgaagtcgagcacacaggctgcagaacatccgcactgagactgcagcatgctggcaacaagcccctggtctcttctcagtcccgctgctcccccactgcaacagcacaccttgatggtgtccatcgacaggaagtgacgcgcggtatcaatgagcaggccgcggtgtgggaagcgcggtgcatcgtgtatcaccgtctcctgcacacccaagatcaggggagttcggcgccggtgtcgtttccgactgtgatggcgatggccgttcgggacgtcagcctctccctcttgctcaggcccctcgctgctggcctcagcgccacacagtccgtcgcagggtctccggcgcaccagctgggccaggctttccaggccatgcagggcgccatacaccgagacggcgtgcagcttgatggctggcgcagccacggccaggctgtaggaatcgttggtggctggacccagggactgatccggcaggtacacggtgacgtgcaccgccgtgatttgaagggcacgatggtgatgacggcggcggcgatggtgatggtggccaacctcatcaggcaaaggacccgagcctgatgtggcggacaaaccccctccagcagccgttgcattgccaatagaatcgtctgactgggtacctggatgctcctgcggcggctgctcgggcgcaaggcgcaggtgttggatgaatctggagtgtgggaccacagatgcatggaggttgaaggtgggccgccggggtacagcatcttgcattagcacaagggcatgccagtcttgtggtcgacattgctctgtgtctggaggagtatatcaccatgtttctcccggcaaggcactcatccattgcctccaagtcactgctacctgtcgagcccatgctgcaggatgtcagagtctgcacccttgatttcgagggacaatcgagaggcgtccaaccaaaattggcgatttccattgatctagaagtggaagcgaaagggaaagggtgtgctgccgtcagcagggttcccagggaacatcaaggccccccccttcatcggatcaagtaaccacctttcttcacctgacgctcaggttgaggccagatactggcatctaaagcaatgcatgaggttgcgagccccaggagggccaaccccgcccgcatcatgttgtgggtcgctaccatggcgtgggtgcttcgaaccgcccaagaaaggagtcaactacccggcgcggcctagccccggcaacccatttttaatatatctcaaggcatcagctggagcgaggggggaatcgtccagtgagatcaccccttcatgtagtgcaggacgagcgatctcccgcattttgcggtgggaatatgcgggcggtgctgcggaaggaagtcaagaaaaatctatgtgactcggcgtcctggatccgctctcctccccagggcccccaaaatcacaccattgccctctttcccaccccagcaatggccctgcgactgcagaggatcgtttctagcgcttgaagtcgtcggggttgaaggctcgagcccctccacgtcgcgatcccggcgatcaggcgcgcgggtaggcagaccccaaatgaagtgacaacttcgcacggcgcccccccctaccctggtaggtgtcgaacagtctgcagagacatcatcttggctctgactctgtgaatgggatgggaaacctcctgtgcggcagcccgcatcggacgtgggtgacggggaggagggcattgtgccgaactgccctgctccggtgggcagccgtctgatcgccgctcgcgacctgttttgcccccctcggctcttcagcgctctgaattgagaagccttcatactcgtcgcaggcgcttgtgcagtggttcgggagcggcccggcggcatgcgggtaggtggcttggaggcaggggggaagcatggggctagggcatgggctggctgctgggggacccgatgcgccccgccaaccctcgccccgagtcccagcacgatgcacaccatttcatgcactcctgcaggacgatgcggctcaggaagtgattgcgaatggggttgctcaggccaccatgcggcggagcaggcgggtcaccgccagctcctacaaatcgacctcctcgtcgagcaccctgccccccggtgagcgtgcaggggttggcaagacatctgggtgttcaagaggctggcattccacattgcagtagcctcgggcgtcggggttggcagcctggtatattctcgcatgggacagggaatgacccccccgaccaccaccctctcgatcactcccacctcgcaccacccttctatccaccctccgagctgtgccctgcgctcctgcccctcaaaggctccctcctcttcaacaataagccttcctgcaatccctccctccgccatgccccccgcagccaccactgcccgacatgactccagcctaggcctgctgacgcgacgcttcctgagcctgctgaatgaggcggaggacgggagtctggacctgaaccaggcctccgacatcctgcgcgtgcagaagcgccgcatctacgacatcaccaacgtgctggagggcgtgggcctgttggagaagcaggccaagaaccacgtgcgctactgctccgggccggagacaccctgtgcgcaccgcgaggcgggccgcgccgcggcctcgcgcggcggcggcggcggcgccgagggcgaggcggccgcgctgctggcggaaatcgcggaggagacggcggcggtgtgggacgcgatgcgcgagatgagcgcgcacgcgctgaacaagcagcgcctgtacgtctgggaccgggacgtgatgggcctgccaggcgtggcgcgggaagaccgcgtgttcgtggtgctggcaccacacgggaccaccctggaccactcgccctgccaggagccagggccgggcgaggccgcgccgccccacaggtcagtgggttgggtgggggtggggacgggggctgagcgggaacggcatgtgtatgtgtggggggttattgaaggggaacggcatgtgtatgtgtgggggggtattgaaggggaacggcatgtgtatgtgtggggggtatttgaaggggaacgatgtgtacgtggggaattggggcaggggaggccccgaatcgccctccctgtgaggaacaggggtggcgcatgcctgtggccggctgcgagacgggctcttttgtgtcacagcaccgtcatacgcagggcacgctgccgcgtactttgtcccagtgccgcccaaacactccgtgtcaccgcttcgtcgcaactcctcctccttccttgtttgccccgcccacctgcccgaccatgccgccccctccccacaggatcatggtgcggagccagaaggagcccatctccattgtcaccctccccgtggcgcgccaggccctgcagcctgggtggggcctgggccccgcccagcagccgccgccgaccagcctggcgaccccgggctggccggggtcgtccttcctcatgccccgggcaggcctcgcgctccgtgaggcgcaggccggctccgtggccgacgcctggtaccgcgccgtcgccgccaacggcgccggcccgaccgccggcgacgggctgcccctgggcagcgagctggaccctggggaggggggcggcctgcttcccggacagcacagcctcccgggcggggcgcctgcgcacccacaggcctttttggcgcgcagcagcgcgcatgagggcggtccatgagaccagggtcggaccgccagccctcgcaggtgccggtcacacaagcatgtcactcggggaaggctgcagtcccggccgtctctggggcccaggctcctcacgggacagggcagctccgtgcccctgcgcgcatggtgctccgaccagcgtccatgcgtgagactcgcaaccccagcagcacaggcttttgttcaatgtttcctccctgacaccgacgcatcacagcaggcctccctgcgggccctccgtgggaaacgtggatgtggggggcccccactctgttctcaggatattcggcatttttcatgctcagcgaatccactggccctttccagggtccagctatttaggagattgagcacctcccgaaatacttttcccctgtttcagctccatcccacactaagctccgcccgtcctgatgtgaccacgtcccatggtctggcttctcagcctgtttgcgtcctgaagctcttcggaggtttgctcccttccctgttgatcagctatttattgccagttcgatcgtgcacatgttcaccgtcatttgaggattaaatggaatgccgcccgagcagccggagggtcagtgtgtgagtgcgatgagtacgagggcggccactgccaggccgccagacttgaaaaaggcgtcaccggtccagacgtcggtcagtccatgctctgcggcatggatgctgctgcgccggcgcgccggcgcatgcacttggctgcagtagtaggggaggagaattgggggttgtgaaatagtcatcagagactcccttatgccactggccatcacaccattgacctcctccaactatgagaacatcggcacttcaagacgaaaatcattttgctgattaccatgctcctgtccaacccagtgcacctgggaagagtgaaggggtcgggatgcatctccaggtcgtctggccttcccctgccctctttgaagctggagaatccggacctggactccatcgctcgcaagcgcacgggtcccggcgcagaagtgccacggtttccatcatgcctcagagaggttggtcgggcgtgtgtgaggtgcacgcgatgcgctatgccaccgagggactgcatggcgcgtggtcagggataccggcagcagcaagggaaagcttcactctgcaagctttccgtcgcgacacagatattgtgcaggttaatggctacttcctcgtgcccataccctcttgatacgtgtgaagcaagaacgacgtgcgcacgtctggcgtcgggcagtcatgtctccaaatctaagaagatcggactcccggatctggttttgcggagagggcactcccggggctcctagcacgattttcagccgagagatcaatgaagtgaagtggaagtcttgtcctgcatgcactcaagatcgtcgcatgttcttatccaagcatcaggcactctatttcttcgcgacatcgatatgtattggccgatctaccgacactacctctttgctggtaaagtgtttaaactttctttcgcaacatacgaatacgtcttcgacatagtcactgcctgtaaattctttgaagtatgtaggtagaagagtcgcgcctaaagcacgttaactatacttcatgacaattcccacgtggttggaagtcgacaggcacatgggccgtagccatctcgccaaaggcgtgtcgtgatccactggcggggcggactgataaccatgcgcacggtcggggcagcctcgacccacattatttatgcattaaatccagctacatattcagccgtgaaacggacggtcgttacgccgctgcccccctgcccggatgtgccagcccaagctcccaccccccagcgatctggtggcggggctgacctcctccccacccaccctcccctgccgcttcctgtacgatgccaagggctcccagctctactcccagatcaccgacctccccgagtacaccccctaccgcgccgagctgggcctgctcaaggagcatggcacaaagctggccaccctcatccccccacacgccctggtcgtggaactggggtgcggggacgccaccaagacctctcacctcatccactccctgctggcctcccgcgaccccggcgcggtgaggtttgtgggcatcgacgtcagcgccgaggccctgcgccagaccgaccgcacgctgcgcgagaggtgcccggacctgcccgccgcggggatccagctggtggaggcggactacctgacgggcctgcgcaccgtgcgcagcgccaacccggacgccacgctgtgcctgctgtggctgggcagctccatcgggaactttggcgagggcgaggcctccgagttcctggccggcctggtggcggcggctggcggcgacacgcgcgtcatcctgggcgctgacggctggaaggaccggggcgtgctgcacgccgcctactgcgacgccgccggcgtcaccgagcgcttcatcatcaacggcgtgcagcacgcgctgcgcatgctgaggcacccggacgcgcgcgcggccgacctgtgggactacgaggtcgtggtgaacgagcggaggagccaggtgcctgtttggagggggggattgtcattcataagcgtgaggtagctgcactgctcccacctcaccaccaacgtcccatcgccatgtcatgaatgcctgcccaggtggagatgtgggtgtcgcctaagcggcgggtgtctgacatcgtgccgggcgtcagtctggaagctggggagaagctgctggtggagatctccaggaagttcacgcccctgagcatcgccgcgctagccgaccaggccggcctagtcgtgcaggttggaagaaggaggggggggggcgccctattcgggtatgcaaaatcgatggagggggacaagtgcttgcggccaacctctgaggtggggcagccttcggtgttgggggtggcagcagtgcatgtgctcagaggtcagccagccagtatatggggaatcttgatatcacacagacatccgtgcacatatcagggcacccgcttgagctttcctgatcttcaagcttgatcccagagttcacacctgtgtcgcgcacatcccccggaaaccccctccctacctgccacagccaccatctccagccctcccccactccacaggagtcgtggcgcacacctggctactccctgcagctcctgctgccggccgtgcaggccctgctggacgcctggcgcgacaccgacgccctcttctcatcggttcgcagctggtccgcccagcccatcggcctgcgccaccccttctctttctactacggccacctggcctcctttgcgcgctcgcggctgctgcccgggcggcccgccggccacctggacctgctgtacagccgcggcatcgatccctgcgtcgtcgaccccagccggtgccacgatcaccccccgcccccgcccacctggccgggcggggaggaggtgcgtgcctacgcggtgggcgtccgtgccgaggtgctggccgacgcgcgggcgctgccggcgcgcacgcacgcgctgcacatggtgctggagcacgagcggatgcaccaggagacgctgtgctacatgctggcgcagcagcgcggcgcggacgccgcgctgactcagcgagagggggtgctgggggccttggccggccgctgggcggggtgcagctaccgggcgactgagcagcgccgtgccgatgccgcgtgggtccatgtccccgccacccagatccagctggggctgggcagggcggcgcgccacgggtttgtctgggacaacgagctgggtatgccggcaccacaggcggtgccagccttccgtctggcttcccaccccgtgtctgtgagggagtacaaggccttcatggacgaggcacaggtggggctgccgggttggatcttgaaaagtggctggccgcggtgcgggtgtgggtgttggtgttggtggtgcaaggaatcaccgagtatctggaggggggactggtcatcttccaatcgcagtgctagatctgagcgtatctgcgccaaaattctatgcccagcttcattgtcgtgccctggacccaagagcctcaccgccaccaagccctgtcccctttcagccatatgagagagaaggactgtggtctgccggggactgggcgcacatctccagctcaggctggaagaggccggccggctggatcctcgaccaggagggccgtctgcatgttggcctgcccgaggccgtctatcagtgggaagaggtgcgcacatgtgtgaatttcattcggcagtggttaggacccgggtctgtccagcatcgagagttgcgcatgtcgcatggtttgctgcactggttccagtctgacaaatatgttcacggcacatgcgctcgctcgtgcaggtggcggacagtccagtctacgtcagcctggctgaagccgaggcgtttgccagatgggctgggggccgcgtcatgacggaggaggagtacgccgccgccgtccaacacaaggagctgcagggcctgctcagcagcgtggcagccgaggcagatgagcaagccaccgcccagtgcctcgagtctggtggctgggagtggacaagcaccccattcaagcctttccagggtgaggcaggctggcaggaggtgtcaaggggccatgccatgatgaaaggacagaggaagtacatgatcctgaaggacggatgctgagagactggtgccctgcacactcctgatcccccctcatctccatccaggattcaaggccgaccccatgtaccctgagtacagcgttgacttctttgatgatcagcactatgtcttgaagggcgcatcaccttacactcacccctccgttcagagggggacgttccgtaacttctatcaacggctgtatccctttgtcatggccaagttccgggtcgtcctggaggccaccatggcacctgcctgaggagtagggggtaaattgaccttcctgctgcctcaagtcgggtatccaccctctgtacaagtattcctttccttttgctgtgatgatgctggcgcgctggatcacgacgcgatctgtcccagggccacttcttgcccccattttttgccctgctgtgcacctgtgccccctctgcaggcagcctgaggtgcagagcagtgtctgcaattttgtccgcgttcgtgcacatgcttttgtaacgagcgaagcagccatcctgtttgcctccggggggaggtggattgaagatcgttggcctggaaaaaggatgtggcggaggccactgcgcgcatgatgggagaaaacctcgcgcactgtgctggaccgggatgcgtgttcagggcaggatcacagctccctgcagattggttcttggggagacaggcttcagcgtggctggctgaccgccacattcgctcattcttcgaccatgagcctgggcaggtcaccggccagacacctgccggagctcaggagcaggccttggaccgtggcctgcagccttggacagtccaactcccgcagagtgaggtgcatgcggtaccgcctgagtgcgcagggagggggcatttgctttgaccagcaggctgtgtgcggtgataggtgggatgaatgcagccagggtgggcataggaggtgtgccatgacactccgatgggaggtaaggtcaatcaaactcccttcaagcggggccattggcatgcaagctcgggttcctgttcaggacggaagacaccatcccgcgacccctggcccagaccatggtagattccaggggagatcagctaactctcgataacggccccagccctcaaaggatgttttctcaccagtagtgctctggattgctgggcgcattgatggtctcctcactggcagggcggaccctgtcccaggtctcgagggctatgatatcctttgggtgttttgagggatgggtgagccgggtgagctgccggcaccagagggtgcaggccttgagtgccggcactctacggcaagtcacagtgccagcagcgcccctccgctcccgtttgcaatcctcgagctttgccgagggggcaggctgcccattgctcgtgtgggtcgtccccttttggcaagaccccaaacccccgccctactacaccagcacacctgaatggggaagatggccagcacggcgggcgagtccacgtgttgctgcgcgatggcccgcatgatctctggggtgcaggacgctggggcgggtccctcccctcccagcacctgcagcgcgggggggaaaagtgtggagaatgctcacgagaccgaccagggggagtgtgtgtgcgagcgcacatcagtttcaaaggaagcaggtgcatgcattccccggcgccactcgctctgacgagagcggccttcggccccgaccggcccctgcggtacctgggcgtagtaccgctgccgccgcggggcgtcctcctcgtaccacgcgcgtgtggtggtggtgtcgtggctggacggcgaggccacgcacatgtaggggtagtcagcggggtcgccaaactcctcctggccggagggcatgcgctggatgcgcagcgctggggaggcaggggtggggctcgtcgagaacggggattgcgagacagagggggtgcccagtccatgcatgacaggcacgctggatgaggtgcgacacaggacgcggacagggggatccccatgcacgctccctgttctgttgctggggcactccactccagttataacaagctctcagcccagtcccaccccccgctctcagctttgttcccaagaggtacccaccgcacagcccatccctgaatacccatcccacaccagacacattcccactgccccggctgcagcgacaaacccgtctcacccaggatccccagctcctccatgatgggtcggacacacgccggcgtgaaccccaggtcctcgccacacatcagcatgtcggaggatgaaaggagggcgggcagcgtcctgtgaccctgtgccctccacagctcctcctgtgcccaagacgaggggcaggtaggggagtgtatgcaactgtcttgtgatcagggttggacaaacacagtctgaaaggtgaggctgcacccagaaccacgatgggccgcccgtgcgacagactgtccccgcttgccgaccaggagaggatgccctgcccacagcaaccccaggaccctccatgaatgaatgactgacctggcgccggtagaagtagtcatcatgctgccaggccagctcctcggcccaggccacattgtccagggcagcaaagctggtggtcttggtcaagtcaaagcgctgtgagcgtggttggagagttctggcttgttggactgggaggtgatgcagtgcagcccaccgctgcaggagcagcggtgcctgggaccataagaaacaagtcatcacgcccacacacccctcgcccagcgagggtcgaccaagcgcgcggcgcaccgggtagagcttctgtggatcctcggggtccctcagaagcagcacattccgccgcatcagcagcagggtctcgtggatcctgggccaggcgctcacggccaggccggacatgccctccggcactgtgagcgtccgcagcaccacctcactgcgtggtgggtgggtgaggcgctcagcgtggtggcatctgcctggccggcatgccagacacgcgccaggcaggggcaggagggcaggggggtgctgttccagtccctttccacaagagaacagcaggcagcttgatgtgcgtgccatgtcagcccctcgatcacctggcatactcctcccggaagcggagccgatcgccgtaggagggctcgaagaaagcgctggcagcctccgcggccagcacgtcgccgagctcggctgtgagcagggccagggtgacatacggctcctccagcctgggtggcgggggggatggaggtgggggattgaggaacccctggcaccctggcatgcagtcagtggagctgaggctcctgcatagcacgtttgagccgcagcgaggactctcatgcgccaatgcgccatcactcccccattaccccgcctccttgtgtccgacatgcctgtggaaatcccagatgcccttggcttctagctcagctctggcaatggggatgcagggcctgaagtgccccatcatgccgctccagcagtcaccggggatctcccagatgcggaagaagccgatgatgtggtccacgcggaaaacctgggggtgagtgtggaggcagggagtgagcgggggcgtcccaggatgggaggtcgcgagcggcggtctcctgcgcaagaacgatggcgcaccggggcaccgcctcccttccctatgtcctgccattgcatcgcctcctaggtatgtatcgcaaactctaggagagcattcctccttccttccacccaggtcccgcctacatgcctgaaagtagcgtgccatctgggcgagacgtcgcctccaccaggagtagtcgtccttggccatctcctcccagttgtaggtggggaacccccagttctgaccgtcctggttgaaccagtcgggaggtgaccctggcagggtgtgagggagtctgaaagtataaggctgaaggggtgttccagcacgcagggcacacaacgacccaggctacaacatcaaggcctgcaatgagacaacagcacctgtgcccgtgcccatgtggaacaggttggggtagagccaggtgtccacactgcacttgtcaactcctgtgaagacagccaatgggagtgtgtgagaagggacgagggatatccccgaaggctccagtcctctttcccacggccgctctcagattggcgatcagcggctccttgtagccgactgactctcaggttgggcagcccatgacaaaaacagcccggcaactcatgccccatactactgccaaaccctcccgcgccaccgcccagccccttttgggtgaacactatcgcgccagttccacaacccgggccccccccacccccttcaactacgcacctatggggaggtcaccctttaggacgacatgccgctcgcgtgcataggcgctggcagcgctgagctggcagtgcaggtggtactgcaggtacgagcaaaaccacatgtcgcgcgcagactcggagtctggccgccagaacttggccgtagcccgtgggtcgtaggcgctgtacctgccccactgggtgtggtctgccgtgccgaagaaggactggaagtagcagaacatggagtatggcttcagccactcctcgtggtgggcgcagaactccaggaaggcggggtcactctatgggggtggggccgggggtggtgaggcactcgacgcggctcggctggggcggcgtcagcggtggagcgacgcatgcatgctgcaccagccaggccccaaaccgcccccccccgcgctggtgccattgcgccgcaggcatggacgtgatcgaggtgcttttggatgataccccacgtgccagcgccggctcaccaggagctgaggaaatgcggcatcaaaaagcttgcgcgcaatggctagcttggcagcgagcgtctgctcgtagtccatgtctgggaggttgagcctcctgcgagcctctgcaacctcctcctggatggcagacgcatccgcccctgtcatggcatatgagagcaggtttgagagccggacgagcatcctcgggagctttgcacccctaagtacattgaagcacgatgttctgcaggagggctggggaggtgctggatcctggacacccacatggagtcggcgaaaagttttgaaaccgtgtccctcgtactgcagcctctctgatgatgagcaggcaccagcaccagtccagcacaggcccaacatggtccagcaatcatgcaccttgggcgcagctgcccgagcaagcaccaggtgccgacacccttgcacgttcatcctaccgggcagccggtccaggcagaggtagagtgggtgcagcgcaaaaacgcagagggaggagtatggatacgagtcccgccagtctcccttgaccgaggtgtcgttcacggggagcagctgcaccaccgacagccctgcgggtgtcatgtgacgagtcgctcctgtgacaggctgacagcatgctgtgcaaattcgcgaggaaccctcgcccgccaacaatgccccgttgcatggactgcccccttttcggcccccatgcaaacccctcttcgctgcgctcatggccatcatcagcccctgtgcatcgcaagccacccactcatcagatggtttgatcagacacccacagggatacctgtgttcctgcagaagtcgaggagggggcacaggtccgcaaagtcaccgcaccccactgacgcctcggtgcgaagggagaagacggggacagcaacaccagcgcccctccaccgccgctcgtggcggaagaaggaatcattccgtaccacgaggaggggcaggggtccctcctttggggctgtgcagggcaggtggaggggacggggtgaaggggcaggcaggaagcggggaagcggaggcgtggatggggacgagggaacctcaggacgggagctttggcccgcaccttctcgagactgcccctcaccagccaggcaaggaaggaagcatccaggcatgaactcgacccacctggcatcatcctgttctccccagcttcgaggaggagggtcccatccgcgccgcgaatcacatacttgtaggtcaggggaaacgatgtgtgcggtatgctcacctggaaggggcagagggagagggtggcgcgccatgcaaacagtatgcatgcgcagtgggagcgagggcatgcggggcagcaaggccacgagcagtcgaagcattgcacggctccatcggcctgatgaccgcacttgttcttcctctccacacatacacacgtttgctagaacgggcacacaaagatcaaaccccgacttttctgaccttgcccgcctccacccccctcacctctacctcccagcaggagggcgcggtcaagcgcaagctgaggctctggggaagctgccaggatcccaggccaggggctcctcccgtgacgcaaacctgctggccctctttcagctgccagtccctgatggtgcgacgcaaaggggatgtgacacaggaggccaaggatgactttgcgtgagcgggtgaaggtacacaacacatcgaatgggagtgtagcctgccacatcccaccctgagcatgccataccacccagccagcctcacctgacttggaacttgacaagagcatgcccttcgcagattgaggggcgagggccctccgctgccagcctggggatctggtggtcgccgaggattgcctttcgaaaggcagagcgagcaaacaggtgggctgggtgcgagtcgtcctgcaaggatgagatttggtgggtcagaccttgtcgccgcagtactccctgcttgctgtcctcagtcacgttatcatgtcgactccagtcccacccctcaaactaggttgcctcaagccctaggcatcaggtaaccagcagtataactcccgctcctgctcctcgtggcccctcttgttggagcaccccttgcaggagcgactcagctccagccccacagtccaccgagtcacgaaccagcacagcctcgcagcacctcacctcccagacatctgtcacggtgacgatggcgtcgttgacgaggtcagccgggaggtgcagtgtgtgcgaccccgactcccatttgaccacgttgagcctggcatccaccaccgcatacttgtacagcaggtcggccgggtgtgccacgcgcagcgaggtctgccacaccagggtggatcccacgtggctgcactccagcttgtgtcccctgcacggcgtgggcgcagggaggggagcagctgctctggaaccccggcatcggttgagagctgctggccgcctgcagcagtgccggcagggccatgatgggagcatcggcctggcccctccactcaccgctccacatccagattgcctagcatgggtccaggaccacataatacgagcgcttcaccccactgagtgtggtaaaaggtcttgaacctcagggttacctcccccgccggagacatgtgcgcaaccgacctccagaatgctgagggtatgtgaggatcatgcgcagccgagcacctccagccgcatggtaccgaaggggttatctgcagtttcaggctgtcaagagggggcacgaataaatttagggatccccggactcgccccatgatgtgcacggtcaggcttgactaagcattcgcacctccaacatcgagtccccgcaaggcaacctgcaacattgggcgaccctcggcaaaatcaagaatcagtgatgacattttcccctctttcaatcataggttccttatcctctactacgcttggcatgcaataaccgccgcgatcgctgtgtttcccgcttggtgtggggatggccaccggcacccctttcctgatcctttacaaggcgccctcggcctggggtcttccctctctatcgatctcaagcatacaaattgaggtgtgctattgggatcgctgcacactgcaacgtggcacatcccgtgctcaacctcgatcaccctccctctctcacttttcaggcataccttcagctggcggggatctcgtacaccgtgcgggaatgctcgtcggactctcagtcccccacgggccgcttgcctgctctcgaggcgggtccgaccctggtgggcttagcccccgtcaagtgcccctacaccccggccgaggaggaggcagcagcgggtgccctcctgagctacctgcgcgagtctgtgcgcgacctggatcagggtctgacgggagaggccaagggcgaggcagtggccttccgatccctcctgcagacgtccctcctccccgccctggtgtactcggcctggagtgagcaggaggcgtactcaaaccacatgcagcccgccgtgggggcccagctgcccttccccctcagctacatcacacctgcaatgcaccgccgggctgtgcgccaggcttttcgaacgacaggcgaacaggtgcactcgagtgttcagggttggatgtttgaatgtagtatgcatcttgggggggggaaggggggtagatgcgtgtgcactggcatacgtggaggcccagtgccgaggctcataccatctgacagtggatgtgggtaacccacacaccagagggctctgttgtatttgcacccgtccctgtacatggtctgaccctcaggtgtacgcaacagctgcggcagccctggacgcctttgcggccaagcttgcggggggggggggctaccttctgggctccagccccagcaccattggtgagttgagaaaggagcgccacagtcctcccccagaccggttgtggcgggggcccttcctgcggccctgcagggtggtggtgaggtcatcccccttttccacgccacgccgtgccagcgctcggtgctcccctcacccacgcagatgctcagctgtacggctgcctcacctaccttcgctccgcccccgtggtgcacccccagcttcaccgccacttccttgggcagcgggagctggtggcgtacacggtccgcgtgggagaggcgctggcggggctggaggtgcccctgccccggtcggaccctggggccgccggaccctcgtggagcgaatggtctgggggggggtccacttccaggtgggctgtcttgagtggctgcagggggcacggtgccttgttgtggctggctcacagcgggacagggctggatggggtccgctgaagaggtggcagaatgggtcgtgaagtgcggatggcactcccttgggaggagccccttggtgtggagcggacagcggcaaagcacactggtagccctgactgcagcgaggtggcattgtagggcatccttccgctcactttagtttgcgacccttgaatcattcttcgcagggccagcaaggaggcaagcgccctctccgcagaactaaaccgcaagggcaagatctgggtggggtgtgctgctgccgtcatcgtggcctacgtagtgtttgggggccagtacttccagtttgggtttctggatgacgaggacgatgacctggacggcgactatgagtgagcggacgtatgtgagctgccctgccccaagcgtctaccgcccaggccattgctgtgtgagtgctcagtcttgtaatacagaggcgagttaccggacacgccagattcgatgtaagaacaacgagctcgtcctctaagggtaaagcccttctggacccgcttgctttcctccgagaatgactataccgtgtcacgggctctccatgcccggtgcaaaccctttcccccccgaccgctgcggggcatctcgataatcattgcaaacctctccataccgtaaaccgatctcgtattgctcccactgatcccagcccgcggtctccgctatgttgcgggtagtccgtgcggcaggtctgctccgcacaagggcagcgcccagctgcagctgcgctggtaggctgttctctggaaaatccaagcccacggatgagctggacgatgcctcctatgagctccttccgcccggtgccagcatgaaggaccccctatacggactcaggtggggccagctggcccgtgtgatgcgggcaccgctatgcataggctcgcatgcatagggctgatggtctgagacgtccactctctcctctatcgccccaccccctcgcagtcccgacgcgaaggtcttccaccacgacaacaagcaggtggtgaccgacaagcagaggctgcctgatgccctcccacacagcagagaggcagcacagcaaaagctgaggtcccaggtgagcgaggaagcttggagaaccaagtttgtgttgggtgtgatctctggatgcaagagacgggtcacgttgaagagcacaaaagtggggcgggttggggggtagtcagcgcatgttcagcctcctgcatcctgatgtatctccccccgcccccccacatatatgtatttccccccgcccccccacatataagtcaaccaatccccgacaccgcatatataagtcgaccaatccccgccctccctggaatccatagaagtaccgcaaggcgccggcggatgacgaggacgatcggtatgtgtacctaccccctgggtcaagcatgcgcgagccgggcgacagcatgtcggaccccggcgagcggaaggtgtaccgccgcgaccccacccccctgcccaagaagggagagtgagggcttgcgtggctgcaaggcatcctgtcaccggctccctccgccacctccccttcttgccccttccagactgcagtgtaaatgcaacacttgtaatagctcgcacactctcaggttatgtggggccagtctggaggtggattgtgatgcactggaggaccttcagaggtccagaccgcccgctgctcctgcgccggtgccctccaaccaccggtgcagcacctcttggtctgacctcgacacgagggccaggttggagatgccttgctgccctgccaggaccctgacgtggccgggggcactgcagcagggatgaggaggcggggctgagaggggcggtgggacgcaaagaactctccaatgcgcatgcgaagcgtatcccagggcacgggctcggacgcggcccggcgtcgtcccgcatgcccacctgtcaccccccccccaacgaagcccctctcaccaggcggggtggaaccattgccgcgccgcgccgccgcggccctggtcggcgcggtccagcacaaggcacagctcttcctcgcgcagcagcgcgctgcaggccccgcagtgcgccctcatcccggccgggccgtaggaggcgaggacgttggtgtcgggcggcccggcgcctatcctgggatttcgggcctccaggacggcccgccgtgcggatcgtgcggcaggcgccaccgtggtgtggaagtcgcctaggatgccgcctggggtgggagcggtgaggggagggattggaggaggggcctcacgatcctcctcgggatactggttgagtgaggcctgggcaggctgactctagcgaaggtgcaagggccaggtgcatgtggtgccgggctccccacgccttcccgcgcctggcgagagcatggccagtccgcagtctcatcatgtcctcacgcccgaggtggacttgccagcgcgtgcatgttgctcttcactcgctgccattcctcgtctccaccccccccaatcagacatacacacctcccaccttggaggcggcccgacggttcgcgcgggccccgcgtcgggtgccgcgcgaccaggaccgtctgcctgacgaccttgcggggcagcgcctgcatcagcacgggctccagctcggcggcgcgggccttccaagccgcctgcttctccgcgtgcatggtcttggtcctgggtgacgcctgggaaggggtgaaagaggtggggtgaggtgtagcaggtgaggcagacatagggtgaaccaggagcctctggcggtagaccaatgccggggcatgcgtggccgccaggggctggacagcggggcatgctggtccttcacctgctgaaccagcaggtccagcacgccgtcgatggccttttgcctcaccggcggcgcggtgcatggcgtcctgtgagtgtgttgtgtgtgtgcatgggagtccactctgcatggggtggaagcatgtggcggggccaggggggcatggcctcctctcatggcagccgaggggctcagactctcacgcacctcccccaactgacagcctccttccccagggctgcaatgggccacgtcccacgcaagcccacccaccggcaggtagggcactggggcgggtccttgaagctgcgatacaggtcgcctaggcacgccccgcagaagaggtggccgcatggcaccaggacgtgggtggccaccaggttttcctgcagggggagggaggcgaggtgcatgggcgcagggaccggccggcgtggtggggaccgccgcctgcgacccaggcccacgagactctgcagactcccaccacacccacacgtccctggcgggtccggacccccctgcagtgaccccttgcgtcgccagcctgcctgacagatggcgcagaccaggtgctccgtgatggcgtcgagctgcaggcgccgggcctcggcccacgccgccctcccctcgggggacacgctcgccctgggccggcccccgaccagctcctcccccgcgcgtttcggcctgggcctgctcggcgaggaggctgggcgcgggagcatgctcccgctgctgccacgctcaggctcggcggcgcacgcgtccttgtctgggctggtgctcgtcgccgtggacaaagcggtggcagggtgccatgcctctgcctggaaggtggctgggccctgctgctgtggggcagcaggggaagcagggatggccagtgaggctgacacctcctcagaaggtgcccgtgggggtgcagcagcatccgtcccaaacacaggcccctcctcctgcacttggattcatgggggacaacatccgcactgagctggtgcggggcctgccggtctgagctgtcggaagccaggccttcagggtgcacaacgagccagcatcaacgccgacaccagcccagccttggttcagagcaggcacacccacctccacaaggtcgatgggcagcgagctgtcgtcctctacgccggccaatggcaggggtggcccgatgagacaggtgtttggaggaatgctggcatccactgaagccggaatgtcttgcactgacgctgtgggggagcaattccggcgtgatcctcgagacaggtgtgcccaggaggcacgcgacagaccatgcttcgcgctccctcaacaggtctgcggcatgacagggtccctttttccaagctttctttgtacctgcggggttgctgcatgggctccggtctgcctgctcctgcagcagtgcctctgcctccaggttgaaagcatgcctcgtgttctcgtcggcaaagacaggccccacccactcccgctgcctgctcgtcgccagggaccgcgccgggctgaagctgtacacctcgcgtctcggctgggagtcgaggtgtgcaatggggcagggcacctccgtgccggtacctgaatccgcttcggggcctcccccgctgctgaaccggaaggcccagggattcgggatgaaggcaccctttggcttcacagtctggggcctgcgagggttgtgatgttgggagaatgtggggcccaatctaaggaggcacatgggtgtagacttcggcccgctccttggcctcactgcagacaaaacgactcatgatacccaggacccacccgccaaagtggaggatgtcgccatcctccaggacatgccagctctcaggctccaggggacttccattgaggaaggtgccattcgttgcattgttatccaggatggagaatcgtccctcgacagcctggagaggatccaatgcgagcaggagtcgtgctgagagcggtccagaacctgggcagagaacgcggtgtacaccactcggcggcccgatcagatcaccttgatcagggcatgccgccgggagagcatgtaggctgttccaggaggtgcgctttcgaaatggctcgcagcgacgtggcaatctcggtcccttcccacgatgatgcggccgtcggccccgaggtcctccagtatactgttgagattgtaggttggcccattgggtcgcagattcctcagcatggctccccgccaagggagttggggcaccgacacagccacctccaagctcggctggaatactgtgccgggcccccacaggagcttatgccaggcgatctagcttcgttgcctttgaactgtaaagcgtggcaaatcgcccattggcgattcctgtgttgatgagccaagactcgtactgtcgggagccatcagcgacagccggtgatgatttcatgctggggcacagcacagaggggtcagtgaaaggtagagggtgccctttggtgagtcgaatgggggctggaccaccttgccctttgacaaacgaagtccagtttgaggtgtcctatatcttacttgtagatgcagaagtggctgtgctaaaaggttgtgcaggtaggctggctgtactacacgtcagtgttgagcccctgttacctttacatggatgtgaaagataagatctgcaagcattggatcttagaagtgttcttgcccggtgtcgaaggggatattcgcatccctgatgttgtgaggctgcgttctgacaaaggatctgcaaaataacaagggtgacgacatgcctcttgcttgcatcatgttctgggcgctggccgccacactcattcagaacctgcagcagtcccattgcttcgtttagccttcacatccaatcgttcatcagtgtggacctcatccacattgatcaactacgcatctgcagcatcagctggagatggcgattgagctgtgtgatgctgttcaacaacatagccagcagtaatcgcgaagttttacatcggatacagatccaaccacattctgatgtgcgagaggtaccaggttcgattcctggatggtccaataacccgaccacgggccattagctcatatggtagagcgctcgcttagcatcttatggaattgctttttggtactgggtgaagctgggaatctacatgcccccgcttcatggcatgtgccattgcggttgctgaattaatggattcattgttgacacaaggcccactcattgggtagaagatggtgcaggcgaggaagattgctggacatcacctcctcagacccacgtcgatggggcccggcaggaacaagaaagctgtcgatcatgcccccgctgcgccagaggccctggcaccgggtcagagcctcgcagccgcgctggcccccgccagtccctgctcctgcagggctcccaccagcgccaccacgtcggcatcgctgtgcgcggcggacaggctgatgcgcagccggctcgtgccggctggcacggtgggtgggcggatggcagggacgtggaagccggcgcgccagaggtcgtccgccaagcgcagcgcccgggcctcggcgcccacaaccaccggcaggatgggggaccgtgacggcaggcccagcgcgccgctcagcacgccgacgtggcgccacagccgccggcgcagctccggctcctgcagtcaggtattcgttttgggggggggcatgggaggtggg

SEQ ID NO: 23238 - DNA, 684 bp, Chlorella protothecoides; identical to SEQ ID NO: 1600

SEQ ID NO: 23239 - DNA, 74 bp, Chlorella protothecoides
cggctggggcggggttcgtcattttgcaagtacatgctctgacgccggggtgcagctacctggggtgaagggcg

SEQ ID NO: 23240 - DNA, 70 bp, Chlorella protothecoides
atcatctctgggagctgcagcgggagggagagggggttgggtttgtgtgtaaataatggttgtaggaggg

SEQ ID NO: 23241 - DNA, 72 bp, Chlorella protothecoides
tcgtgcgtgctgcgctgtgtgctgtgccctccctcgtgtaccccttgctgctaatcgaccttcttctatcag

SEQ ID NO: 23242 - DNA, 102 bp, Chlorella protothecoides
tggcgagaaactgcacagctttggtgctgtcgcccccaaaggtatatcaagcggagtatttgctgtcaacgaaaatttcaagcgcccagcttcattaccata

SEQ ID NO: 23243 - DNA, 76 bp, Chlorella protothecoides
ctgtgagcagctgaggggagcggggctgattgctagtctggagccagatgggggaggcggcggatcatcctgagca

SEQ ID NO: 23244 - DNA, 98 bp, Chlorella protothecoides
gatgggggaggcggcggatcatcctgagcatggtctggtgagcccttggatcctgctgtgcaattaaaatggctgccaagcctggccctggcgccgtg

SEQ ID NO: 23245 - DNA, 61 bp, Chlorella protothecoides
acgagttgtgccaatatggcctcccacatactgttcttgccaaccctgtgtgcattcttgt

SEQ ID NO: 23246 - DNA, 70 bp, Chlorella protothecoides
ccatggcgcagggtgtttggtcaacaaccatacatgtctccaccccccctcctcgcgccagacactgcct

SEQ ID NO: 23247 - DNA, 148 bp, Chlorella protothecoides
catgcacggccccctggcatgccaccacctttaccatctcaccttctccagcatggccttgatcatggcagctgcctgctttggcgtgcatgccgccgagcgcaggacttgcgccctcacgaatcggcgctgcatcccccaagcgcga

SEQ ID NO: 23248 - DNA, 72 bp, Chlorella protothecoides
tgggtggtgaaagaagggagggagaggggggggtccctgaaagggaggtgtggtgctggacgtagagggagg

SEQ ID NO: 23249 - DNA, 87 bp, Chlorella protothecoides
gtgcttggggttggtgtgggtgatgggcagtagtgggttcaggactctcccatggcaaaacaccgctgcaaaccggtccacagagta

SEQ ID NO: 23250 - DNA, 136 bp, Chlorella protothecoides
ggaccgctcctacgacgggccagacatgacgtacttcttcgactcaaaggacgatgcgccagacaacgggctgcgtggcggcgagccgcgcggctcaaccagcttcgcggggcgggtgtaccgtggccaggaggcg

SEQ ID NO: 23251 - DNA, 130 bp, Chlorella protothecoides
gagagaatcaggggtttattcttggacaacttcccctggcaggccttcaggtgaacattcaaccacgtcttgatccactcctcccgcttcttcttgtcatgctgcagcatgggatggaggtcatggtgga

SEQ ID NO: 23252 - DNA, 62 bp, Chlorella protothecoides
ggagcgcgtggatgccttccagcacggcgagggccgcttgttcaggacatccttccatggga

SEQ ID NO: 23253 - DNA, 9424 bp, Chlorella protothecoides
  modified_base (227)..(236): a, c, t, g, unknown or other
  modified_base (768)..(887): a, c, t, g, unknown or other
  modified_base (970)..(979): a, c, t, g, unknown or other
  modified_base (1062)..(1071): a, c, t, g, unknown or other
  modified_base (1227)..(1285): a, c, t, g, unknown or other
  modified_base (1696)..(1705): a, c, t, g, unknown or other
  modified_base (2723)..(2732): a, c, t, g, unknown or other
  modified_base (2802)..(2811): a, c, t, g, unknown or other
  modified_base (2881)..(2890): a, c, t, g, unknown or other
  modified_base (3032)..(3093): a, c, t, g, unknown or other
  modified_base (3845)..(3854): a, c, t, g, unknown or other
  modified_base (4108)..(4117): a, c, t, g, unknown or other
  modified_base (4652)..(4661): a, c, t, g, unknown or other
  modified_base (7414)..(7423): a, c, t, g, unknown or other
  modified_base (7850)..(7859): a, c, t, g, unknown or other
  modified_base (8328)..(8337): a, c, t, g, unknown or other
  modified_base (9075)..(9084): a, c, t, g, unknown or other
  modified_base (9338)..(9347): a, c, t, g, unknown or other
gtaatgaagagatcgttcagaagtgttcgccaagagttttgtttacctcagcacagccggaaataaatcggcttctcggggcatctgtccccttactcaactcctaaatctctgacgctgaactcagagcggacataggcgaggtatgcgcattgtacaagaacattcaactgttttatagagtaacgaatttcaggcatcgttacctaggaggattgcctgggccnnnnnnnnnngtctctgactctgaactcagagcggacatagacgaggtatgcgcattgtagaagaacattcgactttttaatagagtaacgagttttaagcatcgttacctaggaggattgcctgggccatgacaccgggatgagacggatcacttgacgccgattgccaacggcaggtgtgagagcgcgtttgacattacatcctcaaccaagatatgaatatattgctgtctatcggagccttgctggctgcgtcagcgctgcttgctgtccttatcgctataggtgggttgctgcagaggtgggtggtaggatgtaagaaccccccatctgctggctatcctaggctcaacagccatagtttttggacaatttcaggctggttctcgatctggaaagtggcgctttgtaagctgcaggttttccaagagatgttgggactcaggtgaggggagtgcaggaggtcatgtgctgtaggcagggatagtctggtcgctgctccacaccggttacaccccttatcaaattcctcccatcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggtccctgcctgtcagcaggacagcgagagagatacagaaattttggcccgcaacccctcccacttctcatgcaggagnnnnnnnnnnggggggtccctgtctgtcggcaggacagcgggagagatacagaaattttgggccgcaacccctcccacttctcatgcaggagnnnnnnnnnngtgcaagggtagtctggtcgctgctctacaccggatacaccccttatcaaattcctcccatcccaggaaacctgcaaaaccctctcgccgtgagatgcagtctgagatacaggccataaaggtcagcaccgtctcctgcctggggagggtgccctnnnnnnnnnnnnnnnnnnnnnnnnnnnnnnnnnnnnnnnnnnnnnnnnnnnnnnnnnnncagcacatgggcgacgtccctgtctccatgcaacgacggagtaggagggtgatctagctggagcagcatcgccaggtgttcgctggactggcgtcgggacccaggagccttcagcgtttcttacagttgatgcacgacaccaatctcacagccccggagctgtgccagcagctccagattatccgccaccatcttctgcctggcggacgctgcgctgcgctgctgtgcctgcaactgaccctgcagggacttgacctggcggtgcagagcctgctcgcgcaaaatggcatcattgggcgtgctgcggaggtgggggagattaccttggaaggacagctatttgcaggatgcatgacagtgggcgaggagaatgtgggatgcattgcacactcgctgcaagggatgtatgcnnnnnnnnnngaagggcatcattgggcgtgctgcgaggtgggggagatcaccttggaaggagagttatttgcaggatgcatgacggtgggcgaggagaatgcgggatacattgcacactcgctgcaagggatgtatgcctccagctttggactggcctgccagtgagacactttccatcttggtgagccttcccttgagattgccccacctggttacgtgagatgctgcagcaacatcgttcggatagaggcatacctcctccccggatgaaggcagggacatcacttgagcctgggaagcctttgtgaggacatgggtctggtacaggcggcacagtgctgcaacaccctcctttcctgtcattttagctgcagcctcaacatctagctgtatcgccctgcatgacaacaagatcagaagctgtagaacaggttcctgacttgactgtgggccatcatgcacctcgctcatctgcttattctaatggcagtctaattcatcaagagtttgatctcccattcgacaccacatcaagtgttggctcacctcaacgctgcctgcaagtttgctgcggcgtaccgcgccctgtccagttcctgttgcatcagcttgaccctggctctccccatgtctgcagctcggcgtgccaccccgaggctggcatctgcagctgccaattcctccttcagaccctgcacatgtcagaggtcaggtgggcagcatccactcgagctcacagtgaggcttgctccagctgcagcctgctgacaccacagggtctcgctgctggcgcctcacctgaacagccttctcagcagcacacagcgcatcagccttggcattgcccttgtccttcgctgcgtcgcgttcgacaatggcactctcaagcttggcttctaggtcctatacggttgcaaagaggtacttttcacggccaaacgctggctgccaagtctagggcaccaagaaaagacacttttccagaggtggtggagttgattgtcggcattctcagggcgagcatgtnnnnnnnnnntccctgcctagcgatcaattccctggctcgggtaaccaggtgggcctgagcagcttcctgggcctgaaannnnnnnnnncccctgctgagcgatcaactccccggctcgggtagccaagtgggcctgagcagcttcctgggcctgaaannnnnnnnnngcgctggctgccaaatctggggcaccaggaaaagaccctcttccagaggtggtggaggtgattgtcggcattctcagggcgagcatgtagtcctgactggatgttccttacccgaatctgggcccgggttgcctccagcttnnnnnnnnnnnnnnnnnnnnnnnnnnnnnnnnnnnnnnnnnnnnnnnnnnnnnnnnnnnnnnttgttgctcaaggctctgcaaggtgccgcagtggcgcttggacgccaatgggtgagagggaatggccctggaatggatgaatgtgggtccagcacccgcagagccagcagtctgaccctgttggtgctactgaagacaaagcaaggcaatctttcctccacactttccaaaagcacatgcatgctgagcctctccatatggccccaccgcttcaagcgacttgctccgctcctgctctcgtctcagggctgctgcgagccctgccctctcccgctgagcgagcccagcgtgcaagctcgcggcacctgcctcccccttcatctgttcgagctgctgcgccagactggaatagcgagcatctgcggccgcttctgcggccagcagtgctccctctgctcttgcctctgcctcgcttgcgcgtgcaagcagggcagcaatttcgctggctgctcgggcctgcgtggcagccgcctcctgggtggccctctcggtcgcagcctcggcctcggcccggcaggcctgtattgcggctgcgtattcccgctccagctccgaaacctgtgcgcgccagctgtcccacccccagggcaggatacttggtgacgtggctttgaaatcgaatgggatgcaagtgcaggctggctggggcccgcaggaggggatgcccttcatctcccaatgagtcctccccatatccagtcaaggttcgacccacctctcagcggaggcatgcatgctcgaccgggtctctnnnnnnnnnntcaatgagtccttcccatatccagtcaaggtttgacccacctctcggcggaggcatgcatgctcgaccgggtctcttccatcttctgctgggagttgcggagcagcgctgcatgtgccacatgctgggccgccatttccttctacagaactcagttggtgaaggctgggttgaggtgtgaattctgcatcaggactcgagggtatctccccctccgggtccaattgtggagggggatgactgcacagaaaggcnnnnnnnnnntttctgcaccaggacttgagggtatctccccatccgggtccagttgtggagggggatgactgcacagaaaggcaagcagtcctgcatccaataatgcactccctcctcaccttgtgctgggcctccagcctctcctcagtcagagctaccaaagaccgagcttcaacagctgcagcctctgctgcggtcagtctgagagggattgggcatgggagcatggtgttcagctttgggcacggaaatgaccgccagtgaccatgcaacgaacatacaatctctcagtcaacgagtggcagccccctgagggtacttcatatgaggtatctggctcctgccccgtctcgcgcgcacttgtcgaggccagcctggagctcagctgcatgctcggctcggagggctgccagcttctcagcagcctctacctctctcatgtgaagctggtaatcgtgttgccctgtaatgtccttcacctgtggaggggctcaagagaggtttggagcttcaatcaagtctgtgtgcaaccacagaggctgannnnnnnnnncccttcacctgtggaggggctcatgagaggtttggagcatctatcaagtctgtgtgcaaccacagaggctgaagaaatcttcactctcccaggctgtgcacgggaacctcatggtagtttcttgcatgtcccacagccagcgtccccccgtgagcaccatcatgtacctgatcctgcagctcctcgactgtccctctcagggatgagagctcctctcggcccaccaacacctcattggcccaaggaaggagctctgtgcgccgagaggtatctgcttcctgcatggaccgcacacgggtggctgaggaaggcgctggtgctgagttcagaggcctccaaggtcccagacctcgaccgtgaggattctcggtccctgtggtcacctactctacaaaccttggcaagactccactccaggacctaccctgtccatgacggcaaagaaagccaaggcgccatcggccatcccagcaaccagcatgctctcatcggccagcagggccagagcagtgacaggcatgggccctgcctgtgccacttgagcactgctccatccttcggcgcccaggagggcagaccaggggacagaagccactccgccagctgtcccagcgtacaccattcccaaacctcctacaggacttgacatggcaaggatggactgaggagaggggtgggaggacttgtgcccatcgcaagcatgcatgacaatcataactactcctcaggaaggcgccaaggctcaagggcacaggctctgtcccagcagaggcttgggctgcattcaaaccctctgcgttgtgtcaaatcatgggccctgagagcccagcgcaccatgctgcgatgccgccaggacgcccagagactccagaccagccacggtggtgtggcttggcagtgccatttgggtcaggacgcctgcagtcctgctttgcatgagcaggagctgaccctctgcggtcaatacagccgccttgggccactcctcagccaagagaggggcagccggctgcctatctgacgcactggccccggcgggcttttcgtcgggagggagtgcctggcatttgggatggagagggaggcttcagatcacgctgccatggggttgtggacatacccatcgccctcgccgtactggcatgggcttcatcattgtgtcagcaatctgggagcggcaatgtgcctctttctgagtcaggccacctctacatgcggtcgttcccgtccctccagccagccggcctcgtcaccagggaggaaagggggacgccgcgcatcacgctctcgaagaccctggtgccctcggagaccgaccactcgtacacgccgccatcggcccccacactccagagcttgacatcgtgccgatgccacgtgagtccctccacacggcccacatgcgccctgggcggatggcgtgggagggaggcaaaggaaggctcgagggtcccttgacatcaggggctggcccggtggccgccctcgtgcatggagtgttcctaggtgcagtacgctctggcgtgtacaggcgtcccattgcagcccagggagatgaggaggcacctgagaatggtgatgagctggcatgtccaggtgtcgtagatcatgaccagctggccgttggctgctgcaagcatcgcccccgcatggctgaaggcacacgcctggcaggcgcgcaccggcagatccttgactgggctgcatgtggaagtaggggagtaaaatgggaaatgcaggggccgcctgctcgtgcccggtggatggaaaccgcccttttaacaacacttgcaatcttcgcatggcgatagttgaaatcgtcgctcatgctgttgcacggccacccttctcccacccctggcagccctcccttgcctgaatcccttctccagtacagtcatgaggcgcaggcgggaggacaagccaaccaggatcatgtgtcccgccgggtggagagccaggctcatgatgtcctccccaaagtgctcctcctgaggggtttcaggtctcagagcatcgcagggtgtttgttgagccatgaccacagcacggacccggacaccgccccacacagctcactggcgccctccccactcccacggccgcaagccgacaccaagccgccaaatccctgcagcagacatggctctcaccagcaccaggccgcaggctgcggcgtcccagagccggacgcactggtctgccgcggcgctgaccacgataggccgcctcaggcaggtgcacaccttgcgcacagcgccggcgtggcgcggggggcagagccgcgcgcgccgctccacggtgccgccggccacgtgccacacctccaccttcccactgccaaacagtgcggcggcgccagtcctcaggcagcacatcgccgcgacggcgccctgctcctgcctctccagctgcgttggcgctcccgtgtcatcgagggcgaggaaagcggggccggtggcggaggagcccaccaccaggccctccccggcatgcgccgcgatgcaggtggccctaaaggcgggaccgaggccgatgcagtgcaggagctcgccctcgggagagatgacctgcagctgagctgcggtgcacgcagcctgcaggaggattgagtgggggaagtgggatgcttggggaaccttcagaggatcagggacagtgcagagccgccactcggacggtgaggagcctgtgaagtcaaaccaacctcctcgggacacagtttctggaatgcagcggcagatgtcctcggnnnnnnnnnnctgcttggggaacgttcagaggatcagggacagcgtagagccgccattcggacggtgaggagcctgtgaaatcaaaccaacctcctcgggacacaatttctggaatgcagcggcagatgtcctcggtgatgcaatgcaaccccttcaaccccaagggcccaccaggagtggcgctgggtgggctccggatgagatccagcagtgcgccacaaaggcattgtccttgcgtcgactcagcggcgaggactgcaccttggccccgctgccgccgtcatccacgcgtgccaggaagaacgtgggcccgccgatcacagaaagcaggtgcgatgtctcctcggcgccctcgactgcggcatgcttgaggacaaagagcctcacccaggtagaaggtgctcgcccagccaggcgctgcttggcgcatggtgcnnnnnnnnnntgccctcgactgcggcatgcttgaggacaaggagccttacccaggtagaaggtgctcacccagccaggcgctgcttggcgcatggtgcagccatctgcatgggcggaattggccaggctgtccaggcacctcgcacatccaaacccctctcccgcttctcccaccaggtgcgctgaaggcaaggtccagttccggcggacgctctccggcgctctggttcagcactgtgagggtcgcagccacgcgcgaacgctcccaggcccacacaaggaccgagactgggaggttgggacccgcccacacgagacctgcgacaaattttccattccctgtggcccccacagagagtatgctctgcagtggggcaggattcaggagctctgatgagcaggtggattgggaacgcactctctgtcacagcaacacaacagaatacccctccgcacccggcatgacgcggggggcggcnnnnnnnnnnattctgataagcaggtggattggtaacgcactctctgtcacagcaacacatcagaatacctctccgcacccggcatgacgcggggggcggcgtcaactgtttccggcggcgcagggtggagacctcgatcagagacacgcaggggtgcgcccccccctctgccaccgcgagcagctgtcgaccagggaggctctccagggctgtgattccgtgggcgaatgcagaggacaagcgttgggtgcttgtctccacatctgcgaggaccagggtgttcccaaacgtccagccaagggtctggtcgtcgacccggacgaggttccgacgggcttccgtgctcgcaccgaacacatgtctgcgggggaggcgctggctcgatgagattctgagtagtttaagacgccaatgtgccggcatgctgtcccgtacttgggtacgagtcgtgccagcgcggtcgccatgtctgaccctgccccctctcgagtccaagtaatttgacaatgttcgagcagactacgccatcgaaggctcgtgaggctatcaatgtactccacagatgtcttccggggagatcgccatccatgccaggttcccccactgcgccatccccaatttgatggcgatgaccagcttcaccggtgcctccaaaccgaccctggggaggtccgacttcgaagcgggtgggacagccattcaaggtaatccaactgaaatcaggcaacagcccctcgtggcaggaannnnnnnnnncgacagccgttccaggtaatccaactaaaatcaggcaacagcccctcgtggcaggaacgacaggaggagctcagcaaagattctttcatcactcctcaaactttctgaacagcacgcaggagttgtggccaccaaagccaaaggagttggacagcgccaccttcacatccgcctgcgcagcgattgggagaggggttagcgaggtcactcgggctgctgtggctgcacagcgagggcgattcatgtgcaccctnnnnnnnnnnacagcgattgggagaggggatagcgaggtcacttgggctgctgtggttgcacagcgagggcgattcatgtgcaccct

SEQ ID NO: 23254 - DNA, 141 bp, Chlorella protothecoides
cctcccacacgcaagaagcctaggcctccagcgcccaccaaacctgtccattccccaccgccaccacaccgcgacagcagtcccccaccctccctggtcttaaggtccccaccctcccccatctccaagcggcctccacca

SEQ ID NO: 23255 - DNA, 61 bp, Chlorella protothecoides
tcggacagggcccgggacaagcctgacacgactgcagcatgatactttcgttcctgcaaag

SEQ ID NO: 23256 - DNA, 248 bp, Chlorella protothecoides
ctggagcatgtattgcgtcccatcctctgtgaacatactagacttgccagcttcaaactgtaagggttcacgtctgtgtgacctggggaaattgtacgcatcggtgcacaggtcaagcgagacttccaagcgtattgttcccaaagggtgtgccccatagagttctgccgtgactcacggagcaaagattgcgatcaagacgatgtgcatgtgatcaccatgctgtttgcaaatggtggacgagcagc

SEQ ID NO: 23257 - DNA, 124 bp, Chlorella protothecoides
ccacccgccaagaagtccccacccccaccctccaagatgtctccacccccacccgccaagaagtcaccgccaccgccatcaagccccatcccctctcctcctcccagtcctcctcctccaccta

SEQ ID NO: 23258 - DNA, 114 bp, Chlorella protothecoides
ccaagccatgcatgcagccccggccagcacctgatctgctcgagggtctctccatccaggagatacacaactgtggggacggtggtggcgttgaagcaggtgctgatgtccact

SEQ ID NO: 23259 - DNA, 68 bp, Chlorella protothecoides
cataggcgccgcaaggaggcgtggactcggtgcggagagagaacaggtggaaagtggggaaagggccc

SEQ ID NO: 23260 - DNA, 124 bp, Chlorella protothecoides
ttctccgactccctctccacctggtaaggagttgtgtttggtggggtcgcatgcggtggggcggtgccgtgggcagcatgccgcaggggctgacgggattggaagggattgctgcacccacaag

SEQ ID NO: 23261 - DNA, 123 bp, Chlorella protothecoides
aggtgtggcgtgcgtcataatgtgccgcataccgcacaaagggcgggcatggaggtctggctgcgcggaggagcaagggccggggtgcggtaggagcacaggcgacgggaccgcacagcaacc

SEQ ID NO: 23262 - DNA, 71 bp, Chlorella protothecoides
cttcctcctggcgaggacgggcatgggggccgggctggagggcgtgcagcttgctgccagggcccggccgg

SEQ ID NO: 23263 - DNA, 64 bp, Chlorella protothecoides
ggcaaaggatcacgagtggggagggcgatccacagcatgaccttcacccttcacggttgcacga

SEQ ID NO: 23264 - DNA, 114 bp, Chlorella protothecoides
tgaaagacgtgcaggcattgcaggatatttgagtttcagctgctgctgcgacctctccagaggagatgggtcggcccatggagtgtcactgtaagcaagctgaaatcaagagac

SEQ ID NO: 23265 - DNA, 127 bp, Chlorella protothecoides
gcacatcgcctgtgggacgggtggtgtggggaaggtgtgatgtatgggaaaggtgcatgcggctcttaaaggtgcttcctgaatgctgattccaaacgccatgccctgcacaccgacaccaatacac

SEQ ID NO: 23266 - DNA, 109 bp, Chlorella protothecoides
acacagcagcacccctccattttggacctgcagcgctcttgaatgccacatcctcgcctcctcaacctgcgcttccgtgtcactaggggcaatcaaaccctcactctga

SEQ ID NO: 23267 - DNA, 78 bp, Chlorella protothecoides
accggggtcttctcgccagcacacccatgcaccaagcacactgcgtgtttgacagccgagggtttgggagacctgcct

SEQ ID NO: 23268 - DNA, 75 bp, Chlorella protothecoides
gcagaggttgggtgccgcaactcccatggggccctagcctctgcgtgagcaaatgtggaaggggcgcgcacatcg

SEQ ID NO: 23269 - DNA, 79 bp, Chlorella protothecoides
gcgccttgcgcgatgcattgcgctgctgggttcaggagcctggccaccatccagcattcctgttcgcaccttgacctcg

SEQ ID NO: 23270 - DNA, 76 bp, Chlorella protothecoides
tccatgccaaggaccagcatctccatggataaaaatagcctggaacagtttaaacgatggacagtgcaccctcagc

SEQ ID NO: 23271 - DNA, 61 bp, Chlorella protothecoides
cgatcgtcataaagggtggcatccctatccgcccgtcaacctcgggtggtgggctgtgcct

SEQ ID NO: 23272 - DNA, 80 bp, Chlorella protothecoides
gtcgttaccttctgctggatgtgatgtaacggaatgactgggagataaagattggcaggatagccctgaaggggtgtcga

SEQ ID NO: 23273 - DNA, 112 bp, Chlorella protothecoides
ttgttgtagttgcctgcagcatgtatgtgcgcttgttagacatgctgtacactccggtgcacaggttgcgcagccgggggaccccccgggcttaccatagttgttgctgcca

SEQ ID NO: 23274 - DNA, 144 bp, Chlorella protothecoides
ctcgccctgtgggagaagagaacgggtgcatgctttggacgagctccaagagagtgcggggcggcggcacggcgttgttcccgacagtgagcgacaccgtccaaaaccccaccccctccctaccccaagcacaggaaccgtgcc

SEQ ID NO: 23275 - DNA, 61 bp, Chlorella protothecoides
gaaaccgcaaatgcatgggaggtgcgcctcaccatccatgccaggctcagctatccactga

SEQ ID NO: 23276 - DNA, 76 bp, Chlorella protothecoides
ccaccccaagacggctctgagcacacggcgcgccctcgaggactccaagctgaccatccctctcctcctcgagtac

SEQ ID NO: 23277 - DNA, 78 bp, Chlorella protothecoides
cgggataaggaccatgcgcgagcaaggtaaggcatttccacattcaacggcacagaaggggtgcatagggcacattaa

SEQ ID NO: 23278 - DNA, 61 bp, Chlorella protothecoides
caggcggatgtggctagcatcctggcgggggacaagcagctggtcttgcagtacgaggccc

SEQ ID NO: 23279 - DNA, 67 bp, Chlorella protothecoides
gcaccgcacatccaacactgcttggcaatctcatgtgactctcacctcctgtcgaatgatggtgggg

SEQ ID NO: 23280 - DNA, 113 bp, Chlorella protothecoides
acctcgcgccctgaggcccccttccgtccaaaaagccaccccggcctcatgcaggctggcatacagccgctcctcgtacgcgctgccggcccgcgcccgtgcgctgtcggcgc

SEQ ID NO: 23281 - DNA, 209 bp, Chlorella protothecoides
cttctccaccttcatctccaagtgagatttccatgggagagggagagggggttgtagtgggcagagaccttgtggcatgcggtgcccttggtgctggctcatgtgtagtggccaagggaggtaccaagttgaggtttgcgccatcaatcacttggtcagagctgcaaacttgccaccaaggcgatgcagcatcaagcctcctcagtcct

SEQ ID NO: 23282 - DNA, 20595 bp, Chlorella protothecoides
  modified_base (753)..(762): a, c, t, g, unknown or other
  modified_base (1326)..(1335): a, c, t, g, unknown or other
  modified_base (1774)..(1783): a, c, t, g, unknown or other
  modified_base (2007)..(2016): a, c, t, g, unknown or other
  modified_base (2492)..(2556): a, c, t, g, unknown or other
  modified_base (3179)..(3188): a, c, t, g, unknown or other
  modified_base (3349)..(3358): a, c, t, g, unknown or other
  modified_base (3968)..(3977): a, c, t, g, unknown or other
  modified_base (5408)..(5417): a, c, t, g, unknown or other
  modified_base (5488)..(5647): a, c, t, g, unknown or other
  modified_base (6968)..(6977): a, c, t, g, unknown or other
  modified_base (7188)..(7197): a, c, t, g, unknown or other
  modified_base (8720)..(8729): a, c, t, g, unknown or other
  modified_base (9356)..(9365): a, c, t, g, unknown or other
  modified_base (9587)..(9596): a, c, t, g, unknown or other
  modified_base (10528)..(10537): a, c, t, g, unknown or other
  modified_base (12351)..(12360): a, c, t, g, unknown or other
  modified_base (12679)..(12688): a, c, t, g, unknown or other
  modified_base (13152)..(13161): a, c, t, g, unknown or other
  modified_base (13624)..(13633): a, c, t, g, unknown or other
  modified_base (14750)..(14830): a, c, t, g, unknown or other
  modified_base (15196)..(15205): a, c, t, g, unknown or other
  modified_base (15808)..(15817): a, c, t, g, unknown or other
  modified_base (16336)..(16345): a, c, t, g, unknown or other
  modified_base (16842)..(16955): a, c, t, g, unknown or other
  modified_base (17094)..(17103): a, c, t, g, unknown or other
  modified_base (18605)..(18614): a, c, t, g, unknown or other
  modified_base (18693)..(18702): a, c, t, g, unknown or other
  modified_base (18902)..(18957): a, c, t, g, unknown or other
  modified_base (19721)..(19730): a, c, t, g, unknown or other
  modified_base (20412)..(20421): a, c, t, g, unknown or other
gaagcagattgcagatcgaaccactcggcctgtatagttttgcgttcaaggcaacgtctcttgtgcgggggtgtataatgcaaagagatgctggaaagtggcagaatcatagatgtgcacacttcctggacagacacccccacagcaaaacactgctgcctagcactacagcctcgcaagcgcgttgggtgcatgtatgtatcactgtgttagatagttgagagcaaaagacgcaagcccaagtgtgacccagtctttgagaccttccaggatctctgcctttgcagaggcaaaaattagggagagatctcacggtgagctttacgcatgaaaaatggtgtagaatgcgaatcttaattcgttggggatcttgaaatgctgccgctgctggggtttgaatgcagtgtatatgcgattcatacgagagtgtgtgaccccttgacatcaactagcgatctaaactctgtccagtgcttgtcaaggatgccctgttgcgacactgctgctgtcgaggaacccatggaaatgagcatacgtcccttacaattgcctgctgttcaccaaaccccttgacccctactagaagctacaattgtcagtacaggggtcagacatatgctctctccaatgggactgcttgcgcctgattccgaggattgacctgggggatgattacaaactcactccctggatccattcatagcttccggcagaactggaatgtcccttcgccgcctgccgacgtgtccatgnnnnnnnnnngttgacctgggggatgaatacaaactcactccctggatccattcttagcttcccacagaattggaacgtcccttcgccgcctgccgacgtgtccatgctgggttgtcggagcgcctccctctgtttgcgggtacttgagagacaagccccacctttctggtacacaagcaacctcactttggagcaccacccagcaaagctgacagcaaacgcgcttcgacgctcttggatcgactgtgctagttgcagaagcattacggctgctggcggcacgctcgtcgcgcacagccatgtccgacccggcatggagccctgacgcccggggaaagacactgaccagactcaactctcggcgggtgctggacaacccctccagggagctgggccccgtcttcaacaccatccctggctgggcagaggtgaggggggtcccgcacctgcgcggcaccgccaggccaacttccacgaacgtcaaaaccaaatacatacttccacacgacactgtatcccaggtggacaccagcaccgtggtaacggagcgcatctccggggccatgacgaacnnnnnnnnnnatcgaaaccaaatgcatacttccacacgacaccgtatcccaggtggacaccagcaccgtggtgacggagcgcatctccggggccatgacgaacctggtgttccgctccacctgccccaccgcggaggcgtaccccaccgtcatcgtccggctgttcggcccgggcaactccctgttcagccagaaggaggagcgggacgtgttcctgctggcgggccagacgggcatcggcccgcggtgcctggtggagttcgagggtggcagggtggaggagttcatcccgggggcaaccctgtccgcggccaccatgcgcgcccccgagatcgtgcagctgacggccaccgccctggccgtgttccacgtgcgcatgacggcccaacgcgccgcgcgcggggccgtggggcccaaagaccagcccgccatcttccggcgcatcggcnnnnnnnnnngcgcgccgctcgcggggccgtgggggccaatgaccagcccgccatcttccggcgcatcggcaagtggcacgccaccgccaccggcctggcacccgccctgctgcaggagcttggcctggaggacgttatggacgaggtaagctgccttgaaccttggttaagggaaggggggttggggaggtggtgtgggcagccctgctgcctctggatcgtgctgtgaactnnnnnnnnnnctggttaagagagggggggttgggaggtggtgtgggcaaccctgctgcctctggatcgtgctgtgaactgatcccagggcccatattgcatcggaagggtccactcacccctgccactcctttgtggcccgccctcctgatgtgtaccgtgcaccccttcccccttcatccccctccaccacacacacacgtacgcaccactcatctactctcttcaggtggcccagctgcggcgctaccacgagtccaccttcccactctggctcggcttctgccacaacgatctgcagtacggcaacatgctcctctgccccggccgggacgcatcgccgcagggatcccccgcgggcccggccgaggagtccgccacgccgccgggcagcccgcgcgccgtgctggcgtcgggcgacgcgctggggctcagctaccccagcgcagaccccggtctggcgtcggcggcgggcggcggcgacgcnnnnnnnnnnnnnnnnnnnnnnnnnnnnnnnnnnnnnnnnnnnnnnnnnnnnnnnnnnnnnnnnngcccggctcgccgccctcgccccgcgcggcgacggagcacatacgcctgatcgactacgagtacgccacgttgaacgacgtggccttcgacgtggccaaccactggtgcgagtacgcggccgactaccactcgggggaggcccatgtgctggactttgccgcgctgcccggggatgaacagaaggcggccttcgcggaggcctacgcggacgccatgctggcacaggcggcggcgggggcgggcaggctggcggagcgggtctgcgctggtgaggtcgacgccgggtgccgggagcacggcgccctggcccgcctgctcgtgcagaaggcggaggcctacgtccccctgtcccacctgaagtggggcctctggggcgtcatgcaggtgtgtgttggggaggttgtgtgggggaagggaggcggaatgctatcaaggggaggcagacatgagcagcggtagtatctgcgatcgctggggtattccactgacagaagccctcatcctcgctcaaacacccacaggcccagacctccgatgtcgacttcgactacctggagtatgcgcgacagaggatcacgcagtaccacgccaccaagacacggtacctgtgagataagccagnnnnnnnnnngatgcaggtgcgtgttgtgggggaagggaggcggaatgctatcagggggaggcagacatgagcagcggtagcatctgcgatcgctggggtattccaccgacagaagccctcatcctcgcccaaacacccgcaggcccagacctccgatgtcgacttcgacnnnnnnnnnnccctttcttttccagttcctaaggttctatctgttgtgcacgctgggcgtcatgccttgaactgcagcccgtgcccattgctgaagtctgcctattgcgtcttgtatcaccctgccgcccttcatcatcgtcttgtcacttggtgtccaccgcaaacacatgcatgcacatgcagttgggcagtcgcaagacatacaagggggtgggtggctgcgacctccacagacccagcggctcctcccagggcagcctctcagtatcctcagggtagctccggctcgccctcccctcggccccgcgctatgaactcctcgatgctgtccgcatcggtgggcacactgcgcgacagcactgagcatcctggcgagtctgcggcgaggcagggcgaggcttgcggtgggttaacacagcgaagtaaggacctatcgtgacagcaggcgctcaccgccttttccatcaatgggatcagggcgacagacagtcatcgatgcccacgtcgacggctccggcatccaggacttggcaatctccgacacacccacgcgatgagcatcgtgtaccagcccgcccttcctgccggtcccagcccacgtcctcacccacctccccnnnnnnnnnnagacttggcgatctccggcacacccacgcgatgagcatcgtgtaccaacctgcccttcctgcctgtcccagcccacgtcctcacccacctccccacccctcaccccttgctcaacccacccactcttcaccgcaccgttgatctggaccacgtcctcgatgcgcacgccgatgccggccagcgcgccgtaccgctcctggtccgggatgtacagccccggctccacagtcagcgtgacccctggctggaggggggtgtcatgtgccacacccggcacgtcgtgcgtgtccaggcccagccagtggcccacgctgtgcgggtagaaagcgcgaatggcgccctgcgcgatggcgccggcggagcgcccggggagcaggcccaggtccgacacgccctcggtcagcagccgcacgctctgctcatgcagctggcgcagcgtagccccgggccggcaccattcaagcagctgcctgtgtttgggtgggtggatgtgtgtgtgtgtagagggggggggcggcgggtaatataatggtgggtcggtgtgtttggtggtcgcagtggtggtgtgcagctctccgccccaacccctcgccccaacccccctcccaatcccctgcctctcaatccactcactgctgcacgccatgcacgacctggtacacgtcgcgctgcgcgggcgagaagcgaccgcccacgggccacgtgcgcgtgacgtcagagcagtagccgtgcagctcgcagccgccgtcgaagagcagcgcgctgcccggggctagggccttgtcgttgcgcgagtagtggatggtgcaggcgtcggcgccggaggccaccacgggcgggtaggccatgcgcgccgcgccgccccagcgacagtcgcgctcgaagcccgcagccaggtggtgctcgccgacccccggggcgcccgactggcgcatggcgcggagcagccccgcctcggccagggccgaggaccgcgccatcagcgccagctcgccgggcgacttgcgccagcgcgcggcgtgcgtcagcgtgcgcagcgcgcgcagcgcgccctcccgcacgcccagttccgcggttgagagggcgcggagctcgctggaggcgtggcgcccggcgtcgtagtacacggccgacgaggagcccagcatgcgcggcagctggcgtggcagctgcacgggatttgggcggggcaggggagagggaagggtcagatggatgaggccgtgcgggggggctggtgctggggcgcatgaggcccattgggtgggcgactggctggtggcggccatgtcaccagtctcaatggaccctgcacaacccagcgcgccacaacagcgatgcccatccttggcggggaaaaccttcccctgcatacacaagaccacacagataagcacactccggatgcaggcagcacctccgacatggggnnnnnnnnnngatgaggcccatcgggtgggggactggctggtggcggccgtgtcaccagtctcaatggaccctgcacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcggccacggcgccaaacacgtcggtggcggcggcggctgagcagcgcgcgccatcccagcgctcccgcgtctcgtcggggtcggtgacaaagagcaccatgtccccctgccccgctgtgatcagggccaccgccccgggctgggtgatgcccgtgaggtacaggaagtcggcatcctggcggtaggggtaggggatcacgcccgtcatgtaagccacggcggtggcggggacgagggcgcaggaccccaggggcatgcgcgcggccaggctggcgcgccgcgccgcaaactcggaggcctggatcccgggcgccagctcgccaggggcgaggagctggggagggaaggaggaaagaagggtgattcttgtcacggggaagctctggccatgttttggggaaaaaaggcctctacccatggcagcttgtccttcagacaagcatcatgaggtcaagagtaaactctattgtactcagaagcctccacaacaagtcagtttattcccatccctctgcaccttttgtgctcagtgacctcctcccccaccctacatacttcccactgccgtacctctgggtgtgattcatgggtgggctgacccactagagttggcaacgccgagctcgcttgcacagaggggacgacgcgagaaacagcccggcgcaggccaccgacaacggccgacatggggctgagaggggagccttcacttgctccctctcttcgcggtaaaacactgcaccacttttcacactatcatgcactgagtcatgctataagcgaatgatgttgcctgagaagtgagtgtgtttgaggtgcccactgctgcacagccttggacactatccggccttcactcaatcagagtgctcgtctggtcatcctggatcaactcaattcagtcggtgaattaatcttactctatatgttctaccacttgtccgaaattgactggaaacgttatagcgaccaatgcattcgagtggtggtgacctccaaggcaatcgctgcgacacaagtcgtacccttcccgccaggagcaagggcgcgcaggtttcggacgacgaaagctcctgcatggaggcaatacagatgagaaaggacccagcggtcttcagatacccattgcatgctcgaatttaccttgaagtctggtccagaccacaccccatccctgtgcaacctgtcgctgcaagagccctcgggcaaaccctagggtgtcggtgataggatcgggaagggttaccgccctgcattcctgaaatggtcacggcctccagtgatgtggatcccatagtttacatcaatggaaaacgnnnnnnnnnntattcctgaaatggtcacagcctcgagtgatgcggatcccatagtttacatcaatggaaaacggtatgtgctcccccctgggcgcgcggagtggaccctgctgcaataccttcgaggtaggaccagtttttgagatccctgggccggcagtgattgctgatgggaggggcgatgctggcatggctgccgatatgccggctgcacatgcggnnnnnnnnnncgaccagtttttgagatccctggggtggcagtgattgccatgggaggggcgatgctggcctggctgccgatatgccggctgcacatgcggtttgcctcattcaaacgtcctgaggagaacatccccccctcctcccccatacacctgccctcccgctcccagaggtggggctgacaggcaccaagctggggtgcggggagggcggctgcggcgcctgcaccgtcatggtctccacctgtgagcctgacagctccctcctgcaccgcgccgtgaacgcctgcctgtgcccgctgtatggcgtggagggggcccacgtggtcaccgtggaggggctgggcaacccgcgcgacggcctgcatcccgtgcaggcccgcctggcgctggcccacgggtcacagtgcggcttctgcacccccggcttcgtcatgtccatgtatgccctgctgcgaagcaagcccgagccccccacggagcatgagattgaggaggcgctggcaggcaacctctggtgtgcctgaagtggaggggctggcgtggtgtgggatggggggagcatgtttgggtgctggactggacacccacaaggtgtggcccttccacgcatcgacatcccccccttggaccacttttaccttctcagttccccacgtccacccctcacagccgctgcaccgggtaccgccccatcctggacgccttccgggcctttgccaaggtcgacccgggggcgtacacggaggaggcgctggcggcgcacaaggccaacggcatggaggcgcccgtcgtccccgccccaaccaacggcgccgtctgccccagcaccgggaagccctgcgactgcgggggggtggtcagccactcggaggacaaggggcagggcatgggtcctacaactcggaccccgggcaagcagtcgggtgggtactggatggatgtgtggggccggggtggacactgcctttcacggcctttgtgaaccctggtgaggcttggctgcatgccatgctctgtgcacggcatgtgggccgccgaatctgaggcccagtggacatgagttcaacagggtcgctggtgacggaggattcccttcttcttccagcagtgcacccttgccctgcactccttgccctgccctccctgcaccgggtctgggctgggaccagacaccctgccattccccaccacccccctctgccacccccgccgccccggcagccgagcccatcttccctgcggagctgcgcaggcgcaggcccctggagctgagcatccccggcccgcaggcggcctggttccgacccaccaccctggatcgtctgctggagctgaagaaggagtacccgcatgccaagctggtcatcgggaatacgggtgagaagggaaggggcattcttggcactggcccaaccccgcctctctcgtacctgccagcgtccacccaacctccaatctctcaaatcacccttcgatcccaccaccctccacaattcctctcccaaacatacagaggtgggcatcgagcnnnnnnnnnnacccgcctctctcgtgcctgccagcgtccacccaatttccaatctctcaaatcacccttcaatcccaccaccctccatgattctgctcccaaacatacagaggtgggcatcgagctcaagttcaagcatgccgcctaccccgtgctgatcggcgtgacacatgtcgccgagatgaacgagttgaccccgggggagaagggcgtgacggtgggcgcgtcggtgacgctgacccgcctgatggagtcctttgccgcgctgcgcgccagcgtggcgcctcaccagcgccccgtcctggccgcggtggtggagcagctgcgctactttgcggggccacccatccgcaacacggcgggcttgggggggaacgtggccaccgcctcccccatctccgatctgaacccgctgtggatggcagcgggggccaccttcttcctccgcggccggggcacaccggagcgcgccgtccccgcccgcgacttcttcctgggctaccgcaccgtagacatgcaaccccatgaggtcctggtcaaggtgaggggttgaatcatatgtgctgagcgggggggaggaaagggggaataaacggcggtggatactgaggaatgcaagaagtgctcgatcctctgnnnnnnnnnngaaaggggggataaacggcggtggatgttgaggaatgcaagaagtgctcgatcctctgggatccgcacatccagccgctcgtgcatgcacagtgttttcattgcacatccagtccaccgctttctcatccccttcaacgaagcaacaacaacaccccaaacccaacccgcgcccagatctttgtgccctacaccgccgagcacgagtacatcaaggagttcnnnnnnnnnncttccatcgcacatacagtccaccacattctcatccccttcaacaaagcaacaacaacaccccaaccccaacccgcgcccagatcttcgtgccctataccgccgagcacgagtacatcaaggagttcaagcaggcgcaccgtcgcgacgacgacatcgccattgtgaacgccggcatccgcatccgcatggcgcccagcggggaggaaggtggggctggaactgtatattgtgattggggacgaggttgtgggtggagaacgcctccctctgtgtgggttcccagggtggtttcaaggcgcaagggtccagagcgcatatcctcatctcatccctcctcgaccgccgcctacccacaccatgcaaccacctcgcccttcccccctcacccccccaaatccacccatccatcacaggggcctgggtggtggccgacgcatcccttgcctttggcggcgtggcggccaagagcatcatggccccccgcgccgccgccgcgctggtcggccagccgctggaccctgccgccgtgcagcgcgccctggcagcggtgcgggaggaggtggtcattgcccccagcgcgccgggcggcatggtggagttccgccagtccctagtttcttccttcctgttcaaggccatcgtgcacgccgcgcatgccctggcggaggacgtggaggcctacgccagcgccttcccgccctcctacgcctcgggtgggtgggggttgaatgggagggggatggtctgggccacttccctgttgtttctgggaagtcgaagagcgcttggacatcgatgccacgctttgtgccctggcatgaaatgctcaccccaccccagggtatcatgccgtgtgaaatactcacacacacactcacgtccacgaaaccctgcacaccacctcctcgcagccatcacgccgtacagccnnnnnnnnnncggacatcgatgccacgcgctgtgccctggcatgagatgctcaccccccccacccaagggtatcatgcctcgtgaaatactcacacacacacactcacatccacgaaaccccgcacactacctcctcgcagccatcacgccgtacagccgcccgcccagctgcgggctgcagtaccactccgcggtacccgaggaggacgtggtggggcagccataccggcacatggccgccgacttgcaggtctgcggcgaggcgcagtacaccgacgacatcccgcccccaccgggaacgcttcacgcagccctggtcccctccacccaggcccacgcccggctgctgggcgtggacaaggggcccgccctgctcgtccctggcgtcgtcggcgtgttcacggccgaagacgtgccgggggggaacgacatcggggccgtggcacacgacgaggagctctttgccacggtgggtttctggattctggggggggggaggggagtgttgggttggcatgggcggcccaatctcgctgcaacctctgtcttgatcgccgccgcgcatggcgctgcccgccccgccccgccttgccctctgatcgggtcccattccaaagtattcctacttccccccacttcaactccacaggagatcgtgccatgcgtagggcaccccatcggcgtggtggtggccgagacggaggcggcggcccgcgccggcgcccgcgccgtggccgtccgctacgagccgctgccggcgctcctggacatcgacgacgccatcgcggccggcagcttcattgagggctgggggcacagcgtgcacagcggggactgcgccctggccctggaggcgagcgacgtcgtgctggagggctgggtcaagatgggcggccaggtgtgtgtttgtgttttttgggggggggcctccggtggggtatccaatgtatttggtcaggtttagggtgcttgcacagggagggcagggcggggtttgtgccaaggtgcgatcactccagggcaatgggccaaggatcgacgtgccctcacctattcggtgcacgctcgcgcccaaggcctggcgtccacccccattcctattgcgaatgcttggctggccatcctctccccccccccgccattcacgggcgcccactcctccacaaacaggagcacttctacctggagcccaacgccagcctggtgatccctggcgagggcggggaggtgacctccttctcctcctcccagtgccccgacaagcaccaccgctacctggcacacgtcctgggcctgcccatgcacaaggtgacggtgcgcaccaagcgcctgggcggcggtttcgggggcaaggagacgcgcagcgcgttcgtcaacgccgccgcggcagtgcccgcgcacctcctgcgccgcccggtgcgcatctgcctggaccgggacgaggacatgcacatcacggggcagcgccacgcctttgccgccaagtaccgcatcgggctgagctctgccggggagatccgcgcgctggacgtggacatctacaacaacgcgggctattccctggacctgtccttcagcatcatggaccgcgcgctgacccacatcgacagcgtgtaccgcatcccagccatccgcgcgcaggcgagggggtggcaggggggatgggggatggtgtggggggcaaggtgcagaggggggggtgagaaattgaaaaggtgcatccatgaaggaatccagggtgggaccctttccttgagtagagcatgctcaacaataacaagaaaggtacctactgtgaccagatcctccaccgctcccccttnnnnnnnnnnaagggggggtgggggatggtgtggggtgcaaggtgcagatgggggggggaggaatcgagaaggtgcatccatgaaggaacccagggtgggacccattccttgagtagagcacgctgaacaataacaagaaaggtacctgctgtgaccagatcctccaccgctccccctttctcaatagggctggctgtgcaagaccaaccagtccacacacaccgccttccgtggcttcggggggcctcaggtgggctgtgtggcagcgagagagacgcctgatgaagtgggattgctgactggaaggatgtggttgccctggccgtgnnnnnnnnnntggggggcctcaggtgggctgtgtggcagccagagagaggcctgatgaagtgggattgcagactggaaggatgtggttgccctggccgtggcacagccgatggtggcctggctgattacgcaaggagatgcttgcatccaaacgctgatgactctgtctgcacacatgaaaccaactggaaacccctccaaaaccacagggcatgctgatcatggagcagatcatggagagggttgccaaggagatggacataccgctcaacaccctgcgcgagcggaacatgtacaatgtgagcgaatgattgtgggtaatgggccctgggcaccacacctgtggaccggaagcgcagagggatggcctgtcttgaaagtgcatgtcatacacccttatggcatcctaccagcacagcccctcagccccctcgcaaaattctcgcactgcaggagggggacgtgacgcacttnnnnnnnnnnctatggcatcctacaagcacagcccctcagccccctcacaagattcccgcactgcaggagggggacgtgacgcactttggccagcggctggaggggtgccaggcccggcgctgctgggaggaggtgcacaccctgtctggctgggcagcgcgggaggccgacgtggcggccttcaatgccgccaaccgcttccggaagcggggcctgtccctgctccccaccaagtttggcatctccttcaccaccaagttcatgaaccaggccggggccctgatccactgctacacgggtgaggaggtctgagaggatgtggcggcaatgttgtgggggggtaatgggcctggaagcatgcagggactgggtggtccatgcatcggcacagtcgccttcatcctctcagtgggatcactggttgtggcccatactgttggcgtggaaccccaaaatacccatgccgatctgnnnnnnnnnnagacgttgcggcaatgttgtgggggagataatgggcctggaggcatgcagggactgggtggtccatgcgtcggcacagtcgccttcttcctctcagtgggatcactggttgcggcccatactgttggggtggaaccccaaaatacccatgccgatctgctccagccgttcatcccatccgctcacccccgccccaatgcattctccagatggcactgttctggtgactcatggcggcgtggagatgggccaggggctgcacaccaaagtggcccaggtgcgcttggtaatactagggcggtacccctgtcttaaatcctcttggtgagagaatctcctgagatgcagccttgtattttaaaccccacccccctcccccgcaccgtccaacccaggtggtggcgcatgccctgcagattcccctcgcccaggtgtacattgccgagacagccacagacaaggtgagggaaggggcgctcctgtatcttggcaagcttggttgtggggtgctaggatgcccactcaacagcagcagcagtgctgtctgggcctggcgccaggctgggcatggtccatgtcgtgcagcatagcgggaggcaaaaatgcccggagatcctttcattgatatgatgagttgatcgccgacccttaccccatcaaccctgctgcagatcccaaacgcatcacccaccgccgcgtccgcctcttccgacctgtatggcgctgcggcagcagatgcatgcgcccagctcaatgcccggctggagccctacagggctaaacttcaggacaagagcttcaaggtcagtaccgagccaggcagggaaagtctcacggcccagggaaaggtgttgcagagtctgccgcgatggcagctgctgtctgcttgttcagtaccagccgccaatgccctgcaatccatggccaaacccaccattatctccaaaccaggacattgtgaacgctgcttacttggatcgcgtggatctctcggcgcacggcttctacagcacgcccgacattggcggctttgggagcgagaagccctacaactacttttgttatggtgagggagggggtgggggagggggccgcaaggatcatggggtgggtgaggnnnnnnnnnnnnnnnnnnnnnnnnnnnnnnnnnnnnnnnnnnnnnnnnnnnnnnnnnnnnnnnnnnnnnnnnnnnnnnnnncacaagcaatgtgtggggcttgcgtccggcctgtaattgccctttgcatccctcagatgagtgtgcacgatgcccctttccttcaggtgccgctgtggcggaggtggaggtggacaccctgaccggcgacttccacgtgctccgtgctgacgtggtgatggatgtgggcaagagcctgaaccccgcgattgacattggacaggtgggtgctgggctttcctgcaggaggatgttgggggtgaggcccaagacgagggacaggtgcaagtcctaagcgccccacttctctcacgtcattgatccagcgatgatgcagttaccatgtgcacccattcccagcacttctctcccgcttcctgtgtaggnnnnnnnnnntctgcaggaggacgttgggggtgaggcccaagacgaggggcaggtgcaagtcctaagcgcccctcttctctcacgtgattgatccagcgatgatgcagttaccaagtgcacccatttccagcacttctctcccgcttcctgtgtaggtggagggcgcctttgtccagggcatgggatggtcttgcatcgaggagctggtgtggggggacaagaagcacccctgggtcaagccaggctggctctttacgcgtggtccggggacgtacaagatcccgtccgtcaacgacatcccggtcgacttccgggtgatgctgctgcgcaactctcattgtcacaggacgccccaggtgtgaagggggagtctggggtggagtttgagtggtgacacagggcaagcagatggatgttggctaactgaagagtacctcgcgtgcaagcacactgtgaattgtggcagggagcccgcatgtcaagaagaactttgtgtcagctgcatgggcgcacacaggtgctgccttggcatgtcctgcctgtctgggagcagtgcgcctctgttctgacaaatccctgaccatcacaggtgcactcctccaaggccgtcgnnnnnnnnnnatcctctgttctgacaaatcccttgatcatcacaggtgcactcctccaaggccgtcggggagcctcccttctatctgggagcttccgtcttttttgcactgaagaacgcagcctatgctgctcgccaggatgccggtgtgtgctggaggtcgggctggaatgtgtggcaaatatcgtgggtggcttcctgtaatgtatgtcagccgactccctatccttctgtcatatcgtatgcgtttccctggacaatctacctcaacgtggatgcacccgctcccaggtctagagggctggttccgcctggactccccggcgactccagagcgcatcaggatggcgtgctgcgatgagctgtcggccccttttgcaggcccagacttccaagccctggccagctgctgatactttggagggagcgccaaatgccattctcttgccatgccctccttccccactgtaccctacttattgtcattctcacctagaaagttgtactgctccgaagaatatgtttgcttnnnnnnnnnntccatgcctccttccccactgtaccctactaattgtcattctcacctagaacgttgtactgctccgaagaatatgtttgcttgtgtaattatgcagattggaagagtcgcagcattctaggggctgttgcccagtgcatcgaaacaattccgcctttccaccacccaatcctggagaacgattggggatcttgtcggtgccgagtcgatcgaggaggccttgcgcggccccgaaaggagaggactcacgctggatcgcctgctttcgacacctgcttgacattacggcacagatagacctccctcgcagcataggaagggcgccatgcagagtgtcaggagcttcaccggcttcagggccaatgccctccggccgattgcccacaaggtgatgaacggcctggtagcgggcgaggtgccatcatgtactgatacttgttgtcacgggtctgttgtacctcgaccatacttccctatccgattcccgctcgctccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaacgtggtgagtgaggccttgtcgggctcaacgaggtttgacactgttagtcgcccatcgggaccgctcgttttcattcttcatagttgtgcatgatgtccgtcgaccgggttacggctgcagctgtggctactnnnnnnnnnnagttgtcacgggtctgctgtacctcgactagacttccctatccgattcccgctcgctccgtttcgcaggcggtgaccagccggtctagggtgatggtggtcacccgtgctggctacattgggtccccaaccaacgtggtgagtgaggccttgtcggtctcaacgaggtttgacactgctagtcgcccatcgggaccgatcgttttcattcttcacagttgtgcatgatgtccgtagaccgggttacggctgcagctgtggctactccactgttcatcatgtgtgagtgtaccaatgtccacctgccccccaccctccggccctgctgttcagatcatggtgctgtccaccttccttcccatcgtggcgggcaggctgggccttgcccccaccgcaacccggcacaccacccccggcctgaagctgtatgaggacaagtccgcgggcctcatcagcggcgacccggcaggtgcagcgcggatcggaggggaggatggctttgcatcagtttgaacggaggcatggcgctgggaccctgcgcctgaaaccatggcctgtcattccctcgttcggatgtcgccccattgcagctgtcccctgcccacaagcacgctccacccgccccaaccctcccgcacagggttgaccatttgggatgtgctggcgctgggcgcgctgggccacatcattggggtgggcattgtgctgggcctgcacaactctggaaacctgtagggaccgccgtcgaatgcccccccgcagtggggatgcccgaggaaagcgggacgccagcaggcaccgtaaaaatgagaagacctgcccacagaattgagcgatgccaagccggctctcggcttgacccccagccaaaaggccttgtctgatgcagaggaagtcatccttgtaacaacatggaggaggctggtgttgcagctcggggggatttggttgttttaccgaggttgatgagcgcgctgaatcagaggggcgggcgcggacagaatgatgtgggtgtcggatgtgccttgtgctgccacccacccgaaatggagcacggtttagactcgagcagggggcggaatattgccaagaacatcgtactcgagcatctggcccacacaccagggtcggcaggacactccgtgaggcacccagtacccgaccactcctgttgacactgctcccgacatggctgccctcgcggctcctctcaccgccacatttggcgcgtccagcagcgttcgatcatgccgacccagcggcatggccttcagggcctcggcgatgcgtgcggctcggccccagggcctccgcctgcacgccacccggatggctgagatctcgccccccagctcctccggcaagggtgagaggctcggatttaaaaattgcttggaggggatcctcacatgtcatgcgccttgccgcggatcggtcgcaggaagggagtaccacgccgtcgcccgtcccccccccatgcaggcggtgccaagcccaagtccnnnnnnnnnngggggtccgcctgacagaatcaggatccaggaaagggaccttgctctcagcattgctactctaaccagccctttgaccnnnnnnnnnnaagaaggaggaggagtctgactcggagtctgaggacgagttcttcgacgaggatggggagggtctggacccacagcaggtgtgaggctaggtggtgggaagtgggaagagcaaccaatgattggggtctgcctgacagaatcaggatccaggaatgggctcttgctcttagcattgctactctaaccagccctttgaccnnnnnnnnnnnnnnnnnnnnnnnnnnnnnnnnnnnnnnnnnnnnnnnnnnnnnnnntcctggccacgctgtgcgagggcaccgacctggcccacctggagctgaagctccccgggttccagctgcgcgtgcggcgcagcctgagcaaggctgcctcccctgccgcggcagccgccgcccccgtcgcggcgccggccccagtacccgcgcccgcccccgcgcccgccaccccccctcccgttgccagtgccgacgaggccgatgagtcgcgcctggcggtcgtggcgaccaaggtgggcgtcttccggcgcgggcgctatgtcaagggcaagcgcgtgggcaagggcccactggcggctgcgggcgacagcgtgaagaagggtcaggtgctggccttcgtggagcagctgggcacgcactggcccgtggaggcgccacagtcgggggaactggagggcttcctgctggaggacggcgaccccgtagagtacaaccagactgtgctggagctgacccccttctttgggggccacatcatcggcgacaagaagtaccggtgaaggcggcgctcgaggggtggctgctcaagttgtgatgccctgtaacaaccggtgacgaacagtgagtggggagagcagctgccggtgggagtcgaggggcccggggccagcgcggagtcgaggcgtggctgaccaggcaaagcagcgagggggtggtagcgcttgttggaacgatgtcccaaggtcccaagtctacaaaagaaagtcatcacccgatgccaatgcaagcccaagcggcgtcacgccgccctgccggcccgnnnnnnnnnngaaaaggaagtgatcacccgatgccaatgcaagcgcaagcggcgtcacgccgccctgccggcccgcaggcgcagggtggccggctcggggcccttgtccgggccgccgtcgggctccacacctgcttcctccgccacaccggccctcgccggcgtgctctccgcctttcctttgtcttgcgccggcgcagcccccgccccctcgccgccttgcgcccttccccctgcctcgccatcccgctgcgccgcggcgcgctgtgcacgcgcctgcgcctccaggcgctcgcggagcgcacgggcggcggcctcgcgctgcgcggtcgcgggcgcgctggagcggatgacgaagagcaggctctccaccagcagggccagagtggcgaggcccaggcccgccacatgcggctgccagcccgggggcagcgtggcgcggcccgccaccaggccaaaggcgtagaaggcggccatcgtgacaatcacgtgcaggcctaacgacacctgctggcggtaggagccgaagccgtgcgcagcggccgtggcggcccgctccacggccaggacatcgtacaccatggcatcgtaagccgcctgctcccggcgccgggccaggccctcgagcagcgctgagaactcgggggatttgccgtgcggggggcggcggggggcggggggcaccaagccgnnnnnnnnnncggcggcccgctccacggccagcacatcgtgcaccatggcatcgtaggccgcctgctcccggcgacgggccaggccctcgagcagcgctgagaattcgggggatttgccgtgaggtgggcggcggggggcggggggcaccaagccgctgccccggcagacctggcattaggggt

SEQ ID NO: 23283 - DNA, 175 bp, Chlorella protothecoides
ccagcagcggcagcatttcaagatccccaacgaattaagattcgcattctacaccatttttcatgcgtaaagctcaccgtgagatctctccctaatttttgcctctgcaaaggcagagatcctggaaggtctcaaagactgggtcacacttgggcttgcgtcttttgctctcaac

SEQ ID NO: 23284 - DNA, 127 bp, Chlorella protothecoides
cgcgctggagcagcaacaggcctccatcctggcgcatgtgagctgctgggagggaagtctgagaatgggggggattgagatagggagtacgtggccatttactgacaaggtgctggtctgttgcgac

SEQ ID NO: 23285 - DNA, 71 bp, Chlorella protothecoides
cacacaaggcccaacagggggcagcacagcggattggttttgatctcacctgtgcccatccctgggatggg

SEQ ID NO: 23286 - DNA, 67 bp, Chlorella protothecoides
ccaatccagcttaattaccgaggtctaatgagatcgaatgtgttctggatggtatgaacgaaccatg

SEQ ID NO: 23287 - DNA, 156 bp, Chlorella protothecoides
ccggaagcgcctgcccgtgtctgcagccagcgcgaggagatggggctgttttgagagcagtgctgaggggaagaagcttcataggcacagcatgcattgcccagggctaggactgattcaaactcgaaccctcccacgcacgccgcgtggagctga

SEQ ID NO: 23288 - DNA, 65 bp, Chlorella protothecoides
tataaataattgaactacattcaatgtcgtactctcgatagcacgcggtcaatccactgcgtaca

SEQ ID NO: 23289 - DNA, 137 bp, Chlorella protothecoides
gccatcaagaccactcattgcttctcaaggaccttcctccaggctgaagccactcgccgttggccaacagtacgttactcccaactttctgttctactcatagaaacgctgctcatatccctctcaagcattgtgtc

SEQ ID NO: 23290 - DNA, 109 bp, Chlorella protothecoides
ggtggcgtgatgttgtggggcagaagggagcaacataatgattgaagggaagtgacacagcggctgatctgttacgttagcggtgacctgtcccggcactcaattacgc

SEQ ID NO: 23291 - DNA, 307 bp, Chlorella protothecoides
tattctgttgtcccctcttacatgcattcccgatcctcttactcagcaacagcattcagcccagcagccaccagctcctcatcaccacccgatggcttgcgtgccatccctcgtatcccatgcaacagaagcccccgctggtgtgctcaccaggtaagcagcagtgggtgaggcacctggattgcaagcaggtgacgagagtattgcctgtaatggattgggggtcccatttcctgccatgcccaattcttggtcactcttaagtcagatcgaaccttttgcaggtcggatatccagaagttcaacg

SEQ ID NO: 23292 - DNA, 66 bp, Chlorella protothecoides
ccagaatgcacccactgccgtgctcctattgggatttgagtttcttattcatcgtgcatcgcagga

SEQ ID NO: 23293 - DNA, 129 bp, Chlorella protothecoides
cgcatgccctgcatgttcgatcgtcacctgactccagaattccccccccaagttcccccttcccatcgtgtgtattcctgtacgatgatgatgcttcctgctctgaagagcgggcggcgtgtccttcac

SEQ ID NO: 23294 - DNA, 62 bp, Chlorella protothecoides
ccaccatttatgtataatgccatgaagctgtgaatggtgacccataggaagagcagtatgca

SEQ ID NO: 23295 - DNA, 20877 bp, Chlorella protothecoides
  modified_base (1011)..(1057): a, c, t, g, unknown or other
  modified_base (3282)..(3328): a, c, t, g, unknown or other
  modified_base (8679)..(8713): a, c, t, g, unknown or other
  modified_base (10194)..(10239): a, c, t, g, unknown or other
  modified_base (17829)..(17838): a, c, t, g, unknown or other
  modified_base (18127)..(18253): a, c, t, g, unknown or other
  modified_base (18434)..(18443): a, c, t, g, unknown or other
  modified_base (18952)..(18961): a, c, t, g, unknown or other
  modified_base (19245)..(19254): a, c, t, g, unknown or other
  modified_base (20462)..(20471): a, c, t, g, unknown or other
cgggcgttggagggcggggagggggatgaacagcggcgagccgagggtggataaagggggtgaggttggaagtgtcctcggaaggtgaggatgtgtgcgaggaacaggaaaggcgcctgcaggtgcatggccaggagagaccactgcccagcaggtgcctcggcaggggggtttgggtgcagcggacccggtcccctcccccggcccccaacccccccacatgcccaccttaatcttcttgaacaggtttgggatgttctcgtcgtcaaagggcagggagccgcagaggagggcgtagaggatgacgccgcagctccacacgtccacctctggacccgcgtagagcctgccggagatgacctccggcgcggcgtagttgggcgagccgcaggaggtcttgaggaagtggccgtcgcgcatgacgttgctcagcccaaagtccgcgatcttcacgttcatgcgcgagtccagcagcaggttctcgggcttcaggtcgcggtggaccaccatgttgcggtggcagtactccaccccagacacgatctgctggaagaagcgtcgcgcctcgtcctccatcagccgccccttctccacgatgtagtcgaagagctccccagactgttgttgtgttggaataggaggggtcatggcgatggagatgggtgaatggttgtttgcatgcaatcagggggggggcatcccgcgcaggggccgcagcagcccttgaccatcaaccaggccaagaagtctccatggcagcctcaggttcccctaccaccaggcagggctccgctctcccaccttgacatactccatgaccacgtagatgtcatgcgcggtctcgatcacctcatacaggcgaatgatgtgggggtgcatgaagaggcgcaggatcttgatctctcgccgaactgcaggtcggggcaagcaggaggagtacatgcaggtctgcctggacctttgcgcgagagtggcatgcagcagagttgcccttcaccccccccccccccnnnnnnnnnnnnnnnnnnnnnnnnnnnnnnnnnnnnnnnnnnnnnnngcgcaggcacctgacgcccggccaacctccaccatcatccaccctgctcttacctttgtcctccatgtccatctgccggatcttcttcctgttgaggatcttgatggcgaccttgtgtcccgtcaggatgtgctcagccaccttgacctgcaaaggtggaggtgggggagccttgttggtcaccaccacgaccacccacccttgaagggactcaccctggggtgcgctcggatcacatccgccgggagtaccttgccaaaagaaccgatccctagagtcttgccaagccggtaattcgacaggaagaactccgtccccgtctgcgccatgggattggcgccgggaaccccggggtaggccacgggaggggcctggtggtgcgcagcgtctgccatctcggagcgatgcagaggaaaacagctcgtaaaagagaggcaggcgtgcctatttcaaaggctccatgccctcctcttgccgagatctctgtaccggagctaggtggtcggggcacgataacgacggggctggctagagaggacaggcagctctggacctggacggtgccaaactagacagaacaatcactcctgacggatgaaatatcggtgtgggtccctggtggcatcaggagtaccgcattttgcggtgggcacccttgcgattgatgatgacgtgggtgcatcgaggggtgaaatctagcctgttggttctggccagcccattctcgcccaatcctcaaaacctcccactatcagcgctgacagtacaaccacgaaggaatcagcttggtgggtgtggcattgccagttcggtagagtctgggggggcaaggttccacctagtcgagcactatcactcaggtaaccgccccaagcctctctcattactttggcctcctggactccttggccctgacctttagccggatgggcaccccctccagcccaaactcggcgcgcagggacttggtgaggaagttctgggtggaggacggcatggacgcggagcccgacacccaggcgacaaaggtcgggggccggcccttggcctgcagcatgtacttgatgcgccccacgtccttccctcccccggtcgtgtaagaacttgccagctggcgggagacgggaaaaggtggtgtggaggtcgcatgagtgtgcggctcctccgcccagggcacccgcatgcgggctctgcgtccacagccaggccgcgtgcagcgcaccgcacctcaggcaggtgggcaaggccacggtggggagtgcagcagaagagctcccgcccctgtcatcctcagcccaatcccacccaccccacccgccgacacccctccctgccccagctcaccccagccacaaagcggttgagccggcccgtggagatgcgcaggttccagaggcgatacacttcgtgcaccgccggcagcaggcctgccacatcggcgcgcagcgccgacatgggcagcaggcgcacgctggcgccggcggggaggccgcggtctaggctgcgccgcagcaggcccagcacacccgccctcgcctcccgccccagcgcgtccatcttgttggcggcgatgagcagcgcgcggccgtgcaggataacgtcgttggccagcatcagctcgcggtgtgtcagcccctcgccatgctccgacaccctgcagggggccaaggggggtgggggaaagaatgcttgcatttgcttgacaaaggcaacagggtcgcgctgacgctgggaccactgggacggatacatccgcaccgccgcctgactcagcgtggcgttcgtgccccatcccttgcccggcctcatgaacacggctgtgccagtacagctaaagtccctcctcctccacactgggcacctgacgccgtccacgaccaggaccacgacctgcgcgctgtgcatggccgccgcgctgtctgccagggagcgctgagtcagtacaccgccggcgtcagggtcatgcgcgtcgaggcgcgtgcgccgccccccccccgccgtgtccaccagctccaggatttgaccctggggtgggaggcggcggcggcgggggttgggggcagtgttgggaagagaccgcgtccggctggtgggatgctcctcgctccgcgtcctctagggcaccacacacccagcccctggccatcatccagtgatgtgtagggcccacagggtttgggattgcccacccaatgccccctttgccccccccccccccccaacannnnnnnnnnnnnnnnnnnnnnnnnnnnnnnnnnnnnnnnnnnnnnnctcgtggctgaaacgcgctgtgactgcgtcgcgcgtcagccccggctccggccccgtcaggcatcgctcgctggcgagcagggcgttgcagagcgtggacttgcccacattgggcaggcccaccaccgccatgcgcagcagcggagaggcctgcgagccgggggactgggctttggtcgcgctgtctctttcagtcgtgcgctccgctgctgcgtcaccgccttcagcggccggcgccgcgtcgtcgggcgcctgcataccctccgctgcgagccccggcggcccggagccctccgcgccgcccacaccagctccctccgcgccgcccatgccagctccctccgcgctgtccacgtcggctccctccgcgccgcgaacgccggctccctccgcgccgccaacgccggctccctccgcgccgccaacgccaggtccgcccgcgctgcccacgactccccatgccgccccccgcacggcatccagcaggggctgcaggcctgcatacaggtcggccatgccctcccccgcctcggccgccacggcgacggcggggccgaaacccaggcgcgggctctccgccagccccgccgcactagtctcgcgccgctcgcacttgttggccaccagcaggacgcggtgcggcgggggtaggcggcgcagccagcgcgccagctccacatccccgggcagcacccccgcccgtccatccatgagcaggagcgtgacgtcggcgcgcgccagcacgcctgccgtcagcgccgccgcgcgtgcctggatggaacgcggcgcgcgcgcgcccagctccggctccatgcccgaggtgtccaccaccgtgaagcgcaggtccgcaaggctggcgggcgcctcgcgccagtcgcgcgtcacgtggccgtccggggtgttctgcaccagggccatgcgccgcccggccaggcggttgaacagcgcggacttgcccacattggggcggcccacgatcgccacctttgcatgggcaagagggggggttgagacgggggcgggggattgtgggttgggaggggggactctggaaccatcccaacaatcaagaggtgtgcagggcgccaggcccacacggaagacataggcaggccaggtgggggtcttacataggtccatgacgacgctgctggcacttaaggatgcaatggcgatgcgtgccaggcgattgattgccactccagcaattacatcttcagccataccaaaccaccatccagcccaccacagggagacgatcggcgtcgtcagaaaagcatcgccatcctctcagagctccacatgctcctgggagctgtcgacgggggccccatggccctagtcccctcgccagcagggtccaggtcacaccccacatgccatgtgcgcaggcgtcgcacaaggtatataccaacctatcccctcgatgccatacaaataattgctagttacagaatatcgagcatgagcgtatcttctcatcgatgggctttcctgttcacagcaggggcccaagggtgcaccgagaatgctgcgatgcatgctgggcggcgaagagctcgactcggtctgttgatgcttgcctaagcacgcgcgtccaacggggcaagggtgggcggaatccactttggaaatatatatgtgacatcttccaatactctagaagcgtggcgagacagctttctcgatgacagactcggaggagagtaggggtggtgctgaaacaaagccggactcggagtccccccgtgagcgcgatgtggagatgcgggaggctcctcctaggagtgaacgcacagaatcgtacaaggtcttcgtaggcggaatcccatggcagctggacgactacaagctgaaagactgtgagcacttccgagtgggatcgaaaggtttatttcggcagcttttcagcaccatcctacgtgcatcgtgattctgagcacatgctgtccattcactcggcgcttccccactcctgatgtcctcagtttttcgagagtttaatcccgctacggccaccgtgatggttgaccgcgtcacggcaaaatcccgtgggtttggattcgttacctttgcggaggaggacgacatgaaggcagccatcgagtccttacactcccacgagatcgagggccgacgcatctccgtgaccaaggctgtgccggaggccaaaacggcccctggcacgccggcgggggctctcaggaatgggggacctctcaggaatggggagtaccgaccacgcgacgaccgaaggtgggactcttgaatggctcttggagcaggctaaacatctggtgggcactgccatctcttcattcacaggcatcctccaattcccctgcacagggctaggcagagggaagggagaccagagcgctctggcttgggtcctgccgggtgcgacggggtgaaggatcacctgcactggagctgctggcttctcaatcgctcattcagtttgccccatggtgttctcacggctgacctatccatgcatgccgctccccagacccagccgaacatatgatcgcgggggctatggcagacgctcttccgcagcctctgggccaggatatgataggggccccgacagaggctatggcaggagtggtgagcgagggtacgaccgagactacgctcgaccacaggatcggtcatgccccgccaggtactctgctgccacctcgacagattatcatgctttggcgaatgtccaatgaatcaggctggctgcgtgttgatttctgcaatttctgaggatcctgcatcatgcgctcacgctatgcgagccatgcgctggtgatctcattattttcttttgtctctttgtccccacagcgggccctacgcgcctgcatacgagcgcccaaactactcggtctatgatcgagagccgagccgcgatggggatgcaaggtgagtgactctcgctgatgatcaatgctgcttagagtgggagctgggtatgtgccaagggagggcaacccccaactccatcaaacactcagcttccctggttccatgcccagccctcccgtcactgcacagggctccttcacggtacaaccccgctgaaagaggagttgcatatgagcctcgtcccatgtacgagcctcgccccgtctacaatgatcgctcgatctatgagcctcgccccgtctacgatgaccgcccagtgtacgagcctcgccccgtctacgatgatcgcccgatctacgagccccgccccgtctacgatgatcgcccagtgtatgagcctcgcccctactacgcacgcgattatagcgcgccggtgtatgatgcgccagcgtatgatgcgccggcatatgatccggtggcataccagccgacggcgtatcagccagcgccatacgagcctcgcggcggggcggaggcccatgcgccgaggggtgccggagcttacgagccgcgcggcggctacaggccgcgggaggaggaagacctctatgagcctcgcgggcggtatgaatcagcaccccaggagtacagcgccgaggcctacaaggcgtcctccgaggaccgctcttcccgcgggtacggccgggagcgaggccatgagcggccccttcgcgcgtcgggaccctacgaccgggcgcgatgagagggaggtgggggggtgattgggacgggcgccggctgcagtggtcgccatgccggccgggtgacatgcgccaggccagctcagcgctgtggctcacaatgggacgaggggagcgcaccgcaccagcgcaccccatgtgttgagaacctccagccttcagtgtggctcagcagactgagcaggacggcagccgtctatgacggaaaggaaggacctcgagtgcgaggcagctcgcccagccctggtcaacaagtcctcttcagccaacaatctcgctggcctgtgggagcaggcctgctggcagcatgctgcccgggcaatgagacgcatggtacccagagtagcagctttcagacatgcccagggctgtccctgtcagcgtccatgctctctgcactgtgccagtagctgcccacatgccaccggaccgttcagtatgctacagtgcagcttgtgggaaggtaccgacaagccatcccaagtgcagcggccaggccaggcagcggacttggtatcaaaattgtgggagatgcatgcagcgactccttgcaagaggttcatgtcgggtggtcagagctccggcccaagcgcttctccttgaggacgcatttggtcgaggtttccaagcccagtgtcaagcgtggggagtcagtggctgtgcgcctcttcagcactgctgtgaggctcatccgccaggagcttggctcggaactcgtggctgatcacctcctgcattccgtcgtgtggatgacgcctgctggaatggtatgttctcctaggtggtgcctcatgctttggggcgactggcatgcaccaggctgcagtgccgccagcgcaggaggaaggctgcgggatggctgcccgggctgcatgcacggcttgcccggtgcacaacctctacggacatgccctccctcaagctcaccctctgctggcggatgaggtccactgcctctgccacgctggacacctcagcttgtgggtgcatgtgcatgcccagcatgcgccacatagccacgcctcctgctgcaaagatgccgcagagcacgaggctggcacccagcgccttggcctgaagatcgggtgggttgttggtgttgtgtacctctgcaacatggatgccagggtgcactacagcgccctgcagagattatagactcttccatcaccccccccattctctcactgccactgggagagctcgtagccgagctctgggatccaccccctcctctgcggggttggggcagtggaccacagagtgtcagggagctgccctccctggcctagcacacgggcgtcccatcacaagcgccgcacctgctagttgttttgctgttcccatatagtgtgcccctcccccgatcatcgcccccgccagtgcggctcccatgcccgccaaggctgattgggtcggggtcacggaacgggtgtcgtgggcatgctccgacatcgcgggcgctgcttccaacgggacgacgacgcggggtcctcacgatgcaaggacgtgttatcaactcgcatgcaggggagctcgcgatctgtcgattgtacaccgcatgctgccacggcatgctgtggtccctcagcacgtcggcatatcatctgtacctggccccctttgtgtgtggagtctaatgtcgtgggactacaggtacacgtcaggtccagggatcaggcagcgacggtgtgaggtacaacccccccccccccccccccccccccnnnnnnnnnnnnnnnnnnnnnnnnnnnnnnnnnnnactcccactcaatggtgctgggcggcttgctggtgacgtcgtagacgacgcggttgacgccgcgcacggagttgcagatcttggtggagacgtagcgcaggaagtcgggctggaaggggaaccagtccgcggtcatgccgtcgctggaggtgacggcgcgcagcgccacgacatgggagtgggtgcgctgatccccctgcactcccacgctgcggatgggcaggaacacggcaaaggcctgccagatgtcgtcgtacaggccccactcccggatggcgttcacgtacacctcgtccacctcccgcagcgtggccagcgcgtcgccggcggtgacgtcgcccagcacgcgcaccgccaggccgggccccgggaaggggtgccgcgcgatgaagcgctcgggcacctccagcaggcgccccagcgcacgcacctcgtccttgaacagctcgcgcagcggctcgatgagtgtgaagcgcaggtcctccggcagcccgcccacgttgtggtggctcttgatggtgtggctgtgcttctgcccgctgccggggggcggacagctctcgatcacgtcggggtacagcgtgccctgcaccaggaagcgcggcgcgtggcccaggctcgcctccagccccgtcgcgtattcctggaaggtgtcgatgaactccttgccgatggctttgcgcttggcctccgggtcggtgacccccgccagccgggccagcatgcgctccgacacgtcgatcttggtgacggggaggtgcaggtgctcgcggaaggtgtccatcacccgctccgcctcggcgtagcgcagcaggccgttgtccacgaagacgcagtgcaggcggtcgcccagcacgcggtgcacaagggtggccgccaccgtggagtccacgccgccggagagcgcgcagatgacgtggtcggtggggcccaccgccgcggtcaccttggccatctcctcctgcagtacgtcggccatgttccagtcgccctccagccccgcgacctcaaacagcaggtgcctgatttaattttttgagggtggggtaggaagatagggtggggtggggtgagggagaggggaacagggggcatgcagggtgatgacggccagcgagcacaagttggatggaacatgggaacttgctaggtgagccctgacacagaggaagaattagaggtctcggacagggcgctgcaggcctggccccctcacaggccgaggcctgcctcgacaagatcccacacacatgtgccccaacaaacagagccgctgccccacttgatcatggcggagccgcgctcggagtggaccacctcagggtggtactgcaggccgaagaacttgcgggatgggtcctcgatggcgacgcacgcgccctgcggcgatggggagggagggaggaaggcctgagctgctgcgcatctcttaacaacccacagcctgcccttgggggggggaagggggggggggggggcannnnnnnnnnnnnnnnnnnnnnnnnnnnnnnnnnnnnnnnnnnnnntcgccaccctgaagcctgcctcgatggtgcgtccatcatcagctggggtactgcaacatatgctcgtccgttatccacctccattctacaaccacacgggcacctgctcgctcttggcaacggcgcggaagccttccgggagggcggtggccgagtcgccgtggctcatccacaccagctgccggtcggcctcctcgcccgcgtacagcacggagtcacgctcaacattgatgggcatgcggccgtactcgccgctgtccatgacggtctgcaccacacctcccagctggtgcaccagcaactgaagggtggagcggggattgaatggaagttggtgggctgggggggagcgccggcgtggacaccctgtcacccgcttcaagattgaacatagccacccatcagtcagccccgggctgacctgcatgccatagcagatgcccagcagtggaatgccagatgactggcagtaggtgtagaattcggggggaagcagaggggccccctcggcatgcacagagttggggccgcctgacaggatgatcatgcgggggttcacctccttgatggcatcctgcatggccaggcacgcgcattggtggcgggactgggtgcttgcatttggtcgtacatccccttggacatgcatgcgaggccaatttggatcggcaaaggcatgggcgagctcccggcgccctgctgccctcccctcaccatgctggcatccccaggcaggagcacagagagcactccagcgtccctgatccgccgggcgatgagctgtgtatactgggagccatagtccagcaccaggcagacggcgtgcttggcaaacacggccttcgtcgcggcctccggcgtgggtacgggcgccatgccgtcggtgtgcttgcaccaggccttaccgctccacgacccgtatccaatacgtgcgatgtttcgaagtgtcgttcaagtctggcgtgaggtgaaatgcggtatatacgtcgcaggtcctcctggtctcgcgcccaaacccgctttccatacgactgcttgaggaggttcaaaaatcggggagtggagggctcccaacacggagcgccacaacaaacctccctcattctgtatcttcaactataatgctccccccagtcctgggtgctgcaagaccatccccagggggggtgcgggggtggagccccatgatgccgggggttgcgtcgtcaccccaagcatggacgcccccgccggcggcctgctgggcgccaggctggcggctggcggcaggccgcaccccttgatggtggccgcctcgccggcctccccgcctcgctccagcgcagcgacgaactccgcgacggccctcaccacccgctgcacgccgtcagcgccctccgcgccccccgactcgagactggggcccagaccctggagcaccacagcccgggcgtccgtccccgcggccggtccgccgggggcaaacagcgctcccagtcgctccggggggcaccgcgcgtcgcgtccgcccaccacgaagagcatgggcgggctcagcgcctccgccagccggatcaggggaccctccgagtcgctgggcgggggggcgcctgcccgagccttgggcggcggcggtgcgggctcctgagatgaggaaagggggaagtgctcggtgggcgcagcaaacgggcacaggctggcatgtggggtctggagttcctggcatgtgagggaagctgccagagcagcaaacgtgggtcagacgttcccatgctgtgccagcacagcgcccggaggacaagctggggcagtacaggtgctatcgaacctgaagctgatcggcatcgagggaccacacatacagccgcctgtctcccttccctctgcaatcgccccccgagtcgtcgcaccagcagcgggtaagacagcgcgacatagcccccgatcctgatgcgcgtcttggcggccaccgaggcggcgacgcgcgcgccgttgtcgaagcccaccaccacccactgctgcacggtggccagggccaggggcgacagcgccgcgctttccagagcgcgctccaggatccgctggcgccgtgcctctttctggcggcagtggtaccgcatcacgatgtggcccgcgccagcgaagcggttgaccaggccgcgcatgaggggcgagtcccagtcgccggcctccagcccgtgcgccagtaggatgccgatgggctggatgcaggcgctgtccaggtaggtggctggcaccgtcagcatggaggtgcaggtctcgttctgcccagccagctgcacaggggtggaagggaggggggcaggggttatgcaagcccagatcaggtgggatgctgtatgattgtaggactggttcatccctccaggggcagcagggcaacctcgtgaacggtaacctcacttatgcacctctcagctggtgccacgacggcacaccaggacacacgacctgggcgcatcaggatatgatgcatgcattcccctgcgttattcccacctccatctcgcagctgaggtggcacaccccggcctcctcgtccatgcggacgcccgcgggtggaatgaaggcggactggccaccctcgacatgccagtggaagcgaaccatggctcagtacagcgcagatgctatctattcctggctcatcatgaaatacgatgcatagatgtcgaaaccgtggcgtagtgggctagtacggaatgattctcgaaagtgatcgtcagactcaaaaggtaggactctgggctgtagaggactgtcagctattgaggttgtccttgttttacttcattcatgaattgttccactgcccattttaattcagtagaccccttgccatggaatgaaccaccgatgtctgatttcccgccaggaaagcaagtgttggtgaccaccccccggtactgcgtttaggtactgccctcgtggcacaatggtagaatcgcggcgacgggtctccataggcgatccgggggccgggagaagtcctttctggggaggaacaggaaccagctacggtaagcgggaggtgtggatccctggggagggctggagccctcgagccgccgctgctcgcccggccgggcaagcctgtcgaggccggtgctgccccggttcctggctgcggacacgggagtcggggcaggccatgcccagcattccgtgcaaacgaggtatgaggcaggaggttcgtgcccgtcgctcacgtccccggcccccctgccccctcccacagatgggtcgcgttatcaggggccagcgtaagggtgcgggctctgtcttcaagtcccacaacacccaccgcaagggtgccgcgaagctgcgcaccttggacgcgtccgagcgccatggatacgtcaagggcgtggtgaccgaggtcatccacgactccggccgtggcgcgccactcgccagggtgcgccgaggggggggagaagggtatggttgacggggatcttgctggatttgtacctggatttcaagtacactcgaatgcggggtctttttggtggcccttctgcgtggctggagctagctcctgggagggtttctcccactgggataagacctctgcccgaggccaggctgccgtcgctgacctcccggcccggccgagctcccctcccggcccccggccccttctgggcctcgcctggtcctgtgccgcccactcacctcccggccccggtcccaatccccccaggtgaccttccgcgacaccgtccgctacatgcacgacaagcagctgttcatcgcggcggagggcatccacaccggccagtacatctactgcggccagaaggcgaccctgaacatcggcaacgtgaagcccgtgggcgagctgcccgagggtaccgtcatctgcaacgtggaggagaaggtgggcgaccgcggcgcgatggcgcgcgcctccggcgactacgccatcatcgtggcgcacaaccccgacgcccaaatcacgcgcatcaagctgccctccggcctcaagaaggtcatcccctccggttgccgcgccaccatcggccaggtcgccggcggtgggcggaccgagaagcccctgctcaaggcggggcgcgcctaccacaagtaccgcgtgaagcgcaactcctggcccaaggtgcgtggtgtggccatgaaccccgtggagcacccccacggtggtggtaaccaccagcacattgggcacgcctccaccacgcgccgcgacgcgccgcccggccagaaggtgggcctcatcgccgcccgccggacggggcgcatccgcggaaccctgctcaaggtggacaaggagtaggctgtgcaccgcatgccacccaccctgccccccctggatgcaaggcgccgtgtcacacagtcttggaagacgagggtgtgggggagggggtagagagtcggggaaggaaatggagtgcgagcttcgagggaggggagagtgtgaagcgttcacgaggaagcatgggggaggtgcaaagtggcgctgactcgatgtggcgaggattccaggggagggttgaccaccggaaaggtggagctagcaccgcacgacaaccctgccttgaaaaggtcacccttcgcgccctttcccacgattctcatagccgacgcatggcacctggagactgtggctgacactggtacgggggggcgctgcatcatttgaggggcagggcgtaaatgatacaggtgagaaggaacaacccccagcaggacgcaaaaggccgccggcgtccatcttcagtagggtacgttcttgggcagcttgtcgttgatgttgcgcgccatgcccagggaaagccgctcccgtgcccagtgcttgttctggaccttggtggcacgccgcttctccacctgctccggggcccggaaggcctgcacggtaggggaaacgaagagggggggtagtgggttgcaaggtgggtgtgagatgatcagtaaggaggagggaactcgacagagacagaggtttgcttctggcacaaccgcacagagccaaggggagagtttgctgggggggagtaatggaaagcaggaatccccaccaccaaatgcctcaccagcatgggcagctccatgcggcggtactgcgccagcacccgcgcagcggccgtgagcgcggcacggcggtcgtggcggtgccgctgcttgtagtacctggcgaactcgcgcgtgccgaggtaccgcgtgccgccggactgcagtgggacgcccagctcgaagccggtggctgcggccgcgccgtcctcgccggccagcgccaggactgcatgattgagggagggcgagttgggatgaggaggtatgtgggacgcagtgatgggttaccagatgacagggtcgattggcaagcgttggacaggactcaggtctttataaagtgcatacacccagcatttaatggcaaacagatggcatggggagccgacgacagaggccagtcagaatgctgacatggattgaaggatgcatcctggcggtcccagcaatccctccaagccaaaagactcccctcaaccccaccccagaactcgcctccagcgctgacagcctcgccgtcatcgcccgtgtaatcatagaagtcggcatactcgtcctcgttcccatcatacagcatggtgcatcgaccgctgtccaccatgtgcctctgcgggaaagatcaatattgggattgaggacgaagtcagggtaactgagggcaaggccttgcccatctcatcagcgccagtgttgggcagaagcctggacagcgtggatggccccaaaccctgtcaaaccgtgttctgagagcaaaggcaccaaccacgcccatcacaatgcacccgccctgcccccctacccaagcagactcacccgcacggcatgcagggacctgaactgcttggcctccggatcctccccagacttgtacagcggaaccccgccatactgcagcttggcaccctgcgtgagccagtagggattcgggtcttggcatgaggccctgaatgctcctggtgtggcatgcaatctccagcaccagtccctggcgggggacaggcaatcgtcgttgctacacgtaatcgaaccccagggcggactccccccccctctcttaggcaacctaccaggtatctcatgaggccctcggggtccaccaggaactcggtgtcggggaagtagaagccaaagttgaggtacatgtacttgaggttctcctccagcgaggcagacacgtggccgtcgaagagggactggcacacgttccactcctcccagtcctcgggttgctgggcgccctcccctgcctcggacgcatcatcctccgtctcccagtcgtcagacatgtcagagacggagccctcctcatcctcctcggtcgctgcgggtgctggcttgccgatgggcttgctcacatgccccagcactcgttgtggggttgcaggggggcctgaagccgcagcggcatccgcgccggccgggccagtccgctggatggtgatgatggcgctgggtgcggggccttccagcttgctcaggaggtcccggtacttcttggacctggcggcatgggcggaggagaggggggggaggtcttcttttagggcgccggtgtgcggtgatctggctccaggcccgagcacatatcccggaagggaccacttcaatgcattgagatcgccctctcatccaatccccacacccaccgagtgaaggcctcgtatgtgttctcgctgccaaacttcttgccggtcagagggtcttgccatgtgcgcttgacgctcgtgtccagcgaccccagcagctgagacttgcgggcatcgtaccattcccgcgtcacaggtggcagtcctgccaccttgcgcttcaggttgtacctgtcgtcgggcagcatgcttggatcctcaggacaaggcctcccgggccttccctgcctcaccccgggcagtcaggcacgtcatgcaggcacaccggagacttgccatgcgcaccccacctgtgaaattcactcttataatgctctacaagggactccttgtcctggaagaaggctccagccgtcccgcagtagaggccctgctcctccattccgtcgcaccacaaggcagcgtcaccagtgaaagaggacgtcgttcctggacgacagtgtcacgcaggtttcctgggcgtttctggagtcttagttatgcaggcattcgcatgcagggccttcaggccacgaggatcgtttccgcgccttgtgcctggtcttggcgcttcgctgggggtgtcccctcccgcgttatggacggcggcctcgttgtggggcacattcatgcacatacacccgcagccattggtgcaaggcttgtagtgtgctttgtcttgtttcagatgtatcgtagtctcaagctttggataacctcggtccctccgctccgggtcagttcatatcgtgcagcgtctcacaatcacagccagtcagctcggctctccacttcatcttgcaccgtctttatcctctctgattaagccattgcgaaatatcctacttcggtaaaaatcaaggtgagcggtgaggctggtggcgtgcagggttcactgtgtatcatggccgcatatgcctgtgggcannnnnnnnnnccgtgcaccgtctttgtcctccctgattaagccattgcgaaatatcctactgcgatagaaatcaaggtgagcggtgaggctggtggcctgcagggttcaccgtgtatcatggccgcatatgcctgtgggcaggctgctatccacagccagcccctttcagcttccgcggcctagaatgggcgggtctgggcttgacaacccaggcattcaactgcggtcctgacccacggacgggtgcatcctcacatgcatctgttcactattaccagggactacatctgatgtactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagaatgtgtgattcaagtgtacatgccagtcttgccccggaaattgactcgagttgtagcatggatagaaagcaggggccagggacagaccggatgcatggcttagaggcagatatacaggcaagcagatgtgaacccagagggcctcatactaggccaggctcagctccactccccnnnnnnnnnngagcaggggccagggacagaccggatccagggacagaccggatgcaaggcttagaggcagatataaaggcaagcagatgtgcacccagagggccccatactaggccaggctcagctccactcccccgtcctgcacggcggagctcaggatgctggaaagcaggaacgccgatgccacaccagcctcgcccgccagcgcctccaggtctggcgcgggggcgtgcagggccgccagcatgaggtccccatccaccaccgcccatgcgccgtcgggtgctggggcggtcggctcgggagccgcgtccccgcagctccccgcgggagtagcctctggtgagccgtagccggccgtcttgccagcagcgtccacctccccggccggccccacctccgtggccgaccccgcctcctcgcacgtggccgaccctgcctcctcgcacgcaggggcgggggggtcgtactctaaagacccccgcacgcgggcctccacccccgcccgcgccagcagcnnnnnnnnnngcctccgcggccgaccccgcctcctcgcacgcggccgaccccgcctcctcgcacgcaggggcggggggatcgtactctaaagacccccgcacacgggcctccacccccgcccgcgccagcagccgggcgtgcacccgctccagagtgcgccggtgcaccacgtcccccgccggggtcaagccgagcaccgtcccgcgcgaggtcaccgccagcagtgccggcgctgccgggccgccccaggccgcgaccgtggtgtcccgaaccggcagcgccagcaggcgcannnnnnnnnntgccgccccaggccgcatctgtgctgtcccgaaccggcagcgccagcaggcgcaccaccggctctcccacgcggtgctcccccagccgctgcaagcggctgctgccgtcgccgtcgcgcgtgatgcgcagcaaggagagcacgccgtcggcgtcgccggtcgcgagcacggcccctcccggcgccggcccggcgccggcatgggtcaggaagaccgcagcgctgatgtggcgccgcaggccctcgccggccacggcgtggaaggcgccgcgcccgccctcgtcgcgccacctcagcagcgtcaggccgccccgcacatcccccgccagcacgtgccgcccctccgcctgcaggctgtcgatgcggttggacaggcacagcgagtgcaggaggcagaggtcgccggccctcagcccccagcaggccagccgccggcccaggcccagcaccaggcacggccccgccgcccacccctcctcgcgcatgaccgccgcggcggtgggccgctgcgggagcaggacctgggccagcacccggaaggcgccggcctccgcgtccagggccatcaggcgcacgctgccgcggcgcttgaactcctgggtctccggcagctccgccgcgctggccgtcaccaccgcgaaagcgccgctgggcggcggggactcggcgtgcggcccgcgtggcgacagcaggatggggtgggagcgcagcgagccggggccgtctgggggggacagcgtgggggaagaaagggttgaacggcttgcgggttcagcgtgacacgagaccacagtgcagccacagaggcccagctcgtgggcaagggcaacaggtcttcgcccttgccttgccccagcaccacgcagcagcccccccacacgcatcagccccttcccgccatgggttcccagcatcatgcccccagagaagcctctacctctggactcgtgccagggccggtgctgcacaggagcccccggcgcctcgccctcgtggggcgagacgcccgtggcccagtcgcacaccgccacgaccttctcccccgggtcaaagccgtgccatgtggccagctcctcccctgcagattggggtggtagggtccggggacttggggcagagcgattggggtccccccggcccgacgcccatgcggcagccaccccccacctgcttccggcgacaacgcctggagggcggctcccgtggtcnnnnnnnnnngttctcccccgggtcaaagccatgccatgtggccagctcctcccctgcggattggggtggtggggtttggggatttggggcagagcgattggggtccccccccggcccgacgcccatgcggcagcaccccccacctgcttccggagacaacgcctggagggcggctcccgtggtccgcgggtcccatccccccagcaccagcgcccggcgcccggcgtcgtgcagggcccgggcctccaccagcctcgactccacgcgccacggcgcgcctgccagggtcgtgaccctggctacgcgcccgtcccccatcccggccaggaagccgccccccgccaggggcagcgccagcgcggcgccctgtacgcccagcgcgcgcagcgtggcgcggccgacggggccggggccg

SEQ ID NO: 23296 - DNA, 70 bp, Chlorella protothecoides
ggagggttgtgaatggttggcggagaggacgttttccatacagtgaggctgcatgcagatacattctggg

SEQ ID NO: 23297 - DNA, 153 bp, Chlorella protothecoides
ctcccgaactgtacgagagggcttctcaggggtggaatggagcggggcggtgtcaagtaaacaataaatatgatacactcagggacttgcccgtaccaccttgtcatgtcactcccatagtgggaaccagccccttgtgtacgagaatcgttg

SEQ ID NO: 23298 - DNA, 61 bp, Chlorella protothecoides
gaaccagccccttgtgtacgagaatcgttgcgccccgtcacgggctggccctcacccccgc

SEQ ID NO: 23299 - DNA, 172 bp, Chlorella protothecoides
gcctcgacgctcgcacggagatgctttcggatggtttgaaatccccgccgggcccctacggagcccggatcggtctggttccggaagcgtctggtaagcttccatcggtcaggaaaatcttctcctttacactatcctctacatagatatcttatgtaccgtctattactat

SEQ ID NO: 23300 - DNA, 78 bp, Chlorella protothecoides
atgcacaagcatgtatgagtctgtctactatttgcacatctttcagtttgagtgctgagaagggtcagttgcactctg

SEQ ID NO: 23301 - DNA, 69 bp, Chlorella protothecoides
tcgtgaacacacctcatgagtcagcaccaaagatctgagttaatatctgcccatttgccatgctaccga

SEQ ID NO: 23302 - DNA, 101 bp, Chlorella protothecoides
ggtttccaaatcctctggtgccctataaaccaaaggcagagctctcttcccccgggctctggctcaaacacctgcgtgccggcaccctccccctcttacct

SEQ ID NO: 23303 - DNA, 73 bp, Chlorella protothecoides
tggcagtaggcccacgcgcagcaagctctgagcggaggcgggtggtagaggctgccgtggtcagctccggcaa

SEQ ID NO: 23304 - DNA, 77 bp, Chlorella protothecoides
gagatggattgctcaggtagcacctctaagaactgcaatcctgtcgacctgtattcaccctccacaccccccaccca

SEQ ID NO: 23305 - DNA, 61 bp, Chlorella protothecoides
gcatcgctgcatctcaggaaatgacacagcaaacccccctggacatgccccttggccgccg

SEQ ID NO: 23306 - DNA, 248 bp, Chlorella protothecoides
aataactcgagaatctcacgcctccgttccctcgtgctgcggcatcggttttggtcatcctttgaggatatcagaggtgctgccagccccatagtatccagttttacataatgcttgggacgaagaagcgatgctgaaacctggagaaagagaagttcaaatcctacaacgcagtggacatggaaaaatgcacgaccccaggggaggtgctggaacaagctgacaagggaggaatgcctgagaaggag

SEQ ID NO: 23307 - DNA, 61 bp, Chlorella protothecoides
ctgaagcagcgcggggttgctgtacgccgcgcccagctgcgcctgctgcgcctgctgggcc

SEQ ID NO: 23308 - DNA, 178 bp, Chlorella protothecoides
acaagatctctgctcactacttgcctgtgcctgatccttctcacatgtgcacataccagctgcaaacagtttccaacacacccctttggattcgtggtcccatcgcaaggcaatacgttccctgaagtgacaaccatgatgatgggcattaaatctgagtactgacggcggccaccct

SEQ ID NO: 23309 - DNA, 72 bp, Chlorella protothecoides
caggacaaggagggcatccctcccgaccagcagcgcctgatctttgccggcaagcagctcgaggacggccgc

SEQ ID NO: 23310 - DNA, 61 bp, Chlorella protothecoides
caaggtagtgcaggacgtaccccggctccgccaggtgtcgctccagccccagctccaggat

SEQ ID NO: 23311 - DNA, 78 bp, Chlorella protothecoides
gtgtgctcggtccctcgcctcatggggtaggctgtcgggagcgggaaggtctgggtgtgggcatgaccatgccattgc

SEQ ID NO: 23312 - DNA, 61 bp, Chlorella protothecoides
agctacaggagaggagcgtctctccggcagacccgccatcgcaaacctccctttccttcca

SEQ ID NO: 23313 - DNA, 77 bp, Chlorella protothecoides
agattgtcaacacatcacacgggagaagaagaaagcgctgcatgcaggccagaccggagcagggtcacctacacctt

SEQ ID NO: 23314 - DNA, 952 bp, Chlorella protothecoides
cgcgaccggcacggggccgtcggggacggcgaccccgccccctgacgcagcggcgacgtcctcctcggcaggcgccgccgcggggccgcagctgacggggtcgacactggaggggtggaaggctttcaagcgggtgttccaggagggcgtggagctgttcaacgccaagcccgccaagggcgtggccttcatgcaggagcaggggctggtggggccggaccccgacgacgtcgcccagttcctggccaagaccctgagcctgagcaaggcgcaggtgggggactacctgggggagcgcgaccccttcaacctcaaagtcatgcacgcctacgtggatgcgctggactttgccggcctggaatttgacatggccatcaggtgggagtggagcgcggggatgtcttgaggggagggggtgtggtggaaggtggagaaggctcgtcttgcgggtgagtgccgcatgcgtacgacacgtgccgttgagtagagcctgccgattcacgcacaagcctggcgctccctccctgacacagcccactcgcatgtcccccataccttctcccctcaaaccccgcccccccacaaaaactacccgcaggaagttcctggacgggttccggctgcccggcgaggcgcagaagatcgaccgcctgatggagaagtttgcggaacggtacgtgctgtgcaaccccgactccttccgctccgcggacgtggcctacgtgctggcctactcggtgatcatgctgaacaccgacgcacacaacccgggggtcaaggtgaagatgacgcgcgccgacttcctgcgcaacaaccgtggcatcaacgacggcggcgacctgcccgaggccttcatgtcgggcctgtacgatgccatcgtgacgcgcgagatccggctcaaggacgaggtgggcgcggggaccggggtggcgggcgcgcgcgcgcccgccgc

SEQ ID NO: 23315 - DNA, 110 bp, Chlorella protothecoides
ggaggacatcgaggcagcttcccagaggtgcgatccatgcaatatgcttctcagcttcgagtgcaggaaatatcaatatggagcatagcccttccaccttcaaagctcaa

SEQ ID NO: 23316 - DNA, 69 bp, Chlorella protothecoides
ggggccgacagcctggcgattgcggcgctggcggcctccctccggattcccccggccgtggtggtggcc

SEQ ID NO: 23317 - DNA, 124 bp, Chlorella protothecoides
gagcagagcgtagttatgctggcccaggtgtgtgtttggcttggggagcgggtaatagcaacgaggcagcgacacagaaggctcacatctcaattttgcgttccagcatgtgcagatgggtagg

SEQ ID NO: 23318 - DNA, 61 bp, Chlorella protothecoides
gcaccccacctgcacggctgtgcatctgcaaagcaagaggtagcaccccctcctgacacac

SEQ ID NO: 23319 - DNA, 73 bp, Chlorella protothecoides
gtgccttggtgggggaggagagtgccttggcggggaaggcgattgccttggtgggggaggagagtgccttggt

SEQ ID NO: 23320 - DNA, 77 bp, Chlorella protothecoides
tgccgccagaccacggagtgccacctccccacataccttctgcggtaaagggcggcgcatctgggcgcagggaggat

SEQ ID NO: 23321 - DNA, 725 bp, Chlorella protothecoides
  modified_base (280)..(289): a, c, t, g, unknown or other
ccgcggcggccgccaacgccggcgccggcgcggccccgggcgccgcgcgcctgtccaaggtggtgcagctgacgggcttcagcgaccccatctacgccgaggcctacgtcaccgtccaccagtacgacatcgtcctggacgtggccgtcatcaaccgcacccaggacaccctccaggtgagggtgatgggtgggaaggaggggggaaaggggggtcagggggaaccccgcgcggccgacccgcgtggcgggcggcgtggcctgccagcctcccacgcctnnnnnnnnnnggggaaggagggggggaaggggggtcaggggaaccccgcgcggccggcccgcgtggcaggcggcgtggcctgccagcctcccacgcctcccaccgccgacccacacccgtgggaacgccctgcactcccggcgacgccatccacattcccctgcacagaacgtgtcgctggagctggccaccatgggcgacctgaagctggtggagcggccggccagccacacgctggggccgggggcgcagcgccgcatccgcgccaacatcaaggtgtccagcaccgagacgggggccatcttcggcaacctggtcttcgagggcacgggttacaacgaccgcaagtgcgtcgggtggcggggggggtgtgggggggtgtggggcagacggcgaaatgaggggcttcgggggggggggggacagggagctcctggccaatgcag

SEQ ID NO: 23322 - DNA, 258 bp, Chlorella protothecoides
cgggaagcaaatataatttccaaatcgaaatgtccagcaggtgtcctgaggctcagctgagcagcaccaaggcagccatcaccgggaccggtcctggtcacggcggaggattgatgacatggaaaattgcttagaggaatgccggtggtcccacagctggggagaacgttcaatatatgcatgatggggctggtattttcggaccactctcgtacataactgcttcaagcagatttcgcttttgacacctcgtactgt

SEQ ID NO: 23323 - DNA, 144 bp, Chlorella protothecoides
gaggtgagttggcgaaacagaggggggtttaggggggttgctgggccggcaagatatttttggtcacgtgcgatgatgcgtcacggggcgggcatacctgccagaatacccctacagtggcttctgtgacttgaggcggtctcc

SEQ ID NO: 23324 - DNA, 61 bp, Chlorella protothecoides
gccgtcgccctgcggaggtggcaagcgtggtcctggcttggcgagtaggcggggaggcttc

SEQ ID NO: 23325 - DNA, 168 bp, Chlorella protothecoides
gccatctgtctatagtgtgggggagtacatggtcatgtttcatggcagcccgggtgcacactctgcagggagacacaataccatatgctacatgggggagagaagtgacacgccgcagtgtttttgagcggcacaatcctttgttcgatggcataaattcagcagtgc

SEQ ID NO: 23326 - DNA, 80 bp, Chlorella protothecoides
tgactggcgtcgccacgttggcggccgctcgacgtcggtgcactgtgagaacccatgggcattgcggcttctgaaatcca

SEQ ID NO: 23327 - DNA, 102 bp, Chlorella protothecoides
agtgccgtcgtcaaggtaggatggggggcgctgggggggtacaggcaatgggagggtgaagaagggtatgcgtgtggcaagggagatgctgacccgcaggag

SEQ ID NO: 23328 - DNA, 61 bp, Chlorella protothecoides
atggttcagtccacagaaccttatggcccgtgctctcagccactccacatggtcaccccat

SEQ ID NO: 23329 - DNA, 73 bp, Chlorella protothecoides
gcacagctcaggagttgcgagtctatcttctagaataggtgtgatgtatttagaccctgacgacaaatgcagc

SEQ ID NO: 23330 - DNA, 77 bp, Chlorella protothecoides
cattgcggcttctgaaatccaaacccagaactatatgtgcttctttgtcggttgtacaaccacctgtgtacttgttc

SEQ ID NO: 23331 - DNA, 61 bp, Chlorella protothecoides
cggccctcgagcctccgatcaatccctttcaccctccgacacagaaccccagccgggcctc

SEQ ID NO: 23332 - DNA, 72 bp, Chlorella protothecoides
accgttcaacgtgccacatggtcgagtctcaaacaccaagcggctgtttgggcgatccgatgacaggaacga

SEQ ID NO: 23333 - DNA, 286 bp, Chlorella protothecoides
cacgaggcctggagcgcgatgcagggacggtgagggttggggtggggtagattgaagggatgcgcagggtacagaattgagagttcttccggtggtgcaggctggggtgcacctggagcacagacgccggccactcaggcgcccaagagatgcggcagcacagaccagctgcctccccgctgcaaccgcctccgccgacccttttcctccaggtcccacctccaccccatccaaacaacacacatttctgtccgcccccactcacccatcaggagcacgccccaca

SEQ ID NO: 23334 - DNA, 76 bp, Chlorella protothecoides
gtggtgggggtgggggagtgagcaaagggagacttctcgcgaggggacactgggaaccgcgcctccccatcggcgg

SEQ ID NO: 23335 - DNA, 221 bp, Chlorella protothecoides
tatcagttgggaggtgtctggcatgcaccagcttgtcaggaggataccttccatcgtgacttcacatgattcagccggcggcgttctacattagctcacaatcaacgtggatctggatccgctccactaaagtcgatctgtgcataactcaatgggaaatgtcagcttcaatgaggctcttgttagcgtacaatgctggtggtcgcccactccaagtaggg

SEQ ID NO: 23336 - DNA, 134 bp, Chlorella protothecoides
tggatggtcatgcagactgcccgtcagtcaatgagagattcaaagcagggcgtgatggatgcaataatccactgaattgccatacagagtctgcttgtgtagaatccaagccacaaaagctggttcgccctggt

SEQ ID NO: 23337 - DNA, 135 bp, Chlorella protothecoides
taggatgaggatgttccatttggccagcactctaagccagtccaacttcatgcttccgtgatagatctaatgggtgcctgtaatcaactatattgaaatgctttgaatgcaaggatggccactttatatggtgca

SEQ ID NO: 23338 - DNA, 79 bp, Chlorella protothecoides
agaatgcatgtataccttctgccagccaaactttcctccacctgcatcattgatggccagcatctcgatgcgctggcag

SEQ ID NO: 23339 - DNA, 75 bp, Chlorella protothecoides
acttggacttgcaaagggaggatcacatctttcggaacccctcgcttgaaccccttttcgccccctcccactcat

SEQ ID NO: 23340 - DNA, 76 bp, Chlorella protothecoides
cttgggacctgttgatgagttatgtcggggaggtatgaatgagcaccttagttcagaggccctagatccccagaat

SEQ ID NO: 23341 - DNA, 61 bp, Chlorella protothecoides
cgcatgtgcatgttgtctaagcaccgctggctggcgtctgcacctctcatccccttcctcc

SEQ ID NO: 23342 - DNA, 94 bp, Chlorella protothecoides
tatggccccttcactaacgaggaactcatcggtgagcagggggcgctgaggcaaatgtatcgacacctggcatgtgtgattggagaaggacagc

SEQ ID NO: 23343 - DNA, 73 bp, Chlorella protothecoides
catgataatcgggagcatggaaaggtgcttccatcatgcagggcacccccctcccccccccgcatgtacccag

SEQ ID NO: 23344 - DNA, 68 bp, Chlorella protothecoides
cgccgcctattgggaatgccctcgtccttttgcgccttgtgctgccttgcaccctccgagaacccttc

SEQ ID NO: 23345 - DNA, 61 bp, Chlorella protothecoides
tggtgagagaatggggcagaagggcgcgagggcgatgtgctgcctgccgccagcgcccccc

SEQ ID NO: 23346 - DNA, 79 bp, Chlorella protothecoides
gagtgcgcatggtaccggatcatcagcgcgtagtactgcttcttgagctcctccagcgagggagtgccctgcgggcaca

SEQ ID NO: 23347 - DNA, 62 bp, Chlorella protothecoides
cgaacgcgggcatatgcatgcgatccgttctcgcccacctagtacctggtcgtcgaggacca

SEQ ID NO: 23348 - DNA, 78 bp, Chlorella protothecoides
gatcatgatgcaaacatgcaagtataagccagctcgaacgtagtttgcttgaatcagaacggcgcagctgggaggcct

SEQ ID NO: 23349 - DNA, 139 bp, Chlorella protothecoides
gaatgcatcaaagaggagtgaacagagtacgtgggccgtcaactgcaactgtgtacagaaaacatgggcccagcatacatcagcaaacaaatcaaccatcaccagtgcaagcatccaggcggtgcacctttgacatccc

SEQ ID NO: 23350 - DNA, 159 bp, Chlorella protothecoides
ctccttggtcaccaggtgctgagcatgggggttggggtgaggcagcatgtatcgcaggatgtgctgtgcatgcactcaagcaactcgatgggactgcgattgggaccattctttggagcgcagccattcccagaagtctggccagctgcatgagcgtgg

SEQ ID NO: 23351 - DNA, 73 bp, Chlorella protothecoides
ggagtgttggctgctctgttcctgggagtgactgtggatgtgctgtataccagcagcgaggtgcacccacctt

SEQ ID NO: 23352 - DNA, 80 bp, Chlorella protothecoides
gtgcatgcagttgacgggaagcggggttgtcaccaaaagattcccagcatgatgcatggatgccgatgcctgaattccca

SEQ ID NO: 23353 - DNA, 79 bp, Chlorella protothecoides
gcgatctgccgacaagtggctgcttgggccccagccacacgctgcagcaaggatcactgcttgcagcagcaaaagggcc

SEQ ID NO: 23354 - DNA, 183 bp, Chlorella protothecoides
cagactccttcagcttcacctattgatgaagatttggacagaggcgcgtgtgtgcacagggagccactctggacgccttggcatcagtccaatttgtatgggctgggtcattggggtgtagatgcgtgaagttcatcatgcacttccggtctaatacctcgatggcagtcgctcctgcgtcca

SEQ ID NO: 23355 - DNA, 61 bp, Chlorella protothecoides
cgcccatctcatgggtacttagatcctcgcacagcggctatcagacgattgacaactatac

SEQ ID NO: 23356 - DNA, 78 bp, Chlorella protothecoides
atcggtgagctggatagcggaagatggtgattggatgtagagggtctaaagcgatggaatcactaccgtccttcctca

SEQ ID NO: 23357 - DNA, 116 bp, Chlorella protothecoides
ggggaacatatgcaggggcgtacagtgtgtagaggctacagcaggggtgtgtgtggaggcaagtcaatgcatggcgctccttctgctgtccctgaccaagctggacattcccccca

SEQ ID NO: 23358 - DNA, 68 bp, Chlorella protothecoides
gcaagtaacctgactggtgccaaggccggggggtgttcccccccggcccgcagcatcgaccaacctgg

SEQ ID NO: 23359 - DNA, 62 bp, Chlorella protothecoides
cgttgggggaggttcattcctgcgaggaagttgcaagtgtgtctgccaccctgtacaccccc

SEQ ID NO: 23360 - DNA, 154 bp, Chlorella protothecoides
aggctctgggtgccagtctcctggactttgacttgggtggctcggtgcagaactctgatggtagctccacatcaagcattatgtcttgaactaaagatgcagctgatgatgttgtcttacgtgttctggccatgtatgaatgtgtgaggtactg

SEQ ID NO: 23361 - DNA, 240 bp, Chlorella protothecoides
aggcggccgaggaggtgagcggggtgcgggccgatacctgcatggttacgcgcgtgactgtgcgcaccggcggcggagaactcgtacggcctgggtgtgacttttgcctcggcccccggcgccgagctggtgggcgctgaggtttgctgttccgtgccaccatgcatgcccaggatcccctggtaaggatgatccacccaccccccctctcctccccaacccccaaatccaaaggctgca

SEQ ID NO: 23362 - DNA, 69 bp, Chlorella protothecoides
ggtcgcttggctggaagatgttgaggatgtctgctgagtttcacactgctctttgagtccaaacctggt

SEQ ID NO: 23363 - DNA, 254 bp, Chlorella protothecoides
cttctggggggacgtcctgtgacatggcgataaagaactcccaaatcaggttgcaaaccaacttccatgcatgttcttccaccatgcatccggtttggctgcacgtcaagcaagccaagcatgggcccatccaccatcttccagacctgtcattccaaagtgtcaagttcagtggaagccaccgggtaacgcttggtctccagcctggcttctccagagcaggcaccatcatgcgctcagtcaggtgaccgtat

SEQ ID NO: 23364 - DNA, 61 bp, Chlorella protothecoides
ggcacctgcaggcacgacagcttccccacaaccccagccgcaccttccatggccacatact

SEQ ID NO: 23365 - DNA, 75 bp, Chlorella protothecoides
acgccagcacaggggtccgccactcccctctttcaagattcgatgaccgtccctgccttcctaaccccacaccct

SEQ ID NO: 23366 - DNA, 61 bp, Chlorella protothecoides
ggaggatggaggaccccaaggagcggagggaccgagccgaggcccgcctgcgccacgccaa

SEQ ID NO: 23367 - DNA, 73 bp, Chlorella protothecoides
ccgagccgaggcccgcctgcgccacgccaaggcagctgctgacgctacgtgagctcgcctgttgagtgatgag

SEQ ID NO: 23368 - DNA, 94 bp, Chlorella protothecoides
cctgctttcgccatgctcccaggccggagtatagaacccgggccgggtttgtgactaccaccttttaatagccagtgagggggtaatcaatagc

SEQ ID NO: 23369 - DNA, 61 bp, Chlorella protothecoides
tgtctcatttgaagccagctgagaccccctgtcccagccttgcacgcgctctgcgcccggc

SEQ ID NO: 23370 - DNA, 117 bp, Chlorella protothecoides
ccgagcgtcatgccccatgggctctcctgagagccctccatcagcaacgaggcccgcttttcatcttaagctctggaggtatttcagatgtaaaccgagtgtagggcaggatagaca

SEQ ID NO: 23371 - DNA, 61 bp, Chlorella protothecoides
gtagttgggcatgggatgcctcatggcagggctagattcgcctcctgctgatccagcaagc

SEQ ID NO: 23372 - DNA, 69 bp, Chlorella protothecoides
tgctgtgcctccttcgactggcagctgggggcaataccacccacgatgccccccttgtccatgctcctg

SEQ ID NO: 23373 - DNA, 240 bp, Chlorella protothecoides
acaccccaggtgcggatctggggcctgggcttgcgctgcgccaggcgcagtacatgagtggggaggagtcgtgctgctgccctgcttgcgagcttgtgggcaagaatcttctcggcgagcgcgcccagccatgcctgagatgcatgccgaggatggccctccaccccgtccacacccacccacatcccaccgccctgcacgcaggcgtgctgtctggcgagaagcagcgcatagagcgca

SEQ ID NO: 23374 - DNA, 68 bp, Chlorella protothecoides
caaggccaagctcgacagccgacgacctcgctaacgcagagatgcgctcttgcaccttttgacggata

SEQ ID NO: 23375 - DNA, 374 bp, Chlorella protothecoides
  modified_base (117)..(268): a, c, t, g, unknown or other
atcaccgccggatactcgggtgggcgttggcggtgttggtggtgggcgaattcaaagtgagactccattgcataggtggaccgacggggtggcagactcccatcggaaccctttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcacgaatgacgcatgtctgccgccccgagcttttcgccgccgactgaatctcacctgggcaaacatcacaggtcaagatgcctcatccatcctcccatccag

SEQ ID NO: 23376 - DNA, 122 bp, Chlorella protothecoides
ctcgcgcattcccggtcgtccctcaccacttacatctgggcgatttgcgtcgtgctgcgtcgcctcctcgtccgcctgcccttgtggcacgctctccggagtctgcgcgggagctggcgcgg

SEQ ID NO: 23377 - DNA, 75 bp, Chlorella protothecoides
gagtccaaggggttccggctcaatgttcaggctcgtccgccccaaagccggccacccaggagaatggggtggcgc

SEQ ID NO: 23378 - DNA, 772 bp, Chlorella protothecoides
aacctaaaacctaaccctaaccctaaccctgactgcgcactacacaccaccctgcatacacggccgtctgtgttatctgtctcccagcaggccagctgggcacgcatgggccacactatatcacaggtggcatggtacagggccacacatcagcctacagacctaccatcggcccacaaatgtgttggcaagagatggtaacgccaggcaggtcgcgttgggcggcacgcatggccatccgtgatatccagatccgcagcatgacagtctggcacacatgagatgcacgatatcacatacttctttgtgcaggacggtatatggtctcacacatgcatcatactctcagataattgccatctggaggtggtaaacgttatagggtcctgcaaggctctgtgaggagcagtctgtaatatgtgtgcgtcacatccagccctggcagatggccaacagtaaatatcacacatgggatggctgacgactggtctctctgctgatggtctaccatggctagcactacatgtgcaacagagatggtaaagctctgcaggacacatcaagctctccagatggccatctgtgatatctgtttccctgcatgtctacctggcatcagggggaccaggaatatcgccgaagagccaatacacggcgtgcatgggtgccatcagtcaaccactactgtggcgttttagtatctaaacatggtatttgttggcgggtgtgtgtcatgcttgtcccggacaatctgagatattctgcctccctg

SEQ ID NO: 23379 - DNA, 74 bp, Chlorella protothecoides
ccccccccccccccccccccccgccactccgtccacattcaccgccgccctcctctcccgcattacatgattgc

SEQ ID NO: 23380 - DNA, 100 bp, Chlorella protothecoides
acaggagtgtagcgtccaatcacttcatgtaaacataagaaacttatgtgcgctattgaggaacctgaaatatacctcgtatagtaggcgaaacatcgcc

SEQ ID NO: 23381 - DNA, 139 bp, Chlorella protothecoides
ttccaggagagcgtgtggctgtactgtgcagatccaggggtggaggcagcccccaacaagcacgcagcttgcgatggttgtcgatcaggatcgtttcccatggttgcatgccccataaaatgcagcaggactgtgaaaa

SEQ ID NO: 23382 - DNA, 61 bp, Chlorella protothecoides
ttcccagccaacgcaacgtacttgcagacgtgcgtcgagccacagggggtcaaagggcgcc

SEQ ID NO: 23383 - DNA, 86 bp, Chlorella protothecoides
gtgaatcagtgcatgctgttccgtaaaactatggcggtactctccatctgaaactaaatgggagggtagggtttggaatggaacac

SEQ ID NO: 23384 - DNA, 111 bp, Chlorella protothecoides
tcccaaaccccttaacatgtccatgtgctctcgcgcaggtggtcacgaggagggtgcgtcgtcaggttgccttcaccatcaccaaggtttgatgccccaggggttgggggc

SEQ ID NO: 23385 - DNA, 68 bp, Chlorella protothecoides
tggcgcagtccctcgccgacagccgcgccgtggtctgtgcgggcccgccccgggcgaagaggaagaag

SEQ ID NO: 23386 - DNA, 293 bp, Chlorella protothecoides
cacgaccagggagcgctgcggtcccctgggcaccacggggcgaggatcctgccagtgaacgtggcggtaagaagtttgttaagggaacgatatggacacggggtggctgcccatattataccacagtgacagtctgggtgttggagcgcttgcgaccgcctctggccagataacccggaacaatgcaccaggatgcgccccgccatctgtcgggccggggggggcgcacccacactaaaccactatcatacttgtcccagacgctggcacgaatgactcccgagcagccccac

SEQ ID NO: 23387 - DNA, 224 bp, Chlorella protothecoides
cgcacgttgatctgtgggtggtggtggtggggcaggggagggaggggtgacggggagggggggggaaggaatggtacacgtgggctgcctgaggcatgggcgcgtgtgagacgggaccagagacagggagtggctctggtatgggtcgctgggcacgagtacgcagggcggttgacgggtcggtgggcagcgcgcggtcaggagtgcggggcccctcgccacct

SEQ ID NO: 23388 - DNA, 431 bp, Chlorella protothecoides
cccctccctcccccaacacctccccccaccccttgccaggtcatccactcccagtcgtacagcaaggccagcgacgtgtacgcctacgggctcatcctgtgggagttactgacctggcagctgcccttcgcggcgcagacccccttccaaatcatcctcatggtggcggagcgcggcgagcgcccccccatccccgactcccccgccgagtaccagggtggcgacttcgaggggtcggccgactacctggcgctgatgcaggagtgctgggcgcagcagcccaaggagcggcccaccttcgagcacatcatcacccgcctgcgcggcatcctggagcaggccccgggcaaggccgcgcccggcgccggcgcctcgggccgcgggctgctgggcggcgtgggcgccgcctcgcccacgccggcggggtccag

SEQ ID NO: 23389 - DNA, 77 bp, Chlorella protothecoides
gaagtgggcaaggatggcgcacaagatacgatgtactgtacttgctaattggcgttcacagcgaggcaggcgaggca

SEQ ID NO: 23390 - DNA, 71 bp, Chlorella protothecoides
attggcgttcacagcgaggcaggcgaggcacgccatgcatcgcaatgggccatggtctcagatgattccca

SEQ ID NO: 23391 - DNA, 186 bp, Chlorella protothecoides
tgtgggtccgctgggcggcaacctcagtcctgtctcactcaccgcacccctttccccccctctcttccaggatgtggtgtctggaggtccagcgagccagaggccctgctgacctccttggaggcgagcacaaggcaggagtgcacgcacgcgctacgagcctccggcctccacgtgcacctcgac

SEQ ID NO: 23392 - DNA, 61 bp, Chlorella protothecoides
cccagtcccagccccgaggagtcaccctcttcaagccctgaggagtctcccagtcccagcc

SEQ ID NO: 23393 - DNA, 62 bp, Chlorella protothecoides
ttacttgcaagttccagctctcaccatcgtccccgagatcaagggggaaggacttgggtcca

SEQ ID NO: 23394 - DNA, 61 bp, Chlorella protothecoides
catgggtgattggccgagcggtaccatcggaccggtggtaccggaatcaaagcagtcgccc

SEQ ID NO: 23395 - DNA, 64 bp, Chlorella protothecoides
tgcaccatataaagtggccatccttgcatttggagcagttcaacaaagctgatcacagtcaccc

SEQ ID NO: 23396 - DNA, 122 bp, Chlorella protothecoides
gaggtgtttgacaacattaccgcgggtgcgagtggttttcttggaggaggacgtgtgtgtgtgtgtgtgtgtgaagggggggttgaaccacacttgccatgacccctgcactcgtgcctgag

SEQ ID NO: 23397 - DNA, 77 bp, Chlorella protothecoides
gtgaggcctgtggtgggagagggtgggtgtgttcccagggaaggtccgggatgggtggccaaaatcctgggagccag

SEQ ID NO: 23398 - DNA, 68 bp, Chlorella protothecoides
acctgggaagggtcgatgaagtcagatccatgccagtatctgtccatggtccgtgacagctgcaggcg

SEQ ID NO: 23399 - DNA, 70 bp, Chlorella protothecoides
tgaacgctctgcatagattttggcctgcatgtatcacctctcgttggctcgaatgcgcaaagagcaccag

SEQ ID NO: 23400 - DNA, 277 bp, Chlorella protothecoides
gtgcgcttgcaggcctgccggcatcggggttggagtggctgggtgatagcagcacttcaatgggtcatggcatgcacgccgggtcattgggcaaactaacggggtctcgctgcccctatcagacttccgcttggcccatggagcatcgccacggagccgtgccctggtgcaccaggctggcgcaccacactctctcccaccccacctgtctcacttcagcacccccttatggacccccccccctccctttccgcaccttcctcgtatgcaaaatgca

SEQ ID NO: 23401 - DNA, 61 bp, Chlorella protothecoides
ccccttcttctccattgccgggtctgagtttgtggagatgtttgtgggcgtgggcgcgtcg

SEQ ID NO: 23402 - DNA, 104 bp, Chlorella protothecoides
gatgcacacagacgtgggcactcttcatccgcatgcaatctatcattcatatctcctttagccatcatctccaacatgcccaataccgaccataggtggatgag

SEQ ID NO: 23403 - DNA, 69 bp, Chlorella protothecoides
cgagggcggttggtggctaggcaggggctgagagcgtcccaaggcaacttgggaatgttgctcttggga

SEQ ID NO: 23404 - DNA, 74 bp, Chlorella protothecoides
gccctcctcgtggtgttgccctggtcccttgttcccctccaagtacatttcctcatccccctctaaacttctct

SEQ ID NO: 23405 - DNA, 289 bp, Chlorella protothecoides
tttgaccgccacatgaggatcagcgccccaaaaccgacagccacgagtacgtagaagaccagcagctgcggggtgcagtgtctgagggttgcagggcaggggccgggagcagaggcggctggggagggcaagtccagtgtgaatgccctgtttgatttcgggatctcaggcaccccgcttgcaatgcctggccacagccgcaggcgcgagcttggctgcctcagaccctgcaagcattgttcgacagagtgcatcaacccgccagcccacctcttgcagtattttgttg

SEQ ID NO: 23406 - DNA, 74 bp, Chlorella protothecoides
cccctgtggctcgaggtcatcgaagtgtgcctgtccagcgtgttacaggaaaaccggggcatagagctgaatgt

SEQ ID NO: 23407 - DNA, 79 bp, Chlorella protothecoides
gtccccccactcctgcaagtccacctgatacaccccactcccccccgccccccgctcctcacccatgcgtcgtgcgata

SEQ ID NO: 23408 - DNA, 76 bp, Chlorella protothecoides
gaactccttgagcatgcgcccgctcttgatgccatgcaccctgaacgggggtggggagacgggtgagtgaacaggg

SEQ ID NO: 23409 - DNA, 6897 bp, Chlorella protothecoides
  modified_base (603)..(612): a, c, t, g, unknown or other
  modified_base (1389)..(1398): a, c, t, g, unknown or other
  modified_base (2021)..(2030): a, c, t, g, unknown or other
  modified_base (2306)..(2315): a, c, t, g, unknown or other
  modified_base (3994)..(4003): a, c, t, g, unknown or other
  modified_base (4893)..(4902): a, c, t, g, unknown or other
  modified_base (4969)..(4978): a, c, t, g, unknown or other
  modified_base (5053)..(5062): a, c, t, g, unknown or other
  modified_base (5362)..(5371): a, c, t, g, unknown or other
  modified_base (5809)..(5818): a, c, t, g, unknown or other
  modified_base (6460)..(6469): a, c, t, g, unknown or other
ccactcccgccgccccgccgcgctgtaccgctccaccgtgccgtgcttgaaggccagcagcaggccgcccagcggagacgccgccagccccgccaccacgcccaggcgaaggtccccggcggtggccgcggcggccgaggtcgagccgtcgccgtcgtcgaaggagagcgcgcggcggcgcagggcgccctccgcgcccccggacaccaggtcgtcggcctgggtgggcgacatcagccccgcctccacgcccgggaaggcggcggggacgccgccgccctcctcgcccgcgtcggccctggggtcgcgcaggttcttggccaccttcttgcccagcttgcccagcatgcgcacggccttgcctgcgcgagtgggatgatgtgagggaggggtggatgtggcgtccgaggggaggtgcagccgtcctgccacccgggccgggcccggggtggccggcggcggtcgtcagcccctctgccctcgcacacatccctgcgtgtgcttgatcacatgcatggcacccggctcctggtagtgagccgcctccccggttggcacctgcgccctgcacgacccgggagccgcccatgtgcacgcgctccnnnnnnnnnnactcctggtggcgagccgcctccccggtcggcacctgcgccctgcacaacccgggagccgcccatgtgcacgcgctccacgaactcggccacgccgcggtcggagagcgcggcccagttctcctggtcggcgaccaggcgcgggtggaagtcgcgggggagcagggccaggggccgcccggtggggcccagcgccaggccgcgggccgaggggatgcgctgcttggagtcggcgtcggcatccaggccggtgtaggagggcgccgaggaaaggccccaggcctcctccccctccacggcctccctgccacccgcggcggcggcggcgccgccgcgcacgagcacgcccaggaaggcaccgcaggctgcgtcccagaggaggatggtggagcgggaggccgaccacacggtcgagccgtcggccgcggccgccaggaagcggaccgggccgccgtgcggtttgtcatcgcggccgcgccgcacctcacgcgtgctcagagggcctgagaaggaggggattgagagggaaagggggctcaagcatgggagcgggcgcactgatacacatgatgcacggtgtcggatggtgccctcggcggcgtcggggatcagcctcttcctacagcctcgagcgcccggtagatcccagaccgctcaccggcagggaagtggccctgcggggctggtggggcccggggccagatgcgaatgtggccgcgggaggaccccgtccagaggtggccgctggaggggctgacgcagagggcggtgatgtgcnnnnnnnnnnagcagggaagtggccctgtggggctggtggggccaggggccagacgcggatgtggccgcgggaggaccctgtccagaggtggccgctagaggggctgacgcagagggcggtgatgtgccccagacggtgcgcctgccactgccagcccacctcggaggaagacaggggctggccggggctggcgcgggacaggtcgtagcctggcagtatgggtgagggggtgagtcatgtgcctggacaccacaggacatccaggaccttgcgctcacggacaccacgtctgtaccagggggcagggacttttcccgggcatgctctcccccgcgactttgcaccagctatgcaaacccatactcccccccctcctcgaaacactcaccggtgacccagccatcgcggtcgccggtccagacgacggtcgcagcgtggtcgacgaagagcgcggtgacggccttcttccgcggcgggccaaaggtgtgggagggcgccgcgtccgcgtcctcccgagccggggcgaccatgcggtcccgggcagtacacccatactgctgcaggcccccctccaatgagggtccggccagcaggccgccgttccagcccagcgcgcccagcatgcagaggtnnnnnnnnnntcgggcagtacacccgtactgctgcaggcccccctccaacgacggtccggccagcaggccgccgctccagcccagcgcgcccagcatgcagaggtgggcgctgtgtttcgggtccaggggcgggaggcgcagctccacgcccagcggcacctccttgccggaggcgacgccggcggctgtgagggatcagggatggtaggtgttgggtgactctgagaggttgcgcggcttctggggccaaggaagcggcctttgaggggtgttccggtagggcannnnnnnnnncctgtgagggatcagggatggtatgtgttgggtgactccgagaggttgcgcggcttctggggccaaggatgcggcctttgaggggtgttccggtagggcagatggcgtgagaatagaaaagccattgcagctggtgtcgtggcgtcggctctggccaactgctacatgttgtgtgttgctcctcgacatcctcgggcccctcccagattccatggcaccagagagaaccctctgctcgcgctgaccgcgttctcacaccaccccctccctccgacgcaagcatacctggcgtggatgacggcggaggggtggcggtcctttcctgcgctccacagggggctggcgaagaggcacctcgggaggcaggtctctgggaggtgacgccggccccgctttcttcggccgccggcacctctgccctggcagcgagggcagcgaggccgaacacgtcctcgtcagcccacggcgaggacaggctcgtctggatggcggggtgagagctggcgtagctgggatggtcctgggaaaagggggccgccgggtcaggccctggcggggccgggctcgccgggaagctggcctcctgggagacggaggccgcaaaggggttgccactcgctgtcactgagggggctgcagcgcctggcgctggcgccggcaccccgcgctgcgcccccgcccgctgctgcccgggcgccgcccctgacgctcccgtaaggtgcagcagcgccaggtcttcgcagggtggctcgggtgcccgtgacttgagcaccgcaccggcaggcaggcggcctgcaggggtttcgacccgagccgcgggcccaaacacgggggcgggcaagggggcgccatgctctgtcagccaggtggcagggctgagcgccacgtcggcgttcttgctcgtgaaggggtgctcgctctgaaaattgtggtggttgcgactggggtgggtgagtggggggccaacaagtacaggcccaggagcgaggcatggaccaaagtgccccctcctcagtgccagtctgcattgacttcatgttgcgtccgccaccaggccagtcgcttggggcccttgcaggagtcgcccaggtttgaagcctgtctcattctctcagcacatccccatcgcgctgatctccagcgattcccacacacacaaacacagaccgtcctgccacgcatgccatggcacacctgtgccagagcaatcatgcggagcatgagcctgaatcggtgctccgtcaggcccttgccctcccgagccaccacctccgggctcttcacaaggcgccagatctgcaggaaggtcaaggactgatgagggaggactgtgtccaatatcagggttggcacccagtcccctcacgaactgcaagcaggcaccctcgtgctatgacatgtctggcccaccttgctcaggtcagcagatgacaagccagagcgcaggaagaaggctcgagcctcgtgatcggccaccctggaacaccgtgagaggaggccaaacggctaagacgacgcacacacctggtggccacacagattggtttgtactgcatttgctccatgctgtgggcttggattcaatccatgcatggccttgcccctgtgaatgcttcctcacagcacagacattgccacatctctcactcccccacctgccgtcgctgtcggagtcggcnnnnnnnnnnctggtttgcactgcatttgctccatgctgtgggcttgcattccattcatgcatggccttgcccctgtgaatgcttcctcgcagcacagacattgccacatctcccacacccccacctgccgtcgctgtcggagtcagcatcgctgaaccactgggtcacggtggagtcctccacaccatccaccgggggctgaggcatctgaagggacgccgtgcgcatcatctggctggaagcccgcgagggcccccctgaaaactcccgcatgggtccactgcggcgagagccaaactccgggggcagcaggtcctgcagcggagtgcacttggctgatttcattccagaggagctcaaggggcatgcatgcccgaggtgtggatggtatgagcgtggagaggagggatgcccacccggtccacctgaacctgccttgaagctcatactgtggaccgagtgaccctgtcgatcacaggccacagcctccgtatctcttcagtatggcattctgagcctccaaatacgctgtcccaagagctgttggtcgtgatgagcccctaatcagcgcttgcagcacgctggcgaggctcgtagctcggggcagccagtctcgcaaccaccgacagacttctcgggactgacacggaatggaatgcagccgatgtgggtctgggtgagggtgaaatggaagcctttcgtctcatcgagctgtcgagatcgctttggacggatatacctccctggcaaggatccagtcgtggccccgttcttggtcgcgcgcctgtaacgagacttgtcacacgttcacagccaagcctggaattttccaaggagctttgactcaatgcaaagtatctgtataattctgtatttactcatctgcacatttggagtgnnnnnnnnnntgacagggatccagtcgtggccccgttttcggtcgtgcgcctgtaacgagacttgtcacacgttcannnnnnnnnnggctttaaaaactcactcgaacgggccttcccatccttctcggtcaccaggccaagtcgcgttaccgggaccggnnnnnnnnnnagctttaaagactcactcgaacgggccttcccatccttcttgggcaccaggccaagtcgcgttaccgggaccggcatggatatcctggaatccgtggggccccagctgcttgtacacgatgggcagaacatcgtgaagcgatcccctgggttctatctcaaagggaagaccgtggccttttacttcagcgcacactggtgcgtgtcttggggtgggggagttgcttgcccgtggagcatgccagcctcagacaggccttcatcgtcctcgaagcgtgagtcgcgcccacggccagaccgnnnnnnnnnnggggaagaccgtggccttttactttagcgcacactggtgcgtgtcttgggatgggggagttgcttgcccgcggagcatgccagcctcagacgggccttcatcgtccttgaagcgtgagtcgcgcccacggccagaccgagcaagcgctgctctcggatcctcctcgtgcacagagtccagggctctccccttcgcaggtgcccaccctgccggcagttcactccacagctagcggcagtgtaccggcaactcaaggctcgtggcgtcgcctttgagatagtgtttgtctcctctgacagatcgccgtcggaccaggaggtgagtggtgggggactgggcatctgctgcagcatggctcaggcccccccactgaccttggcacgctggggtgggtgcaagactcggcggctgatccgtacccacccacaaatcgccccnnnnnnnnnnggccccactgaccttggcatgctggggtgggtgcgagattcagcagctgatccgtacccacccacaaatcgcccctggcacagtcatacttccggagcatgccctggaccgccatgccctacgaggccgcgaggggggacctcggccgggcgctggcgcagcgattctcgctggcgggcatccctcgcctcgtggtcgtgggtccagacggggcgatcgtgtcgggggacgcacgcgccgcggtcgccgcggaccccacgggcgccaacttcccctgggctggacctgcgagcgctgtagccacgggcgggtgaggcccgggagcatgggtgggttgctatacggtggggactggttcctggcacccggccgaatgggtccccccaggaggcgccgccctgcagcccttctcaaaggcctggaggccagagactctccctttcccacctttccatgccctcaaacccatgcaggtgggcatcaaaccctgttgctctcatgctcctcttcctcgtggcctggctcgtgtccaactggatgacaaaggggcaccctgcacccatgcagcatgtcccaagctgactgacgcttcctcacacatgaaggctagacttacagggagggcacagaggcagcttggcnnnnnnnnnngactgacgcttcctcacacaggaaggctagtcttacagggagggcacagaggcagcttggcttgatagctcgagggttgttgaattgcgtcatacagggaagtcagggctggtatttgtcaggggtctgggtcaatgagatgcattgtagcaaaatgccctgtggcaagggcagatacgaggcaaggagcttgtgtagcagctctgctccagtagcttagcaggcagtcatctgcagtggaatggatgaagatgggaagtacaccatcagccaacgcgattccagcctgatcattgctcaaaacagcaacattgcaagcaggagtgtggccgtcagattagcatgaccggttttcatcgttgcacggaaaacgtgcagtcagcagaccgttgtgagaagttaataggtaatcatcaccgccacagtga

SEQ ID NO: 23410 - DNA, 61 bp, Chlorella protothecoides
cgcagcacacaggccatacatggggtgtgccatacggggttgagggactcaggtgcatgct

SEQ ID NO: 23411 - DNA, 65 bp, Chlorella protothecoides
cagctcccgccgcagcacgcgcttgcctatcaagaggggggcagggtgccgatactgaaagggtt

SEQ ID NO: 23412 - DNA, 71 bp, Chlorella protothecoides
gcaagggagtgataaccgattctcagcactctaaatcatagtcccaggcctcatataccattggatccagg

SEQ ID NO: 23413 - DNA, 129 bp, Chlorella protothecoides
ggcttcaggcactccacggcggtaaggacctccgtggtgcgagctgacaggatctccaagttgctgacacggatggctgccatggaaagccccacaatgtggagggtggaggtccgggtggaccctgcc

SEQ ID NO: 23414 - DNA, 62 bp, Chlorella protothecoides
ctccatccccctcctcccggcactcccaatcactgcagccatacttctctgccccagacttc

SEQ ID NO: 23415 - DNA, 171 bp, Chlorella protothecoides
gccctccttgtcggtcacgatgacctgttgccttcgggaagcgcgccagcctggcaatcgccgaaatagacatatggtcaccacctcggccccatgcgccgtgactatccctgcagcccctcgcggcccaccacctgattacaatggagaacgtccgtaacataaagatgc

SEQ ID NO: 23416 - DNA, 61 bp, Chlorella protothecoides
ccgtgcagcagaagtggaacctggagttcaagtagaccctggggtggccctgcggtcatcc

SEQ ID NO: 23417 - DNA, 61 bp, Chlorella protothecoides
atgtcgcgatgtgatttcttgagctgcatgtttcattatagctcgcatatgcagctgtatg

SEQ ID NO: 23418 - DNA, 61 bp, Chlorella protothecoides
aacttgcacacacttgatggccacaggctcgccgttcatgaggtggccagcaaacacctgg

SEQ ID NO: 23419 - DNA, 174 bp, Chlorella protothecoides
cattcccatgcaatctaagagtatcctctccagattttgatgcggctgcatgtcgacaagatgcaggccttgggattccatgggcacgagggctcatggagcgccagcggccaaccagaacaactcactggtctgtaaaccttactccacaatcctcctcatgcaaactcacag

SEQ ID NO: 23420 - DNA, 122 bp, Chlorella protothecoides
tcagtcccatttggcgtgcgtcttttagagagggggcccatcgcggtgctttgatctggctgagccttgaactcattgatccccgcctaaaagtataccctgatctgctccctgaccccccc

SEQ ID NO: 23421 - DNA, 139 bp, Chlorella protothecoides
tcgaggtgggtctgtgcacacctgtgcccatctcagatccatgacacgaacgttcccatcttctgccccaccgtctcacatcgtatcacagcacatgaacggaagcgtaccttccaaagcggcgcctgccgtgctttta

SEQ ID NO: 23422 - DNA, 61 bp, Chlorella protothecoides
acctgcaaagcggcaaagcagcacggcaccacccgcccctctccgccccaaaggcccagcc

SEQ ID NO: 23423 - DNA, 61 bp, Chlorella protothecoides
ctggccagtgatgccgagggaggaaaacggacccgcctcccttgagaggactgaacgtcgc

SEQ ID NO: 23424 - DNA, 61 bp, Chlorella protothecoides
aagaagtgttgcttttgcctcgtaatatttttggcaatttctcgcctgcagtaacggcact

SEQ ID NO: 23425 - DNA, 175 bp, Chlorella protothecoides
gacaacgcaaccatgattccctcttatttttgccttctcccatggaactcagcaggccaggccatcgccgccagtctccgtggcgccgactccctgcccggtggctgcaccggtctgcgccccacccacctctgcggcggcaggcgccaccgacgatgccaaggagcggcggcgc

SEQ ID NO: 23426 - DNA, 15225 bp, Chlorella protothecoides
  modified_base (965)..(974): a, c, t, g, unknown or other
  modified_base (1879)..(1888): a, c, t, g, unknown or other
  modified_base (2180)..(2189): a, c, t, g, unknown or other
  modified_base (2803)..(2812): a, c, t, g, unknown or other
  modified_base (3693)..(3702): a, c, t, g, unknown or other
  modified_base (3998)..(4007): a, c, t, g, unknown or other
  modified_base (7337)..(7346): a, c, t, g, unknown or other
  modified_base (7465)..(7474): a, c, t, g, unknown or other
  modified_base (10768)..(10777): a, c, t, g, unknown or other
  modified_base (11954)..(11963): a, c, t, g, unknown or other
  modified_base (12098)..(12107): a, c, t, g, unknown or other
  modified_base (12510)..(12519): a, c, t, g, unknown or other
  modified_base (13003)..(13012): a, c, t, g, unknown or other
  modified_base (14364)..(14373): a, c, t, g, unknown or other
  modified_base (14680)..(14689): a, c, t, g, unknown or other
gggtgggtcgggatttgtgtgtgagggtgggtgggcggggtggagtctcgctcgacccttcaccaactgatcgtgggtattgagttcctgagcgggccggagtcaagcaaacaggcccgcaagcagaaagagccaagtggacgtgtcgcgcagaggcgcttgcaatgatccacaatgaagacgcatcgtcacatagaactaaagataactgcgcagaactggtgcaagaagccgacgccacatgccaatgaacttgcctggagccacagacccctactgataccacacccgaacacatggcgcccccgcaacaatctccccgagcgctcaccatacatcaggcactccacgaggggcgctcctgccatgctcgtgatgttgaccaccttcaggagcaccagcaggtaggttgcaaacccaaacacgagggcggaaatgaaggtgcccaccacctgtaccgcaagcaacggtggggtttgggtgaaacaaaggtgctgccagatcaagatgtgattgcagggcagtaagcctatcgactgcatggagctcgcctcgggcacgattaggaactctaaaggtgatacagaggacatacagcaccctcaacccaccaccagctcgactcatttcccaatgcattcggaatcacacaaataatcgctctgcaactcacagcaaacatgaggatcggcccaaggttgtggaaaaactgcttcttcttcaatgtgaagcccgctgcaaacacgatgggggggagcagggcgtagaagaacacctctggcgagaatcgcagcggcttggccagacctggaaggaaaggatggagaaggttgaggaccactgtacatgcagtggtttcaatcatagcatcgacgtgcacttaagcaagccccctggggttgagtaggggtggtgggtccacgtgctatgtttacaccaggtactccaatcgcgcctctgccatnnnnnnnnnntgatcactgtacatgcagtggcttcaaccatagcatcgatttgcatttaagcaagccccctgggtttgagtaggggtgctgggtccacgtgctatgtttgcaccaggtactccaatcgcgcctctgccattcagcccccacctcatctgcagcatgcaagcctgctcctcaccgatcactttgctgagtattccagcaaatatgccgatgaccatcgcacagctggctgggggtatccagttgagcttgtgacgctgtatgaggtaggtcaccacaatgaccacgatgaggagagcccatagtaacgtgatctcctcctgtgtatgtgggaatgggattgtttgggaacctcagtggccgtggctatccgtttttgcctgagcgttcctcgagaacaagcgtcaatgtccccgactcgatgccctaaggggtcgccggaagcttacagaggagacggcctctccagagtagcctttgcccaccaggcccattacgacacttcaacgcagaacgtcgatctagcgtaatctgatcgagcacggcctcgcgacttccagacaggtggagaaggagtcgagacttgctgggacaccttgcgtctctccgctactaggagcgcattgtctcgcgaacctgagctttcatttaactgggaggagcatgtgctctatagtgattttaagcaagtacttgcacagcgttcgtttagtgtattagacctggcatgcagcgttccggatttatttcgccattcagcgcgcccggagatcagactcacataatcagagggagacgtgccttcaacgcaacatgccagatatacggacccagatgcatgcaagcaacagggctaatgcctaggtacgctcttatgaggcccatcccttcctcgtcttgcagctatnnnnnnnnnnaggcttgcagcgttccggatttattttgccattcagcgcgcccggagatcagagtcacataatcagagggagacacgacttcaacgcaacatgccagatatacaactgcatggggacccaaatgcatgcaagcaacggggctgttgcctaggtacgctcttataaggcccatcccttcctcgtcttgcagctataccggttcttggacctgggcatccatgcccagacaagcacgaaactatccaaaggctacaagattaaaacgacatcttctcagactcctccctgatcnnnnnnnnnncacccgggcttccacgcccagacaagcacgaaactctccaaaggctacaagattagaacgacatcttctcagactcctccctgatcttctgaaatagcacggacgagaggtagcgctccccaaaggatggcagcacgaccaccaccagcttgccctcgttctcagggcgacgtgcaatctgcaatgggtgctggcaggtgcgatcagcagggtgtgatgtgtcacacaagggatgacctggtgagcgcaacagtggccgagcttggggtgtgtaggaagcccctgcaatccgaccacggtgcaagccatgccctacaaagaaaggagtctgttctttactctgtttgcaaacctactcacctcatttgctgccagaagcgcagcacccgacgaaattcccaccagcaacccctcctcactagccagcctgcgagcagcctctacagagtcatcgctgctcacctgcaaggggtcggacatgaaggccagatgatggcatgggaaggccatatcgcggggcaaattcgcaagctggcccatccaaaccctccctccacgcaggaatctatgattttcaatggacatcagccatgaaacccacctggatgatctcnnnnnnnnnntatatcgcaggcaaattcgcaagctggcccgtccaaaccctccctccacacatgaatctatgattgtcaacggatatcagccatgaaacccacctggatgatctcgtccaggatggaggtgtccagattcttgggtacgaaccctgccccaatgccctggatcttgtgaggggcaggggagccgccagagatcacaggcgactccttaggctccactgcgatcaactgttgtgggtgtgggggatgggccggtgacgcagagtgggggattacactgccacccctactggcagtcctcgcactccggaatcctggagtggtcgcatgccttgggacacaccttgatgttggggttctgctccttgaggtagcggccggtccccgtaatggtaccgccggtgcccacgccagccacgaagaagtcgatcttcccagccgtgtccctccagacctcgggccccgtggtctcgtagtggatcttggggttggcggggttctcaaactgctgcagcacaaacgcgttgggggtggctgcggcgatctcctcagccagggccaccgcgcccttcatgcccttggccgggtcggtcagcttcagctcggcaccaaaggcgcgcagcaagatgcgccgctccagggacatggaggcgggcatggtcaggatgagcttgtacccgcgggcggcggcgatgaaggccagtgcaataccggtgtttccagacgtgggctccaccagcgtggtcttccccggcgtgatcttgcccgccttctccgcctccctgatcatgcttaggccgattcggtccttgactgcatgggcgtggtgcagtggccgttgttaattgcaacgtgcaggacgtctatgccttgcgaacacaccnnnnnnnnnnacgtggtgcagaggccaatgtaaattgcaacatgcaggacgtctatgccttgcgaacacacccctgctccatgcatccatgtcgacccacagaatcacaagaaaaaccctcatacaggcatctcaccagaactgcatggctccatggtctccagcttggctgccaccctggccacattgccctcggtcaccttgttcaggtacaccaggggggtgttgcctgcagggagagtgtgagggtttcgctaagatttgtgcaagagagagagagctgccgcatccaggtgcccttaggannnnnnnnnngttcactaagatctgtgcaagagagggagagctgccgcatccaggtgcccttaggaccccgaaatcaccagcttgagctggggacaaacctcaagggtgcgctcacctcccaagccccgttcaaatcctcctccacaccatcccctcactatgcagtacccccacatccctacgcaccgatgagctccgagatgtcatttgcgatgcggggctgtgatgtagtggcaggggcttcgggtgcggccacagcgcggcaagacaaggagtggcgagatggtggcacgagccggctgggccccgcctgtgtgtgtgagtactgaaagcaacgtcgtgagatggtcgccacgtacatttcaactcgtaggataaaagcaacatggtcggaagaaggattgtggagtggggaagttcgggacgaatggcaagagttgaactgtcagagggaacaggcagcacagccccagcgaatttgctggcacataggaaaaccccagcacgtgtaaggtccgaagccggcaagcgccagccccactacctttcctcccagcacacagaactaccaacactcacccttatggcacgccgcacagagggaggagcgcagaaggatgaggtttgaaggcaccgactacttgcggcctgcgaaactacggaaggcatcgtcgtggagggccgtgcgatttggggaattcaagtgcgctgcaagtgagtaatcgaattacttgagcgtcggctcagaggtgcatgtgggatgtttagatatttttggaaggggtttcggcgcgcgcgacccgcgaggcgataagaagaaagatcgagcatggactatgaacggagctgcccggcgcgccacccccgcgtacgtcgtctcggccaataaatgtccatggaatagaggatccagcttccccgacaattgtcctgggcaacgtgtggtgctgtaatgagtcaagatgagtgtatatcccctttaaaagcagattgcaaggtctctctgtcgtatgatgggactgtatgctcgaggccgcagggcctcctccctcctcgtactcgtagcgtttctcgcgttttaccctgcaccggcccaggcacagtggtgggccaacttgggcgacatatttggtggtgattctggtcctcctcctgccccaatcccgaccgcggcggcaccagtcccgacgacgagtgcgccggctccgaccgccagcagcgacccactcccggcagtggctccccttcccgtcagctccacagccatcgctgaatgcagtctcctctacgcgatatctcagcaggttaatgcctccatatacacgtcggcaatgcagctggatggtgttcgcaagtgagttggccatgtgggaggtgcgggtcaaccggaacagtgttcatagtgatgagccagcaagcctggcctgtcatggactccacgccgtgcacagtgcacatcctcgtgggtgcgtgtaagggtcttggaccatgtaccatccctccagcttgccaccagctgacctcctacacctctgtcacctgcagcactctgaatgacccggccttcaagggcacggcttttgttccaacaaacgccgcatggtcgaacctgctgactgcccttggatggagccaggatcagctgctggatgcaggttctcgggacgctctcaacgagaccctccagtacaccattgtgcctggggcagcacagacccagcgggccttggcaggcctgacctacctggccccgctccctacggtacagggccagccactgctggtgagtggtgcaggagcacatggcagacatcgggcgatggctttgctgggacctgggtgtgacatccctgctttccacgaatgcagccacacggccgatctccctgtgtatgcaggcttgcaggaaacatggatgagacattacactgcacttgccgacatggctttggtatctgtgtaagtgcacccttctccttgctccctctccttctgcaggtggattcggagacgggttacctgcgtgtggtttccaccagccgccagcctgccgtcgtggacttcaacgcgaccatctccagctgccagaatcaggcagtggcctactttgtagaccaggtgcgatgggtcgagggccatgtgtctcgtcataatactcaaaccaagcttgccaactgggtagattgactaccaagatactcgcgtaaagaacaccagcctcagcactgcacccatgcacccccttgcactcttgcacaggtgcccctccctgaccctgcctgggtgtcaagctgagccacagagggaccatgtcctcatgctcccctgttccaacgccgacattggccctccggctggtgtgcgaagactgcagcagttgtgcacagggatagccgccactgggcgtcatgagcttccgtctggcgtgtaccggcgctgtacattcaagttgattttcagcagacagagcgtagggcccctgcaggagtatgcttatgacgaagggaggcacggattgggtggcggcgtccccatcactcccacgactccaccgccgcctgcatgcagccctttcatttgccgatgcagaactctgagaacacagagtccagcacctcctcggtgtccaccaccccgctgatggcccccaggccgcgggtggccccccgcagctcctcggccgccagctccagcgctgcccacacgccctcgtaccgctccagcgcggcgacgcaccgggaaagcgcggcggcgtgcctcgcgcgggtgaccagggcggcggcctcgggatcgccgccctgggccaggatgtcctccactgcccggcccagcagccgggtcaggtcgtccaggccctcccccgtctcgcaggagatgagcagcggcgcggtcgaggggggccctctgtcccgtggcgcaagctctgctggcatgccgaggccctggccccggggaccctggccctccgccagaaggtctgccttgttccagaccgacagggtcagctgggcctctgacaattcgccgagcgtcgagtcgccgccccagtccccagcctgggtggcggcggcatcgtcaccggcccagaccgcctgcgcatcccggagctggaccacgatgtgtgcggtggccagggtggccctcgcccggcgcacgccctcggcctccacagggtcctcggtctccctgatcccggcgcagtcggccaggatcacctggggtattggggtgttgaggggggggaaagagggaattggactgggacatggggcatccccctgaggaccttggccacgacatgccacatagatacatgatcacattcagctgccaggcccnnnnnnnnnncgtcagctgggcctctgacaattcgccgggcgccgagtcgccgcccaggccccctgcctgggcggcggcggcgtcgtcaccggcccacaccgcctgcgcatcccggagctggaccacgnnnnnnnnnngttggggtgttgagatgggggagaggggattgtcctgggacatggggcatcctcctgaggaccttggccacgacatgccacatggatacatgatcacattcagctgccaggccccccctgtgcccacccacccgctggcccccgagctccagctccagctccatgacgtcgcgcgtcgttccggggaagggggacacgatggccgcgtccctgcccgccagcgcgttcaggagcgagctcttgcccgcgttggggggccccaccaaggccacccgcaccccgtcccgcaccagctggccgcgctgcccgccgcccaggaagcccgccagctcggcgcgcagggcgcgcatgtccggcagcaccccggccgccacctcgtcggcgatgccctcgtcctccccgaaatcgataaccgcctgggcttggggtgtgtgtgtgtgcgtgcgtgtgctggggaagaaagagggtatggggggaagacagcgaggcttggggaggcaatgcatcgtgcgtcagccggcggagcagccatggccccaagcgcggccggtcggccggtgcaaggtgtgagtggtcttgtgtccgaggcaaccaggaaccagtctcaagcagacatcggatcctggtcccgggatcgcacctccacagctgccagggcggtgaggaggcgggcgcgccagccctcgtaccgccggcgcacggcgcccgtggcgtgcagcagcgcctgcctgtgctgggcctgggtcccggctgccagcaggtctgccaggccctccacctctgtcaggtccagcttccctgcctgggaggaacaaagatagcgcaaggggtgagacgttaagaatgcagagtgtcaatgtccactcatcagccctgtgtgcatgggtatctctggaccccttggacattgcagcagcagctcattcatctccagaacatttccccgcgtgagtgtgctcctttctcagcccaacacatgtataaaaccaagcagcagtcggtccctgttggtatggtacctccacagaaccacccccccttccctacctcaaaggcccgccgtgtgaactcccccggctcagcaggtcgtagccctggcaggctcccaagcgctgccagcacggatcgcacgaccgatgggccgccatgcagatggaactccacgcagtcctccccggtgtagctccggggcccagagaagcgagtgaccagcgccttgtccagaagctggccactggccgggtccaccacctcgacgaggtggaggaggcgaggggctgggagccgaacaagcgccggagccatcgctgtcaacgcctcccctgcaaggcaggacgatgaggtacgaaggggggtgggggggcaggcagacagttggtcaggcggctggggtcctggggaacagcacatccttgcacagccctcagtgtgaccctgaatgatgccacagtatcgacagactccttgaccatcactgtaaatacacagtccccccacctcgcaatgtgtctcacccgacttgctgcctgtcaatcttaccactgccactgccgatctgcctgccccagtgctcaaagcaaaaatcgtgggcggctccgccagtgaaaccatacaacggactgcatggcggtaaatattatgcactggtcttgccagagagcgtgggcaccgcgtccaaactctcaaggcagccgcagatgctctcatgaaatataggtcgcaaggagccggctcgggatcacggatcgagcattctcgctaatgcatgatctcgccgaacacgaaacagcaatttatgatgaatcagaacagtgtacatgtcgatgctgacgccgggcgattgagctgatatcgtggtggtgcatgttgctgtcgaggaattttgcgcgcgcgatatcgtgtgggggtaaacaactaggcaaaggtggtcagggggaggaggagcaactacgtatccagcatacacattggatcgagatatattggttgagtccggtcaagttgtctgcattgctcgagtttactcgttggtcggcacctcggtcacgcagcttgggcaacacgtcgggttgaatggagtaaccaggagacccgagcgagggtctctgccaggatgagagggcccattttcgtacttttgttcatctccctgtgtgcctgtacctgtcttggctcggagccccgtcaattgcgactcaaggtcacatcccgagacatagactggggcccccacccccaccgtcgtttgctcctccggaactccagcattcccctccatggcgccgtaaaagagttcgggtatgtatgccgcctccttgcatgtagggcgtgtgtgctgacactctcctccgtgcaggatttccatatacaggttgccaacagccacccctccccctggacctccacacagctacttctttgccaatgtctacctgggctcccccgcccgcaagttcagcgtgatcgtggatacgggaagcaccatgacctacattccttgtgccgagtgcgggagctcttgtggacccaatcactgggtgaggcctgctctgccgcgttatgggaacctcatctgcttgggattggcacacgaccttggacagaatgagcatgtcatgggagcattccgcacttgatattcaatgctgtatgccatgatttcaccgctccttcccatacccagggtgggtcatttgatccgaggacatccaacacttctgaaaggataggctgcaattcgcccaagtgcatctgcggctcgccgcagtgcgggtgcactgccaacacctgtacctacacccggagttatgcggagcacagcagcagctcaggtgtgcccgtggggtgggagtccctgggactcagacttgtcatgtcacccctggtggggttggtaaaaagcaaccccccagaatgcatctgacagctgttcctcctttcccaatccccacagggttgctggtgcaggacgtgatgcacctgcacgacggcagcccccccgtgcccatcacctttgggtgcgagacacgggagacgggcgagatctactggcagacggcggacgggctgctgggtatggggcgttcccctgccagcgtgctaaaccagttggtggctgccgaccaggtggccaacaccttttcgctgtgcctggggtctgtcaggggggatggcgccctcatactgggggacgcgggcatccctgcgggggtcgacatgcaggtgggcaggaggcggtgaatgagatcattctgggcgtggaggggcgattggggtcctgcactgcgcatgaannnnnnnnnntatgcaggtgggcaggaggcagtgagtgagatcattctgggcgtggatgggcgattggggtcctgcactgcgcatgaacaagaacctgacgcagacaacttgcaaggcgttgtgcatgggctgtagaggacatggggatggttgcatgcctggttgagcttctgttggtgcctgggtattgatggcattacaagcaagagtaccattaaactacaacttgccccagtacacgagcctgatcacatcgagcttgcatccctactactataatgtggagctggagggcgtcggtgttggaggcaggatgctcagtgtagaccaggtatctcaagtgggaggaagggcggggcgccatgactgtgcagcctgtcctccctgccagcgcatgaattgtgctatcgaaggattgtcccaggaacaaggacgtggcatgacacagtcgtcctgcaattgcatcccaagcctggaaagcatgtgatcatctcgtggtccatgtgttcccacccatcatcccgcttcccaccattcaggcagagtactcgtccagaggatatggcaccgtcttggacagcggcacgaccttttcctacttcccacgccgtgtgtacaaagcattcatacaggcggtgactgaagcttccctcggagctggcctggagaaaaccactggtccagacagcagtgtgagtaggtgtacttggatgaagagggagggccaaaatgcgagctctggcttgaaagacaaaacagctgagtggtggcgggcaaattgatgggcaagtcgtctgctttgtatgctccagaccctgccaagcttgttgcctactggcagctggcatcaacccgctgcaaattgtcgagcacgaatggcatcccactgttttgcgctgtcagatttcgcggcttcccttcacaacaacatttcatttaccagcatttgacattgtcgtgcaggtgtcagacatctgctttgaaggcgctcccgagtttgcagatgctgttgggctgtctgctgtctttccgtcacttgagctagagtttgctggggtaagtgaggctgctcagaggcgcgcacttggcatgctgtaggaggtcactatcttatggacaggttcctagctgagcatcgctgctgctccacgcccgcccaggggatttcaatcccatctcctcatgnnnnnnnnnntgctgcaaattgtcgagcacaaatggcatcccactgtttcgcgctgtcagattttgcgccttcccttcacaacatcatttcatttaccagcattcgacattgtggtgcaggtgtcagacatctgctttgaaggcnnnnnnnnnngtgctgtaggaagtcactatcttatggacaggttcctagctgggcatcgctgctgctccacgtccccccaggggatttcaatcccatctcctcatggtccaaacagggagtcaggctgaccctccatccgctcaactacctgtttgtgcacacatttgggactggaaagtattgtgtcggcatctttgataacggaaactcaggtagggacattagagtaaaaccgtagagcagaatggcatggaggaccaagttgatcccgatgtttccaagagccggctcggtccaattactgtcgataagcatggacagcaggaactgactccctcacagtccatgtccttatcctccttctgcatggtccccacaggaacgttattgggcggcattgtgttcaggaacnnnnnnnnnnaagtccatgtctttatcctccttctgcatgatccccacagggacgttattgggcggcattgtgttcaggaacgttctggtgcactacgatgtctcttctgatcgtgtcggttttggtctgaccgattgtgctgctctagggtccgacatccgaccaccatgctccatttttgaccccaaggtggtaggggtctcctggggcctcaggttttgatcgagggtcatcgtggacccaggcagatgtgagtgacatttcatgtactcgctcgtgttctgcccaatccctatccgctgctagcacaaggtcatgcttggtggactacaccctttctttctgatattttccttgcagaatctggaagcagcggcgacatctggagactgtgcactgacggattctggaaatgccaaatccactggacctcttgatgacgggtctatatctgggcctgaagaggttcgggcagcagactctccgactgtcnnnnnnnnnnacacaggacctcttgatgacgggtctatatctgggactgaggaggttcgggcagcagactctccgactgtcggcgccgacaatgccgtcagctggaggtcgacggcagctgctctgctaccctccctcaccctggccctctttggtctgggtctgatggcagtcatcggcgtcgttggtgcggttgtcctcctccgccgtcgggctgagggggtgtggggggaggatgacacctccgaacgatccgccgatacttcaggatggcggtggacgcagggctggcagccccgacgctggtttggcgcgagagacgccagcggcgaaggactgcccctgcatggcacctccaagcagaggtcttcgcacaaggcccccaccctgcccgtgattctggaggcagcctccagtggcgagcttccacgggccgttcccttggctgtgctgggacccagccgagactagggtggccgaggaatggcggaaaaggactttcggcaatactgtatactgatggctggttggctgccgccaggcatgcatgcacagcatccctccaggaccaagcggtctcaatcaaggatttgtaaacaagacatcctttcagattctagagtgagggtagttggtagaggtcctgacgctcacaatacgccaaaacaatcaaggggctatcgcgctttgggcagataatccagcatgcccaggtctcgcagcgccgctgatgcagcgtcctggagggctcctggggccgaggagtccctgatggagtacagcacgtcttgagcatgcagcgcaaggagttctgtcttagcctcttcacacctgtcgtgcttggaggatggcatctcgtgggtgcatgccaggcagaaacagacacagtcgcatctcaacgacctcctgacctcacgctgtccctcgcattccgtcgcgctcagtctccactgggatggctttcatgagtcatccaatgacctggcttcccagtcgaaacccgcacctgacagccatgttgcggatggccatgcatccctgccgcatcgccgaggcggcccgtgggtcagcggtccgctccatggctgcagcagtgagcgccctgaggaccgcgtccaggcacccacgctcccccacaagagccagggaggcggccggattgcgtaaggcaaggttagtcatcagccccagcacctgcagcgcatgtgagtaggggtggtcgacacctgcatgcaggaggggcacgcccttgctgcagcttgtgagagcctgcttacacacctcggcatactcaggagaaggatacccgtcgcacctgttcagtaatgaggggccgtgtgttgtaccgcttgagcgcggaannnnnnnnnngaggacacccttcgcacctgttcagtaatgagaggccgtgtgttgtaccgcttgagcgcggaagcgagtcgcgggatcacgtcatcctggtccaggaaggcggctttgcacgagtcggaggagcagagctggcgcagggcggcgcaggcagcccgcatgacgctctcctccccggctgcagcgggccgtggaatggagatgcaggtggggcggtgagggtgaggaagaaggcctgtggtgtcaacaacgtttgacaccgcagcaatggcgcccaatcaagcaacgaccaccactctgccagcgttcnnnnnnnnnngtgcaggtggggcggtgagggtgaggaagatggcctgtggtgtcaacaacatttgacaccgcagcaatggcgcccaaccaagcaacgaccaccactctgccagcgttccctcccctccctccgccaacaacctttgctggctgcgctgaagtggcgcagcaggatgccgagagcgccatgctctgccgccacggcacacaactcctcgttggccgatagctgtcagggtgtgcgggagcggatgagattgttgcatccactgtgcattgtattattgtcactccctctcctttcctgcacaaggaaattcgcccacaggcccagagaggtgcaccatcctagcaccagaaccatgcactatcgcgcacaccacctgcttgatggccgagcacaaagccactagcgtgctgggactcgtgggcacaccctcgcgcagggagagggtgcgcaccagtaccgggagggcgcccttccccagactccgggcgttggcaaaggcactgtagagggaggtgtaggtgggggggggggattgg

SEQ ID NO: 23427 - DNA, 61 bp, Chlorella protothecoides
aggagtgcatggggtgctgagcctcgtctgcgccctggaccctgccgaggtgcggggcgcg

SEQ ID NO: 23428 - DNA, 79 bp, Chlorella protothecoides
cggtgagttcaaagggtactccttgctctatttaacaggggttgcaaacatacaggtccacaagtattcgctggcatgt

SEQ ID NO: 23429 - DNA, 123 bp, Chlorella protothecoides
cgtacaccatcgacgttgatgcaaaacccaagtacatttctacatcacgacgttgatatcaaactccgatcggttcccctgttcgccttgggtgccgcttcccatcgctcccacctgtacttc

SEQ ID NO: 23430 - DNA, 601 bp, Chlorella protothecoides
  modified_base (294)..(364): a, c, t, g, unknown or other
tacaatagaatatgtggccaaaactctccgcaacttcagcagcaaaaaggatattattgacataacctcctcacaaaaagtacacaaatggctaaataacagagcccctctttttactagggaaatggtggatgtggactttagaatttaagataataaagctcttgatcccaatgttatttccatgtgagggacattaaattgagtaacctttgccacataccctctcccagagtccattctctaaaacttgaagctccgcccctttttacgcacattaggcttccaattacnnnnnnnnnnnnnnnnnnnnnnnnnnnnnnnnnnnnnnnnnnnnnnnnnnnnnnnnnnnnnnnnnnnnnnngagcttttgaagagtaataagaaccatcacaaaaaggaacccagaagccgggagtgtctaccaaaaaaattcaagggttaaaaaaaagtgacattttctcctgttttttacacatgattttgaatgctgatgggtccacgtccagctctaaaggtaggttcatggttctccaaagttgctttcttgtcagaattgagccacatcaggtaggtggggaagtagatcagtgaggatgct

SEQ ID NO: 23431 - DNA, 67 bp, Chlorella protothecoides
tggcggtagctcgagcgacggcggaggccgtcaaggcgtttgcggaggccgacacggagagggcaaa

SEQ ID NO: 23432 - DNA, 68 bp, Chlorella protothecoides
gtttgcggaggccgacacggagagggcaaaagctgccgaggccagggtccaggcagacaaggacaggg

SEQ ID NO: 23433 - DNA, 115 bp, Chlorella protothecoides
taacaaatgcgaatgcgacctcctcatgcatcagattgcacgctcggtgctggtgccccaacgtaatgcagctccctcttcatcgcacaggggcctccccgggcacgaccgactc

SEQ ID NO: 23434 - DNA, 62 bp, Chlorella protothecoides
acaactatacgagaccattagacatgttttgcccagaatagatgtgcacagatacttggaaa

SEQ ID NO: 23435 - DNA, 61 bp, Chlorella protothecoides
cttccaggcagccacccaggcgcagatccgatcgacgttggactccatctcgggcacggtg

SEQ ID NO: 23436 - DNA, 61 bp, Chlorella protothecoides
cagccctgtatgggctcaccggtgcggcgggtgtgctcctgccttgtggctcacaccaata

SEQ ID NO: 23437 - DNA, 78 bp, Chlorella protothecoides
atgcatgttggctacatcttatgaaagttgtagccagcacactttggtgcatgattcgatcgtctcgtccagccaggg

SEQ ID NO: 23438 - DNA, 61 bp, Chlorella protothecoides
gaggagaggttggacaggttgggaggagagtttggacaggttgggaggagaggttggacag

SEQ ID NO: 23439 - DNA, 80 bp, Chlorella protothecoides
ccaggattattcaaggggtgccgttcctctgtgcctatacgtcgacatttatccatacattctcaccatgcaatcacacc

SEQ ID NO: 23440 - DNA, 61 bp, Chlorella protothecoides
gaacgcacccagggtggcccagcggcagtgaatgacctcgatcaccctgtagcgggcaaag

SEQ ID NO: 23441 - DNA, 216 bp, Chlorella protothecoides
agcgacatatcttcgactcgcatatgtcgcgcgtccctttgcttcccctgcacccccaaacatcctcaaggacttgtcatataattacagcgcatgcccatgtgcgccctgtcaacatgcaggagcacatccgcgaccatgccagaccgcccgcccaaaccatggccatcacggcccattgaacagggggggcgagcggtggtcctccgggtccac

SEQ ID NO: 23442 - DNA, 101 bp, Chlorella protothecoides
caggccagcctcctcccaccccaaccccctctcatcagccccctccccccggctagccaggcaaccccaccctgaacccagacaccttgcggtcagggtag

SEQ ID NO: 23443 - DNA, 24539 bp, Chlorella protothecoides
  modified_base (427)..(436): a, c, t, g, unknown or other
  modified_base (1275)..(1284): a, c, t, g, unknown or other
  modified_base (1600)..(1609): a, c, t, g, unknown or other
  modified_base (1977)..(2007): a, c, t, g, unknown or other
  modified_base (2384)..(2393): a, c, t, g, unknown or other
  modified_base (2573)..(2582): a, c, t, g, unknown or other
  modified_base (2676)..(2685): a, c, t, g, unknown or other
  modified_base (3023)..(3032): a, c, t, g, unknown or other
  modified_base (3470)..(3479): a, c, t, g, unknown or other
  modified_base (5313)..(5322): a, c, t, g, unknown or other
  modified_base (5692)..(5701): a, c, t, g, unknown or other
  modified_base (6282)..(6291): a, c, t, g, unknown or other
  modified_base (7751)..(7760): a, c, t, g, unknown or other
  modified_base (10790)..(10799): a, c, t, g, unknown or other
  modified_base (11563)..(11572): a, c, t, g, unknown or other
  modified_base (12444)..(12453): a, c, t, g, unknown or other
  modified_base (13198)..(13207): a, c, t, g, unknown or other
  modified_base (13872)..(13881): a, c, t, g, unknown or other
  modified_base (14265)..(14274): a, c, t, g, unknown or other
  modified_base (15790)..(15799): a, c, t, g, unknown or other
  modified_base (16137)..(16146): a, c, t, g, unknown or other
  modified_base (16842)..(16851): a, c, t, g, unknown or other
  modified_base (18149)..(18158): a, c, t, g, unknown or other
  modified_base (18872)..(18881): a, c, t, g, unknown or other
  modified_base (20848)..(20857): a, c, t, g, unknown or other
  modified_base (21418)..(21427): a, c, t, g, unknown or other
  modified_base (23023)..(23054): a, c, t, g, unknown or other
  modified_base (23407)..(23416): a, c, t, g, unknown or other
  modified_base (23960)..(23969): a, c, t, g, unknown or other
tccttcagcagcgggacggaggcgtgctgtggcaggggtgaagggggggggggtgtttggggggggtgtgtgagctgcatcccagggccttggtcttggaggatgaggtgaaggtagaaccctccacccccagtcctggcggccactgagtgcaacggctgcagctgcacagcccaaccctaacgcctccgataccccacctgcaggtcccagtgcttgtctgcatggttggtctgcttgccgtggttggctgggacgtcggtcagggacacccacagcatgtggacctgtgaggagcttttgagttgtgctgaggggtgggccgcgtgctcaaaccttctagatgcggtgacgacactgtttgccccctcttccagcctggcacatggataccccgactgtgggcagcctgggaatcctgcccagnnnnnnnnnngggagcttttgagttgtgctgaggggcgggccgcgtgctcaaaccttctagatgtggtgacgacactgtttgtcccctcctccagcctggcacatggatactctgactgtgggcagcctgggaatcctgcccagtactcgtgcacagcatgcctgttgggcccgtcgacacagccattcccactctgttcagatatgaatacaagggcttgcgtacccagtggaaattctcaaagcccatcgtggctgcgatgccggcaaaaggcgatgtgggtcgctcctctccatcgccctttgtggcttcgggtgtgtcggcgcccttggaggcgagccgcgactcctgcggcgggggaccggtgctgggctcggcgcctttcgtcatgatgacccagaggtggacagtggacattcctgcacagcgcaggactcggcctccggcgcgcacctccttcaggcggacatactgcgtgcagtaggccgccagccgcacgaagttctggaagtcctcctgcatcagtgtggacaccagaagacccgcacgcagcccggcaaacatctggcggggggttgtggggatgggagggggccagaggtgagcatgtgtcgtgaccaggtgggaaagctgacccaggcttccaagcacactcctcccagcatcctttctcgatccttccacacaatggctcaccgtgctcatgacctcattgtacccctccgccaggagctcctcgaggaaggccgcgagtctcggcacgaggacagtccccgagctggtgctcgtggtccctggcttcacccagccagagggcccctccctcctctgcggtgcgagtgcaagannnnnnnnnnactcctcgaggaaggccgcgagtctcggcaccaggacagcccctgagctggtgctcgtggcccctggcttcacccagccagaggggccctccctcctctgcggtgcgagtgcaagaggggggaatggcgatcatgagtcggttcatggcgccgggggaacggctgtctggggcccgcagggttcctgacgtcccgagcctgcgagtgcctcagctgctccggatcgcaggcaggctctgcaccaaatctggccctgtgctccatgtgcaccaccacttccccccaccccctccctccctcacctgcgcctgcgccnnnnnnnnnnttcatgggccggtgcaaggcgcggggggaacggctgtttggggccacagggttcctgatgtcccgagcctgcgagtccctcagctgctccggatcgcaggcagactctgcaccaaatctggccctgtgatccatgtgcaccaccactttccccccctccctccctcacctgcgcctgcgcctgcttggcgttctggatggccggcagcaccggcagctctgaccgccggtggttgtggcgcaggaccacgtcccgagtgtggtccgcatgccggcgcacgaagacggcgttggagtgcgcgtgccgggcgggagcacgctgggccacgctgcgccccagcgcggtggccgtgtccaggcggggcaggnnnnnnnnnnnnnnnnnnnnnnnnnnnnnnnggcggcggccggcgctggagaccgctgagcggccgcttgtcgaggccgggactgtgcgaggcggctcggttggggccagcagcagggcggacggctctgccagggacagcaggccctgcatgatctccaccagcagaggggcctctgccttgaaggggtgctgtggagggaaggaagaggagcaaggggtttgagtgtgttgggtgaggtggtggcaccttcaagcaggttggtgtgtatggaggatgcgagggctcgtcggttgtgatgggggactcatccccacagcatgacgtgcaggtaacagacaaaaacgcaggtcaagtctgcaagcaacccccccagaacaacaatggccaccctggcgggcgccagtnnnnnnnnnnttgtcaggtgaggtggtggcaccttcaagcaggtaggtgtgtatggaggatgcgaggactcgtcggttgtgatgggggactcatcccaaaagcatgacctgcgaataacagacaaaaacacaggtcaagtctggaagcacccccccaggacaacaatggccaccctggcgggcgccagtnnnnnnnnnnagcatgccgggcccttatactggcgtcccgcgcctcgctggggccgtccctcaggtctgggatgacgcacaggttcctgcaagggattggttcnnnnnnnnnncaacagacacgcacctcccccgcggcgcaggtggccagggtcagcacgtcggtcaccccctcctcgaagcagcgctgcacgaatgcatgccgggcccttatactggcgtcccgggcctcactggggccgtccctcaggtctgggacgacgcacaggttcctgcaagggattggttcgcgggttggagccacgaaaagcggcagctggcagcaccggctcctgtccagggtgcttgactttgcagccgtgtcaccattcatcattgaatttgatgagaactttcactgtgggagagagaatgcaccacgcacaaccgtccccagcgccgctttccaccnnnnnnnnnnctgtatttgatgagaatttccactgtgggagagagaatgcaccatgcacaaccgtccccagcgccgctttccacctgatgaacgtcagcacgagctggatgagggcgacgtccgcgtccctgacccgggtgccctgggccaggggcccctccagcagccccaccacgatgcccagggcatcgggcaccaggaaagcgtcgcgcacggcggcagcggcggctgcggtcgccgccgcgttctggacgacgtagtcgcgggaggggggcatgcacagcagggtgcacaccttcactgcatgattcgagggtaggaggggcgggcttgacacggcgagtcgcaataatgcagtctgagtggcaggggcaggcgaacatgtgcacccttgcaacacctgccctgtgatcggaatgctgcagggaggtttgggaagaagccgtnnnnnnnnnngttgacacggcgagtcgcaacaatgcagtcagagtggcagggccaggcgaacatgtgcatccttgcaacacctgccctgtgatcgggatgctgcagggaggtttgggaagaagccgtcggcccgcagaccccgggcgcacatgcttggatgaggagggcctcatcgtcggggtgggtggtgatcaggggcaccaggtccgttctggcaaaattgaacttgctagccgcgaagaaagcgggccgttcctcggggtcgtcgtcacgcagcatgcgctgcaggtcgcgcaagcactctgggagggcggtggggagcagtggcatccgtggggtatgggggctgctgcagggatggtatctgcacctagcccaccccgcccatcacgagccaccaggctgtccagccctccaccgaaacagaatcacaccccctctcacccctgcaatcttcatgcttgcggtagaaggcaggtgcggagctgctcttctcccaggtcccgatgccaccggaggctatggaggtgaggagatccaggtcgacctccatgccgagagcactcccgatgccttgtcacggcaggggactcagatccttcacccctcgcagtatgaaggttctccgtgtcagtgtgattttccaatcatcaaagcatcgcactcggtggcgacgcacatgccgtccagctcgcgccagccctgcttctcttaaatattcaagatcgcgcgcgcggaacaacccccaaacctcccctccacctgtccatgtgccctccccagaccccacgggaaagcgagcggcatgcccgatcccttgctcctcgaggccagaagtatgtgtgcaccaaaatcggcagtctccatgtgccgctcgtaattgctgcacatcgtcaccgtgcgcacctccgcagctcgggtttctcgccgtggcgttcatccggtgcagaccatggctgatcctgccttgcagaccctgctgagcaccaaggctgccctcgatctgggcctggtaactcaggccgacttcgacatggtgaagacctccttcctgcgagcccagcagctcaaggctgctgtggacgtgggcgtcctccgagaagaggactacgaggccaccaagtcccagttcctggagctcatcactggtgggggcggtgctacgtcttccagccccactgctgctccccctgcaacggctcctgcttgggcccctccccacgtccaagtgccggcccccgcccctcccacactggctgctcggcccgcgccctcccccgcacccaggcccgcctcgcggccccagagccctgtgcctcccatgagcacgaccgcccccccaacaccgggatcacgtgcggtgcagcatgacatccccctgcagctgccgaagatcgggggcacccgatccaagcccaacggaggggtgagtctcttgggtggccgtggctggccccgtccatgaaagtgattcaaacaatcatgccctgtggacaccttgcaaaggattacgacgagattgtctcagagtattcttgtgatgctcccaaggccctagagcaaatccttaagctgcacacctgatgtcacttgcccctcccctcctacgcagacgtccatgagcgggatcgcagtgagcgatgatgccgtcaacctttactatcatatccgctccaagtctgcggtaggagggcgccgggggctgcgttgatgatggttcatcgattcagtgtccatgcagatgtgtgccgttcgaagctcccacccccccgccccaaatgttggcctctgccagaggggctgcgacttcacccctccacactgccatcaccccttgtagtannnnnnnnnnaaagctcctacccccccgccccaaatgtcggcctctgccagaggggctgtgacttcaccctccacactgccatcaccccttgtagtaccgctgggccctgtggcgcgtggacgatgagggtactactgtggtgatctccgcggtcggtcccaaagactccacctacgccgagttcctggccgccctcccagacagcgactgccgatatggaggtgggcggcactgtggggtaattcactcatggtctgtgctgcagaggctgcagatgagagtgcgagggcatgggagctcgcatgcaccgtgcagtcgttcctgtttgctgtggcagccttcatggatttgtgtccactccctgtccccatgcagtctnnnnnnnnnncgagctcgcatgcaccgtgcagtcattcctgtttgctgtggcagccttcatgggcttgtgtccactccctgtccccatgcagtcttcgactttcaggaggtgatgccggacggacaggtcttgaccaagctcgtcttcctcaactggtgcgcgcatggggctgtatgctgcgtcttgggtactcaccagtgctgcgaccttgggccctggaatgcattctgtctcacgatctcatggagacgcttgctccttgcattcaacccacagggccccggatgtcgccaaggtcaaagccaagatgatgtacgcctcgaccaaggactttttcaagggcctgctggatggcatatcaggtacatgacgtcatcatggtgccggtgggaggtagttgcatagttgatacgtacaacccaccgtctttgtagccacacgagagccagggtgatgggcgaacaatggtgggcgttgagtgtgacgaggttataactgtgatgatgtcttgtcctaaggaccctcagaaattctccaactttccccctcgtggccccccctcccgcttgattccagtcgagttccaggcnnnnnnnnnncactgtgatgatgtcttgtcccaaggaccctcaggaactttctaacttcccccctcgtggccccctctcccgcttgattccagtcgagttccaggcgtcggagcttgatgatatcaacgaacaagaggtggcagatgccgtccgtgccctgaagcgctcctgaaggtggccgctgccctcaaggaggagaacgtaattaaaaatcagattcgttcaacatgctcagtatctcagtctggaaagtcttttccaaatgctaacacggtgacagacatggaataacacctccatcctccggatgcgcgagaatgcggtagctgtcctgacatccgctcgtccctgagtccctgcagagcgcagatcatgagtgtcgattgcagggtggcagcatgatacatatttttttactttgggaaacccgcggacaactctgagatccggcgcattgccatggctccacctccacgccaccgacaattacacagttcgaggggccactggcgaacgatactccccatagctggcttctctttcacattctacataatatggtcgctctatagcagtagggccctgcgggagagcgccatcaaggacctccccgtgcagacggtggttgaggacaccacggacccccagacccgggcagcgctgtccgccagcacacgcctctgcttccccgaggccaatgccgactactacggcgaggaggcgctgcagagccaagtcgtggtgcgtggtcctcagttcgacgcccaccccctggaatgcctctaccactgagcatggccccatcgcggaccccacctcccctcaaccccttccctcctccccgcccaggagtcgatggacgcctgctgtgcggcctgcgtcgccctgccggcctgcaacgtgtacgtgtactgccactcggcggcgggctgcggcgaccagctcaccggcacctgctggctgaagcacgcgcgcaccctggacctggcccgccccgctggctcccgctccgacgccctgggctggtcctccggcgcggtggccaccgccggggaccgtgccgcggccctgctggccgccaagcaggcggaggagacggaggcggcgcgcctggcggccctgcgggccaacgcctccctgcccctcgtcttcttggatgtggccatcaagggcacgccgcaggggcggatagaggcggtgctcttcccggacgtcagcccccgctccgccgagaacttccggcagctgtgcacgggggagaagggaaccgtgccggaggggagggagggggcaggcatggcgtaccacttcaaggtgggtgcgaggagtcctgggcagctcgcgattcgactcggagggctttggtggggtgcactgggggttgtgattgacctgggagccagtgctgggccgctcgccgtggcctgccggggtgcccgcccaaatggtctccaggacaatgaccctcnnnnnnnnnnttcgcgatttgcctcggagggctttggtggggagcactgggggctgtgattgacctgggagctgtagttgacctgggagccagtgctggatcgctcgccgtggcctgcccgggtgccagcccaaatggtctccaggacaatgaccctctcgcaaggccagcccgggctccatcgatcggcacgccgacggtgaccttctcgcggccacgggaacccacgccccactcctgtgttcctccatgcccctcccctgcccactcaccgacagcttcaattccctctccacagtcatcaccccaaccacccaacccttcccgcacagggcgcgtccttctaccgcatcatcgacgccttcatcgaccagtccggcatcaacaccgagtccgtcttcggcggccagttcagggacgatgccggcggcctggccctgcaccacacccgcaagggcctgctgtccatggccaacatgggccccaacaccaataccgcccacttctccatcatgatgggccccgccccccacctggacggctcctacaccatcttcggccaggtggtggcggggctggaggtggtggacgccatcaatgcgctgtccaagggccagccggagaatacggcgggccccgacgcgggggcagtcattgtggatgcgggagagctccgccacggcaccatcgtgcccaacctggaagcctgatggcggtcgcaggcgtgtaatacagccatagcatggatggcgaagggtagcggagtgggcaaggccccgcccctatggaacacccacccaggcaagggccctgaagcaccatctggctggaggactttctgtccctggttggcaagacttctttggcctgcgcgtggtgttaaagcttgctctccagaccaatgtaaacacacccagcaaaccttcggttggccctcggatcatagtagcttgtgcatgatgagtaataccatgcagtagaaagcgcgagcatggaatacgcagcgcggacgggcgcagggaagcccgtgcggaaggaatgtgggaagcatggatcccaccgcctccaaacctcaatccgtttgcattgctggcccggatcccgtagccctggtgctcagcccctcgcctctgcgcctccccgagccagcccgggccgtgcccccaccccaacccccgaccctcgcccacatggccgcccgggtgcagcagctggtcagcaaggccaagtccacggtcgccccgatctactccaccgctcgcaaggaggtggtaaagcagtacgacggcctgctgtccaagaactccgagtacgtggtcaaggaccctgagcaggccagcaagctgctgaagcagtacacattcaccaagctggccaggtgaggcgctggagttgcatggcggtgggcatgcatgcagccgtggtcgccacgccacagggacatttcagggacctctctgtcccccaccctgcagcatccccgagggcatcgccacctgcaagaaggaggccgctgcagcgaggcaccgtctggggcagtggcgcgaccttcccgtgacagaggtcagtcgtggtagtggaaagcgagggtagtgccctgcaggctgaggaacagcactgctgccgcgggttgccagccagggcaaaccatggtgtgcttggagacaatggctccctaatgcctgtatagaaatacatatccggtattgatatgccgctcaatccatcttcgtccatccacaggcggcaatgtatgctggtttcgcggcggaggtcttcgcatggttctgcgtcggcgagatcgtcggccgcggcggcaatgtcgctggctacagcgtgtaggaagttcatccgtgctgacactgtgtccctcatccccttgcttcaaagctcctttttcttgctatgaaatagatttgtaacccagtctgaggctgatggcgcttgaggcttacgggtaagggcgtcgagaatgaggctcggcgctgtcttgccctctttgctcagcaaccttcttgtcgacatggagcaggttacagggcattacgacacagtcacggtcaaggaagttcgatgaagactgtgcaggaggactcgtttgaggttcggcaacctggcaaggggggccactgcacgaggcccccacctccagatggggctagtgggcatggaagttgaccagctcctttcgagggttcgggggaaagctcggaggcctcatcctgaaccctctttaccgttggtcgccggtcccaccttcctcttccgcttggtgtgtgtgatgatgtgagccagatcctcctgcgagttgacggtgaagtctccgtgaccgctgtgaccgaggcatatgaacgtgccactggaacgagggaacatgcatgctccacagcacttggagcctcaccattcctcattaaagagtttagcatgccagaggacagaaggagcatcacggcacaattcatcgcagtcctcgacgttcactggcaggacagtgacgcctaggtagcccctctcacctcgatctcagcaggagtcagagccagctgaaagtacggcctcttatagggaaatagaggaggaggcatggtgtatctctgtggtcaagcggctgttgtgggtgaatggcgtctgaggaagccctggagaggtagagcaccttgcgtgcaaagtcgccgtgggagaactggtgagcaacttggtgtctcaaacactgtgtgagaagtgtaaaactcgtggaatattatcgagccaaaagagcaaggccggcacagaggagcaacccacatgattcggggagcacacagttgccacgtaaccatgcaggcccgagcgctgcatggaagacccttgccgaccttcctgtagcgcaagcatattccgatggggaattttggcgaaaggacatcacacgctgagtttgagccgctccactcccactctgtcgtgtggcctccgactcgacctgccggccacagctgagctcgcgccatggaggctcaggctgtcgacctcctggatcgactcgaagattgcgggnnnnnnnnnngacccacatgattcggggaccacacagttgccacgtaaccatgcaggccagagcgctgcatggaagacccttgccgactccctgtggcacaagcatattccgatggggaattttggagaaaggacatcacacgctgagtttgaaccgctccactcccactctgtcctgtcgcctccgactcgacctgccggccaccgctgagctcgccatggaggctcaggcggtggacctcctggatcgactcgaagattgcgggtagggcgtgctgggtcgacgaccgcgggctgcttgcttccccacctcgcgccgtggtaaaaggcggtgcctgcctgagtcctggcagcgcacgactcggcgagaggaacatcgaatcccacaccgggctcaaacacctcaggctgcacagatcaagtccaaatctgtgacggcaaaggcccccggaacatcatgcacccatgagagggggtgggaagggtcctgccaccaggctcatgcgcctagcacccctccaccccgcaggctggcggctgggttgacggaggatgacctcaccggttccacgagcgcacgcgagcccctgcgcacagcatgcgtccagctagcacagcgtgtctgggcgctgaggcatcacctgaccatccacagccacacagctctgcaggtgcgcaagggccttggacgaggttttgccggcaggatgcacgtccatcctgctggcgcgtccggcctcattagactcagtgctccaccatctggcccctccnnnnnnnnnngcaagggcctcggacgaggtgttgccggcaggatgcacgtccaccctgctggcgcgtccggccccatcagactcagtgctccaccatctggcccctccacagcgcgctgtcctggccctgggcgcggcggcggagacggaggcggcggctcggggcgggcgcctggacgctgccctcggcaggctggcccaggcacttgaccccggtttcgcgccaggggtccaggccggcggtcgcactgctgcgctggacgccgtggtgagcctcatgcaggccgccgccctcctgaacgaaggcaaggctgctgtgggcggggccaggacaggcgtggcgaagtcggcggatgagtcagggactgtggatgggacgacagcgtctggcgcgaccgaggcgacgccatctgcggaccctgccgacgccacggtggtcatgtccgccgcgctgcgcgcgctggggcggctggtaggtgccgacgccggtggcgccagcgccgtcgcgctcgcggaggcggccgcgggtcgcgtggagacgcttgccgcccagcttccccccggcttcttcgacccgctgctgcccgccctgccagggccggagggggagacgctgcgcgcggcgctggtcgaggtggacgccgcgctgcgctcagagtacacgctgcgccgcgccatgctcaaggaaagggcggcagtgacgctgcgctcgctgctctggtccgacaggctggaggtggggcggtgagaggttggggtgttgggggcatggcggtgttggttggagggttactaccatctcgcgagcatgcggagcagaaggggttgtcctgacatgtgacttgggcatcactgagtggctgtgtgttgtgcggtgctgannnnnnnnnntgggtgttggggcatggcggtgttgattggagggtagctaccatctcgcgtgcatgcgggacagaaggggttgtcctcacatgtgacttgggcatgactgagtggctgtgtgttgtgcggtgctgaatgcgaggggtggcctgtcacggcagcaccaacctcctgcaccgggtagcagcctggcaaaggtgctgtggcagctcatgggtctcacagcgcacattggtcggcaaaggtcccaggctccttttccacacgaccatcttgctgccctgcctgccaggagccggaagccaaggcctgcgaggtcagcatcgacgccgccctggctgccatgccgcccgaccccgtcgtctcactggacgaggtgcatgccgcccgccttggcgacctctactccatcatggacgcggccaccagcggcgcggggtccggcgcctgggtcaaatccgtgcgcatcggggccgtgccggaccgtggagggagggtggaggggcgggctcgggccgcgcctatgcctggctggaccgcgaggaaagcggggaacgaaaaaggtgggctggggacaggggcctggcacgtacagcaccttacaacagacgcccaatgcatgggcgggcaagcggagtctgcacgtggcaggcaccttggaagctgagctgcagcgcaaagggccactgcccccgccactgccttcaataataccgtgctgtgggggggtaccaagtgggaacactctcacctnnnnnnnnnntagggccactgggccccaccttgccttcaataataccgtgctgaggggggtaccaagtgggaacactctcacctagctccctcatgctccccttcctccaggcaagcaccagcacaggcagaagaggttcaagaagagctgacagggagcagtcgcggcaccatgctactcgaacttgcctggcccgtgtggcatgtgagtaccccagtcgcatccaacagaagcagggtttacaaggagcaggactgtgagcatgtcagggacagaagggcagggcacgattcataggtgcagtgtgtgcggctgagcagtggtccaattccaggctcgccctcaccgacatgctcaggctccatcttccgggaaaagggggccctcctcctcctcggcgctctcctcgccatccagcgcagcctcgtccaggatctccaccaccccatcagccagcacggccaacaatgtcatgccaaacaccgcttgccgggtgtcaaacatcctcaggatggcagcctggcagaggggcgcccgaaggaggggtcgtttctgagagcaaggaagcagggcgcctgctgctaattgcacgagcgctgtagtgcagcgggattgtccccccacctcaccggcattcgcctgcccacctccacccctcacctggctgggcttcnnnnnnnnnntcccccacctcactggcatttgcctgtccacctccacccctcacctggctgggcttcagcttgtcgcccgctcggcaaaccagatggtctgccaccagggtcactacccccttgtccagcttggtggggaggccatgcgatcgcagggtcggctccagggtgtgcgccagcggctcgccgtacagcgtcaggggcccggcctcgaggctgaagtcttctgtggcgcgcgcgccggcgcgcgcaaagtctgcgtgctcgaaatcctcgaagatggacgtcacctggtaagaagaagaagtggtggtgggtggtgaggggggtggcacgcgcgcacaagagcagaggtgctgtaagtcccccgacgtagaaggctgccagccgccnnnnnnnnnncaagtggtggtggatggtgaggggggtggcatgcgcgcacaagagcagaggtgctgtaggtcccccgacgtagaaggctgccagccgccatccaccatagaaccatgaaacggccccctgctgtgaggaataccccccctgcatgcagccaggcccccaccacccacctcctcgcggggaaggttggtgaagaacaggcccatgctgccgcgcatgtgggaggccagctgggagctgccaggggtgtgctcgctggcctcatcggcaccgagggccaccttcagcatcttggtggagcccaggcagaagcggctggtcgcgcggtgctcctccctcaggtccttgaacttgtcgtttctgaagttctggtaccggaacaggtaggcagaggcatacctgggcagaggaggtagaaatgggtttggaagtcggtcgatgtgaggatgatgggagcagggacatccagaacacaacggcaaatggatccaggttggtcacggcactgggttctggtgctccctgcgacatactgatgagcttgggggacgggtgcacacctcccagcctgctcctcactcactcatccagatagctgcgagtttgtgttatgatgccctccttccactccttgttcttcttcttgacttttgtcagcgacactgcaggaagggaatttgcggagagggacgggtcgcttattgtgggcccatggcatgcaagcattgcagggttagctttcatacgtaccaactttattccgcttgctcttcggcatcgcggagctctgccgtgcgcgcgcggctggccggaggtggcagtggcggcaggtgctgtgcgccttttagccccgtaaccaggctgtgctgattccaaggatactatttaacaccgcacataatgccaaacgccaagccactcgagctagtggctctctgcagcgtgctgcggttctgcccttccatacatgcatgggcggtgtgctgcgcgtgaggcgcggcatccaaaccgtcgagtaacagccccgacacgagcaaccaccccgcacaagcgatccttcttcctcgcactgccatggcggtggaggtggtcgtctagtcgatgatgctcgcgactcgagatactgatcagtgactatggacgaggcgtcggaattcggcgccggggagcgagttcccaagctcgacctgagtacggtggacttggggaccagcctgcagcaggctctgggcagagcagacgcagttttaatggaattgaagactcttcgggtgtgttggagggttatgagatgtctcggaaactagatgccgtgcggctcctattattgccaaaccccacttcaccaaatgatcacagtccgtgtacggcattcccaccccgcgtgatggagatggagcggggcccagcttgaaacaagcgttttcggtgagtacagggcgaggttggacagggtttgagcattccaaaacccgatttccgctcacgttcaggataccatgctgatacccacaccctnnnnnnnnnnaatttgagctttccaaaacccaatttccactcacattcaggataccatgctgatacccacaccctcccaactctgttgcaattccagagtcccaccaagggtggcagagcaggaccccgacccgcccccacagtgccacccaccagtggggagtggcgcatccctgccctatccggtgccgagatacaagatcttgctcctctggagcctgctcccacgcccagccagcccctgcacacaccctggcaccctagcgccgacctcgccagagccctggactcactcagcctccaggatgagccggcatcaggccccgcagagcgacaggagcctgtggnnnnnnnnnntgccagagccctggacttactcagccttcaggatgagccggcagcaggccccgcagagcgacaggagcctgtggcagcagccccactccccgaggtgctaacttccaggaagcagcggtacccagtgcgccagtctctggcccagcagcggctccaggctgagaagaagagcgccctggcggccaagcagctggatctggaagctgaacggcgacgcctcgtcgccaagatggaatcggtcggtgaagcgggcgtggtagggaggagggggaggagggcgcaggatgtgtagtgagattcgccgatggaggtggatcttcatcgatatttgattgtatgggagtggatttataaccaagggcctgtgtacttacgtgcacacctggaactcttagacagtgccgcctggggcctagcaatctcccctgagctggtgctgctccactccaccagcagcttacatcagtccttccctcaacattccctgcagtgccgagcccatgccaccaagccaaaagtagcaccgcagcgcaaccaggtcttccaccccaagccacctgttgccaagcccgccatcccctccaacagcaccccagccaaacgcaaggtgagattgtgtcggcatgtactactgaaggtggagaggactggcttagaaccgagccttgtgggtattgaagtcgttccagtgctggnnnnnnnnnnatgggggagaggactggctaagaaccgagctttgtgggtattgaagtcgttccagtgctggctgctgggagggtctgtttggtgggggctgtcccaggccaatctcacaacccaaggacacagcatggatgtctcaggaaagttgctggctcgcatgtgccttcccccaaggcctgctcgccgcccttttcacaggctcccccaggggaggcgacaaatgcgccccccctgcgggccacccgcttcgtcatggcgcaggctgccgagcgctcggatggaggccgtcccggccccaatcctcggctccggcacgcgcaggcagcgccaccaccaggcacccgcggtggggtatcgcgagcgggcgctcctgggtctaggctccctcaggcccccgccagaccccggccccttgaggtacctgccagtaatggcggcgcggctcttgccgcgcctgaaacgcgagccggcgagggtgggcctgcgccgggcggcgagcggctcgcccggacgcctcccggtggggcctgcgccccgatcagcggcgccccgcacgccgatgcggggggagccgacgcatgtgcgggcgccggagacggggacgcccaggacccagactcccccatggcccatgcaggccggccaccgttcctggcacccggcccagacgccgctcttgcggatccttccagacatgcccggccgcccctcggcccactggtgacgggcctggagctgcctagcaccagcgcgtggctggccgcggacggcagcgaccccacgctgcaccccacgccctccaacatcggcgccggccgcgcggccctgccgcgcggcggccctgtcgcgctcccccaggaggcccgtccggttccgctgggcgcctcccccgactgggcggcggccctcctggccgtgggcggcggccgccgcgaggcggccgaggcgctgcgggcgatgaccgctcggggcgcgagggtgtggaagcgctgggcgcgcacggcgggcatgagcaaggggtccagccgccgcctgcggctcagggtgggcgacggcggggtgtgcccggaccagctgcaggtcggctaccgccgtggctggttcaggagcgcacgctggtttggcatcgacgggtgagggcactgccaagaccggggagggtgatcgcggcctgggcccggccatgctggcacggcatgtgcgagggacatgacgttccacaggcatgctgtgccgtgacgggaacatgtggacttgttgtgttggcacaaggagattctgtacctcacctccaatcctgnnnnnnnnnntgagaccggggagggtgatcgcggcctggacccggccatgctggcacggcacgttcgagggacatgacattccacaggcatgctgtgctgtgacgggaacatgtggacttgtggtgttggcaccaggagattctgtacctcacctccaatcctgctgcgcctggtgcctccagagcccgcccaacccccttacaacaccccccgcattccagtctcaccatccaacctcccacgcaccctcagcgtgctcgtcccccgcgacagcaactggcccagtctgctcctccgcaccagcgagggcgtcctccaggcggacttcgagagcgaggcggcgcaggctgccgcgctcgtcgcgctggcggccggcctggctgcagcgccggctggagcgccgctggccgaggtcccctgcccgccggccatccgcttcctgcccccggccacgtgatcaacattttccctggcctgctcaagtgcccccgaacgcacacgcccgtgactcgcgctaggactttcaaccagacgcccgcagggcgggggatgcagggtggggggagagtgcggctcgacgagtagggtacagggggcacggtgcaatgttcagccgggacatggatcagaggacgcatgacaggggcactggtgccctcgtcctaatatcaaaccgagcagcagggggcagaaggcagccaggagcccaggtgccacttctgnnnnnnnnnntcatagatcagaggacgcatgacaggcgcactggtgccctcgtcctaatatcaaaccaagcagcaggggacaggaggcagccaggagcccaggtgccacttctgtagcactgcgccaggaactgcaaggcgtgctacccctgctttgggacaggacgaggagaccgctggcagtggggttgggccgctggcagtccaaacagtggccaggcccaagcctattccagcttcaatggggagggccgccagatcattccctcttggaagcaggggtacggcgcagagcgggcgcctgcttggcggcgaggacgccgatggccgtggcggctcccagccagaccagtccgcgcagggcacccccgaggccgctctcacgccttgcctgcttcggcctggcggtagccacggtgccggggcgcacggccggggcctgcgtctccacgacggtggccgctgcggggacgggggatggggcgagcgccgccttgacgggcttggctgacgcatcccttactgtggggtcagtccgcacctccaccttgacattggtcgaggcaagggcggggctgggcttgccctccactggaccagcgcggatggtcacctggacctgcacgaggcatgcgaggcttgatgagggctgttcctgtgttggtccaccaccatgccgaggtgcacctccccacgccgtgcatgctggcgacggcacaagtcagactgacctcctccttgcactcaggctgcgtcacagcgatggctggggcggcgggaagctgcacgggtgccggcgggggaggggcaggggcaggctccgccttcacgggactggctggctgcgccggcgtcttggcctgctcggagacctcagcccctgtccacaggtgggggggtgggcagggcaggggcttcaggactgcatgccaggcggacttctgtggcccgggcaacagtgggccagcgcgccgccagtgcatggcatgggcctacagtgtcacagccaggcgattcccttcacaaaagtaggtgctgattgccgctagacccccgctcaccagccttggcgctgggcgccgctggcgctgtcttcttggaaggctggtaccgctgagggtggaaatatgggggcggggcattactgcacatgggcaggccgggcactcagccctcctgcgcccatcatggccaagtgctcacccagaggtagcctcgcgtgatggaatggcgccctccctgccaaccttgagcagcaatgccacccccatcagcgagcgcacaccccttgctccgcccacgaccaaccaccacccacccctgagaagccggatgaccattccagactgggctcgccaaggaggccggaccccgcgctcttggccgtggctatgggcgccgccttgggcccctcgcccccggcagcgccgttggaagggccgttggactgagcagcagccttcttgggcccgctggaggtgcggcccaggatggcacgcatggttgagctgttggaggtcccctccacggacttggcggagggtgcgggggacaggtcgccgctgaggctgctgccgcgaggggtcatgagttccttcacctgcgatcccattttctgcaatcgtggtacagcgcaaagggggctgtgttgatgcgagggggatctagatctcgactgctggtgtcgatgggggtgagggacagccaggcagccgcggtcgagtgatctggctcgatcggtcgacacctgagaccgcgcccccatcacgcccaccttgaagctcttcgccatcttcttactgaagctcttcttcttgacgccgggaacatcggcctcgctggcatcttgagccgggagatagaaggaggagcgtgtgggatccgacatggctccaaaacctgtcgggccggagggggcggggggcaggcgctgaatattgaatcgcaggtcgagcatggggcgcgtcgcgggacagnnnnnnnnnncaaacctgtcgggccggagggggcgggggcaggcgctgaatattgaatcgaaggtcgagcatggggcgcgtcgcgggacagtgggtcgacgtatttattcatggctgatgcttatcttttgtagtaacaacataccgatgtggtttctggggtaagggcgggcacttgcacctcgcttcgggtggctcaagaaagccttgaagggagtaaaagcagtcgcgctggggatatcccggtccttttcgaatgtttagggcttttgaagagcagaccatgagtacgagcagggcgaggatgatcggcggatacttcgccgaatcgcagcccgcagtacccctcaaagcttgattttgagttccgtgctaggatccgaggtaccaaaatcctcatcaaagtttcgcgccctctgtcttcatcgcctctggaagcccggaaaactcgcacgcaccggaataagcagccttcggaacgtgtcagtgggccggtctgtccttgcaaacagcgaccgctgccgccagcagtggccccattcgtatctctggaccaccacgcttccgtcgnnnnnnnnnnactggcgccagcggtggccccactcgtatctctggaccaccacgcttccgtcgtcatccggcccctccgcacgcgctcagacgcccgggagaaccatggcgctcacatgtggtctgacgggaccttgcatgcggtggagcttgtcccaccgggccaccccggcgaatgttacgtgggagcccgtgcgcaggcctcgacgagcgaggctcctgacggtgcatgcatcatggagcctcggagtccccgaggagctcccgcccagcgagaccgggacggtgcgtggtcatcacgcgcccggggatcaaagggtgggacatgccgggcgatgggtgaatgcagccgttgctgcgtggcatgatgggttggatggtacaggtccccgggtctatgccaggcacgcgtcaaaggacagcactccacatcaccccatctttcccccacccccccttccacagtctgcgactgattgcccgctgctgcagtatgctcacaaggtgtccttggaagaggtggcagcctttgacgcctgggcgccactggccgtgcagcatgccctgcggaccacggtgaacaacctggtcggcaacctcccctcctcctcctttgacgtcatcatccgcaccagcgcccccaagatggcgctcctgctcttcagcaccctcatgacaggtgggaggtggtgggggaggcggtagggaacatgcgatggccacgagtctgctggtccagtgcggcgggatctgggatgcacgtccatgctttgtccacggtgaatgtcgctctttcacgtggctgtgtgggtggactgaaatcctcgccaggacctaacaccggctacttcctgtcgctgtccttcctcacatgcttcctcccccctccctcaccgcccatctgcacccaggctacatgtaccacggcgcgtggcagaggctgtgcctgaacgagcggctgggggcagggtcccccatcgtggccccccaccaccgcaccctgatggacagtgtgcacagcatggatgacgacgagtaccggccgccggggggcgagggctcgcccgccgcccccggcgccggcccggaccctggctatgcccgcggctcccagcagctgggggtgacgggagaggtgctgcgctggcacctggcggcggggcgcgagagcatgcctgccagcgagtacatccgccagctggagcgggaggtggagcagcaccgcgcggcggctgccgccgcgccgcgcagcccgcccgggcacgaattgttggactttgtgcgccgcgcggacggcgctctgacggggcaggccagccccgccgcgctgcaggccatgactggcgtggtgcagcgctccatgggcgagagcgggggccggggcgggagctggcgctcgggcacgcgcgactgcgtggccgctgagttggctgagcagctctactggctggcgatcgtgggctggcagctgcgggccctggagtttgacgccaggaggggggccgcggatgccggcggggaggagagcgcggagcggccctgacccgccagcaggggatctcgcgctcagtcgtcttggccaggactctcccgcaggcgtcctgcnnnnnnnnnnnnnnnnnnnnnnnnnnnnnnnnccccatcccccctcatgtactataccaatgtatttgaaattttcttccctgcatcagctgctttgatcgagccatgcgccctttaatttgtgagaacccgggaccggaggaaggatcaggaacgcgtggcatcgcgcgcgggctctccagtaaggaagacgtagggatggcgtcataacaacccaggcagccaattgtttcacctacgcgtcaatgccatggtctagttgatccacacactcctttcgtaccgcctctcgagtcactcccgtgatccgacaccccaagcccgaaggaggccatgccgctttcccaggaggatgagggagtgaaggtcctgcaggcagccgagnnnnnnnnnncaaggaacaggaacgcgtggtatcgcgcgcgggctctccaccaaggaagacgtagggatggcgtcatcacaacccaggcagccaagtgtttcacccacgcgtcaataccatggtctagttgatccgcacactcctttcgtaccgcctctcgagtcctccccgcaatccgacaccccaggcccgaaggaggccatgccgccttcccaggaggaggagggagtgaaggtcctgcaggcagccgagcgcctgtttgctctggcggcaacaggaccactcgcagagtttgaggccgggacggcgcctcttaaaggcaccaagctgggcgaaatcggcgacgccaggcgccgcactctcttgcatgctgctgcctccaagggccaggacgagattgcagactacctggtgcagaagcacgatctcaaggttgacgccgaggacgaagcaggtgacgggggttagagttgtgtgtgtggcgggggagctggttggcttgcatggcaggggccaagtgcacgaacaggtgtcatctgtccaaggggttccnnnnnnnnnncggcttgcatggctggggccgagtgctcgaacaggtgtcatctgtccaaggggttccctggtgctcctgtgcctcccatggtcgagatcaaggtgctagatggttgcgtctggatttttggaaggtgatcggcacatgtgcagcaggtggaggcccccgatctggcacttgagggttaggcgcccacacttccgttcaccatgctccccaggcgagacgcccttggccctggcggcctcggggggccacgcctccacggcccggctgctcctggacgccggcgccaggccccacccctcccgcccaggcacggcggggcccctgcactgcgccgccgcggccgggagcgttgccacggtggagctgctgctggccgccggcgccgacctgggagtggatgtgggctccggcccccccctcttctgggctgccggcggcgggcacgccgagacggtgcaggccctgctgcgcgcgggcgccgaccccaacgcccgctccgccaacggcatgaccgcgctgttcctggcgaccgccgcagcgcacggtcgccgcgccgccggcggcgcggcc

SEQ ID NO: 23444 - DNA, 165 bp, Chlorella protothecoides
gagggggaagtgcagcaacagggtggcaggggttggttccgtattcgtcagagctgatgcagaaccacatgactgtattcatgtttcgacgtctcaggggctgagtaggacgtcaaggatttgcagcttcccctggcttccctccgaggggagataggagcctcc

SEQ ID NO: 23445 - DNA, 143 bp, Chlorella protothecoides
gatcgcgccggtcaggtactggtcgaagaactggcgagcgcctgtggcgtaggcgccattgccggggtccagagaggcgagcaagacggcgttggcgccgtagtagttccagacctgggtcgtgatggggtggtggggtgttt

SEQ ID NO: 23446 - DNA, 112 bp, Chlorella protothecoides
ggaggccgggttccaggcccagccctgggccatgctcaaggtgtgcgcgtgggtggtggcaaaaaggaaagggcgagcgggtggagggagcattcgaggacggtggcgcagg

SEQ ID NO: 23447 - DNA, 78 bp, Chlorella protothecoides
tccgcgataggatggcctgcaagggacattgaatgctctcgcgggtggcaggggtggtttacttcttgcatcctttcc

SEQ ID NO: 23448 - DNA, 76 bp, Chlorella protothecoides
cctgatgctgaacctcaaggacctgcgtctttgggagagccccggtagccttcaatcctgcctcacgcaaagcatt

SEQ ID NO: 23449 - DNA, 76 bp, Chlorella protothecoides
tgaggagcctggagggagcgactagggtacgggctggctgccgaggtggtgggagctggcacggtgccggtgtcgg

SEQ ID NO: 23450 - DNA, 123 bp, Chlorella protothecoides
gacgccccactccaaacacacacacaccagggcctcccctttcccctttccgccgtgcaggagggcgcccccaagaacccgcgcgccgtggcagaggccatcgtggccggcctccccgcctcg

SEQ ID NO: 23451 - DNA, 68 bp, Chlorella protothecoides
ctatgggacacggaggtatgtgcattacaattgtgaagggctccttgctgctgctgcgatgatcgtgc

SEQ ID NO: 23452 - DNA, 124 bp, Chlorella protothecoides
tttgagggtgtgctggtggaggtggaggggagggggggggctgggaggggatcccctcgccatttgcctgcctccgcccggcgggatacagcatggtgcatgctgggtggacatcacccttacc

SEQ ID NO: 23453 - DNA, 394 bp, Chlorella protothecoides
tctcgatcagcagagccacgcatgcttgggacactccagtggcccccggaggccccccctccgaagtggcacaccaagtcctcacacaccttcccgtatcggcctagcgtgcccgcctcgccgggcgccgtccgccactcgttcaccgtggcgtcattctgccactgttgtgccttttcaccgtcaccgtccagcttggtgaccgcatcgagctgcacaggggccaattgagagtcctgcgacacagaaggaggaaacactcagtgaggtgggtaggtttccgtttaggagttctagatgcataggcttcaaaaattaagcttcccatgtcgaaatccgtcagagccatgcctgtcgcacacccatcaaataaaccaactcagtccacccaaca

SEQ ID NO: 23454 - DNA, 64 bp, Chlorella protothecoides
ttgcgaggattcgttgctaccttctaggttgaaaacacctctttctggtcgccactggctagag

SEQ ID NO: 23455 - DNA, 61 bp, Chlorella protothecoides
actcatggtaaaaacactgtcgcacctgtctgtcaccatgtcgagaacctggcccagagtg

SEQ ID NO: 23456 - DNA, 76 bp, Chlorella protothecoides
gttgctagcagcttcttcccgcaacgggatttcgctggcgcactttgttgcctcaaatggcgaaccaagggggggg

SEQ ID NO: 23457 - DNA, 69 bp, Chlorella protothecoides
cggtgcgtcaacaaggcctgcaaggtcaacattgtcaatcgcgacgtgaatggagctgccaacctgctc

SEQ ID NO: 23458 - DNA, 147 bp, Chlorella protothecoides
catggtgtccgctagaaatacagtgtgtcttacacagcttgactctgtagccgaggtccttggcaggcgggaaagggcccggctgaaactcccgcacacagtgctcgctgtacggcccacgcccattggcgcatggcccgtcccact

SEQ ID NO: 23459 - DNA, 64 bp, Chlorella protothecoides
tggattttcacagatttcttagcaacccccttgccactccgaatgcatactcatcgtgtcgcat

SEQ ID NO: 23460 - DNA, 61 bp, Chlorella protothecoides
atccggcccagtggccgactgggacctgggagtgtacgtgccctacctgcagcaggtggcg

SEQ ID NO: 23461 - DNA, 506 bp, Chlorella protothecoides
cgccacgcccgcgtccagccccgcgccgggcgtgcccagcgccgcgcccagcgcgcgcgccaggtcggccacatgcccgcgcacgtgctcgccctccagcccgcgcccgccaaagtgcacggtgccgcggcggtggtcgaagcgcgcggagaagtagccggcgcgcacgccctccaccaccaggcgctccgccgcgccgtgccccagcgcgggcgccagccgtgccagctcctccacgcgcatgacggagtagacgtgggacagctggcgcacagtgtgcgccagcgccacctgctgcaggtagggcacgtacacacccaggtcccagtcggccactgggccggatgcgggggcgggggggagcgcgccgggcagcgcctccagcagcggcgccaggcgcgcgcagagcgccagcgggtcaaagtcgccctccagcacctcgtggatgcgcgcgaccacgggcggcgcggcggccagcaggccgcgccgctccgcgtcggccagca

SEQ ID NO: 23462 - DNA, 78 bp, Chlorella protothecoides
cttgactatcttatgtcagactttcaaacgtttatgtgtctggcatgggcgccgagagggaggtgtgttatgagccgc

SEQ ID NO: 23463 - DNA, 80 bp, Chlorella protothecoides
tgtatccatgaccctaacctgacttgtacaccccccctgctcctctcctggcaacgcccgcttttcctatttctggttgt

SEQ ID NO: 23464 - DNA, 73 bp, Chlorella protothecoides
gccagcaactggagcacgccgcagtatgtcaacctgactgccggtaaggacagtgtgttggtggcgaggacag

SEQ ID NO: 23465 - DNA, 61 bp, Chlorella protothecoides
agcgggaggttgagaatttgctccaggccacatgtcagtcagcgtcgtacagcccaccgga

SEQ ID NO: 23466 - DNA, 72 bp, Chlorella protothecoides
gtgctgatgtattcacaggagcctgctcagtctgaatcctcgcctaattgatgcaagggttccgtgtcctga

SEQ ID NO: 23467 - DNA, 146 bp, Chlorella protothecoides
gggtcttgaaggatgcaaaggtatcatgaaatgaagttgcgatacatctcatcgtttcacgtcgagaaaatgctcatcaggtttacatcagcaaaattgaaggccaatctctgactgtcagcaggctgtaaagctgctgtgttgca

SEQ ID NO: 23468 - DNA, 64 bp, Chlorella protothecoides
ctggaggttgtttgcgctgacatcatggctcacagtgcgcatgcatctccattgcaagcagcca

SEQ ID NO: 23469 - DNA, 78 bp, Chlorella protothecoides
atttctgtgcatcctggcctgacactgctggaaaacgcttgccagaccattcacagttcatcctcctggacccccacc

SEQ ID NO: 23470 - DNA, 61 bp, Chlorella protothecoides
ggcacagggcctattccgcgcggcgaagccccctggacacgcaaccgctcaccataccgtg

SEQ ID NO: 23471 - DNA, 74 bp, Chlorella protothecoides
ctcttcgtcacctcgacagaagactgttttgattgagcatccttctgctcagtcgggttggtcgaccggcccag

SEQ ID NO: 23472 - DNA, 116 bp, Chlorella protothecoides
gctccacggtgaaggggacgcatgcgcccatatgagggtcccgagggggctgtgatgtgcggagcgcaggcatgtgtgcccggcgaccttgtgtgtgcagacgagatgcaactggg

SEQ ID NO: 23473 - DNA, 119 bp, Chlorella protothecoides
aactcacgtcgttccataccataacttctgaggacgagcgcgattactttttgcaatttgagtacaatgaagcgatgagcaggatttcacggagcacaggctggacagtgccacaccag

SEQ ID NO: 23474 - DNA, 61 bp, Chlorella protothecoides
ccccagggccgccaggctggcggagggcacccgacaacctggtgggttgccggcacggggg

SEQ ID NO: 23475 - DNA, 168 bp, Chlorella protothecoides
tccgctcttggccatggccttggcaaccaccggcagttcgaagcttcctggaacccaggccacctggtgggatgagaggggcgtgggttcaccaggtgggccaggcacactgcgcagtcctatggaagagcgccaccattgggagagctgtacacaggcgttggggag

SEQ ID NO: 23476 - DNA, 111 bp, Chlorella protothecoides
tggggaccgatgagcagatgaaaatggtgtatccttgtactgattccaatctggtagattagggtgggagactgcggagtaaatcggggtattcctcggtgacatgtcaac

SEQ ID NO: 23477 - DNA, 77 bp, Chlorella protothecoides
ggcgcaacgcaattgtatgctggatggagagcccctgaaggacgagcatcggccaccaacggcaggagactccctcc

SEQ ID NO: 23478 - DNA, 80 bp, Chlorella protothecoides
acgtatgacggaccctcagatggagccccgcaccctcgactcccaaccccctcccatgtgcacttgcctcggcggtggac

SEQ ID NO: 23479 - DNA, 72 bp, Chlorella protothecoides
gggggggggggggggggggggggaggggcgatcgctcaatgatgggcagtgggcgggatgtgactgggtggc

SEQ ID NO: 23480 - DNA, 130 bp, Chlorella protothecoides
acaatcttggaatctcgcacatgcactgctgagatcgggacgcagcagggggtgggtgtaatatcgactagtatgtagttggccaggagaatgatcccagcagaccgatcccgaactcacccgctggggc

SEQ ID NO: 23481 - DNA, 80 bp, Chlorella protothecoides
cgatgtagaacgagattaggcaccattcctatgcagataggcagcgcatgtgtgtctcaggccaggcttgacgcctcaca

SEQ ID NO: 23482 - DNA, 132 bp, Chlorella protothecoides
aagggccccacaaagggggccgccagcttgcggccgttgggcgccacaagtttgaggtgcgcgctgctcagtaaaacgcgatcaccagccttgaaggcgtgggcctggcgcgtccggttggcctgtgtggcc

SEQ ID NO: 23483 - DNA, 80 bp, Chlorella protothecoides
ggggggctcgaaaaggccgagatggggatgtcgttggaatggacaacactcccatcagaagccttgaaccacgcgtaggc

SEQ ID NO: 23484 - DNA, 70 bp, Chlorella protothecoides
cgtccagggcctcttggagcaggtcgtcgtacgtcttggcacgcctcacctccctcttcctctggatgta

SEQ ID NO: 23485 - DNA, 79 bp, Chlorella protothecoides
gcatggggtggcgtggtcctcgttccagtcaggggcgggaggttcatgggccacaagggaagttgcatcatgctgacgt

SEQ ID NO: 23486 - DNA, 206 bp, Chlorella protothecoides
ccacccccccacccccacctcccgctctcgcctcgcccacacccacacccacgcccacccacctgccatactcgtcgcgcgaggtgcccttgatccccgcctcatccgcggggctgcccttgcgcgcgtctagcaccagcacgccgcgcacgccgagctgctccgccgactgctccggggcaaaggcgatgcccagcatggggcgc

SEQ ID NO: 23487 - DNA, 142 bp, Chlorella protothecoides
cccacccccccttggacacaagtagctcctcgacagtgccctgagggagtgcgaccggcacctccctcgcctgcaagccccatgtctgcatcctcaccaccccactgccctaccgccatcacaacagacagaggagcggaag

SEQ ID NO: 23488 - DNA, 241 bp, Chlorella protothecoides
ttcctcgcctccttagctcaaaaggatacatactttgcaggatgcgagggctgatgaagtcgcactggccctcaaggaacacgccactaccggtgccatgtcacttgccaccattgctaaaggtgagggtcttagggctcattggggatgctcgtcactccagggagtcagatgctttccacattaaggcccacgcatgtagtatttcatccgtatcacttctgtcacctggattgatgcg

SEQ ID NO: 23489 - DNA, 1145 bp, Chlorella protothecoides
gtgcggctggagcgggccttggcggccgccgacgacttccacgcccgcttcctgcaggtttgctggattgattgggacggggagggggccgggggggcttgggggtgcccaggcaagtcagaccagtgctcaggaggggcgctgcctaggatgacttcgcctggaggtgcccgggggcgcccgccgccggcacgaccacaaacattaaaggcccgcatcccaattctgcaggagcgggccgagcggcgcaaggtgcacgaggagctgcagagcctgcgcggcaacatccgcgttctgtgcaggcgagaggggaggagggggggaaggatgggacagcaggtttcggtgtgccaggagggagaaattgcatggctgccaaacggcctgacgcgccctggggcctggactgccgcccgccgcgatgagatgcccggcgacgcagaccaggccgtccgggcgaggggtagggcagggttctctcgggccttggaccactttcacgacgcattatcttgtgcccatgaacccctcacttcctgatctctcaggactcaaccccccaatccccccatcccctcgaaacatcccatagattgcggccgctggcgggcgggcccggcgccccctgcgctctcgaggtccccttcccaggcaccctgcgcgtccgctgcggcgaccgccgcatgcaggagtttgagtttggcacagtggcggacgcgggtgtgagccaggctgagctgttcgaggaggtggcgccgctggtgcggtcggtggcagacgggcacaacgtctgcatcttcgcctacggccagacgggttctggcaagacgcacaccgtcaccggcccggcgcatgacccggggctggcggcgcgcgccgccgacgcgctgtgcgcgctggcctcggccgagggcgccgagcgccgtgcgctggaggtgggcatgctggaggtgtacggcgacgtggtgcgggacctgcttgcggggcctgacggggccgccggcgccgcgctggaggtgtcgggcctggggccgggccaggtggccgactgccgggcgcgggtgccgggtctgggctggcggcccgtggccgggcgcgaggacgtgctggcgctgctgcgcgaaggctgcacggcgcgcgccacc

SEQ ID NO: 23490 - DNA, 63 bp, Chlorella protothecoides
tgtgcttgggtccctgagcagactccttttcttcctatggacattcttacgtctgacctggcc

SEQ ID NO: 23491 - DNA, 17984 bp, Chlorella protothecoides
  modified_base (1433)..(1464): a, c, t, g, unknown or other
  modified_base (6243)..(6314): a, c, t, g, unknown or other
  modified_base (8004)..(8052): a, c, t, g, unknown or other
tgggggggggggcagggggaaacagctgggtgcacgatgaaagaatgggaggctcctcgccagccacgggactgacgcgcgcatccggccgcccaccttcctcctcctcctcgtcaaagtcgctgccctcctcgtcctcgtcagagtcgaccagcgactcgtcctcgctgctgtcgtcgtcgtcactctcctcctcgccctccctgtgtgggttgtcagaggtggggaggttggggtcgacgattgggtcatggatcctttggacattgcttcggcaagtgcttgagcatcatttgccgcagtccccgatcatgccgcagcgacacagtcccccctcccaacaagggaaaaccatcttacgtgggtgagaactccgactcctcctccgcctcctcctccgaatcggtctgggaggtgtccaggaaactccagccgccactgtggatgaagccctcagggtcctgcgggggggcagatgaggagtgggattgcggtgacaccagggagtcgtggccttcatgagggcaggccagcagtgcagtcgcccgatgacaacactgagtctgtgccgcaccgcctggtcccctgcctgtcagtgttcacatgacgctgtcgtccgcgcagtgccactgattactccataacacactcaacaccacgtacctccttgatgctcttgaggatgttcttccagttcaggttgaccttggactcgtagtacttgatgtccacggaggtgagccagtccttgatggtgtccagcgccttggactggatggcgtcgatcctgcccacatcccgatccaggtcctgaagcgggattgtaaaaacagatgatgagccctttactggccttgcattcatgctgatgcatgggcccaccaccaaggcaaggatgctgcacgagcctcgcaagcaggcaggcaggcagggctctcaggccatccctcaggcgaaccatccaccaccccaccttccaaatgatgaccaggtcaaagttccgtaggttgaaccctacacgctccagattgacgacgttgacctctggaaagcggggcatgattttgggtggttgggtaggatgggcaggccgattcaggcctttcaccaccatgccttcccacccccccacacacacaatcgcccgcccctcatcagatcaaacagacgcattcacgagcgtgcaacaagtgccagcccgctcgccgcacctgccagggtgatgacggtgaagggcatctccgtcagctcaaccaggcaattgacggtgggcatgatgaagcaggtggtccgtgccggcacaccgtcaaaacccagttcccggaagggcacctcaaactccaggtttaggtccctgccaaagtggggtcagaggatgagaagcgaaggggtttacttttttttaaggggggggggggggggggggggggggnnnnnnnnnnnnnnnnnnnnnnnnnnnnnnnnttgaagggttggtgcttgagcatagggtgccagcccaggacatgtcggcaccggcaaaccgccgttggagcagcgcagtccacgcaacaccctgtcctgaatgaatacgagtcgaatgcaggacgcactcacgggaactcgcgttcccagatgttggtctgcacccgcttcacgaactgtgagaactggtggttgatctggttgcggcgctcccgctccctctgctcgtcctcgatctcgtcggggtcgtgcctgagcatgcccagggtgagagggggtgttggcgaggcgggcgggttccagcgtgcagggcagcaggaccctccttgcctcccccccaagcgcagcccatctgaacgacagggtccgtgggcaggggcacgaaacgagatcctgccaccctgaggccaccagtgccagccttcctggaagacatctactcacgccgagcgccgcccggcctcgagggtctgcacggagtccatcacctccgtgtagaactgcacgtccatcgtcttcttcttccctacctgccgtccgtgggcgtgcggggaggggtgtctcgcacgcgtgctggcacaggggttcatcagcagctggcagggcgccacatgcttgagcaggggatgagttggattgcatcgcccagcctccgtagagacgagcaggacctcccgcaaagcactcccctgcgccacgccggcgccatggaccccattctacccaccatgatggggtggatgaggtggaagtggaccagagtgatcatctcgttctgcgccggctggaagaaagcgtgcttgatgttgcggtacatgacgtccacctcctcgccacgcccagaggtgtagcggaagccattcgcatgcgcctgcagctcgcccgccgccttgcgccccttcccgccgaacgccggcctcatccagaggtctggcagcgaatacacgcgcgcctgcaaggtttgggaggctttggatgtgacttggaggcagggtctgatgcctaagggctgggtgggcaagtggagggaggagccttggagccaccttggttcaaaacagccaggtccgtgcttctgcctggcagggtggatcgtctaccttccccacacccaccctcattcccaccgacacgcgcaccttgccgcggatgagccgctcctgcgccaccagcgtggcccgctccgcgtgctccttgtcgcgctgcagcaccatgctgcgcatggtcttgatctcctgcacgaccttggcggcatggcgtgggtcggagctgcggaaggtgagctccttgaggaaggcggcgcccgggaacttggcggtgggctcgtacgcgccgccgtagttgaaggtgacgcggatgaaggcgtggtcgccgtcctagacaagtgagggggaaaggggtttggagtttggggcggtgggattgggggaggcggggctgtgcacagagctcgtgtcatgcagagagcgagagatctcagcccagtaactttccccaactccgcaccgtgcccagtccatctaccaaaccccattacccacctggttgagggttgcgttcttcacagtcagcacgtggaagggcaccatgacgccgtagatgggcaccaggatgcactccttgcgcgtgtcagtctgcagcaggagacgggtgatgtcagggagaatacggcagacaggggggctggaaatgacagggtgggtgctggcaagccctgcgattgtaaggtctggtgtgatgcaagcaggtaatcacaacttccaagcgcatccccactgccagcggcatgcgtccttcctcaaccctgcgccaaatgcattgccagaattgcgcctgaccccgtaccggcccctcccaccgatgccatcaccaccgccggggccctcacctgcacagtcagcgtgccgtttgtcgccatctcggcggcagaggcgtaggcgacgatgtcgctgaccttgcgtccggccctgccgccgccgcccgcgccgtcgccctgcttcgtcagcatgttgagcgtggcctggttcacccggtccagcagcgcctcctggttctcctgctggcgccgcctgcgtgaagggagcgtttctgggtgagcaccctaaagctggggttcacaaggacaggcaccccgcatgcgtccagcgcaatgcctcccgcctctcgcaggtgtgcccctggattcaggcctgcagcacatgcgggtcaacccctccctttcaccggaccccccacccacaacccggcgccaccacccgtgcatgcccacagtccataaggcctccccctccccctcacacacctctcctcgtcacgcaggcggaagtcaacctgctccgtgcgctgggacctgcgcccggccaggtcctgggggtccagaggctgcagcgtgcgcccgccgcccttccctccactccccccctcgccctctgcctcctcctcctcttcgtcgtcgttgagaaagtaggccacctcctcccagtccttggaggccgcgatggtggccacctcggggctctggccgccgccccgcaccaccaccgtgtcggccagcaggatggcgtaggtctgctccgcgccttcctccccgtccggcgccggctggcgcagccccgtggcagctgggcagcgagggagggggcaggggggggaggatgctgagcttggctcagtcagacaaccctggaccagtccctgactcttcgcagcatcgcaatctctagacttcacagccaagggaagcaacctaggaatggagtcgtgatgcttttcgctgccgctggcacacccgacgcctctcagaaaacccgcataagcacacccggagccctcctctccgatgagttctgcatgtcgaacatgccggcccagctccccctttgcatcttccccccaccctcgacctccccctcccaaagccaccgccacagctcaccgacagcgacgtggaaggtggtccctgcccggacctggccggcggcggtggcggtgagggcgcacgacccgtcccgcaggtccaacccgatccccgtccccacgttcttccccagcgcctccaccagcgcgccctggcccctctcatccagagcggccacggccgcggcgtgcgcggccgacagtggcgcgccctccaccagcgccgcgatcgccgcggcgtgtgcggcgcgcagggccgcgtactccgcctcctgccgcggcgtggggttgacaaagagggtgcggcccacggtggcgcagtaggacgcgtacctgtcgcagtgtttcgggagggaagcataaactcggagcgtgagcaggtgtgatggtcagcagggagtcccagggccttggagtcctgggacttgtggcccgacaccatcacagcaaaagtgagacacctgcacctgcctgatcacaatacaccgaggccacgggccatcgcatgcccaccacccacctcgctcccacttggcagaggatcacgtcgtaggaaagggtgtcgtcattgctgcccgccgacagcttggggtcataggtccccccggattgcaggatgggcggataggccacgtcgatggcgtcagcctggcagagggggaaagcgcgacagggcgactcgtcagcaggagggccggagggagcaaccatgggaactgctgggctctcaacatccctcctcagtcatccgctccaggtatccgcgtcatccctcccacaccttgagcttgatgttgatcttgctggggttcaggatggtgtcctccgtcttctccgcaatcttgctgtgtcgcaccttctcctcattatcgatgacgcctgtgggtgacagaggagtggcgcacatgggggctgggacgtcaacatccatgcattctctgtgccagccaaccacctacaccattgcaggacgcagcaggtccaaattcaagaccaggccacgccagtggtgggcccagcatctggtctaagccgcaaactacataccatccccgactagctctcagctcctaaacaccccctctcaaacccccaaaccccacccaccctcgatctccttgaccatgaactgggtcaggacaccgctggccaggaacgcggccttcttcacgttcttcacctcgtcctcgtccttgacagccatggcgtgggccaggccggcggaggcatccacggtggccaggtcggcctgcaggagccgcgccagccaggcctctgccgtcgcacccgtcggcttctcctgtggttgcatgtgaggatttttggggtccattgctctgatgttcctctcgcgtggagctgcaccagcatgttccccatacaccaaaccacatgcctcggcatcacaacatgagcactgcaggaggggctcctcccccagccaatccagcgctcacctttggcagggtacccaccgtcacggtcccgacctctccagaccccttcaaggcatccagcaagctctgcatctgggccgcgccgtcctccttgcggggcttggtgtgtagcaccagcttgaccccggcggcctcggctgccggggccagggggcccagcaggtctgtcttcttggacccggccagggcatgcagctcagtcttggtgagcaccaggatggtgtctgtggtggagtggggcaagataccatccaacattaaacaggccatgcccagctgggaaggagcagtttctgcattgactgcatgacaaggagcatgaacgccttccttgacggagctcgcgtgagcaatcggtctgcatgcgccacacggactgcgccatgctcgtcaggattggcggggnnnnnnnnnnnnnnnnnnnnnnnnnnnnnnnnnnnnnnnnnnnnnnnnnnnnnnnnnnnnnnnnnnnnnnnnccggtgaactcgtatcccagcagccagaggtgcagactggaggaggtatagtaacggatctcctccgtgggctgtcccgtgacgatggccagggcggtggctccgttccaggagggagatgtctgcacagccatggcgtgtggacgatgaggggatggcatacacagacaaggagtcgctcccagcccttcctccatcatatcaccaatggaagctttaccttccagtcatcatacaggagctgcaggcgtttgccgaacaccgctgcgtctatcgagtacgacatcgcgagcgatcgtccacgagcgacccttgccgtcacgcctcaggccgtcccatgcatgcggtgcaggtcgaaatggacgttacccgattgacaggaccatctctttgatcccaatgccctggatcactaggcttttccttgctacagatctcgggagcccggggtgcggagcgtgctgcgctgccttcaaacacttcaaacacgagtctcatcctcggttcgttgccgtgactatttacacggcacacaacccactctccgcgcacgcatatcccacgacatcagagcgtgggcttggggccttggctgcggatctcgtagtcgccggcggtggtgatgtacctgacccagggcagggcctggtacccgctcctctcgatcaccttcaggtaccgcacctggatgcccgagaccgtgaagtacggcacctcgaacttgaccttgatggggggcatccttccctgggactcgtcctcggccgccactgggagagggaggcgggggagagggggtcggtggtgaggaggaggcccgaggttcaagggacacttgtgggtccctcagcccacgtggcaccctccaggctctcgcaggccctggctccgtgctgcaggctgtgagggcagcgttcacgcagctgcacaccctcatcaagcctcattccagcatcgccgcacctgagggcaggccaaacttgcagcgcagcaggaactccctcccccccgggaagttcttgatcttccacaccagcgcatccctttcgggaacatacacggcagacccctgcgattgtgggcatgggggcacggtggcatggcagaaggggggtctggatgctcacagcgtcgcaagagggcagcccaggcgtcggtgggagcccacaggcaggctgcatttccccccacgcccgcccgaccggcccccacctggctggtgcggaaggtggggctgatagcgtcggcggggatgggcagggagatctccacggaggtcgcggcgctgcgctccttgaactgggaccgggccttgaccaggtattcggtgcggctgcgcgagtgacgctccacggcgcactccacccagatcaggggcttcacgttctggctcagacgatacgtcctgcatgtgtgtgtgggtgggtgtggcgggaggcgggtgggcatgggtggaaggtaccagagtgatgttccagggtttcgtggtggtgggagggtactgagaatgtgtgctgtgtgcagacaccccctttcatgggtttggtgagctgatgatccatgcactcgacagaccttcggccctacccagggtcaccccgcatggctcggagggagcctccagggtccctccccatcacaccccaagtgcacaccctttgccccctcctattccccccccccccccccnnnnnnnnnnnnnnnnnnnnnnnnnnnnnnnnnnnnnnnnnnnnnnnnncaagcatgtcgcccctacccacgcacatgaggtcaaaggcgccgtctggggggatgaaggagatggtccggtcccgctcgaagtttgccagcctgacgcactggtgaaacttgatgtcctccaggtccacggccttctggcggccagaccggccctgcacgtcgaacaaaaccttgtcgttcaggcccagcttgcactctggcatgccggagaggtaggtgcgcatcttcagcgcgccaaccacctcgctgcggaccaccgagccgttggagttgaccagcaggttcaccgcctccaccacgtccaggaacacctcgttcttcttatacaccaggccctccgtgcgccacgacaccgcgttggtcaccgccatggggggccggggctggatctggagcagggtggtaggtgaggaatcttagggtggggaagaatggtgtgaagtgtgtgagcctcattcatgcggccacctggatcagggaggggccgggggagggcgggcatgtcatggacagcccagactcccgctccatgcacaagtctgcgccccatgcatggacactcctccactgcagcgagcgctgcagctttcgcacgtcaaccatctcaggcccccagcgcactcaccgcgagcttatgggcgtcggtcttgatgtactcagagaggatcttgccctctgtgaactgagggtagccgtagtccattacctaggggcggggcaggcatggcgacagagatccaaagataagaaggggcggggtgcagaccgatgcacaatgctactgcaatcttcccctccctcagtttaaccgccagcatcgcctagccacatgactcacctcatccaggagctcataggcgatgacaaagttgtcccgcagggactcctcctccaactgcatgaaggggcttggtggtgcgtggtcaagcatgccaacattttcacttatgaggttgccagctggcccggccaggcaggtcaaggccggctaagcaagcactcaccataccaccctgccccccgaaactaccggacaattcgcctcccatactcaaggtcccacctccgtgaagtactgcttgaagatctcgattagcttgtgcaggaacaccaggatggcggcggcgttcacgttggtgcgcgacatggccaggaggtacaggttactatactgcacgaacacgaagcaggtgccatcgtccaccagcacagggctggacttccccgtctcctccacctcattcagcttggtgatgaacctgtccacgtccctcaggggaatgtcgcccctgggatgtgggtgggcggggggtcaggtgtaacgctcagccaagcgatccggtcaggcgatcgctggtggggcaccccgatcccagtcctcgttcccacctgtagtcccgcgacagcactggcttccccttgctgtccaggaggaagagggccgatatggaggacattgcgatgcggtgctgggccccctcgggtccttacgacattctcaacgcacacggccccagaatggatgaagaggagcggcgactcgggtgcccagtcgtgcggcaaggctgagtgagggcttccctgcaagccaagcactcaatgggcatgtgccctccagatcaggggtggtgactaccgactctcttgggggggagcggttcgtcgtgagggggccctacccgatgccagctctggcgatgcacgcgggtgatgctccacggattcgaatagattgtccctgggtgatgcctttccctcgcggggcttggcgggcacgggaagcagggcacactttcgcggtcaatgagccggggcgcgcctttttccctcgactctcatctgggcagctgggacggaacccacgcccctggctgggtaccctccacctgcctctcatctcaggctgcgcatcgacaggtgtgcagtcaggcatccactcgtgacttcttggcagggggcgcgaggctgccaaacacctcctgcggcacctctttctgctccagctccagtgcggcgggctccccctcctcttcctcctcctcgtccagctcgatgtcctccggattgacggcggcagccgctgccgcctccccaccctcctgcccagcatccccctgctggatgacgcctgccgagacgaagcccgggagcctggtaccccccgccggctcggccgccagctccgcctccagggccgccatgtcgtccacggccggggggggggcgccccccgccgccatggccttggccgccaccgccacggcgtccaccacggtcgtgttgaagtgggtctgtgagaaggacgcagccacggagcgcttgatgcgcagcatctccctgcgcagggcaggcgaggaggggggttggacgccggtggcgaggctgcccagtgggtccgtgcagccaagcccccccaggcccctcgctgcaacccacgcacgccccgcgcgcgaccacccctgcctccccccccgcgccccgcaacccacctgaaggtctcctcgtgcccgtgctggacctcgaacgcgttccagtcgctccagaaggccgcgtcccggcgcgggtctgcgtgtgcggggggaaggggggggaggggtcgaggggcgtggggtcggggcgtgatcggagggcgctgagggcctgaagaaagggtatcatgatgctggagggcccagatgtcgcggtctggctccagcgccccatcccgcgacaggccggctggctcccacgtcgtcctcgcgagcgtgtgcgcgcggggagcgagcctccagcccccgtgctcacagccacgaccacaaacctgccagggctgaggcgtgcacgtagatggcgcgcgcgcggtccacctcccccagcttctgctccaggtgggcgtagcgcaggcacagcgtgcgcgtgtcggcgtccgacagcgcaaagggcggctgcgcctcaatggccgtctcgtacacctcccgaacctgcggagaggtttgtttgtttttgtgggggggggggttgtgtggacgtgcatgcgtggagcagcgcttggatggcttccggggggaagggcccgtgcggagctgggtgaagcacacgccagtgctcgcacctccaaccccttccccggccacaggcggcagcccacatcgctcatctgccatgttccctccaggcgagcagacccctgctcccacgacgggctcgaaacccgctcccctgcctcaccttgccgatgccgaagaactctgaggcccgcgccaggtagacatcgtacacagacaggcgctcgccgactggcaccttctgaacggcttcttcgtagatctacaaaaggaaaaggggagtggggcccacacaatacagcacctgctgaaaccacgagggggatgccacggctcatgtgcagagcgtgcccggctgacgaccctaccagtcaagaaggacagctgcacgccagcacccacctgcatggcgttccgcgccaggccatgcttctcctcaaaggcagcgtactgcaggaacagcggcttgctctcctctggaggagcctgcagtggtgggagggttgtatgcttgaccacaggtcacggagcggcaaagccagggatccgcggccaccatggggtctcagagcaccctgccagctcttggagcctccaccgccaagaagttccatcaacggctacaagaagcgaggcctcaggcagtcagcccaggtagtgtttggccgaggctcgaagtcgacgagcacgccgggatgttgggctgcggtacccagccatcacctgttgccacgccctggcatccgatgcctcaggtccatcacactctaggtcctccagtctccctcaaaaccctgacaaacctcccacctcgtcaatggcctggcgatagaggtcgcgtgcccgctccaccttctttcccccgtatcgctggttgaagaaggccaggtaggcctgccagatgtccttgacgtgcgggtatttgaacagcgccacgccacgctcgtacaccctgcatggagtgcgcggtgggatgagtgggtcagggcagggtgccaggaggacggtcgggggggaaaggggggcagattctcagggcctgtacgcccgtcccaggctcaactagcgtcaggcacgagggaatgctcacccaagccggacggtgctccccctatttaacacccatacccccctccttcccacagatcctccgcccacgtgcctgaaggagtcctcccagtacttgctctcctgcaggaaggcggcgtagttgagcacaatctggggcgtggcgatcttcaggtccagcaccgtctcgtagaccgcgcgggtggaggccaggtcgcccaggctttcctccaggtccaccagcagggaccagaggcgcagggagcggtacagccgctcctgtaccggcaacttgttctcctcctgttggtgtgtgcgtgtgtgtgtggtgggggtagcgtcagtggttgcccgggccgggaagcttcattgcgggttcctgctgccagggcagcatgagaaccctgccacatcatatgggcgccaggcgctcttcacagcaggggaacgagtgccaggcgcgagggatcctggtgcccaatgtgcatccccaccccaactgccgagcgtccctacctcccgcgtgcgcggccgctggggcggcgtggtggccgtgcgcatgagggcgagcgccttcttgtaggccttggcccgcatctccatctcggcccactcacagtagatggtggccaggtcatccacgtacttgtacggcacctgggaggttggaggggagggggttgtgggttgtggcgggtcaaagcaaaccctaatcctcgggctgtaggtgccgggactcctactgtgtgtcgggtaaagatgcaacaccccctgtccggccaccttgcgatccgcacgctgcacgccatttgcccagccgcagagcacccgaacccgcacatccccgcgccatctcaatccaccatcctcctcgcaaagcccacacactaacctcggccgccttgccgtatatgaagcgggcgttgacgaggtcgccgtgctgttcgtacagcttggcaaaagccacccagaggctgtgcaccttccccaccgcctgggatgtgtgtgtgaatggggagggcttcaggcagctgagagggccagggtgaccttggcgacgacgttccggcacacatgcacctagggggaaaaggattccactcccccatcccttctccgcgcctccacgcccaactcaccttgtccgggtcgacggtgcgcacagcctcggtgtagcacaggatttgcttggtggggtcggcggcgaagagcttggcgcgcttgtgccactcgtgcacgttgtgcgggttctggcgcagcaccacggaggacagcagctcggggcggcgctgcatcaacgcctcgagccgggccaagcggaggtcaaggtcggcgccggtgtcggtgagcaagaagtcgtcgccgtcccccgccgccgccgggtcctcctcctcttccccctcgccctcctgccaccgatggagagcatggtgaggttggatgtgggtggttggatgcggggcgcgagggaggggtgattgcactttggacttgcagtgcacagggcaaccgcctttgcctctcggctcagttacccccgatatcaagtacatgtgcgtggacattcgaccgcccaaattctcccattgtctgacatcgaaggagcacaacgtcgcagcctcgtttggaagttcattccccaggctatgcatccagcccaggtccgtcgcatgcaatcagcccccaaccccccaaataagctatctccccctcacttcctacctgctccagcttggcggagatgagcgactcctcaaactgggtcagggcgtcgaacacgagcgagaagtctcgcaccgtcacgactgggagtgtgtgcggaggtggggagagcttcacgatgagcacgagggcgagcggcaatggaacggcatgatgacatctcattggtgtccagggtctggcgccgaggcacattgccacgtcagtcccttcccttggaacactgggtgggcttcctggaggtcctgaaggggttccaagggccccccccctgttcccccttcacaccaccaggggtcagcacccgacaccctctccccctcctcccccaccccccaccaacctgacgcgaggccctcctcgtacacgtccctggcccgctcgaagagccccctgcggatgtagtagtcggccagcgaggtccacagccgccccacctcgttggtgaacttgcggatgccggagcgtaggatggcgtccaccttcaggcccttgacttcctgcgggtggcgggtgatgatgtcgcacagctccagccacagcgcgtgcttggacttgccctccagcgagcggaagccctcgtcgttgaccaggagggccaggcgcgcggcggcctcgccccagcggccgtgagtcgtgaggtaggccacgtactcctcggcgtgcgcgggctcgaagcgcaggtagcgccggtatatgcgcaccgcggtctcctgtggcgtgccgcggtgcgagatgaaggccaggtaggcgggccagacgcgcgcgtgctgcgtcaccggcagcgccatgagggcgcggtcgaaggcgcggcggcaccgcgtgacccaggcctgacggaccaggaactccaggtactcggcccagatgcgcggcatcttgtgcatggacaccagcgcgcgctcgtacacgttgttcagagcctccagggccgggtgggcgggggagaggtcgcgcacctcctgccgccgctcctgcaggtacgcatgccacagctgggggcgggggagaaaggggggagggggcgtgaatgcgtgtgtgtggggtgtgtgtggggtggggtggggggggccaaaggtcgggcacatgctacaggcacagaaagtgagccgggctggatcccaggacccttttcctggcagacagtgagcatcattggacggctacagatgggcctcgctccggctgtggtacatgcagggcacagcattctccctgcatcgaggcaacaccgcaagaactcctgcgaccctgctcaacaccactgcccaccgctcctgaccccacgttccccgcatgcggggcatcattccacgccatagcaccttgtaggagccaggcagcttctccagggcacgctcatacagcaggcgccgcttcagggtgggggcgctcttccgggcatccaggtaccgaacccacatgcgcagggagtaggggttgcgcagcagctcttcctcatacaggagatccgcttcgtctggcagcaggctgtcgatgccattctcaggggcatcgctgccgttgggccggctggcgggggccatggccctcccgagtgccgatggtgcgcccaaggaagggtgaaggcctccagcaccgtcctcaaagatgtctcatggtagtgaatgagcgtcaatacgtaaagggattgaagaagactcacaagtgcgggtcccagcatcatgcaaagtcgagggaggtggggctagcacccccgatcagtcccagcacacggagcgcagctttcgaaccagggagcctgcagggggagccagggcatgcaccccactcgctcccatggctgacaacaaaatgcccttgcatcatcgcatggttattcaaggaggtcaccccgaaatccagcttagacttttctctccttaaccgcctcagttgttgggtgctacccggtgccgtagcccgagctcccatcccatcgcttccctgggcagcgcgcttcccagcctctattgtggcttttggcggtgctcaggggcaacagatctctgttttgtggccggcgatggtttagacgccaatccgacactgtgctcctgcgaacggacccccttgccctcacgagaacgggcacactcctgaccccactccgccgtccgatgttgatccgagtctatccagcgaccagttgaccgtcgggatgcggaacgagcatacgccgcgtgggaggtacacccggcgcctgttcctgtccgccggcctggccctggccctctacgcctggtgggagcagccggggcgcggcgtcggcaccccccccaacccccccccgctcctcgacctcgccgagccctcggccaacgcttctctgccgggcagggccgcgcgcgccgacctggcggcccgcttcgccgccgaggacaggctgctgtcctccgtggccccccctcccccacccggcgacgcctggccgctgctcggcccccgcctgcagcccgccatgcccgccgcccgcaacggcacgctggtcctctacgtctaccaccacacgcggggaccagagcacgccgcgcgcgccgcgttgtttgtccgcgccgcgctccaggacggcgacggcgtggcggcgcgcctgctgatgccgcgcggcacgcgccacctgctggccccgcgcctggcccccctgcctcgcaacgccagctgggtggagctgccggagggtgcctgccaggcctccacctggggcgtgctgggcgcggcgctgcccctcctggcctcggacctggccgccagcacgtacgtcgtggtggtggactctggtaccgccggccccttcctgcctgcccacctccgggcccacctgcactggacggagccgctgctggcgcggctgagcgagcgggtgaggatggtgggccccgccatcagctgcgagggaaccccgcgcggcggagatgtggcgggggactggcgccggcagccccacctcccggcgcacgcctgggccaccgacgcgcagggctgggcgctgctcagccgcccccaggccggggtcatggcctgccacgccgacccctgggacgtgcgctggcactccgacctcggcgcggctgcggcactcttcgacgcggggcacaccatcgactgcctcatgccgcgctaccagggcgtggactggcgggacgagcgcaactgggcctgcaatgaccggtgggaagggggcgcgggaggggggtggtggggtactgaggggagagagaaggtgactgccggcaaagcgaggctcgctgcgttaaagcgctggctgatctgggtgtggtcccggtggagtcactgcagctgggagggtgtgtactgccagcgtgccagagcaccattctcgcgtgcctgggaacctgggtgtatgtcattgatggctctccgcgcctccgcactctcccctccccgcaccaggttgccgccagaccgccagcggtcgaacgacgggctctccgtgacgccctacgaagtgatgttctggcccttctcgctggcccaggcggagagctatgttgagctgaggtcggggcttaagtacgcccagtggagccaggcgagcgggcttttgtcgtgtatgggggggagaggaggtgaatcgcccaggctgagcggcaggcttgcctgctggggtactggcgaggtgttccagtgaggatgcaactgaccttgttttggatggggacacgttcctgccgtacgcaacatgcaatcactttccgagctgcccaccccatgcactgagcaccatgctgtgccacattggctccactctgcgattcattccactcagctgccgaagaacctattgtctggacatttcggacccggtatagtgccctgcttaggcaccggtcgcctacatgtcgtagcttacagcctgcatcataccagcactcgttccctgctgcccacctcatctcccgctccctcaactagtccaggcggaccccgacatcaccagcaatgagtatctgggcagggcggtggggaagctgcaggtcctggagctggagtggagcgtccgcggcgagctggcgctgcccctccagaccacgatgggagggttagtcgggtgggggggggttctatcggggggtgg

SEQ ID NO: 23492 - DNA, 73 bp, Chlorella protothecoides
taagatgatgtgcgacctcatgggtatgccccgtcgaccgcacacacctgacatcccttccgaacgtggagtt

SEQ ID NO: 23493 - DNA, 112 bp, Chlorella protothecoides
atataccacccagcgattgcggcctgggcacgacggtacgcgaggggccaaacatggtttgccaagcagcccaagaacattgagccctgtacgctgctgcagcgttcacgag

SEQ ID NO: 23494 - DNA, 109 bp, Chlorella protothecoides
caaacaaggaaaccacagcaccggtgtgcccacaactcacccccacccttttcccgcccctctctgatcatccacgcacgagacccacctcttaaaaaatgtctggtcg

SEQ ID NO: 23495 - DNA, 128 bp, Chlorella protothecoides
tttgacctggtgagatgcagactgcatgccatgtcaatgtgtacgtgcgccaggactgggcattcgtatctgcatctttgagccctctcttcctcaccttcaatcccaccgacgcggtggcctcagac

SEQ ID NO: 23496 - DNA, 65 bp, Chlorella protothecoides
cccctcacaggagcttcaccttctcatccagtcagccagcaagaagccaccagacactcgctcaa

SEQ ID NO: 23497 - DNA, 61 bp, Chlorella protothecoides
atagagcggtgccaccactcctgttaatagcagtgcggctcaaaagagccatgctcaaagt

SEQ ID NO: 23498 - DNA, 230 bp, Chlorella protothecoides
gctcctcctcgctcatgtggcctggaatgggcagctgcgcgggaagacacagcatcggggtgactgcccacccaatagccattacagtaggcgagcaggtggtcttcacaccatacagggaaggcatctgtgctcgcttcaacacctccgggaccccagctcacgttcccattcacatggcgctgcacatgtggcgtcatgtcctcagatgagtactcgtcctccccctc

SEQ ID NO: 23499 - DNA, 61 bp, Chlorella protothecoides
atcccggccacccatcagacgtgcacccatctgcacaagccagcacccaccggaggccagg

SEQ ID NO: 23500 - DNA, 276 bp, Chlorella protothecoides
cgcaaggtgagcaagggtgaagccttggtaaagatggtggggcttgttaggggagggcgtgccgggtggctgcatgatgacaatgcaaagtctcaaatgggaagcaaggatgcaatccggtttgggcatgccctggccgcccgcacttcttgtcagcctgcgcatggacgtccatcaagtgggcacctcacacccgtcgccacgggcgagcaaccccccgccctacaggccatcgtggcgacaaatatcgcggagacgtcgctgacgctggagggg

SEQ ID NO: 23501 - DNA, 109 bp, Chlorella protothecoides
tcctggcctgagcaccacttgggagggctcgccggtgatcgctgcacggctcgctcttgcttcttttctcctttcgtcaaccttacaggctcgtcatacgaacacaacc

SEQ ID NO: 23502 - DNA, 142 bp, Chlorella protothecoides
tgtcaccagtctcaatggaccctgcacaacccagcgcgccacaacagctatgcccatccttgcggggaaaaaccttcccctgcatacaaaagaccacacagataagcaaacaccggatgcaggcagcacctccgacatgggg

SEQ ID NO: 23503 - DNA, 61 bp, Chlorella protothecoides
agagcagggggttgagaagagcagggggttaagaagagcagggggttgagaagagcagggg

SEQ ID NO: 23504 - DNA, 61 bp, Chlorella protothecoides
ggattccggggtgtcggtggagggcgggggtgacccccgaatttgccagtgtgccaccgtg

SEQ ID NO: 23505 - DNA, 70 bp, Chlorella protothecoides
tggcagtcctcctgcccctctgaaggggccacatgcacgtcccccctgtttccgctccagtgcccgcgcg

SEQ ID NO: 23506 - DNA, 77 bp, Chlorella protothecoides
cccgccgagaccaagataccgtccagcttgaagtcatggatgttgaacagagaccacagctcccagaactcctgctt

SEQ ID NO: 23507 - DNA, 61 bp, Chlorella protothecoides
ctctcccagccccgcggagtcaccctctccgatccaagaggagtcgccctctcccagcccc

SEQ ID NO: 23508 - DNA, 103 bp, Chlorella protothecoides
attctggttccaattgatgccccatcagccaaactcagccatcttgctggatggagccccacttcttggaggaatgcgtggccttgaaagctcgtctatccaa

SEQ ID NO: 23509 - DNA, 271 bp, Chlorella protothecoides
gctcttgggagcctgtggcgaatgtgaggcgtgggaagtaagggacctggtgaggctatcgttcctgcacacctcgagccttccggcagtgaggcgttccgttgggtgtgcaccctgcagagcgcctgtggccggcggctgggttacggtacccaagctcacatgccggcgatgatgcatggcggggccaggagcctgcacagaaccaagggacgcccccgtcgccccgctgctgtgcctgcgcgtagctcccctgcacccaccgtagacc

SEQ ID NO: 23510 - DNA, 64 bp, Chlorella protothecoides
caagggcaggttgacctgcatcgctgcgggcttcctccccttgcacgtatgattacatctacac

SEQ ID NO: 23511 - DNA, 149 bp, Chlorella protothecoides
tactgagctgatccagcgtgctttaaaacaccgtgagctgggacggcattgcaacatgaagatgcttcgttctgagttgcgcgcctcgcagaggcgaatgcatgccggagaatttgaatataccaaatgacaggtctggtggtctgagg

SEQ ID NO: 23512 - DNA, 91 bp, Chlorella protothecoides
gttggtatatatccacgaagacagtctattgaaacaccaaaccttcaagttcccctgccttattcctcaaccagcaaccaaaactccaaaa

SEQ ID NO: 23513 - DNA, 65 bp, Chlorella protothecoides
caggaatgattctgtgtgcgcagggatgggagggggggggtggagggatgggaacgaggatcgca

SEQ ID NO: 23514 - DNA, 407 bp, Chlorella protothecoides
  modified_base (113)..(332): a, c, t, g, unknown or other
aggacattgtggagccaggacaaggtcccagtcccagcaccggagctcttgcgcccattagggaagaggacgtttcatgcctagcttctgagggagccaacaaagtcccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggtgcaaattaggcctctttgggttcagaaatctctggtacatcctcctctcgtgtggtctgcagctggct

SEQ ID NO: 23515 - DNA, 82 bp, Chlorella protothecoides
ggctgctcatagtgcctgggccgcaggatcgccaaccacccacagccaagcgacaactcagtgcaattcactgtccttccct

SEQ ID NO: 23516 - DNA, 61 bp, Chlorella protothecoides
gcccaagcacgagcatgcagctgaagctttccctcccaattgcaccactatagcatatgag

SEQ ID NO: 23517 - DNA, 158 bp, Chlorella protothecoides
gagatgtctccaccagctaggcccgattccacggacctgtgtcggtgatctgggaccctgctgtgcatgctccacatcaccaccagttctctcgggtgtcaattcgagggtcttcgatgcccgtgaatcccatgtatgtgtgttcaggaacgcgaata

SEQ ID NO: 23518 - DNA, 79 bp, Chlorella protothecoides
atgagggcgctgctgagttcctgggtcaggttcacgaccacaccgaggtatgccggtgcccgaggctgaagcacatcgc

SEQ ID NO: 23519 - DNA, 366 bp, Chlorella protothecoides
  modified_base (163)..(306): a, c, t, g, unknown or other
ggtcacgattgtcgtcatggtgctggccatccacaacgaaggtcggtctgcccagcaggtcttggaattttttcagaacgtaataattttcgccagggcattggggtcattcatgaggcgtcctctggccttggaggggccaggcagacgccgtggcacgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacttcaatctgatacccaccctaccccacagactgcttcagcgtcgcgcagactgga

SEQ ID NO: 23520 - DNA, 116 bp, Chlorella protothecoides
ctcgcaggcggcgtggggctgcagggccgcgtaggccgccgcggcgcgcggcgcagcggcctcggccacacccggcaggcgcgtggcgtcccgcacccctgcctcgcctgcgccgc

SEQ ID NO: 23521 - DNA, 110 bp, Chlorella protothecoides
cacaacctctgtcaagacgacctggaacggtttccgggatcttccgaagaaggagacgaagaaggagacgatgaagaaggagaagaagaagatgaggcagcagcagcagc

SEQ ID NO: 23522 - DNA, 65 bp, Chlorella protothecoides
cgccgtgatggctaaaacagctgtgaccaggagcgaaagcttcgctcgccgaggtcccggcattt

SEQ ID NO: 23523 - DNA, 71 bp, Chlorella protothecoides
aaagcttcgctcgccgaggtcccggcatttccacggctctacagtggtgaaacgatgagaagccgagttga

SEQ ID NO: 23524 - DNA, 63 bp, Chlorella protothecoides
gctgagacgcacccaggatgcacgcagctccaaggtcgtcaggcggccgtgtgccgcaagttg

SEQ ID NO: 23525 - DNA, 65 bp, Chlorella protothecoides
aacaccagagaggggagggagggggggggggggttgcctgatggggaagattgcgagagacgcct

SEQ ID NO: 23526 - DNA, 97 bp, Chlorella protothecoides
tgtattcagggattgcatgcgtgtctctcaagaacggagtgcagcaagacatgtggactgggtggtgtgagacaattccgaccccaatgatgagcca

SEQ ID NO: 23527 - DNA, 78 bp, Chlorella protothecoides
gggaaagggttggagagggagggtgtgctgctgttcttgatgaagaggatttgaggacagaagcttgtactccagggg

SEQ ID NO: 23528 - DNA, 105 bp, Chlorella protothecoides
gtgtcagtttcaatgaggattcgctggttcaatagtacttgaggttctgtgtgacttctgtttgcaaacactgcaaagagagctcgcaagctttgtgcaagtcat

SEQ ID NO: 23529 - DNA, 70 bp, Chlorella protothecoides
gggggtggtgtgcgccgccggcgcggggggtgcggtgcatgccttccacgcggccactggaaagtgcgtc

SEQ ID NO: 23530 - DNA, 730 bp, Chlorella protothecoides
  modified_base (145)..(154): a, c, t, g, unknown or other
gcgcgcgcgcgcgcgccgcggcggagggcctggcggccgccgggtccgagctggacgccgcgctgggcacgctgggcggcgtcgcctccagcctgggcaggtccgcggccctgctgcgcagcaacgcctccgccgccgagctggnnnnnnnnnnttgggcaggtccgcggccctgttgcgcagcaacgcctccgccgccgagctggtgccggccttgctccaggggcgcgaggaggcggagtcgagcggcggcagcggctctggcgaccaggccctctcctccgcgctgtcgctggccggcagctgggtgcacgtgagggggcaggccgcggacgtgctgccctggcatcgcgacgccgtgccggggtcccccttttcggtgactggtgcagtggcaaaagcgacgggcgtcgcggcaaagacgacgggcggtgcggggaaagcgactgatgctgggaccgtggcgaggcatgaacacactgcggcacagggcaaaggcactgccgccgcggcgacagacatgaatccgaagacgacggctgccgacggcacgcctgcccaccaaagcaacgccggcgacgacgcgatgtccacggcgctgtcggcgcagcgcgtggacggcgtgcgcgccgaggcggccgccgcgctggaaagtgcggcgcgggagctcaacggcacggcgcaggcgctgctggccgcgcgcctggcggccgagggcgcgcacgccggc

SEQ ID NO: 23531 - DNA, 158 bp, Chlorella protothecoides
tgccatccacgcccgcgaccatgacccggcggcacgaaaaatgcctcgccactcagcagtgaagtaccttcatgtcaacccaaggctaccaggcatacggtgtctacacatgagtgccccaggcaatcagcacggcgcataagggcatgcaggaccag

SEQ ID NO: 23532 - DNA, 61 bp, Chlorella protothecoides
cctcgtgacgctactgcggcaggtggatgccagttcggcctttctgggagatctagtcggt

SEQ ID NO: 23533 - DNA, 80 bp, Chlorella protothecoides
cgtgctccgggtgcgcagacctgccgggggccggggcctgcggggtcgccgcgccgtgggcgtaggcgccgcgcttgatg

SEQ ID NO: 23534 - DNA, 69 bp, Chlorella protothecoides
cgaggttgctagtctgttgccacacccttccaacacgcacctgcctactcccagtacaaactcaacgag

SEQ ID NO: 23535 - DNA, 77 bp, Chlorella protothecoides
cagggccagcctcaacaccgcaaacaacaacaaaacaatcatcaccccttggcggctcccaacaagtcccctgccct

SEQ ID NO: 23536 - DNA, 61 bp, Chlorella protothecoides
gtatggagttttgctttctggacccgcgggtatatagctcctaggccaggggatgacaggc

SEQ ID NO: 23537 - DNA, 77 bp, Chlorella protothecoides
aacccctccctggtgcacgcccagtccatcgtggccaccctcatctcccaggtcattctcatgggcctggtggaggg

SEQ ID NO: 23538 - DNA, 38828 bp, Chlorella protothecoides
  modified_base (9599)..(9637): a, c, t, g, unknown or other
  modified_base (18665)..(18729): a, c, t, g, unknown or other
  modified_base (27516)..(27525): a, c, t, g, unknown or other
ggccgccgcggccgaggcggcgctggtgagccccggggacgagggtcatgcggccccgggcggcgccggagaggcgcgcccggggggccgcaacgcgcgcgggccgggttctggcgcgccgcccagtccgtttgacgcgcccatgacggccgtgaccaagccggggggggtggcgcggactggcgcgccgcccagccccttcgacgcgccttcaaatgtgcagcagcagcagcggactgcggcgccgcccagcccctttgacgcgccttcgggaacgcagccgaggactgacgcgccgcccagccccttcgacgcgccttcaaatgtgcagcagcagcagcggactggcgcgcctcccagccccttcgatgcgccttcgggaacgcagccgaggactggcgcgccgcccagccccttcgacgcgccttcaaatgtgcagcagcagcagcggactgcggcgccgccgagcccctttgacgcgccgtcggcggcggcggcggcggcgagcattccggcgaaggccgcggggccccccagcccctttggcgcctctccgcccgccaccgccggcggcgcgacagccccccgtgcctccacgcgcggcgccccgcccagcccctttgacgcgccctccacgctgggcaccaacgggggcagcctgcaccggcccagcccctttgatgtgggcgtgcccaacccctccagttccttcaaggtgctccggccgtacgacctcgcgggctcgtccggccgcgtccccggcgtgacctcggcctcgcccgcctccaacgccggcatgatcgcccagaccttcagcctgcggtccagtcagctctcctccgagtcctcggccacggcgcccaacctcagccaggtggcctccgggccacacactgccagcgacgactccgccgaggtgaggaggggagtggggaagagctggggcgcatctggggcgggacaggtgtcgaggcacgcgcgcacagtggtgtcaccccccccctcccccgccccacccctgcttcgatcgcagccgcgaacggttgcctagggggcggcgactgcagcgctgctgagtggacagtcatgtgggactccccttccaggccgggatgcctccttgcgttgctcaggcctatacacactctcacccacgccccgccctgccatcactgtggccgagtccctccccctccatcgagacgcggccagcatgaaacattactgttgtggcgagagcagaggggccactcctctcctgcccgctgttcgagttcccaaaccttcccttgtgtgcaattgcgtggcagtgttcaaatttctcttgagggcaatgagtggcttgtcatcccgctgactctgtactcctttacgacacgctgtctgctcgagcggggccatgggttgcaggcagggaggatgcatgcaacactcattcctgtcgtcgacagaccagggtgtcgagccgacaatcaggaaattaagaagcgcagcaccaaagattgtacctcattgcgcggctgcttcctgcgccgctcttcgtcgctgcatggccgccgcaaagtcggcctgcaggtccggcttctgcaggcccgtgcgctcctccggcgcgggcaggccgacgcccgctggacgtagcttgacggcaaagggggagggcgtgccggcctcccccccggtctggccccccagccgcgtcttgagcaggggggtgggggccgagtcgccccccgccgccctcgccctcgccacctccaccgccgcggggctggccgtggcggcgaggctggaggcgttcctgggggtcatgcggggcagcaccagcccggctcccagggcggggatgcctcccatggccgtcacccggctctccaaagagcgcaggctgaccccaaagggtgtcgtgtccttgctgtcctcgggctgtgtgcgggagggggtctaggggccttacttgagaagcctggagcagttgtcgctgaattccacgtgcagcgtgctcgggaacggggaatggcatcagaatctggaggtaacgagacgtcctggggagccacgtcaacaagtgaaccccgcagttctattgtcaaggatatgctcacctgggagcccgacacgccaggctcctgctcacaacccagcagtgcgtcccactcccgcatctgctcgcggtggctggcgatgaagccctccctctggacagtcaggaaggaggccaggtccgagcgcggaacctcggagaggtgcgagaggctggtgtctacctgcctctgcagggactctagtgacatcatcaaccgacgaagactttctttcgcctgcgctctggtcacgccggggccggggggtgagcccgagccgtcggtagaggccatacctggcagtaggctacacgacagcctcgggctggtgagctgggcgatgtaggagtgcagtatccgaatattacatcagacgacctgacactgcatgttgcccatcggaacagccgtgcgggagagtgtgttcatcatcccgtcgtgctgtttattccgtccgtaagctctcgtcaaacatcccccggtggaaaggcgggatccctggttttgtcactgcgggtcagagccaaggcgttcgcgaccttgttccggcgtgcttcttcctttacacctcgtgggtttttggcatcttccatctgtattgaatcgatcccaggagggctcaagaggcactgctaactctattgggagcaccatggattcttatggctctcaaggcgcgtccagcagcgctggcctgaatgaggggcacgtcatggaatcggtaggttggcgggcacttttgtactgttgagatgcagctgccgtcgtgctcatccgcgctgcggctgcctgggcgagggggtgacgcccgccgacaaccctgctgcagatcaagcaggagatggcagtggccttcctcaacgagttttaccaggtgtgtttcgagaatggatcgtatgtggaagggttgtgtgtcttgcccgtcgtatgctgataggaacagggtgttccaacgcctagaatgcgcattcatggggatgctggttggcggtctcaggttgcagggtcctcgacctgcgcaccaacgcctgccccgtctcacatgccgacacgctccattgacttctgctccagcccaagtatcttctcccttacccttctatttccacagactgtgcgagacaagtgctttggcacctgcgtgaccaagccgtccagcagcttgagcagcagcgagcagcagtgcttggcacggtgttgtgaccgatacgctgaggtggggagcaccggctggctgttctgtcgaggctttcagcgctcaggtctgattgcatgtgaaggtggcctggcatccatgtcgacatgagcagtaacttctctttcctcacaacccatcttcacgcaggccacccaggtcgtcaccaaggctaccctggagatgaatggctaccagtgatcctttgctgtttttgatgaaagaatgtgtagcaaggtgaaaaatggtttggaaaagcatttaggaaggggcagccggggatgagaatggccgcaaagggctgtaggttgatgctgtgggagttcgcagccagtcctgggaatgcactggagtaggatacgagtggtgctcctctgcggcgcaagctccgtgaggaggggcttccaggcgagtgctcagacgccccccagtctgtaagcccttcccacttgcgccgcatggctcctggatcccagctgggggtactatcctgccttgggcttttttatgtacccccccagcggcctcttggcaggcctcccgacagcccgcgggtagccggtcggcgtgggccccagcttgcgcaccgtcagcgcggtacgccggccctgctgccccgcgcagaccacatcctccaccccgatcagctgggcgccgaggagctccagggcgggccccgcggccgcgacctccccctccggcgcgggccccttggcggccacccacaccccgcccggcgccaggaaggggaggcacagctccgcgagcacgcgcatctccgccactgcgcgcgccgtgaccacctggaaagcgtcgcgcagggccgggtcgcgccctgccgcctcggcgttggcgcacacgacgcgcacgccggccgcgcccgcggcctcggccgcagcgcccaggaacctggtgcgtttggccagcgagtccagcagggtcacgcgccaggcgggccgcgcgatggccaggaccaggcccgggaagccggccccggagcccacatccatcagagtcagcgggccggagctgggggggcagggaggggcatgcgcctcgatgatgggcagcagggccaggctgtccacaacgtggcgctgcagcgcctcctcgcgcgtgcacgggcctggaaatgtttgtttgggggggaagatttgggggacggagaggggtgggggggtgaggaacaatgccccagccctatgtattgcaagggctgagacctggcttgcttgtgcagccacagcacaggggacgcagaccatttgccttctcttcaccccccatgaagccacgccgacctgtgaggttcatgttctggttccattccatgaggatgtccaggtatgcatcgagctgtgccctctgaccgctgtcgagctgctggagcagggggttcatgggggccggctccgcgaccgacacgtcgaccgagaagggtcgttttggtccacgccatattcgctgcgctggcacaaagcctcggcgaatgcgcatgattggcctggccgcgagccccatgcacccggccatggccgggtgagtgctaacgctcagaccggcaatctcgcccagtgacgtctgatttgtatgttccagtcacagcttccgttgaaatatattacatggacggtcagggtggcaatgcatcatatatgaggtgcacgattgactccctcgcgccctggcgagttgaccccccggatgacatcctgagcaggaggaagtcagagaccagttccgtgagggaacatgtaatctgggatcccgctgcggacccaccctgcatcctgtggtggccatatctgcggaatgtactcgaggccaaggtcaggagctgggtgttgagatactactggagcagacgccggcagcaatgattgaaaccttcgcttgaccaccaaattgccggatgcaagaaccgaccaggcccacagcctcaaggacaccccaccaatctaggtcagcatgtacctccaccccccagcttgccttcaggaaaaccctgccctgtagcagggcatatggcacagggccatacgtgcgcgagtctgtgctgttgtggaagttgtcaccctggagccagacatggcccttgggcaccaccgccaccctgcgccccgtggtcgaccccggcagggggactacatcgccctccaggcccagcactcgcttgatgacgatgtgccgcacattttgcacgctgcgcgccaccaccacgtcccccaccttgatgctgcgtgtggccaccgagacgcgctccagcagagccacgtcgccatgggtgttgaaggtggggctcatgctgagtccaatgggctgcagggaggcaggggccccagcgtgtgggggttccattggtgcaagggagttggggcatgggccaagagcgcacccgtcaccgtctggtgtccccgatgccgtgcgccccaaccatcaacgcacgcagtactgtttctaattctacgtctacctaccactgtgaactccgcgacgtagttgcggaagacgtggatggcagccgcggccttggcgaaccagatggcacgctcaagcagtgagcgtagggagcgggtggaccgtccgtgggcccatcccgccccagccgacatgcatgcaccgtcgaagtagtcacgttattgcatgagccgaggaatgtggtacctcgaacaagcaggtgcggtgctctgtaatgaagaggcccggggtatcgatctacagatcgcacccgtcctttcaggatgattccagcctctgatgataatgcaaattttgttttacgtttcagtgagtgatgtcaagcgatggaggtgggtcacgaaggtcactcgtcacaacatcagcgcgcgcgcagggttgtgctgctggcggacggcctggagcgggtcacgggcggctctgcacctccccaggctacacattgggggcactgtgcctcaatacactgcagccctcacctctggcacacccatctcctggctgaggcaggatgggtggatcgccgtgccctcctggtcgcagacgccgcccagcctgaggagggccggcagggcgtcgggcgcaaacttgcgcccgaacagcatgcaccgatccggcatgggctggtaccccggcggactggggtcgccgtcggagtggtgcagctcccgcgggagccccagccccgcccacgagcccctggcgcggtgctgcgccgccgccgaggcgagggcggccgcgacggggcactccctcgtctcccacacgccccgcctcatcacccggagcagctcggggccgacgtccctggcgcggtagaccttggggctccagccgcccgccgcccagtgagtgaaggtcagcgaaccctcgcagctcgtctgcgggaggtgtgaggggtgcgcctgggcctccgaggtggcgggaaccctgcgatgtcggcgggcccgcaccagccacccagatccacggcggttccggcccctcagcccgaggacaccctgccacccggcacgcggcgccgacctcgttctgcagaccggcgacggccagcagggttgggaagtagtgctcgtcggagacgcaggagcgccgggccgatgcgctgcgccccacggcgcgcatgtaggggggcagcgggaggccccccccgggctcatagctgtagcactcctgctcaaacagccgccacagggagtcgtccctcctcacgacctgcgccgggtgcgactcggtgcaaggggaattgaggacgttgcagatgccttgatgatgccccgtgatcatcaggggcacctactcactccccaccgccccaggcatggcctactggctgggcgcatgccaccaccaggccctccatatccagcagagcatccactgaggcccccccacccctgcgtcgcaagggctcacctcggcatgagacttggtgaggctcaaccactgggaggacttccgccaatggaccttggtcagcagaccctctctgtggaggtatggaccccatctgaggccggtgtggggagggatcgggtgacgagtgtggggcacgtggaatcagggcgcccagagagcgttcagtgcgcacatgagcccgcgctctcgagtcctgggaaccatgcagggcaccccgtcccaatccccgtcaaccatcaggctcgttcacgctgaaaagaacaccgtctcatgaccctctgtctcacagaaaagcctctgcctcagcaagcccccaccgccaagcttgcctttctgctgctttcccatgctgagggcacagcgaaacccggctcagccggtcagccagcagctgcgcatgcaccactgcggggggaaagagcggcgcgcaggactcggacaggaatgcaaagcgctggttcctcgggtcgcgcagggcagcgatgatgagccgccgcatggcctcggcctgaggggggagcgggtggacgtgggacctgggtgcatgctgcgcaatgccccagccccgaccgtttcattggcagtagacaatcttccctgcattaaacagtcacaccccactgaagctcatgtgatgcgtgccatggtgtacgcaaacccacgccagaggtcccgaaatcctcgccctcccgccctacgcagacacatcacccgacacgatccctctccccacgccaacgcaccgccgagtattgaccccagcgaacaaacacgcgtctgtcgatctgcgtcccagcaaaaacagagtctgcggagggaggggtaggagacctgtgagcatggcaggacaaacgtccaccactccctcccagctgggcgtaatgtcactcggatcttggctcctcacttcccctgccacacagagcctgtgcacgcatgcatcgtcaggctccagtccggccccaccctgtacctggggggaaggcaaaggcggcgcgggtgtgggtgtggacggagaacaggtcctggcgcgcgacggggccctgcggatccagggggctcagcgccgagaatggggcctccaggctgccagaggccagctcgttgtgcgtgtcgtggacttccgctgccttatcgctggaaagcatggcctgtgtgtctgggagacggaggaggccggtgctttcatccaggagggctcgcaagtcctgtgggagggcagcctcgcgggccgtcctctgcccagcagagcggccgccggggtggggggaggcccgtgggatgcgatcgatcgaggaaggtgcgctgtccttgcctctggcgtggcgtcggcccccgccatcctcccaggtcttcctgcctaggctgggcccgggcgactgccgcagcagcgcggcatgctcaaagaactccttccagaccggctccataggcagactgccccgtgaaaggaagagcagggccaccttgtgcggggggtgctggatgtgatcccccccctgtccgtgcctgggcaccggcgtgaaggcggcgcccagggaggcccaggcgatgtagctgacgagcagtgctgcggaggtaaagtacgccaccgtggtggggcgcagcctcttgcccagtgccagccctcggcggcgccaagctttcgcaggctcggcagaatgcgggcggaggcacggcccgacaccaccctgtggaagggtgcgggctggacgggtctatacggccccctgcatgcccctgggccatgccacgatgcaccgactcacatcgacgggtttgagccgggcaagcatggatcacgcaggcgctcgttccatcctgaatgtccaggcgtccttcaaaccgatacagggagcctcagccgggctgggcagtcggggcgacacatttgtcgttcgtgaccaagcgtgtatgctattgacatcatacttcatgcaccatggtctgaaggacgaacagctgtgacaacagattccatcgctcttccatctcagctccgaattatttcgtgaacgacatccggatctcaatctcgcagcgctttggcaatctcccaagctcgatccgcgcatctgaatgcactcaccacaccaagtatacaaacacagatcgatatgatggaagaatatagtcgtacgcaatttttactcaagatactcaagcagcaagagagccacctcgcacactgatgagagacagaacaagcccattcgacattatcgcgacatcccccaatgtgattgccttttaactcagaggaacgcaaagggatgacttatgctcgatcgatgcagcgcatgcctttggtgacgcgatccggcgccacctcctcctccggggccaccggggatcgaggtgcctcgggttggtggctcaacgacaagatccgggcgcatccccccccccccccccccccccctctnnnnnnnnnnnnnnnnnnnnnnnnnnnnnnnnnnnnnnncagatcttgcaggaattacattgcataatgctttcctgaggacgatcagagatgggacgagctggcacagcgggcaggacccctcgcggggttatagatttttccaaggccaaggaccaggtaggtaggtcttaggggactcgccgcatgacattctgcctttgaaaattcgctaagaagtgcccgtacacctcgttccgcccagcaggatcggttcgaggtgcccaaaggatgcatgacggtgtcgaagtcaggtgggtccctcggcatccgggatctggccaagggtcctcggcctggagggcctgaccaatgtcgagcacacgggcagctccccacgatccggacgggatcgaactgaatcattccaaatgttggtcacaggaactctgttgcacgggctgccagccaaaccatgcctccggctggacaggtgggcagggcctgcggtggttgggcggtggttgggcgaatgtgcctgtgtctcattcgcatcgccccttccctgcccggtgccgggccccgctctcacctccaaccactgcgtggtcacctttgccgctctcctcccctgccttcctccagtgcacactcgatgctggaatcatcctggacgataggctcgggtgcgccctccggcccggtccccgatccgtcccgggtccagcaccgcgccgcccgccagctccagtatgcggccgccattgcctcgagggaggtcaaggagggtctctctgcacgagcggtgagcgcgcctgcccagctgcctgcagtgtggggccactggggcatcacctgcccggactgggcgtcaggttcgccatgtcagcacatgctggcacttgacgggggctggaactggccaacactcacccccccaccctggtctccatgccttccaggagcggggcaaggcgcgatgccaaaacacccagttccggaaacaccttggttccagcgtgggagagcatctgcggtggggcgggtctgtcgccgggtccgtcgaggtcactcccagacctgcggcagcatcgaagccggtgggtgcgacgcgtgtggccctgggttgatgggctgggccgaggcagggccctgtgtctgttccagccatctgagggtagatgggcacagggggttgtggcctgactgctggagtcgcggcccagacccaagaggcctctggcatctgaatttgcaacccgcaggcagccgtgggcccctggatcccagctcaacaacccctttccctcccccgcatgcagctgcaccagccgccaggtcagcagctgacgtcctgggacatgtctcgccaggcctgctgcccgacccgcacgccgcgattcgccgcccgcgcagcggcagagcagcaacgggccgccgcccccgacaggtgagccataattgaccccggcgggggcagagggcatgtttgcaggagagcagggtgggatgtgcgtcgccgacgatcagccgaggagtcgacttgatccgtctgggggagcgctccgcgcctcagggctgcctggatgccctcgcgactgtcggctgtaccccaagcagcttccccagcttcttcccaccctccctccctgtgcagggatgcaatccgcaacaggagactgactgagcttcactcggcccgaagtgctgcctcggccgtgaggcttgtccgggaggagtgcctggcaaacgcatggccgcatggtctgccagtgagtcgggagtcaaacatcgggagaagagtggggagtaggtgtttgggagtatcggctccgcaccaaccctcaagcgcttgagctctgagtacgggaagggaaagcccggtcagtgggactcgtcctcatgcccaccagctacaatccttgtcacggcccatcaccaggggttctgctgggcacagacgctgcacgacctgtggtgcttgtctgaccagtcctggcccaaagcttcgggacggttgcctccctgcaagaccccaactcccacaccctggtccctccacgccacagaagggggacctgagccgcgcccgctccgagggcctgcgggtggtgggactgggctgcggccagccctgggccatgcccgaggctcagtaccgtgccttgaggccgggcatgaagatgtgaggcctgactgcgaccggtggactctgtgggcagcccggccccagcacgaaactcctctgcgagcagactgcatgctgttgatgactacctgcaatcctttgcgacagtgcatgcacaggaactgcctgtatgcgctgcctgaaccctctgtaaaaactccttcttgcagcaacaatgctctgtgcagataggagcaattggctcaagagaatgtacgcatgtgtccctctgtggattgtgcagactcgattattagctgttgctgtgctttaaatctctggcaaaccatctgtcgcctcgacatgccatgtgcaagtcttcactctgctcgggatcaatccacactgggaatcgggggcctgcacagcttgctggaaggtacagttgtgtacaccagcaatacccttgatatgtagtaactctgcggctgtaaagtgcaggctgcggggtgccagcaatgtgtgtcacaatctcaactacagcaatcgctggggtgtctgcaggccacattttcaagccgcctggaccagggccatgtccagcaaaatcgagcaggctgcaccttgggccgtccagcgccgttaatggcaaaggtcttggcttcgcggcaaggattctgcctttgagaagcagcgatcaaaccgctttcctgtgcaagatgcagtgctctgccgaccgacggccgagccgtcccaatcactccctaccttcacacgggcctggtgagaagtgcccctgtgccgcgagactctgtaagctggggagcctcccggacgacactcccagggatggcaaaaactacttgtcgttgccgtcctcacacacctcccactcttcttggttgcctcagtcagcctcgctgcctgtgggggaggagggggccccagtgctcctgggagtgcaacgctggacactgcctctccgctggaggctacaaaggacagccgccacgccaacccccagacataaagcgaggacagctctccagtcaacacacaggacacccccccgccgttgccaggagaccaacccagggtgtgcggggaaggggagaacaggagaggccccccggtgagcgccggtcccgcatgccgcccagttgaccccgccgcgtctcctcggcccggggtcaaccctgcggtgcccggccatccagcacgatccccacggtggccgccagggccgccacgtcctcgccggccacctcgcccggcccccggctcctgaccaggcccagtcgctgggtccagagccggcggctgtgcggatgcaggcacagggctactgccgacagctccagggcggccaggctggagcagaggtcggccagcttcacggccgagtcccaaagggacgggggagcgggcgggtggcaggacagcagcgccatggcgagcgtgtgcaggtgccaggacgcgcggcggtcgcgccagacggcaggcccctgtcgctgcagagcatcggccatcgccttgagcggtggaggccgaggggtttggggtggattttggtgggggtctggaacctattccggcggccttcacaacagtattgatcgatcgtcgaaggccagggatgtgggtccctgactttgcgcaacctgcgcccccccgcatattttgagggcccccccccacccccccaccccaaacccacacaccttctttgcggcccccaggatcaacgccgcctggtcgggcactatggtgggaaccagggcgcaggcggcgggtgcatgaccgccgcctccatccctcaccagctcctccatcagctgcgtgcggctggcctcgggcaggccgccaaacatactggacagcgccgcgccggcgtctgcactcagtctgggcctgagcgagcccatctggccgctggcccctgccaggtgcggggggaggggtggcccgggtgcctccgacggccagcacgccggcgcatccagcacccgctcccctgcagtcagggcgcgctgggcgcccctcagtgcggcaccgcccccgctcggccgcccgtgcaacctgagcagccagcaggcggcctcctcctgggcggccagcacgccgcttggcgaggcggacgcggcaggggagcgcggctcctccgcgtcgtcctgagtagcagagtgggagtgcctgcctgccagcaggcagtgcaggcagcccgccacgcccaggtacagggcctgatgggcagaggttccccggctctgccccggcttgggggggctgtctggaatccctcccacgccatcccggcccacccagtccagcagctggtgcagggccggggtcagactggctcccaggagcagcctcgcgacgccctcgctctgcacgcccccggatgcaccgtcggcagccttcccgcgcaaggtccggggcccctcggcggcttcgggcgtggcagccgccacagccgccgcgaccgctgcaggcccctcccacgccgccctccacctgtccgccgcccgggcggccaggtcgggctccgcctccaccgccagcgccgtcagcgcggctgccgcacacagtggatccagtagcccagaccacagtgccagcagcatggggttgctggcgccgggaatgccggcgtcaccggccgtcgggtgcgccaccgaggtcacgcaggccagcgtggtcagccagatcagcgcgtccggcgggccagaggctccatcttgtccgtgggtgggggtgggtgggggtgtggcttgggagagggtggggcgattcaaactgggcatccccactgcgcatcacaagagggcgcgcgtgctgagcccccgagactgcgctgcgccgccgtgtcctcccccggagttgccccttgggatttggttgacatccaggcccagcctggaccgcagccacgagcccctcccccctgtccccctcacctttgcgccgacatgcccagttcatccagagctcgcccgccctcccgagcacggcctccgccgcccgcgcggcgatcggcgcctcggggacgctcgccgccgggtgcgagaccctgtgccgccagatgtaggccgaggctgagggcggcggcagcagcaggcgccagctgctgaccatcgcaccggccagtttctggtcgcgggtgagcacggccagggataggcaggccgatagcagcccgctacgtgccttgatgcctggcacctgcatgcactcccgataccgcttcttccgatactcctgccgtgttaggggggggccggggtggggggggggttgaagaggcaatggagggagcgcacggcatcacgtcgaccaggggctaacaagggacctttggcttcgtggcaccggccgaagcccctccaggctgccacacccatcccacacccgggcgcacatccgtggctatggcaaggtggcgcagggcgccgctcgccagcaggaacgcatcctttgtcagctgccctgcagcccagcacacattggggacggcaggctcccgacccagtccctgctcgatgctctgatggaggggaatggaatggggaggggtggcgggtgactatctccatgctctcaggaagaggcaacggagtggggagctgtgcgacccaaacaaaccagtggcaggggcatgccaggacatggagataagttgccccatgcttccatgcccctgccgggagatcagtacacagcgcccgcctctgcgcctcgcggcacccagcactcaccgcaggcacggcggcgttgcccgccagggacgccagggtcaaccacagcgtggccctcaggtccaggaactcggccagcccctcctccaggcagcgcagggtgaggctggccggcttccagcactcccagcgatgtgcgggcgccgtgcctcgcttccccgtgcccttcttccgctcgctgaggtccagcgggggagggaaccagccacgcagcgcctgcagctgctccgggcgctggcaggcactgctgactctgcacagcatgcgcagcgcgaggtctgcggcggcgctcgcccgcgcccactcgacgcgaggcccccgacccgggccgggtccggccccgtcggcggggcctgggagcagagcgcagacgcccttggccagcacccacagcgtgtcctgcagggtgcgctggcgctgactcagcgcgacgaaagccgcgtgggagggcggcacccgccccagcccgtccatgtgcagctgggcctctgcgtggccagaggaagggatggggactgggggaaggctgggcagcaggacagctcgcacggacgcccctgctgcgggtgcaggggtgaggctccctgcgacacaccaccgagcgacactcccctctcagaacagcatcccggccccacctgcgctcaggatgaggggcaaatccgggcagaggtgcaggtacaggggccaaagcagtgccgcggccgggcactgcgtgatgccgcaacgcagcacggccagcgcggcgtcgcgggcggcgggcgtcagccaggcctcggtctcggacccgcccgagtggtggtgcgccgcctgcgtcacggcgcgcgccccgccgctcactcccaggcatgcgagcgccgccgacaggaaggctgcctcgcagggccctgcgcggacctggccctcctccagtcgctccaattcctcaccccttggccctccagccttggtggcggcgggggtccccggggtcccggccaactcgccccagtcctgggcgcagcatgcgacccaggccagcacctcctcctcagaggccgagggtcgcggaaggggggtggctcgggcagcagcccccgccgcggcccccaactccccgctttcgctcgtcgagcccacagagaagtagcgggccgaggtgcctctggcagcggagatgcctggcagccccgccccaggcccggcgtgggacccgacggcgcctgcctctgcaccgcccgtgccctgcacgtcgctcggcaggggcccctcccccgccgaaaaaattctcctgggcgcaccggggacgagcttgtacggcaggggcagaggccaccgccagcccagcggcgctactgctgagaggaggggcgccgtgaacaggggcccccgccccggccgcgccccgcccagcgccgcgccgcgccggtagaccggcaccggctcctccagcgcaacctgcttgatgacggagggcggcgcgcggacggcgccccctgcagtcgccaggtcgcgccgcatgcagtacctgggcatgaagggggtggaagcaggggggtggtgtgttcaatcatgtgggagcctcgctgaaacctgcccttgagtcacattcagaccactggaggcacaccaccaggcgcgtcgcgcggtgtacgatgttcaggctggagcgcccagggaccccagagccatgggcctgtcggcgggtgcgcgctcccgcaagcctgctggtcttctggacaccccccgcacccagcctggccctacgagacatcaggaccccaccccccctcaccggcagttaggatcgtggcagttgccgcgcaggtcgaagacgcaaagtggccactctgggtcgacgccggccgggcccctcccggcaccagcagcagggggggtgcccgagcctgcagcgccggcatggctcggagctgggcccatgttgtcggcggctgcagggccagggacaccccatgcaccgaccccaggacctctgggccctgcgtcattcggccggctccgttccaccgcggcgtgcgccgcggccagcaggcagccgttgctcgcgaggaacgcggggacggccttggaaacccgccacggtggggtccggaccctggccatcgcctccaggaggcgcgctggtgattccgtcacggtctcttgctgctgcggtgccagcccgggcacgctactcccaggggtttgcggagcagggccgggtctgcccgccgccgactccccggccccgccgagcgcctgcacccctgagtgccctggaccccactgcgccgtcggcgcatggggacgaggtgcgggggccgggtccacggcgatgggggtcacgttggcgccaggcgcggcctccagttcccgcgcacgctcgacgcctgagcctgctccagcgaggcgcttggaggcagccgtcggagctgccgccgcgacctgagcagcggccgccgcgcgggcaccggcttcagtggccggcgaaggaaagggcgcagccgccagcggcatggcgagcgtctgaggtggcggccccgccggcacggcgggcgtgccctcggccgggcgagcctgctccgctcctgccccgcgctcaggggcagccccggctgcgcccggcaccgcggtcacctggtgcaggccgcctaccttgccgatcttgaaagtgcccgcacgggcatgtgcctgaggcagggggagcttggtggaggggtgttcaggggacagccatggaaggctttcctgcttgggcagcaatttcttcgcaggtcgccccgagcccgccggtctccctgccgtccccgcggtcatcccagcccagacagcgccacggccccaccccgcagccccgccactcacccacacgatctggccgatggggtgcttgctgcggtcccagcaggccagctggggggagcgctgcatgcgcgccacgaccaggcggaccgggaagggggtcgcactggcggcagcctcggcacgcaccgcgtccctgaagatggcgttcagctgtgccggcaggtcctgcaccaacaaccttggccggcccgcagcagcctcgccgcgccgctccgtcggcgcggcgccggaggggggccctgccggggcactcggtcgatcctcgtgcaccgagcgcggcgcacgggctgccagggtcgtggcggagggcgccggcacgggcgccggcggcgcccggcccgacccccagatgaaggcnnnnnnnnnnnnnnnnnnnnnnnnnnnnnnnnnnnnnnnnnnnnnnnnnnnnnnnnnnnnnnnnnggcgagtgggcgactgtcggcacgtaggagtgcatgttaccgtaggccccagccgccgtccctgcacgctgccaggcggcggcggcggcggcggcggccctcccctcgtgcattacgggtgatgggcgatgccccgtccagcgaccatcccgaggcgcggtcggtgggggtggcggccgggggcggggaggggtcgaccccggcggcattggcaccggcccctgtatcgcagcgggggccgcggcgggctgcaagacctcgccctcctctagctcggaggccccgtcgccgccgccggccgagaggtccagggtggccgccagggaggggctggtacgcaagacgagggcggcgacgggctcagccagcctcatgggcatggccccaggggcatcggcgagcggtgccccaagcacgtcggcgatggacgccccggccacgtcggcgctggagatcgacatgtccaccgacggcagcgcggggcccgggctgacctctgccgactcctctgtggcagaccttggcgcacggtcagccccattgctgtcgtcggctagcaccacgatggccggctcctcgcagccactctcggcggcaaccccagcggcaccagccagcgcgcgagcatgtggcgtggccccgccttcgccggctgatcgcgccacggccgcgccgcgggtcgaggagacggccgacacgacgctggagcaggggcgggcgcgtgggctggccagccgcgcagcaggtgacggcgtgcggctgcgtgacctggcagcacgccggccatcctggccggtccctgccggcgctggcgccggcagggacccacgctcggcgcccatttcgcgcatcgcgcgcatcgcgcgcacgtgcagggtggccagccgtccctcgcggtacgaggccaccgagtctggtggcggccacgaagggggcagagcggctgcaagtgggtcggcagggggcgtcgacgtcgagttgggggggagtggggtgcggggacagcctgggaaagggcgagggcgtcaacctgcttgacgatcaacgtgccagacagtcgatccaggcaggggtcacagcctgcactgtgctgcccggatactggcttgcagcatgccaagcacactcgagcctggccaaagaaatccagagggcataagccaaaacatccccgcacagtaaaagactgccgtgatcatacccagcccaccttggaccgcatccgcgcccgacattccatcgcgctggaggcccgccaactcagcatccgtgcagcgcagcagctcctcgaggacggcgcggcggagaagagcgcgctgccgcaggctggctcgctcgaactcggaagcgacgcgcagccgggctgcctcctgcagggtgagcatgcacaggtaggttaggtttcagaagggactgcagcaacggatgcccacagcatgcaaggttaagggacaaacaaagcaatcttggtattccctggcctgccaggcgccacgcaagcatgccaggtgctggaccgccaatgtgcggatgcacaggccaccgtctctgattcatgagacccccaaacccacagcagccaccacagcacaacctgtcacagcaacgcgcacctccgcctcgacgaccccttcgctcagcgctgcaggcaccgttgctcgatgaccctccgtcacgagcgcctcggcctccggcatcgctcctgcactacctcccgcggcccccctggtcaagcgtgacagggctatttcaggtggcagctcctgggacctcatggacaagggcatggagggcggcaccaccggccccagcgggcgcgtggacagcactccccgcggggccggcgaagggagggtcaacctcggccttgtctccggggctggggagtggctggcctgggcatcaagcgctcccgccggcggctgtgtgccgccgcccacgaaagtcggtggccgtgcggcaggcggtgagctgccggggccatccgtcagggcggtcacgatgccccaggcacagacctctgcgctcaagtcgccaggtccctccggtcgtggcgtctcgcagctgtcgagctcggcacccgcccgcgtccgaggcccaacgccggcgccctcgctgcccgtgcgccctgggtacaatggcccagaacgccgcccgccaccctcgctccttctcctcagcgttcggcgtgccggtggggacggagatctcctccttagccgggggggcgagcgagacgctgggctccaactcctccgccttgcaggcgagcgagatgccgacctcgtactcctgctgtcaagggagttgcccggcccggcccaaggatctggcgtgctccccctcttccggcgtgaggagtctctggtgacacgatgatctcttccgcgaccgcccaggatgagggccccgtcgctacgctgcgagacattcgccctgggccgcgctcgttgaggaggcaggtagccctgagaccgcactctcccgaggactgcattggcaggctcgcgggtgggctggcagtcaggttcggttgccgccaaagcctgggcctggcagtcagattcactcagccctgcgccggtccgtcttctctccggcggctcggtaggtaagcgcgagggctgattggggccttgaaaacgaggtgcgctccaaggtggggccgggccactctcgtcggccccggcctgcgcggaactgtccggaagtcgctgaccggggcccctggagggccacccaccgctggccgggcgaacgtcgggcgacgacgcaaacggcctcgctccaggctcgccaggacttgcccgtgcacggttgggcagcgccgccgcctcgccggcttctgtgctgcctcccgcctcttcctcccgctgttgcatgcctggagcctcctgctgcgcgggtcgaagcacaggctccccctgcgcctgcaggtcggcgctcccaagctgatgctgatgctgcgtcgaggcgtcgctgcccaaatcaaagatacagcacggctgcggggccggcagggcacctacgacgcctcctccggcgggcatggcgctcttctcaagcctgcgccccaaagggatccctccaatggttcttgagaccagtccagacctggtcgggcctgtcggaggaaagacttgctctcctgctgccacgctcacccctgaagcggcgaagggaatgctgtctgggtcgccgtgcgcttggctctcgccgtccacgccgccgaggatgcagtcgacgcgcgcagctccatccaccgcatcggcgcccgggacaatcgtgccacgcgccagaccgccagcaggtactgcagggagcgagcgacccacggctgccgctgatacaagcacatggctaggctgctcaagagcggcaatgctcaggaatgggccggcggcggcggcccccgatccgatgagtgtgggcctccccttgttggcgtgcgcgacagtgactgggacagacggcgcgcttgactgagcaatgggacctggcgctcccgactttgcaggtctcgttgctgggccatgcgctgtggaaaaggccgccaacgccaacagtcccgacgccgggcctccaccagaagtgccagctggctctgcagccaccgagcccgcgatccctgaccggggcgcatgcgccacctctccgctgccagctttgggcggtgaggcgatggcggtggaaagggagccatggggcccagtcgcggccagcactgagccagcactcgtggtgcaaccagcagccacgccctccctgtctgacggccggagagcagcttcggcagcgcccgccgtctcggtcatggactggcgcgcacaaggcgcggtagtcatcggcagcgacgccccgctcagagtcctcgcccgcggctgactcggaccggccccgcagttcccaactttagggacaaggcctgcgccggcggcagcagggctggtgccagccccgctggtgtgcgcaggctggagctgcaagggtggcttggcagacctgagcggcggcctgcgcgcctgcggcacctcgccagactcgaatgaggaggtgggagacggggtgccgaccctgatcgaggcagcgagccccagtgcggtctgaggacctgcgacgcccagtcctgcatttgaatgggctgctgtagagcgggcagcggctgcaatggagcaggcagcggctgcagttgaccgaggcccggctcctgaggggtcgactccaggctgcgcattgtatggggtccgaaggcagggatgaagatgaggctgtgttctgagcatcgtgacaccaagcagcttgataatgtgtgacataagcacatgcaacagagtggcaaacaatgcagaagctcccccagcctgcagggtcgcaggcgtggcaccccatactgagcggctggagggccctcacctctccagctttgccctctatctgagcacggagggcagatattttggcttgcagtgcagtatagtccttgatcgagggcacgggatgggagcgcccgtgctgaccccgtttggcccgactgccccctggaatggtcggctttgcaccttgactggggacttctgcaccaaggagaatggcaatggttggagctcgaactgagcacacggtaccctagggatctagcaatcgcccttggcacaaacatctcgcctaccttcgtcctccgcgtcgaaatcgatgatgaggcgtccctccatggtaggccaggcccgccgctgggcaggcacctatggcaccgcataccaggtcgtcatgattggaacgcaatgatatattctacgatcaacaagagtagaaaccttatcggagcctgtttccagaaggtaggaatgaatatctttcgaggctcccgcagtgttgtgacatgcatatcacgcatgacgcgcctgtgtggcggtcactgtatcaatcccatgtgcaatgtcctcatgcgacccctttcgatagcggtacttgatggggctggcgctgaatatgcatcacagagctgtctaaggtccattgctgtgtcggtcggcctcctgattaccctttgctgtccaacaagatgacatgcaggacatacctaggcatgtcctccagcagaggtggtgcacgtcatcatctctccagcaaatggttgatgaccttcgctgactcattcttgatcggttggcactcgaaatagctcatgtcatgctgctggcagggggtcgaaacaagcttagcagcttggtcctgctgtccatacagaggattaggcagaccgtgttcagaacaattgtcattcgatgacctgctcgtaacgctgtacgtgtattcaaaggaggttggtagggacgtctggctcccgtcagtatggtcgggtgcttagcacatgaacgtccagcaatgtctacaaaaccttgcagctttcttcgctatgtctagcgttacaaacgagagcgagggaagagataaagattagtccaacacgatgaacatataaaagctgctcagtgcatgctgatttggcaaagatgtgtcctagaaggggtaccaccgcggggtaccgctgtctccatctcactgccaccaccaaaaaggttactccccgaccccaggttacaatttggacccggcaggttctttctccctcgcgtattgtacacgtccaaaagagtcccgtagccccccagcatggctgtctccggaacctccagcggtcccttcctcggcgcatcatacagtctgtggaagctggcgaggagcaccggtaagtgcaatgggttgattcaaggcgaaaatcgaatctatattatacagatgcgtacagcgatgtcctgagcgcatcgtgtcactcttccttgtctgcaccatcacctgaacaggtaaggccgcctggatcgcggggactactttcgtcatcctcttcgttcctctcatcatcgagcttgagcgtgaggcccagctggtggagttcgagaccaatcagcttggtgccttgacctccccctccaagtgaaggccaataggacgcccaagccgaacagtagcaacacctggaagtccctgcagccaccccttccttcatctgggaggactagccacacgaccctagatataatggcagaggcagcacgccccgtgctgcaccttttccgcatcatcctgcgggctcaccgggagaagctgccagctcccatgcgggagctgggtgacacttatgttaaggacgagttccgcaaacatcttcgtggcaagacaacccaagagcagtggcggcagttcatggaggagtggaggcgctatgccgggaccctcgcggcgtcagatgggcctcaggcttcgggcggtgtggccgcagctgacgcttcgggcgacatccctccagagatcctggagactctgaccccagaccagcgggcacggctggcaaagctccgcgcggaggcccagcgactccgtgcagacttgctgggggagtcccgctgagtgcaaagctgtagcacttgggcttcgtggcgggagctgaatggctacatggagtgctgacgtgagcggatagttggctagatccgagaagataaccttgcaatgtgccatgtgcttagcccccactggtcttcttgtaacacaaccacccccaagggaagcggggatacagatgcaggaggcagggtcccagatcagccaaacccgggggctcgggggatcctacaaatgtagtgcgttgtgtacgctcggcgagaatttccccgctgcgaatgcctgatgtgtcctatttcgagcattttaatacatcctgtttggctgtccatgccgtatgcattgtatcctgcgggatttccgtgctcggcacaagaggtgcctttccaggacgaggcatgacttgctgacggatcgtcgctcagccctggctgggtggtatcaagctaatcgatccttccccttttcaacactcctcaccctaaaactatcttatacgaggcccttgtctgtggaaaatgccaagtcatcgcaccgaccgcttcttcacgatcgaccgggatcactagctttggggaacggtgctggttatttgtgccagtgcaatacggccctgacacggtggggtgatagtgtacggaggacacacatcgctttcatgatcccgtatctttatccacgatcgccggcacccgtgcggcgtgtggctcggctcctgacggcgagtgtcaatcgcagaaggctgatcttggtttcgtcgcactttccatcggatccgtgccagcgaatctagcggatcaagttggattgcacagcccacccacctcgagtccttcaagttcagtggctgctccagcttccgtcttatactttcattcatcaccatttcatttatctggcattaaacccagtgtacacgccatcatgcagtccgccaccatgacccgctccttcgtgggcaccaacatccgtcaggtcgtccccaaggccggcaaggtcagtgccgggcatcactcgctcgttacatctctgtgcttctcgtctgctgcccatcgcactgccgggcaatgtgctgcaccccgcgccttgcgcgatcatgtcggtccgaggcagggttgattcaacatctgctgaagattgtgtctcgatcgtaccatatctcacctttccgcacgcgtcgaccacccgcagggcccccgccaggtgacccgcgctgccgtggagttctacggacccagtgagtcgcggatgctgagtttgttccgggataccctcctccgatcatgaggaggtcgtagtgcacctcctgattactgttcatctgtcctgcatctgtttgtacctcacattgggggtcgagcagtccactgctgggccagcacatgtctgtccttgtgaatgaataagtgcctcatccagggcatgtgtgaagccctctccaatggagccatgtactcatcaggcccccttccacctcctgcagaccgcgccaagttcctgggccccttctctgagggtgtcaccccctcttacctcaagggtaagagtatttccccctaagcgcctaaatattgagcagtcatgaatcgccttctggagtcgccatctgcacggcacccactccacatccccccttccacctcaggcgagtaccctggcgactacggctgggacaccgccggtctgtccgccgacccccagacctttgcccgctacagggacatcgagctgatccactcccgctgggccctgctgggtacgctgtgctggtggggtttgtgaggctgtatcttgtgagatttacgtgtgtgatacaggtcttgagctggacagccgcttgttagtcctgagacccttcacccttgacccctgtgtcacagagacaagcctcgtgccgctcacactcccactctcctccacgctctccaggagccctcggcatcctcgtccctgagctgctgcagcgcaacggcgccgtcgccttccccggcgacacctccgtctggttcaaggctggctccggcatcttcggctccgacggcctgaactacctgggcaacccctccctggtgcacgcccagtccatcgtggccaccctggccgcccaggtggtgctcatgggaggcgcggaggcctaccgctccggcggcggcgagtccatcggcctggaccttgacaagcagtaccccggcggccccttcgaccccctgggcctggccgacgaccccaacgcctttgacgagctcaaggtgaaggagctgaagaacgggcgcctcgccatgttcgccaacttcggcttcttcgtccaggccatcgtcaccggcnnnnnnnnnnacaacaacggcttcgccgccgccaccaacttcacccccagtgagtgtcagggattgattgttcgggaccgtggcctgggctcagtctatatgaatgtagtgcgctgcacccgacaccacacctcagttcgtcacacctccccaccacacacaaccgcaggcggttaagaaggttttgctctcttcctttgcgtctccattcaagatgctctgctcgctcactgatcgccctgtgaagatatcaggcgggtggccagccaggcagccagagtcggtttgatccagctgtgcattcttccttggttcccattggtcctccccgtgagctttggggtgatggcagttttgcgtagcttcaattttgtgtaagaacgatgaggcccataatggttgggaggaacgagcacaagggaggagggaagagcactgagaatacatatggtagtcgagagaacaagccagaaagtacattgatgtgcatggcactggagcttcaacacctatgcctcgcccttgctgccagcccgccgcttctgtttgcgcttgagcttcgcggctcgcttctggagtgccgtcgccagcttgcgcttgggggccggggcaggtacactctccttcacttctgcatcgctatcgtccgacatgcccagcacaacatcgaactcgtgctgcaggttggagaggacagaggtcgtgaggagtctttggcttctggactgatccatcatgtgctggtgtggtcttgcgtgtacctcaagacagaaaatctcgacactcccgcatgccggggacactggtcccaggatcgcatccacacctcacaccgccaggcacctcgtcccgctatcacttgcgtcccttggccttcctcccgcaggaaacacttctaaagactgacctccaagcactccccaactcccccaaaccaacctgggagatctttccccgccgcagcttcttcagcatggtgtactcggtggccaactcctccgcctcatccgccgcctcgagtgcacgccgcttggcggccgtcagccgtgcccccgcccccaccgcctcggtcgcctggcgagcagccgcctggcgggcggcctgctgcgccgcgcggtgggccgccttggcggactcccgcggcccctccgcctcccgcttcttcagcagtgcctgccgctgcttctcccgcgccttgtccttgaacttgactgtggatggtgagggtggggtgggtgcggtgggctgtaatgagttggtggtgggaaatcacaagggcaatgggtgcacatttctgggatcacaacgagtggcagctatcgacacgacactcaggccgcacagcacccacaagatgggatgctctgcacagatgttgtcctcggcagcaatgtctcaagacagctgccaccacgacccaactcaatcccctgcgcatcgccacccgccaacaaaccctgctcactgctgtccacatctatggcggagggctcgaagccggccaacctgattcccgccttcttcacctccggcatgccaggcagcctgagcagcccaaacgcggtcgccagctggcccaaggggacatcctggggagagagttgtgggatgggtgtggccgaacaaattgcagccgcgagctcagtgggcctcggccaggtgcaggctctgtgagctcgaagaagctaccccctggtgctgcgggcctgtgcccagacgactctcccacgccacagatttcttggctgcctggccagcgccgctgttcgcctcccgaccccaacaccctactcagaaacacaccaccctcacccacctgtatcctgaagatgtagcggcagtggtgctccttgtacccgcgcacatacgacacaaaggccttgaccccagcctccatgaaagcgcggtcggcctccgcggcggcccgcagccgcgcgctggtggcggcgccatccgcggccgcggtacctagcaccgccggggtcgcggggcggaggggcaccttgcgcacccctaggaagtccacgtaggaatcctcatgcggcatgagcagcagcagcgcgtcgcctggcatgagaggagaggggggatggacttgatgagtcgtgggtcgggcaagaactcgcactgggagaaatgcggcgagtggtgtatccaggcacgcctcgagtgccggctggaaggaggccttcagcccggcccttccacctgccggcaggaagcgtgatcacacacgcatacactcaccactgccaccaggctccccgccccctcccaccatgtacctgagcggcccatgcgtgcggtccgccccacccggtggatgaaggcggcggggtcctggggcgggtcggcctgcacgatccagtgtacgtcggggatgtccagcccgcgcgccgccacgtcggtgcagagcagcacgccggtggcggcggccgcgtaggcctccagcaccgcctctcgcgccgcctgcttcatgcgaccatgcagcgcgctgacggccaggccgcgcgtgtcgggcagcaggcccagcgccagcagggcgtgatccacgcaggcgcaggtcaggaagtagacgataatcttgctgtcggggtgggcctgtgcgttggcgtggggtgtatgggcgggggggtggggggtgttgcagggaggggcatcaaggagggtgtatagggccacgtgactgaaacacttcaatgatgccacacggcagtgcaatacgtccaatcgcgcagtctgatgctgatcatgaacacgcaacccagctcagcctgaccctgccagccaaccctccccccctcatcaataccctgacctgcagaaagtgggctaggacagcgagcttgtcgacggcctccacaatgtggtagcagatggagagcgtgcccggcgtccgctgctccagctcatccctctggagctccgcttcccagcccgccgcctcggcgacgccctccacatcgggccgcggggcggcggccgcgcgagacaccgcgacgttgacgcgcacggcgttgcgcaggcccgccctcgccagggcctggacggcctcggtctgcgtggcgctgaacaggcctgattttggttggggttggggggtatggaggaggttgaactgcgaaatacagtcgtaggcgacagccttcattgaaatgcaatactgctcggctgtcatgaatctttggcgttcatctccaacattctcccgcgctgacctgtccttcgctggcgggggagggcggagatgatggcgtccagctggaccttgaatcccatgtccagcaggcgatccgcctcgtccagcaccaggatctccactgcacataggaatggaaggaagggggaggatggtgaaaaggcatatcttgtcgctgtctcctggcagaggacggtgctccagaccatgcgcttctcttgggtcatgagcttcagaccctgtggctctgggctctgaatcgagcgacacctcacccgtcttgacctccagccaggcggcgcagcgctggcgtatgtcgtccagccgccctggcgtgccaatcaggacgttgctgccgccgtcgcgcagctgggccacgtcctcggcagggtcgctgcagtgtgtatgtttgggaaggcacgggcgtccagaggggctggcgagcctcgatgtgccgcggcaagtgtatcatggctcctcaccatggcggaccaggcacaagactctgagcagtggtgactccccgcatctggccatgtgaggtattaatgcaccagcagcaataacatgcttgctatcaagcacctctgccacccccgcccccccacacaccttcctccgacaagcagggcggccttcagccagggcaccgatgcgatgaatggttgggcgacgctgtatatctgacgcgcaagctcgcgcgtcggggacaccaccaccgcacccacctgaatgccacgggtgtaagcatcggtggcggtgagggcacagagattgtggtgcagggtatgtgcgagacaatcccggttaaggacagcaaggagcacagcgcaggactgcacacttgccaaccccagggccgctacctcgcgatgcccggcccgccacccacctgatgtatcgtcaggggctcctcgagacgcctcatcttctcgatgagagggatcaggaaggccagagtcttgcccgagccggtgcatgcgtccactgccacgtccttgtggccagcaaaaagaggaatggtggcctcttgcacgggcgtagccgtgcggaatcccagtttgtccaggacggccagcgtctcggaggagattccgcccagttcccggaagtcgcgcccagccatggcactctgtttgcctggcaagctggtgcacagcgacaaatcaggaagctgaatggacggagtgtatggatatcatgttcatagctgagtgccagcgcagcggcgtgggctggactggtcatggtgggaaggccatgcattggcagtctccgtcgcgcccagagtggggcgacaccggtgcgcgcgggccggcgggaagatgctcatgacagcgtgccttcctgccgagtacacaggctacgttcccttcccttgaatcccgtcacaaggcatcggccctcctgcacatgcatagttcatgaagtgatttcctacaagcactgatgcatgctaagtttcggtgatcgccactctgtcctgtgaatccgcacctcggatccttgcagtctagcattacacgagcttatagcttacatgcgctcgtggggtaccatgccgcaatggaaccctcaaattattgcctcggaagggtcggggccggccctgcttgtggcaggagcagctgcgctgacaacggggttgtgcatcgggtacgccgtggggaggaggtctgcccacccacatccgagcaacggccatgcggggtctggccacggccatatgggacggacatggagcgattctagcctctcgagtttgtccccatcggcgccctcctgtgagttgtcatgcgaaacacttgcagcatggcatggacccattgcatactgtgttcttctaggaaagctgcgtagaccaccctcgcgccatgttaccacagctggagccccttccccaatgaagcccggctcttcggcgaggaccctgtctggggagggcggggacatgctgagaatggccgttgtactcaggactgacctgccatcaatggtgagtgatgtgttcaggtgtgtgtggggggggcggcgctgatcaaggctgccagtatttcagttagtttcatttgttgttcaaccttgtccgcacaagagggcagactataagtgatggcgcttgaccaggtgctttgaacttgattcgtctcccgctctcacgtcgtctcgtggcagaatgaggctcacatgaccagaggcgtcgcatggacgatgctgggcatgttcaagaagctgtggaagcgtagggatgaatacttgaaagcatgggtaagtggtctccgtggtcatagacgctgagcagttgatgtgtcagggttgcgcttactaagaatgctgtgccttgtgtgatccagatacccatcggattccttaccctacccctgcacaggacctgcatggacgatccctactagtgcttggagctgccagcgaggaggcactgctgaacgcacaagccgctgctcggtgggctgaggtggtgagatccccttacatttcacaatgcaagtgtgtcatgtgcctcccactgacctctgctccttccccccaacccgcccgaccagacgcatctcgctcccgacgcacacatatgcgggggtgccaggccagccaaaggagcgctctgtgatggtggtgggacccgccagtgagaggctgctccgagagacccttcccgagctccagattctttaagctgggggggtatgtggggaaggtcggtgcctctcccctcaaagcttctgagactatgttgcaagcaggttggccctgtgggtgatgcacaggcgaattccatgccccatcgcctccttgacatgactgtatgacagccagccactgagtactctgtctctacctgttcctggagtgtgactggcacggcgcaaggcattgactgctgtttgaggcacggtgcataaccccatgcatgacgacatgcttcccttgatcactcacccccacacccctcttggacaaagttgccacattctgcaccgcttgaggattgattgttattggtactgcctcatttccacgcccagactgcttctctgccccatgcattgacagcctgcaccgcggactctgcatctaatgctgccagggtggcagggccaggggatccacgggtggtgcccgcatctgcctcaaacgcccaggggtgccgagtttgtagctgctggcgcatagacctgcatccaggagtgtgtgacgaaagcgactgtctctgctgcatgcactgaagcgatgtcaggagcacaggatgaacgacaaccgttcacacgtacttgaggcgcctgtgcaggatgtcaaggtcgccgcgcatgctctgcaggatccgagctcgggtacccagatcctctaccagctctgaaacgactttcggcgatgatccggagtgaagcgcttcttgtatacttcggacctgatcagtcctatcagcagggtgcgagaagaaataggctgatggtgcaagggccagctgaaaccagatgcaaggaatggcatcgagtactcacagtttacgctgtatagcctccatcgctaccgcctgtgcatggtgtgttgcgcccttgccacccattggcacgtctggcgtggggcgggttgaaacaatgaggcccagtgaagaacctgattactggaaaccttcagatgcaacttcactgttgagtccaagattgctgaatctgttccagtctatatgccgagaatgggcccctgtgcttgacttcgctgtcgaaaccctttgcttgccgggacaggctttcggcacagcacagcatgcaccgatcgctttcgcttcttatcttctttctgcgttcgctttgatgcatcactgacgagcagcatgtcgcaacggggacattgacgatctattgatgtttcgttgatgacctgaattgagtctgcaccatgtcgctcgcaatgtgtatgtctgtgagctcaagtataagggcaacacaatctggcagccctgctcgaagcacttcccggcctatgtgagcggggagggagccatatccatccccccacgattcgccatggttgtgtgtcgccctttacccccatccagcccacacggtgtcaaccatcaccttcacatctcgctgcaagcaggactgcagccaccagtggtggctacttccaagggaggctccccctcctgtcgcggagaggtcgctggagtgctgtgcctagggctgccatctgcccggacaatgccagcatcctggtggcgggggagagtgatgtagcactcgaagtcacgcggctcttgcgggaccaaggagcctgggtgtggcatcttcagcaggcagaggacaacaggtgtgcttgcacgaggcagggctgggagcatgggagcaagagttgcagcagcaggtccctcgaattttccgagtcttgctttccatccaacgtctgagcttgtcgctgtaatagatgtatgaaaggagattgagctctggggtcccatgcggtctctccacacttgtgacctcacccagcccccatccatcccagtatccttccccctgctcatgcacagggagcacattgagggaatgggcgccatcgtcgtgaaggccgacgcagccagggcggatcagatagatgcagccatggctggaatcgatggactgcaggcggtggtctcgaccctgggcagcattgctgagcctggcacgtcctctggcggcaccctggtgagtggaccacgaagttgggtgtgcttccacactggtcatggcagctttccttgaagggcagggcgattcaggcttcattgcgacagcatccccatctatcacgcattgtacctgacgcaaggaatggttctgcatctcaaacccaccgattggcactcaatcacctggatctgtgaccgacgcctcacagggcacggttaacctggtcagggcggctgctgggctttctgtcgagaagtttgttctgctgggcgccggggaagcagtggaccacttcaagatctacgatggcctcaattatgtcatcatcgagccgcgcagggaaggccctgcctccgcccaggaggtggcgcagaccctggtgcaggcccttgtgacagatgcagaggacggcaaggtggtgccgtccagtggtgcagcatccagtgcgtgacatgttgactgcccaggaaagggatggagccatgcagccaggagactgacatgtaagacatgtgttccgttgtgctgccgagcaacatgcactcaagacccattgctcctggcacagctgccaggccgagggacacaccggagcgcgcgcctgaacaagcctggaaacgaaagtgcacgactccggtcgcaggaatgacatggtgcgacagacggcacattactccattctaatgcgctcgtaaattatacaatagctcttctgcatccgtagacgccccgagtcctgtcacagccccatttgcagcgctccggcacggcacttccggcgaatggagcgcagcgaggtgacgggcgcttcagggtacagtgaaggcaccacgaccttgttgggcctgtcccgatcttcgaggtcccagagaagtgccctgagctccttgctgcgacggggccttgctggcagcttggcggtagctctgtcgccctggcgcctcctcctcgcctgggcctcctggtggtctggcctcctgctctccgccctctcatacctgggcgcgaccccaaccgggttcctgccctactccaaggtgacatgctgcgatcatgacatcgatgatgggcgagatggggcatcctccagtagtagacaagggcaccggcactgccctcactgacacccagtgcatgttgctgcctgcctccatctacctggcatggctggaacctgcctgttcccttacctgtcagtaccaggagctgggtaacatcgtggagcacatgcactcccgggaggatgccttccgaacgaccatcagggtgagcaggggcaaggatggtgtgcgccagcccacagagtgcggggcaaacccacgtgcatgcatgggaagagcttgtacagctcagccatatggcccctagaccccgcgttccgtggctgtgtgttgacaccccccttgtgtctcctgcatccttgagcaggagttgcaggacaagcttgatgccaacaatcaggacaagcgaaaggccctccgaaaactcaaatctacgctggtgagagtggggaagtgctggacgggggagggggggagcgttcatgcagggctgtatggcgacctgtgtaagggatcaattcaagggcttggctcccatgccccgccatggagtgatggtgacgggggtggggttggtacgtacggtctgagctgtcgagtgccgcatgcttcacgtcactggcatgaagcccgcctgcatggcgctccatgccgtccaggccaaaacttgcacgctcttgcaacagcaatctccttccctacccacagtcggagctggagctgacgcaccagcgatttggtgaaggagggggtgccttcaatgcaaatgcacgcaagcaggggccgcctctcaccggacggccctccagtaaatctggactgcacatctcagcggcagtgcttgccctggctgtctggtggttttactcccaggtgggttgcaggggagggcatgggaaatccttgtccacccagcccaggctctggaagggggatcggtgcctgcgaggcagaagtgagggtcagcttgcttgcccgcaacgataaaagtcccattcccatttcaagctatcttgattccttgcaccaacagcctctacccctcctttccttgttcaggaccaaccagccctgcagaggaaggtggtcttctccgtactcttcccggtgagaagctgttgttgtaagggcttttgcaggctcggcagctgtccatgctcatgccctcgctggtctcggcacctgtgccacatttgtagatcctccttcgtcttgtcgttcgctggcgaccttccttgcaccacccaccctccctcccttgcccccctctttctcctctccagctggcatgggcatacgtcgcggccctgggcagcagacggccgcccatcacgctcctctgctgcgcctgctggttcctgaccgggttcgtggcggcctaccgcctctcggcggcccaacgcaccctcctgtagcggcatgtgatggcgaggatcttcctcgctccccaccattctaccacttgtgtagcatggacggcctccagtgggaccagctcgttcctgatgactatgaaggggatggggagcatgccgccgcgtcgccatgctccagatggggaagagggtgcactggcagggcatggccccaaacaatgtgcctgcgcacactcgttgaagcctgctccatcctcaccacgggcctcgtgttgggcctgcattgcatgccaaaccggcagcgagtcgtagcagtaacctattacatactgcaggagtgcaccgtttacgtaacattgagtggaaggggggtttgaaagtctgagcacgacgttctgacctagagctaaggaacaatgggggacggggctgggcatgcatcggtgatggctgcgggccgcacctgcactaatttcagcaggtgggagtttcggggtcccggcctccaataggctggggctggaacccaaccggagcatgctggtacaaggtggtgcagaggtttgaaggcgtaagcagagtgcagggtggggggtgacggagcaggagagcgtggtactgtgacgcacgaggggatggttcgacgagggcccaggggcgcccaagccactattcttccttggccagcgcggacgcccagcagcgttggaactggccaggccggcgtaggggcctggtcggtggcctttcatgcggcgccccggcctgcaggcctgccccgccccgaccctcgccgcccggccggctcccccgcgccctgcgccgccgcgtcccgcatggcctgggactccctgctgcgcacgctgagctggcgctggatcaccgagcccggggtcgtggcccggctgcccgtgcccgacacctcctgcgccggcgcctcctgcgccgcctgcgtcgccggcccggcccccaccgcgctgccc

SEQ ID NO: 23539 - DNA, 146 bp, Chlorella protothecoides
ctctctccgctactaccactcggacatcccgtggaactatggtctcctgccccagacgtgggaggacccggactacctcaaccctgatgtaaacgccacggtgcgcggcggctctgaagggtgttcacctgaaaagcagacggtgc

SEQ ID NO: 23540 - DNA, 67 bp, Chlorella protothecoides
gacaaggtgggaggacgatggatgtgagaaagggggaaaaaggggctggggagggaagcagggtgga

SEQ ID NO: 23541 - DNA, 75 bp, Chlorella protothecoides
ggagcttcagcggggcagcagtcccagccccaaatgcatgcatgatgaggcaggccgcaaatgaaactcgcccat

SEQ ID NO: 23542 - DNA, 114 bp, Chlorella protothecoides
cctgtcagccattctctcacactttgcgattccgaagaacacattgccacaactattgcaatcctcattgttacttggttgtgatcctgcacccgctccgtcttgcgaaggccc

SEQ ID NO: 23543 - DNA, 77 bp, Chlorella protothecoides
ctaagtcaggaaccatggaactgcagaggtgacttgaacaggctgatatccgagttggatgcaggccttattactca

SEQ ID NO: 23544 - DNA, 103 bp, Chlorella protothecoides
ctttggcaaggtgtgtgcgctatgccttggcgtcatcaacagattgtttttttaaacggcatgccctgctctgcttgccctccctaagggccatcctcactgg

SEQ ID NO: 23545 - DNA, 66 bp, Chlorella protothecoides
gcacgcttgcctggcagggcacctggggtgctgggtgcagggctgcgtgatttgggtgcctcagca

SEQ ID NO: 23546 - DNA, 61 bp, Chlorella protothecoides
ccaaataaagacaatgctctgaaacccaggtattgccgaaaaaattggcaagatcgatggc

SEQ ID NO: 23547 - DNA, 61 bp, Chlorella protothecoides
acgtgaagcgctgctaagcttgctgctccctcagccactgtgtcaactcagccacaccgcg

SEQ ID NO: 23548 - DNA, 184 bp, Chlorella protothecoides
gagccggttgcgagctggttcggccctcctccaaggtcccctggggccgaccaaggctgtcacaagagcggggaggttcctggtgcatctgccagtccaccctcgagggatgtcagctagatcaatcaagaccatccaaaccccgagggaaatgcaacgggctggaggtccgcaaggagaggca

SEQ ID NO: 23549 - DNA, 93 bp, Chlorella protothecoides
gaagtcaccgcctccccaccaagaatcgccgcctccccaaaagaagtcgccacctcccgcaaagaagtcaccgcctccccaccaagaatcgcc

SEQ ID NO: 23550 - DNA, 2847 bp, Chlorella protothecoides
ggcggcgagggcggtggggagggaggtggcggcgagggcgggggagacgggggcggccacgaaggcggtggggaagtcggatgtgagggagaatgtggggagggaagaggagagggcagaggggagagtggaagggggggggcggtgaattccttgcgggaggtggcgacttcttttttggaggcggcgattcttggtcgggaggtggcgacttctttgcgggaggtggggacttctttttgggaggcggcgacttctttgcgggaggtggcgacttcttttggggaggcggcgattcttggtggggaggcggtgacttccttgggggaggtggagagggctttctggttgccggtgatgggtaagttattctcttgtacgcatttacctggagttcctgcaggctacaatcgttgccacccgccctcgtccccttggagttattgcaaaaaaggccggtccccgcgttgttgaatccccagtttctgtcacccttattaaggacacctgtggttgaaggtgtgcatggcagaatcaggacgctggaagctagctgtccacagagcctgcacgtctcatccgtagtcaacatccccctcacctatgttgttgttgcccgcgttgtagtccccatagttgttgtgtcccctgttgccggtgccgatgttgccggccttgtctgccgtgcatgccttctgtccagtcttcagacactccacggccacgatgatctttgtagagcgggccgtcttcaccttcagagtaccggcgttgatggcatcaacagccagtcccaatgtctccaaagtggtgtcgcggagggagccagctttgctgtgacctttggccctgttgcgtcaagcagtagcgaggtggaggtggcgcggatgttggtctttcccacgatactgtacgtgaaatattgcaggcagcctaacaagcgttacatacttcacaaatactcatcctcatcgtcacctgcagaaatcgttcgtactctcgatgtccagcagataaacatgaggcccgtagctgtgcacgatgtgtgatgtgagggcatcgtgaggagacgacggaatatccggacccccttccctggctgagcaggccccacgggcgacggcggcggctcggcatcgacgagggtcggctctcaaatgtgcaactctcgtccacaaactcacataatcgacggcagtgggtagaacgtggaggtgcacgccccctgggattcgaggagaagggtgtatttcgcggtttaaatggtcgttctgagcactcgcccaacctttgcacatgacatcctctccaggcaactcgagccctacgaacttacatgagatacgacgactaccccgagaaggtagagagctatgcccacgcgaatgacctgcccgttggcccacatcctatcgtcgaaagccaagggtggtccggcagtccccgctccgtcagaaggcgagcatgaatgaggaggatcggctctttaatttattgcagcaagatctgcggtcctgtccgcgttttcattgagcgctgtcccatccgcagacgacgtgcccggacgatgtgagtttcccgggaagggtccggaattagcgggggttgaagcagtgttgatgctgcacggcggaactcgtcctactgcccttgcctggaggccactggttgttacaacaaaggcaagatgaatacaggcgggtggacactcagtttgcatgtagcatcctgtgtttaaggacgcgcctacgcataggcggctcctgaacaggaatggagagcatggtaagaggcgtgatgggctcgggggggtactactcccgtatccgggtgaggtagcgcttgtgtaggtaccaatttaagattctatgggtcgcaaggggcgttaaaccgtcagaggtgcaacgcgacccacagactgtccaggaaagggtacttacagcctcactccaaggtgtcttatctcagctctgccaatgagaagatgatccagcgcggaagactaggcttcggaaaatgtggcgtgcatcttagacaacttcctgttacagaaagccatggcagaggtaacgcaggagtcccctgcaatcaaatggctgtcgattatggtgtcaagacgggccttgagctatcttgggtgtgtccccaggagtccttcagggccaccaattcagggggagagcatctgaagcgccaatccaagatttgattgctactgcctcggcataggatgcatgtgttgtggcatctagcgttgtggtccagatcatcggtgtgatcctgtacgcattatggtaggatgtaaacaggccacctgctgtagagaaaacagcgtcatatacaccgtctggtgacaagccttcaaaatccagcgagaatgagagggcaagcccattcttggtaacggtcccgctgatgggccccaagactggggttggtggggacggccccgaaggaggtggagaaggattgagcagagtcagtggtacaagcttgttgactccattttcggtgtagacatatgccgagtccacgaaatagcttgctgccatctccagatttcttttgcctagggtaatcctatgtgtggcagaagttgggggtttatacacagtcacatggccttgatgactgaggtccaatgaatagaagtaaacgtctgcggcttgggatacacatcctgttgtgttgatgatgactgtgagtgggatcaagctatctgcttgaatactgaacccgattgttgcagatgtacgtggtggtggtggcagcgagggcctgggcaggggatgggggctgggtggaggagagggtctgggtggaggagggggactgggggaaggaggg

SEQ ID NO: 23551 - DNA, 196 bp, Chlorella protothecoides
gaattttgcaaacaccggttggagtggccaccatgttatcactccataggtttcacgtcgttgtccttgctgttgaggaaatggtgaaacatccaccgctgaggactcttcggctgatgaggccaagtacagtttcacaagcagaggcgaactaagcggcagagagatgggtgctagcaatgactctgaatcttga

SEQ ID NO: 23552 - DNA, 70 bp, Chlorella protothecoides
cgcgcgggagggccaggtccagaacttccccgacggcatcgaggagtgcggcaccgatgccctgaggttt

SEQ ID NO: 23553 - DNA, 280 bp, Chlorella protothecoides
gcctggggagctctttgcacgtggctatgtgatggggttggggggggggcgggcaccgggcgtcgggagaggaagcggcgccggtccagcctggtccttgcgggcatgtgcgagccttgccaacatcctttcagctgtccagggtgatgccatcggcctgagaagagggtgttggtgggtcaggggagatgtggactgcgccactggtcgcaagaggcacaagctgtctctgcctgtcgttatcactcgggtgttccttgtttccacacacacagatccc

SEQ ID NO: 23554 - DNA, 202 bp, Chlorella protothecoides
gtgggtgcttcatgcacgtccattcatgcgaggatgctttcattcatgtccattcatgcatgtatgcttcatgcacgtccattcatgcacgtccattcatacatgcatgtccattcattcatgcgtggcggctctgtccacgtccattcattcatgtgtggcggctctgtctatgcgtcccccattcatgcgtggcggctct

SEQ ID NO: 23555 - DNA, 69 bp, Chlorella protothecoides
gccacctgcctgaaaaagcatcgagccatgaccttcatgggctcgccctccgcgccgccgggttggaag

SEQ ID NO: 23556 - DNA, 80 bp, Chlorella protothecoides
ccacacttcagggtccatgcgcgaggcgttattttgagttccacaaaccatcccggcatcgcacctggaagaacttggag

SEQ ID NO: 23557 - DNA, 853 bp, Chlorella protothecoides
  modified_base (459)..(468): a, c, t, g, unknown or other
cgggcgagcgcgaggctgccggcgtgcgcgccgcggccgacgccgtggccgcggccgggctgcccgacgtcgtggccgataccaagttcctgttggcagacagcctgctggagctgctgcaggcgctggcctggggcggcggcgacctcgccgccctcgtcgcctcgggcgagcccaccgacagcgccgaggttgggaagaggtgtttggtttggggggaggggatggtgaggggggcgttgtagtgcgaggcaagacgacgtcccggggtgtcaacatcgtttgacgacgtatgcataggaccagaggcaaccacctcttcgagcagactacgccccctctccactccctccctcccctccaccacctaatcccccctcccgcagctgtgcctggagctactcatcacggtggcgctccgcaaccgagaccgcgtcaccctcatctggccgttggtgnnnnnnnnnntagcgccgaggttggggagaggtgtttggtttaggggggggatggtgagggggcgctgtagtgcgaggcaagacgacgtcctggggtatcaacatcgtttgacgacgtttgcataataccagaggcaaccacctcttcgagcaaattacgccccctctccactccctcccccccctccaccacccaatccccgctcccgcagctgtgcctggagctgctcatcacggtggcgctccgcaaccgggaccgcgtcaccctcatctggccgttggtgcacgaagtgctggccgccgccacgtcagcatcgcaagaaagcaacgcgctggtggagcgggcggtgctgggcctgctcagggtgggtggatggtcggggggtccggggggg

SEQ ID NO: 23558 - DNA, 61 bp, Chlorella protothecoides
gcggcgacaaggagggccttgccaccgaccacagccacgactcccaccttggccatcctcc

SEQ ID NO: 23559 - DNA, 74 bp, Chlorella protothecoides
gcccacacaaagggatgggcatacttccgagcatctgccaagtcggactcgccaccctacacagatagagtact

SEQ ID NO: 23560 - DNA, 63 bp, Chlorella protothecoides
gtcggagatagcccccgcccatggcaaagcacgctagcctccgctgcgggatgggaaggacat

SEQ ID NO: 23561 - DNA, 282 bp, Chlorella protothecoides
agccaggtgtgggtgggaggggtctgggtggtgctcacaggttgacaccttttccaaggcagacaaccgtacaaactaaggctcattaggggtagcaagccacggcaaaacaacaggtctatttgcgaggaggacaactatgctccagggcgcagtgtggtgaaaattcccattcagcacaaaaagtttcagcttgagagtggccccgccaagagtccccctaacacctccgctgtgcaagcccttcaggttacctgcagctgggtcgtcttccctgcgcca

SEQ ID NO: 23562 - DNA, 61 bp, Chlorella protothecoides
tgttaagcaccacatgcatgcttcggcctcagtgccgcacgccctctagattcccaccatc

SEQ ID NO: 23563 - DNA, 65 bp, Chlorella protothecoides
gcccagacgcttctcccccaaggagacgacgtgcaaggcacgacagcccagacgcttctcctcca

SEQ ID NO: 23564 - DNA, 828 bp, Chlorella protothecoides
cgggcgtccgcgcgcgaggcgccgtcaccgtcgccgccgtcgccgccctggcggccgcgctcgtgccgcgcgtgcgccttgcgaatgtgggtcagcagcgccttgtgggcggcgggcacggcgggctccaccgcctcgtagccgcagcgcctggccaggcgctccaggatcatgcgcaccttgagtttgaacttgttcttggagtcctcggcccacagcaggcagccctccaggatggcgggcaggcggggcaccagctcctccacgggcaggcggctggccaccaccttgacaaagcccagcacggacttgaccacctcgcgcgcgcgggagcgcaggagcatgagcaccgcggggaggaggtcggggacgagatgcagcagcgccgcgctgaactcgtgcagcagccgcgccaggcccatgaccgaggcggagaccatgtgcggcgacgcgcccaccagcccgcccagcagcaccgtgaccagcgtgcccacgccgcccagggccgctaggggcccggcggcgggggtggtggaaagtgcggccgatgccccggcgtcctgcagcgcgtgggccaggccgacgaggaggtcaaaggccgcggcgcgcgtcttggcgttgccctccttcagcgccagcacgatctccccgatcagcgcagacacggtctccgcgtgcgcctcgccgcgcgcctcggcgcgcatggcctccagcgccgcccatcgcacgccgcgcaggcgatagcgccgcgcggcgctgagcgcgccggcgccgccgccgacgatcagctccagcagcgccgcgcggcgcccgggctcggcgaggtag

SEQ ID NO: 23565 - DNA, 61 bp, Chlorella protothecoides
atgctcctgcgctcccgcgcgcgcgaggtgatcaagtccgtgctgggctttgtcaaggtgg

SEQ ID NO: 23566 - DNA, 83 bp, Chlorella protothecoides
ggactcccctagcctgtgaggaggggcgcgaagcggggttgaggcccagtagacgtgagagcagcagtctgctcttcaccctc

SEQ ID NO: 23567 - DNA, 218 bp, Chlorella protothecoides
cccctgccatgccgcttcgagccaccctcctgcagcagtctgatgtcttatgtattggtgacgcgctatacctcccctgtccttggacgtcgcttaggactgtcgagttcctcccttccaaccccttgcaggccctcacccgagctcagctgtgggaggagtgcccgtgcatcctggtcactgcgagggggatgccggaccttgccaccaggtgctcg

SEQ ID NO: 23568 - DNA, 61 bp, Chlorella protothecoides
gcattggccaatgttggtggcagacatgctgatggggaattgaaatggagaagggaggaag

SEQ ID NO: 23569 - DNA, 170 bp, Chlorella protothecoides
ttgccaattttaagcgaagggccgagctatgcccagagccaggactcaaggagttgagcgtcattctcacatgagggtgatggcaatgttgcggggggcgggaccctggcccatcaaagtgccagggatatccacgcgcccatgaggaggaagcctctgtggtaagggat

SEQ ID NO: 23570 - DNA, 76 bp, Chlorella protothecoides
gcccgcctgctccctcaggtgacagcggattgttgtattgatgtgtgccatggttcctcagggcggatggtcacct

SEQ ID NO: 23571 - DNA, 61 bp, Chlorella protothecoides
cagctacacagtcgtgagtttaggggggggtgcaaggtttgttgggcactgatgtccagga

SEQ ID NO: 23572 - DNA, 2376 bp, Chlorella protothecoides
  modified_base (2276)..(2302): a, c, t, g, unknown or other
gctccccctcctccctcccccccgcccccctccaatgcctcctcgtccacggctcgcctggtcctgggagcctggggcgcatgcgagggcgactgcgggcagggctggcagactcgtaccgccacctgcactgccagcacgggcgacgtgctgcctctgacgtcctgcaccagcgctagtcccccggtgctcctgcagagctgcaggtgggtgggcggagtggtgggttgttggctctgtggttccagctggttcgggcagaggtcttgcatgcggcttgctgagagccggcgtacctgttgaccaccgtccccccgcctcacggctccctatcaatgcaatttctctccaacactgagaatcaagcaccccaaccccacctccgcctccgctcctccaccaccctcgccagcctggccactccctgcgccgcggctcactggagctacgggccctggagtgggtgcgacgcggcgtgcgggggcggggaggccagccgcaacgccacctgcgtcgacgggccctgcacggagcccgccgccctgacgacggagtgcaacacgggcgcctgcaccgcccacgcctggcgcacgggcgactggcaggcctgcagcgtgacctgcgggggcggcggctcgcagagccgcaccgtgaggtgcgtggcggtggacaccggcgcggcggccgccagctccctgtgtcccgccgcggcggcgccggccgcctcccgcgcctgcggcacgcaggtctgcgaggtctgcacggcaggcacgtgcctgcacggcgcctgctcgaccggcgcggcctgcgcctgcgaggcgggctggaccgggtcccgctgccaggtgactcgggggatctggggcggggagctggggaagcagagcgcctggcgctgcggcaggcaggggcatggcgtgagggcggggaactctgcaacctcggcccaggagagcatcgcccagggcctgggttgccgccggcgctgcagattcgatcgaggcgccctctgatccagccatgccgatgcgcgcaccctacccacccccgccacctttcgacctgccacacaccctcccacttctctcaaacgctcaggtgccgagcagttgcacctccggcagcgtggacgccgccggcgcctgctgcgactctggcgtcgtgtccggcaccggcgcctgctgcccgtctggtgcctcgctggacgcctccggcgcctgctgcggcgccggcaaggccctggacgcctgcggcgtctgcggcggaaacgccacggccgtcgacgcgctgggtgcctgctgcgcttcgggccagctggatgccgcggggctgtgctgcgccagcggcgcgctggacgcttgcggcgtctgcgacggcctgggcacctcctgcgacctggccctgtcgctgcgcatgggcgtgaacgcgagtctggtgagcgatggcggggtggagcaggcgccgctgcaggcctacctcgacgcgctggggcgggcggcgggcgtggacggcctgggccaggccgaggaccttgcgctcagcaccgggggcagcaggaggaggcggcgggctctgctgcaagcggggggcccggccacggtggggcagggtggcgcccaggatgtcggcctggaccagaccgccgaggcaccgagcccggcgctggccgccgggtccccgtccactgcagccgggtcccccgtcacagcgcccacgccatcggcctccggcgcctcgacgccaccgacagtcctggcgacgctgaccgtgcctgcggactcacggacggggaactcgccgtggacgccgggctggtttgctgccaccctggtcccgggcgcggtgagcgacgaggccgtccagctcctggccccggccgtggcatccaggtgtgtgggagggtcggtggttgtggggctggtggctgtactgataaaggggtgacgggtggtgctcgagggcgggtttgaggatgaatgcagccagatgatcgcctggcgaccctggaggatgatttcgttgcccaagacgggcatgactcatgctcacaacccctgccccgctgtcaaccatcccccgcgcccgaaaccccggcgtagcgtggccgtctgcggcaacggcgtgtgcgagctgggggaggtcgggcaggccgggtccggggtgacgggcacctgccccgccgactgcccgctggccacgccggcggggtgcagcggcggctgcggcgcggggacgtgccaggccgccgccggcacctgcctctgctggcaggggtnnnnnnnnnnnnnnnnnnnnnnnnnnngcccctgcctctgctggcaggggtacgccggcgagcggtgcgcgacctgcgccgccggctacgccgtcggcgcc

SEQ ID NO: 23573 - DNA, 62 bp, Chlorella protothecoides
tgcccctctaggccagtgtacggaatccgctccatgggtcgggtgcccatgacttggaaggt

SEQ ID NO: 23574 - DNA, 127 bp, Chlorella protothecoides
gagcccgaggtacaggctctctgagtcatgagtgggcgggtgtgagcccctccgccagctcacacacaaaaccacacatgaccacataaaccctcacccttccctccactccaggtgatcgaggagg

SEQ ID NO: 23575 - DNA, 64 bp, Chlorella protothecoides
ccaggctgcactggccagcaccttcccggtgctcctgagcatcgtgcaagccctgatgcggtgc

SEQ ID NO: 23576 - DNA, 61 bp, Chlorella protothecoides
ctgagcatcgtgcaagccctgatgcggtgcaccagcctgtcgtgcacggcaggcgtggaca

SEQ ID NO: 23577 - DNA, 61 bp, Chlorella protothecoides
cctcctggtttgatttccttatagtggcggtatatttgccaatgtgcactcctgcagcacc

SEQ ID NO: 23578 - DNA, 5840 bp, Chlorella protothecoides
  modified_base (1963)..(1972): a, c, t, g, unknown or other
  modified_base (2440)..(2449): a, c, t, g, unknown or other
  modified_base (2781)..(2790): a, c, t, g, unknown or other
  modified_base (4379)..(4388): a, c, t, g, unknown or other
  modified_base (5487)..(5496): a, c, t, g, unknown or other
ggcgccgcggcgggggagcggggcccgcgcgggcgccccgccccgccgcccaagaaggcgctgcgcgcgcccctgttccccccggcgccggtggccgccaagaagtcgccgcgcggtgagctggcgcgtcgccgctccgccgagacctgaagaaacttgaggggtgggaatgcatcccacgacggggcgcggcgacacgcgacgtccctgccatcgtcacccatctgtacaacatcccttttgccacttgggacccgaatgcctctgcctctgccctgccctgcacctgtgtaagacctgcatgcctggatgatttcagggtcggaacagtgtttggaaggaggatcggtaaatgctgtgagccatgaaggacaggcaggtgtgttggccctgctgcgggatagctaacaacgcgcgctctccccatcctgcatgcccaggatccctccacacccgtgtgatgggtgccatcgacagtcttaggatatacataatctttgtagaatttatgggttgatcggggcgccatggctcgcaggaaacagggcgccccacgtcgacagagcccgggcaggacaggggatcgccaggatgtgtcgctgcaagggtcaggatccatgcaggagccctccgatggccgggtcactgattcagatgatgtagaagacgcatcgaaggtggcagatggacgtgccttggcttccgtcagcaacagcgtgcgagctgtggtggccgtcagccctaaaccccagccgtgggtgctgggacccctcgtcctccaggaggcgcctgtcgccagcctcgcggctggaagctccatctcactctctgcactggacgattgcattgttgcggaggtccttgcagaggatcccgagccatgcccagcatggaaggcaaggggtagggtttggggggactggtggacacccgcagggcctctggatccaccagcactcgaatcacccctctccctgcctccttcacaggaatgcatccccctgccattagttggcgcggcccatgccatcgtctccctgctcaagtctggccatgccggcctgtgcctggctggaacccagccgggcctcctcctctgcctggccccaaaggccctcgaggacccagcgctgaaccccctggacgcctcgagcaggccgtggcagtcctccctgctcctggccctgcgcagcttcggcctgggaccatgggccgcccaggtccccgccgccgaacctcaggaagccgaggccggcgacggctccgaggtcgctcgcatctacgcccgcatcctgccctccaagaccgcgccagagttcgagggccccctgccgccagccctgcgccccacgctgcccggctaccagcgccgggcgctgcgctggatgctgcagcgcgagggtgccgctgcgacggcggccaaagaacacggcgccccgccctgcaagaggccccgcgccgacgacctgcacccgctctgggcacgggtggccaccgcggacggggggtccctgtttgtgaacaggtgcaccggcagactcagcacagccagcttcccgacacctagcccgcggcaggtctgtcccgagagcgggtggagtgcggtgaggctggggattttgggggatgtgggggatgttcgattgaggcgttcctctgatgcaggcgggccgaggttaaatattctgaacacaacccctccaatgcaggtgtctggcggcatcctggctgatgagatgggcctgggcaagaccgtggaggtgctggcctgcatcctggcgcacccctacggcggtccggcgcccgacctggaagcgcaacggggcatgcggtgaggcggatgtaagggctgacgtagtttgggaaggtcccagagaaatcaggagagaaggctgcatgtgtgaatatggatggggcactgtccgaggtctcgcggggagcctcaaatgtccgtgggacctcnnnnnnnnnntaatcaggagagaaggctgcgtgtgtgaatgtggatggggcactgtccgaggtctggcggggagcctcaaatgtccgtgggacctccacacgatctactgagccccacaggaccagcatcaaaaaggagagggtggagtgcccctgtggggccaggagtgaggcgggcgcgccatacacgctttggatactgtgtgaggcgtgcaatgcctggatgcacggtcaatgcatcgggtatcccaggcacccacccaagggtgggtgggtgggagggttgtgcggactatggctgcgtcggcggatggtggagaggaagtttcatgcagctggggctttgcaatgtacggtctgctcattgaggtggacaggcataggggaggagaagatgtctgtcgcactgacccttgcttgcctcctctcatttgaacccgactactcacaggacctttcatttgcgggcgctgccaannnnnnnnnngtgaggtggacaggcagaggtgaggagaagttgtctgtcgcactgacccttgcttgtctcctcccgtttgaacccgataactaacaggacctttcatttgcgggcgctgccaagccatcctctctggaagggagatgagtcatccttgcggcgcaaccctgatcgtgtgcccccagcccatcatggagcagtggtggggcaggcagaggcttgggggaggcagttgggttgggtgtggactgtgcaagggatgctggtgcagccgtgggcgggagggagtgtctctgattacattcgaggtttatctggcatgccggcccttacatcagcannnnnnnnnnaggagggagtgtctctgattacattcgagggttatctggcatgccggcccttacatcagcacgacatcagctactgctgctggtgctctgagattcctgaagacctcttcacccaacactgcaggcagcaggagatcctcaagcatgtggataccaatcaagtctccatgctagtatattctggccagacccccagcaacatgggtgagcgccatgcagccaggatgagggcgattgtgggcgaggcgtggattggaaaggacaaacgattgctccatcccagcccagttcgcaagccataatcaccgcaggcggcgacaaggccggcgcagtagtgtcggcgctggatctggccggcgccgacatcgtgctcaccacctacgacgtgctgagaaaggatgcttggcgagtagacgggccggaacgccggctgcggcacgccaagaagtacgaggtgggttcttcatcttgatgccggaagggcgcgggggggtaggtgggtttggaggggaatgtggttgggtatgccagtcgacgctgcacctcatggcgcttgccaacgactgccgatacgatgtatcccttcctggcaggtcctcaagaccccgctcactcgcctccactggtggagggtcgtgctggacgaggcacaggtatgacacgagggtcagggtactgtatggccgcggcacttgcctgcctccctcgcaccctatttacacggccaaattgcctgctctgaaccctgtacctatgtacacaagctgcacaatcccccaactcatatccctgccctctccagatggtggagggcgcggcgtcccgggccgccgagctggcgcgctccctttccgccacgcaccggtggtgcagcaccggcaccccgctctccaagggcctggacgacctgcacggcctcctcgccttcctgggcgccgagccctacgcgcagcggcgctggtgggaggcgctggtcacgcggcccctggccggcgcctgcgccggcgcggcagacctcgagcagggccgggcctggcgcgccgcgctgcgcctgctggacccggcctcgcccgccgggctgatgtggcgcaacaccaaggcgcacctgggcgcggagctgggcgtcccgcgccagcacgggcacgtgcgccgcctggacctgtctcccatcgaggcccacttctacgcacggcagcacgccgactgcctgcagcgtgcgcgcggcgcgctgccgcgcgcggcgctggagccgggcggcagcggcccggaggacaggctgctgacggcgcgggaggagaagcgggtgctgctccccctcctgcgcctgcgccaggcctgctgccacccccaggtgcgggttgctgctgctgggaaggggggatctggaatgtctgaacggaggggtccgagggcagtgttcaaaggtcatggcacttcagagaactggttctcatcgattgcacggcggacactcaggctgggtgggccagtcagaggggaatgtaggtgctgcagtcttccccccccgcaccctcaaccccatgactcaccgcaggtgggcaccggtggcatgcgcagcctggccctgnnnnnnnnnnttgggaagggggggtctggaatgtctgaacggaggggtccgagagcaatgctcaaaggtcatggtacttcagagaactggtaatcatcgattgcacggcggacactcaggcagggtgggccagtcagaggggaatgtaggtgctgcagtccccccccacaccctcaaccccatgactcaccgcaggtaggcaccggtggcatgcgcagcctggccctgcaccgggtccccatgtccatgcacgacgtcctggacgtcatgatctgtgagctccagagggtggcggggcgatgtgcgtttgcactggggacgtgggggcatcggttcagggtcgcagcgcatactccacggccacgagctttcctcgttctgggcagccagctttcgaggggcccttcccaacgtccccctccccctgcactcagccaagcaaagaatagaggcggaggacgcgcagcgcctgctcctggcggcgctcaacggcctggcggggctgcagctgctggcggggcggccggaggaggcggcggccacctaccgcggcgtgctggcggccgccgaggccaacgcgcgcctgggcgtgcgcgccgacggcctgcagcgcctgcacgcactgcacaatctgcaggacgcgctgcgtgccgcgcgagacggcgtgccgcgcacgctgcgcgacgacgtgctgacgaggcaggcggaggagctgcgggacgcgtacgcggccgagtcggtggcggggctgacggcggcgcgcgtcgcgcaaggagcagcggcgcgcgaggcggaggcgggcgcgggcgaggggctgggggatctgaggcccgaagaagcgcgtgccctggaggcggcctggcacgtcgaggcagtgcggctgatagagggcgcaggccaggcggaggtcgcgctggccgcggtgcgtgagacgctggcgggcggggaggcataccagagggctggcgcggcgactgggggagggctgaaatcgaacgcccgcttcgactctctgaacggtctggccctggtgctgggccgtgagttgagggagttgaatgacgcgcgggaggccgctctggctgagctggcccgcctggaccgcgccnnnnnnnnnnctcgaacgtccgcttcgactctctgaacggcctggccctggtgctgggccgcgagttgagggagttgaaagacgcgcgggaggccgccctggctgagctggcccgcctggaccgcgcctgtgaccgccccggaccggacctcgtgcggctggcgggcagctgcgcgcggtgccgcgccgagacggccgtgtccggcgccacctgcgcgcactgtcgcctggacgagcgcttcctgcggtgggaggtgcgggccttcagcctgtcggtggccggcgcggcgggcgtgggcggcgagcaggcggcgctgctggcgcagcgcgccgcgctccagcgcgtcgggcggg

SEQ ID NO: 23579 - DNA, 61 bp, Chlorella protothecoides
gcgtcagtggacccgcccgcctcagccgaaccagaggtagcggctccgccttgggggcctg

SEQ ID NO: 23580 - DNA, 75 bp, Chlorella protothecoides
aaaggatgaccaacgtgagttgtggcttgctaggcgcttctgtgccttttccagcagtgatcagatgtctgaagt

SEQ ID NO: 23581 - DNA, 91 bp, Chlorella protothecoides
tacgagtatggtgtccaggaaatctgttgctcaggatgccacccttttcctttcacacggtagattgtagcctacataagaggagcaatga

SEQ ID NO: 23582 - DNA, 262 bp, Chlorella protothecoides
gctgagacattctacaggcgatgaatgtcctagagatagaccgggagaccagaagacgcgctggtgcgtttgtgagtcctcaaatctgcgcgcgcgcccccggtgacggagaactgatctgaagccggttcccatgcaaccatgtgcctacagttgacaggcgatgtcttcactctcctcaccattcccttcgactcttgtcaagaagcgtgatgtgaagcatgacctggtgcaaacgctattgcctatctcttccctacat

SEQ ID NO: 23583 - DNA, 75 bp, Chlorella protothecoides
cctgggcctggtgagtttcttgttgttgttattttggggaggggtggggtccttttggcattcacatttcaaggg

SEQ ID NO: 23584 - DNA, 80 bp, Chlorella protothecoides
acacgcatgcatcagcaccttgcggctgccgctcacagctgcatcttcgtagcggatcagggaaacctttctattcccag

SEQ ID NO: 23585 - DNA, 145 bp, Chlorella protothecoides
ctattcctgaaacggaatcagccgagtcttttgagctgagcctcacatggcccacggtgtcttccagtggagtgcatggatcgcggaccaagacgatcacgtgagaggtttggatgggcacatggcccctgtgctgacgtcctgg

SEQ ID NO: 23586 - DNA, 75 bp, Chlorella protothecoides
ctgcgtcaaaaaatgagaggaaggggtgaagaggtcatctaaccccaaggccaccagtagagacacacgcagcgg

SEQ ID NO: 23587 - DNA, 61 bp, Chlorella protothecoides
ggggtggggttgagcaagagggttggtacaattggagcgatgtgagatgtcgtgacacagt

SEQ ID NO: 23588 - DNA, 65 bp, Chlorella protothecoides
atgcaatccatgctgcgcattatgccattgcaaagaccctcacactccctacatcatacagtccc

SEQ ID NO: 23589 - DNA, 131 bp, Chlorella protothecoides
gatgccatcaggtggaaggatgctgaggccttgagcacacagcccacccaaagcttgtcgcttgccgatactgcagctcacgcatcgcaggcactgatgattggaatggtccacaggcccagctccagtcc

SEQ ID NO: 23590 - DNA, 74 bp, Chlorella protothecoides
gagatggcccactggcgcatgtctcttcccgaccctccaccgaaaattcgcgcatactttcgattcccttgcag

SEQ ID NO: 23591 - DNA, 171 bp, Chlorella protothecoides
gtctttcaggctgctcacgtcgtgccagtagcctgcggtgtggagatgtggagagggttggacatgcgcaagggtggcggattcgggcggtagccaaacaaacaaaagtgaatcgcatggtggtggagagccaggtatgctactcccccggcctcagcactatcctgtgca

SEQ ID NO: 23592 - DNA, 61 bp, Chlorella protothecoides
cacaacacaacctccctcggcccggcatgcacctccttgtcccatccacaagataataccc

SEQ ID NO: 23593 - DNA, 68 bp, Chlorella protothecoides
atgaggagtgagccaaggggggaccagtactcagcggcaccatgtacagggcagagagaacatgtggg

SEQ ID NO: 23594 - DNA, 61 bp, Chlorella protothecoides
cggctcgactccttcgatactgtgggggacccacggacagtcatcaagatgctgccctccg

SEQ ID NO: 23595 - DNA, 67 bp, Chlorella protothecoides
cacggacagtcatcaagatgctgccctccgcaatagtctgttgaaacgttctgctggcagggggctc

SEQ ID NO: 23596 - DNA, 67 bp, Chlorella protothecoides
tgagcagacccagagttggcagtggatcgtttgggacttttgcatcctggtgttcctggcctcatgc

SEQ ID NO: 23597 - DNA, 68 bp, Chlorella protothecoides
ctattgccggccggccactgcctgtcctcgagactcttccccacaaaaatctcctcatccaagtgccc

SEQ ID NO: 23598 - DNA, 73 bp, Chlorella protothecoides
acccgagacagtcgacaggtactgacaggcaatggaggtcatattcttttcctgtgtacccgtagagagaagg

SEQ ID NO: 23599 - DNA, 61 bp, Chlorella protothecoides
gcgtgccaggctggcaagacaggtgccggaacccagccgctcaccagcgatcaaagcgcca

SEQ ID NO: 23600 - DNA, 61 bp, Chlorella protothecoides
tcgaatgctgagtgcaaacctgggaaagatgccgggaagtttcaccctcaatggcaacaac

SEQ ID NO: 23601 - DNA, 194 bp, Chlorella protothecoides
ggcatggaacggcggcatgaaactcttcgatctgcccatgaccattctgctcaagatcctccatctggcgttaggcgtggattccatctcgaccgacgtcgtcggacgatttggattgacgggtgacaggcttccgctctggagatgcatgcccggggtttgtgggtgctgtgttttggggctccgggcaccgg

SEQ ID NO: 23602 - DNA, 80 bp, Chlorella protothecoides
actgcacacaagatctgtttcatctgcaccccagaactcttcatctctaaatcctcgttatttctgtgtattcggacgtg

SEQ ID NO: 23603 - DNA, 61 bp, Chlorella protothecoides
caactgatttgcatagaggagtgattcaacctcacactgatttgcatagaggagtgattca

SEQ ID NO: 23604 - DNA, 79 bp, Chlorella protothecoides
gcgctcctcagcaagattcccagcaacacacttgccatcgcacggtcacgcccacaaccccaccaaaactcaccgagtc

SEQ ID NO: 23605 - DNA, 71 bp, Chlorella protothecoides
gcgctggcacagttggagtaggaggccctcctccacccctattcgacaaccttctcccccaagtattatga

SEQ ID NO: 23606 - DNA, 4221 bp, Chlorella protothecoides
  modified_base (518)..(527): a, c, t, g, unknown or other
  modified_base (1923)..(1932): a, c, t, g, unknown or other
  modified_base (2060)..(2212): a, c, t, g, unknown or other
  modified_base (3075)..(3084): a, c, t, g, unknown or other
  modified_base (3923)..(3932): a, c, t, g, unknown or other
  modified_base (4022)..(4031): a, c, t, g, unknown or other
  modified_base (4088)..(4139): a, c, t, g, unknown or other
ttcgacaaccttctcccccaagtattatgatgggtccaacaccacatacactgcacaggatatattggcacgacactttctggacagtccatatgtagtagcagggtctatttatcctgatagaatactaaatgcagtccccgtgcttggattttaaaagcacatcccagaggcagaaggggaggcgagacagattctttgatggtccagactggtcagctgctgagacatgcaagcttgacatctcgaaaaaggtaacgaggcatatgcctgccatacaacaacacaattggaccacagattagtgtgctatctgcaaccaccaaaagcgtgattgggtgtccagcctcggcatcaagtttccttgggcttgacagggaaaattccctgcgaggtggttgagggtgactcgattgagcacctttgcgctttgaaacggaccaaactgcatgcttcccagataactgcaacaatatgactataacgcgcctgcagagacctgtctccctccaagagtnnnnnnnnnntgaggtggttgagggggactcgattgagcaccttcgtgctttgaaatggacatgaactgcatgcttcccagattactgcaacaatatgactataacgtgcctgcagagacctgtctccctccaagagtcccgcacgctctgcagttttgcggccaaattctgaggatcgcacggggagaggaagtgagtgggaggcgatatagctccagaataatgcaaaagccagacacatgaaaacgatggtcctcccccaagttctcatcagattctcatgcaattgagcagggataaaggctgtataggaaggaatgtacacaagtaggtgtaaccaaacattttgcacccaagacactcacttttgtcgtcatagttcgccgcacgagcattcagagtggaaggatggagctcagcctcccccagacctagcgagtatgagtacatggggtttagccggcacgcaggaaacgcccaatcacaggagaagcacgttcccggagccactttgcgtgccaagcaggcagctcacctccatgccgtgtgacgttctcggtgaggaatgacgggtcgtttttgcccttccgataccagaagaatccgaatcctgccaccgtagcagctacgatggccacaagcggagctcgcctgactgcgaggaagccgatgtgagaaaaaggcgtttacaggggcttcgacactaggtttccatcttatatatacataaacataaccctgatctaccagggcaatcaacataccactaaacgctcccgtctctttgacggtttgagtggtcggcatgaaggcgaaagtgcggaaggacgatggtcaccagagtgcggcttccgaacacggaaaggctcgcgatgatactgattggattatctctgctgcgcgtgcctgagatttttgggttggctggaagtttaccaagtctgaggtgctgctgccgcattcacgtggaatctgccgttgcttaaaactgctgcgagacatgcttcgcatgctgtggacgtccggaacagccgcgatcgcaaagcgatccgtctcgtctaggactccagtaacccatcgagggaacacccatagcattctgatgcggaccagatgatcatatctattctgtaggggttcacacgtaccaagcgccggaaacggggcgagtgctcgttgtgcactcgcctctcgtgtggtatgtcggtggccccgtgtgcgatgcacacaaggaccctgtatcaaccgaggtcatgtcagagcgccatcagcgtatgcgcggctcgaaggcgcgctcatcggaccgctggcggtgtcgtagcgcaggtttggtccagagttgcccaccaaccgcgtgctcaagaagatgttgtatcgagatggtccaccacgcaggcgatgcctnnnnnnnnnncgactccagtaacccatcgagggaatacccacagcattctgatgcggatcagatgatcacatctattctgtaggggctcacacgtaccaagcgccgaaaacggggcgagtgctcgttgtgcactcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggtgcccaccaaccgcgtactcaagaagatgttgtgtcgagatggtccaccacgcaggcgatgcctggtgggggttgtgcccggcgattcttttgggaatgagactgtagaagggctcaggcttcccacctgcatctcccaatttcaacccgactgatcctccctgcgcaggccaagaaacaggcatctgatgccgatttgatggcgcttgtcaaacagctgcgggctgagaacagtgctctgcgtgtgcagctggcacgggctgggctcctgccttcaggtggcaagcgcgcgcaggatgcctctgcgcccgccccaccgagcccccaggcacgagccctggcgtctccaagacggaaaagggaggacccggacccccaccagtccaaaggtagtgctgagggggtcatagaaaccctttctgatttaaaatcatgctcccggctctgagcctgatcaatccccagcacgctctattgcccctcacaggcaaatccctgcccagcctcgcagagctcgaggccggcatcgtctggccacaggggcgggaggacaggttctgggagcgcccgccacgcaaggccccgctgtccctgccaggcccgccggggaaggagggcccccctgcgacggccgccgagcccctcaccatcatccacatcgccgccgagatggcgcccattgccaaggtgggtgggggtgcggcgactgccattgctgaatctgtgacgcagggtatcatccaatgatcatcccctgtgtcgcacatgccaggcaccctgaacccgattcgtccccccacccatccacttgcactggggtgcaggtaggaggcctggcggatgtggtcaccgggctgnnnnnnnnnncgctgaatctgtgacgcggggtatcgtccaatgatcatcccctgtgtcaaacatgccgggcaccctgaccccggttcgccccgccacccatccacttgcactggggtgcaggtgggaggcctggcggatgtggtcaccgggctgtccaaggccaccgcagctcgtgggcactctgtggaagtggtgctgccctattacgcgttcctggagggctccccagacgtgagggatgcccgctcggtcggggtgtttaatgtgcccaaggtatggtgactacagagagacgcctggcagtgcgccgccgggaggggtcctaggtcagagggaataattactttggctgtgtccaggaacatgctggtgaaagctctgtctgcttagcatggggggtgatgaactctgcaatgacctttcaaacccttctgattctctaacccccctttctcctctcccccctttcgccctgcacagggcaacggcctggcgaggtgcgaggccttcactgccacggtggaggggtgcagggtgctgctgctgcgccccgtcgaccaggggagcctgttccagggccagagcgtgtacggcggcgcctacaacgagacagaggcctacctgcactttagcaggtggggtactggctgttgttgctctgtagaaggagagggagggggggagggggggaagtgcctcaatactacaggtctgacaagacactcgggtgtctcgcatggcagtgtgcaggcaaaggaggagcagggtgccaggcgtgcggcatggcaatgcttatgatgccaccctgtgtcgtgaagaggcccacgacatcaaccccttcccccccnnnnnnnnnnaaggcgggcggcatggcaatgcttatggtgccacgctatgtcggaaagaggcccacgacatcaaccccttccccaccccccccccctgannnnnnnnnnagggggggggaagtgcctcaatactccaggtctgacaagacactcgggtgtctcgcnnnnnnnnnnnnnnnnnnnnnnnnnnnnnnnnnnnnnnnnnnnnnnnnnnnnagtgcccatgctgttctgggaggcctactccgcgaccctgccccgcacgcgcctggtgctcaccatccacaactttgactcg

SEQ ID NO: 23607 - DNA, 76 bp, Chlorella protothecoides
gaggtggtgggcgatgctttgtgggaggtgatgggcggtgccttttgggagggggagggcggtgcttttggggagg

SEQ ID NO: 23608 - DNA, 61 bp, Chlorella protothecoides
gtcttacgacgagaaggtggacgtgtttggatttggcatcatcctgtatgagctcttcatg

SEQ ID NO: 23609 - DNA, 68 bp, Chlorella protothecoides
tgcggccctggtcctgctctggttccagatcagctggaccaccttcatcggtcttgccatcctcctgg

SEQ ID NO: 23610 - DNA, 61 bp, Chlorella protothecoides
ttcctcgagaaccatcgcgaggttcatgtcgaaccgaagaaagtagggaattcctgcgacg

SEQ ID NO: 23611 - DNA, 236 bp, Chlorella protothecoides
cactattggcccagaaatactgcaaatctggactcaaatcaagattcccgatccagtcctgccaaagggttgagaagaagactgtttgcctgcttagaaactgcgttctaatccctttgctgctattctgcttaccctctcaccatgtgagctgcatgtgttatgaaactgaccctacaagatgtaaaggtagggtcggtagatactgaatgtgccaagacgagcagaggctgagt

SEQ ID NO: 23612 - DNA, 61 bp, Chlorella protothecoides
ggagtcaccctctcagagccctgaggagtcacccagccccagcccgcaacagtcgcccagc

SEQ ID NO: 23613 - DNA, 135 bp, Chlorella protothecoides
tggcagggcccggctggatgcagccccaccattcccgcagccctgccgagcgtgagtgcccctgccactcctccacatcccagcgatccatccccgctccttgaggatctcctgctcggtgcgccccactcaccc

SEQ ID NO: 23614 - DNA, 73 bp, Chlorella protothecoides
gatctcctgctcggtgcgccccactcacccccccactcgcgctgaaaaacaggctgcgccagacggtgttcct

SEQ ID NO: 23615 - DNA, 63 bp, Chlorella protothecoides
gccgtgcggcccgctcgatggcggggtagcagcaggcctccgctcccctcctctgcctggggc

SEQ ID NO: 23616 - DNA, 61 bp, Chlorella protothecoides
cagtcggtccatcgcagaggcctgtttgggtttgggttgggggggggagaggaggaggggt

SEQ ID NO: 23617 - DNA, 661 bp, Chlorella protothecoides
gtcgccgcgcccgcccccgccgccactcgaacccgctccgccgccacccgacgccgccccgccgccactcgccgaccccgcccctcgatcccaccccgcctcgccccgctcctcggacagcagcatgcgcttttcggcgctggccagcatctccagcgcggccaccttctcgtgcaccgcacggcgcaggtcctcctcgaaaccggcctgggcggcgccgcggtgcggcggcggggtgcacatgctggcgtcggcgtcggcgcaggccacatccccgacctccccgccgtcgcgtcccaagccccactcagcctcgtcgtccgcggcgcggtgcgcggcgccgatggcagactcggccttgaccagcgcctggcccgcggccaccaggcgcgcggcctcggcgcgcgcctcgcccagcgcctcgcccagcgcctccttctccccctctgcggcgtccaggagcagctccaggtgggacgccccgcgccgagccgcagccagctccgcctccaggcccgccttctggccgcgcgcgtgcgtcagccccgcggtcagctgctccacctgcgcctccaggcaggccagctcgcgctccagcgcctcgacccgcgcgccgcgcgccgccgcgccctcccgcgccgaggccagcgcgtgctcgagc

SEQ ID NO: 23618 - DNA, 61 bp, Chlorella protothecoides
ccatgttttgcgagcccagccccgcccccgcaatccagtcgtcgtgctggtgctccgtcag

SEQ ID NO: 23619 - DNA, 68 bp, Chlorella protothecoides
cgcgcccttcctcgacaaagggaactgtcgaaagcatgacaaagaggggggcgccacccaacccccag

SEQ ID NO: 23620 - DNA, 61 bp, Chlorella protothecoides
agccaggcagaccctgaacagccacacaaaggccaccccacacaaagccacaagaattcct

SEQ ID NO: 23621 - DNA, 61 bp, Chlorella protothecoides
gccaccccacacaaagccacaagaattcctaccctgggtctccttgtacgtcagccacttg

SEQ ID NO: 23622 - DNA, 61 bp, Chlorella protothecoides
agtatcgtcgacttgtcacagcgatgggcaaaaacagccgcgaggatcggtcacggtcacc

SEQ ID NO: 23623 - DNA, 78 bp, Chlorella protothecoides
gccctgctggcgcccctgcggcaatggctgcctgaggctggcgatgacgagccccagcctgcagcagggcgtaagcat

SEQ ID NO: 23624 - DNA, 98 bp, Chlorella protothecoides
gtcccgctcctgatgagatatggggggggggactggtcagcctcctcatggcaccggtaaaactgtgcgcacacccacctgaagcatcagcagccccg

SEQ ID NO: 23625 - DNA, 78 bp, Chlorella protothecoides
caaacattgatgtcaaggtggaacctgacacccgggtccacacagcttgctcttcagccgctctcacactttccccta

SEQ ID NO: 23626 - DNA, 115 bp, Chlorella protothecoides
gccgctgcaaactcttcggctgaccctttgctctattcgatcgctacaaacatgattgtgacttgaatcgtatcgttcgagctggatcgtgcctcgattccgtgtaccgccttcc

SEQ ID NO: 23627 - DNA, 61 bp, Chlorella protothecoides
tcctgcatggtatggagagaagcggtttggtatctccccaggacctgtctgccgcttcctc

SEQ ID NO: 23628 - DNA, 61 bp, Chlorella protothecoides
cgcgacgatgcgaaagcagcttatcctcgcgcttaccctggtggccttggatatcgctcgg

SEQ ID NO: 23629 - DNA, 61 bp, Chlorella protothecoides
cgccttgggttggtgggagggacttggctttgggatcaacgggaggtcgatggctcactgg

SEQ ID NO: 23630 - DNA, 75 bp, Chlorella protothecoides
gtatagcgtccattaagaaacgcccattggtaaaaacattgaatgatcataatcgcaagacattgggactgcttg

SEQ ID NO: 23631 - DNA, 28949 bp, Chlorella protothecoides
  modified_base (100)..(109): a, c, t, g, unknown or other
  modified_base (198)..(207): a, c, t, g, unknown or other
  modified_base (787)..(796): a, c, t, g, unknown or other
  modified_base (1157)..(1166): a, c, t, g, unknown or other
  modified_base (2814)..(2823): a, c, t, g, unknown or other
  modified_base (4817)..(4826): a, c, t, g, unknown or other
  modified_base (4910)..(4919): a, c, t, g, unknown or other
  modified_base (5450)..(5459): a, c, t, g, unknown or other
  modified_base (6072)..(6081): a, c, t, g, unknown or other
  modified_base (7558)..(7567): a, c, t, g, unknown or other
  modified_base (7951)..(7960): a, c, t, g, unknown or other
  modified_base (8037)..(8046): a, c, t, g, unknown or other
  modified_base (8755)..(8805): a, c, t, g, unknown or other
  modified_base (9009)..(9018): a, c, t, g, unknown or other
  modified_base (9123)..(9224): a, c, t, g, unknown or other
  modified_base (9732)..(9741): a, c, t, g, unknown or other
  modified_base (11607)..(11616): a, c, t, g, unknown or other
  modified_base (12248)..(12311): a, c, t, g, unknown or other
  modified_base (12652)..(12661): a, c, t, g, unknown or other
  modified_base (13976)..(13985): a, c, t, g, unknown or other
  modified_base (15912)..(15921): a, c, t, g, unknown or other
  modified_base (16716)..(16725): a, c, t, g, unknown or other
  modified_base (17203)..(17212): a, c, t, g, unknown or other
  modified_base (17616)..(17625): a, c, t, g, unknown or other
  modified_base (18981)..(19035): a, c, t, g, unknown or other
  modified_base (19141)..(19150): a, c, t, g, unknown or other
  modified_base (19505)..(19694): a, c, t, g, unknown or other
  modified_base (20093)..(20102): a, c, t, g, unknown or other
  modified_base (20224)..(20233): a, c, t, g, unknown or other
  modified_base (20317)..(20326): a, c, t, g, unknown or other
  modified_base (21474)..(21483): a, c, t, g, unknown or other
  modified_base (23702)..(23711): a, c, t, g, unknown or other
  modified_base (24655)..(24664): a, c, t, g, unknown or other
  modified_base (26196)..(26205): a, c, t, g, unknown or other
  modified_base (27005)..(27014): a, c, t, g, unknown or other
  modified_base (27463)..(27472): a, c, t, g, unknown or other
  modified_base (27842)..(27851): a, c, t, g, unknown or other
gtgtaggtgagggagattaagggtcaggattgaggaagacgggtttgagatggcgaacacaagctaggcaacagtcctcaggtgaaggcgtccagcacgnnnnnnnnnntcttgcatcttgtcgcagaatgtgttgataagggaactttgatgctcgtgttccataggcgtgctggacgccttcacctgaggactgtnnnnnnnnnnaaggctgtgtcccggcatccggctgctgtcgagcagcagcatgcagggcgtgcagctgaatctccatttcacgcgtgagttcttccaggtcatggctcagaactggtggatgtgtaggtgagggagattaagggtcaggatggaggaagacgggttttgagatggcgaacacaagctagggaaacagtcctcaggtgaaggcgtccagcacgcttatggaacacgcgcatcaaagttccctcatcaacacattatacgacaagatgcaaggttcgatgggtggcgctgtgctgcctgacctcggactttttgccgatcggctcgaatggagggtatgtcgagatccgctcttggaaagccctgcaaggcggtacaacgggacggacgtcgcacgtaatcccatagcgtgtccaaggtggagtcttcgaatacctacaatgcatctgagtgcaccagtcacacctcacctcagcatccacaaggggtgcgtgaagtcctacgcctgaattctgcaggcgatagctgcaggtagcgatctcggcctctagttcctccttccgggattgaagtgccttcagcnnnnnnnnnngaggggtgcgtgaagtcctacgcctgagttctgcaggcgatagctgcaggtggcgatctcagcctctagctcctccttccgggattgaagtgccttcagcaccgttttgggatcctcttgggtcatgggaggatgagggttgtctctcagagtaactctttgtcagtgtttcacggagtgatcaccgtatggtgggacgcacggaggacgaaagcgacccgcaaagcccgctttggatcgcgtgattcaccaggatcaacgtcgcaacaataatgagaaccatatgccatgccgttggatttgttgagctcatacattgtggtgcccgtaatccttgccttccgtcgtcggtgtttcctgnnnnnnnnnnagaggtgacggctgtcgccccaggctctccggcagctggttccgggatgcagcccggggatcgcctcgtggcctttggcgatgtcagctctcagactccgcgcccagtggagggcatggcgcaggcgctgccgttgctcgctggacgggcggtgaggtgtgaggtcctgagggccggacgccctgtcacacttgccataactccagggccttgggcggggaagggcctgctgggagccacgctgatccttttgtcatgagttacagggtgcatgcccggttgctgtttgcccagttcctcttctgcgaggcgtcttggaccctgtctccctgaccaagacgtggggaggtctgcccctgctgcaatccttggcaattgcagcgatattacagctcacatgattcactgtgacaggggacaattgcaaccaattgagatctcatagtaatgcgctcgatacaaggaaggtaatttcagggaggaaaatcagcacgtgctcgagggcaacatgctacgaagtacagaaaggggctgcagcaaggttggccgtccaggccagcaaagcgtgtggagcagctgtttcggattgaaaatcggccacatactggcaaaacttattgtgcatgcgccagcccccgtcgggcatgcgcgtgacttgcaaggaagggaagttgcttatcttgatcttggagaagttgagcgtgccgtctctgtcccttttcacacgccacgggaacctgcagagggaagggggcgagggtgacggcggatcacacagcttcaacacattattccagaggcgaaagccgatgcatgtgccgacataggcatgcatggatcgaccaggaagaccaatttcccatgccctcacgtcatgcgggtcacaagtcgcagagggtcatcgtcggcagccagggtcaggccgttcgcaaggaagtagcggcgcatgagcgggccggaccccgtccaatgaggatccagcctcttccagtattcctcaacattctcattgaacctgtggtgtcggagagcgggtggtgtgtttcttcacggtgcggactgctcgcgagcgacgcccgtgcgcaagcctgcctgccagtagggtttcctcccctggcccagcccctcatttcacccacgtgaatatccaggtgaacgatgtgagctcctctactgttatggcggttcgcctggcctcagcgcgcaggagttgcacttgctgccataccggaagctctgtacagatgggcgtgctgtacacgattcctgacgcctcgttctccagaatcggtcgccatagggtatcaaggcgagcctccaccctccactggcgacacactgtggcgcagatggccaaggtgcgggcatccatgaaggcgaagcatctctgtaaaatgaaggcgggtgggggcgcgtttatggacgacttcctgcgcttgccacagggactcatatcgcttgctcaatcatatgaaacgaaccatatcgtgcattacggcgccgattattgcctggccagatgtgtacatcatctctcgcctccggggtcgcaccgaggaaaaataatttacgttgcggtgacggactcaattccctccgggccacgtggcccccccccccaaccggttcatgagacagggaagccagnnnnnnnnnnactccggggtcgcaccgaggaaaaataattgacgttgcgatgacggactcaattctctccgggccacgtggctcccctcccaaccggttcatgagacagggaagccagggggctcctgttgggtcccccagagagaataccaaatcctgagaacgccaatccctgcaccctgcaatttgaagcgaatcccatccagtaactgcggcatactatgatgagcctgaacatggcacctttgaggcgttgctgccatgcgtcgaggccgctggcaaggcatccccatgggttgttcccgaggcccgcatttacaaacattcgcccgcgcaggcctttacatttggcccgtgcggaacctgtgagtttgcggggaatgggcttgcccgacgagcagagccgaactctccagatcaaggatgttgtcgctccattgcccgacctgatgggaaccgtgacgtctcacgcccgctccgcttcctactggattccacccaacaggagaaggacgacaccgtcaaggaacagacagagaagacgaaggagggtctgaagaagcagggcatggatcccaagacggctaacaaagtgctgaaggcatggcgcgaggcggtgggcaaggacattgagccgggtgaccttcgcaaggtgagagcctggtcacgtaaatggcaggatcttatgctctgacctcctggacaggctttggcttgatctggccttccatggggcgggtgcaggatgcgagggccctctcatgtttcttaaggaagtataaactgagaatgcatccaggcacgctggccaccaaacatccacccgttcgtccctcccaacagctgctcacccagcaagcaggaaaggcctccttgtttgtgatcttccagatcctgctggacctggccgccgcctacggctcctttgtggcgggcagctacctgtcggccgccgccagccccggcgggatcgcaggcttcttcaccttcctgctgcaggccggcgccttcttcgtaaccgggtactacctgtcaggtacgcggtacagggtggaggaggacaatctagtcatgtccagatcaggggtggccaaatgcatggtttactccactctcggtgcctccgggcatgcttctcccgtcatggttggtggcaggctctccctgaaccatactgggtagcagtatgcccctacaacagctgcctttgtgactgatgttacaatcccaccccccacccttcaggtgctgtgtttgatgccttcaagctgggtgttctgctgtacagctccctccagttccagacaaattctggtgagcacaggaatgggcgtggtggtgtgaggttgggacccagcaggatccctccctggcactgcagtttgggaaatcgcaacaggtcatgcgatggagtgccgggagcccaggcaacagatcggcacctcagccccactctcaacacccctccacacactcccttcccactctccctaccatcagccgcgtacctggcagccctgcaagagattgcgggggatcagtccactgggctggccacggtggacaaggctcgcgaggcggtgaacagtgtcaaggtcctgggcgcgctgaaggagatccagggcctcctcaaggtgggactgggagctgttttgcatggccgcgttgcaagcaggcgccgtcacttcaccctgcatgcacccacagcgcctcctgttcagcaactgtccttcttatccctcctttccgcacagaacgagagccagggcggctcgaagacctccgatctcctggcggagctcagcgcctacatcaccctggaccgggcgtccaagtacggctttgacgccaagaagtacggaatcagcgaggaggagctgtcgcgagtggcctcggtcttcgcgcgctacgacaccaacgatgatggcgtgcttagcgtggatgagttccggggactctggtgggttgctgaggccaggggcggggggggggggaaagggacgnnnnnnnnnncgtccctcctttccgcgcagaacgagagccagggcggctcaaagacttccgacctcctggcggagctcagcgcctacatcaccnnnnnnnnnncgcaagctggcgcgggctcactctcggcagtcgcttgcggcgcccagatgcgcgagtggcttttagaacatgtgtctttcaaagaggaatcgcggctgccgcctggcgccaggggcttgggtgctttggggtctgaaaaaagcctacaggacatcatcagagctctacatggccttctgcccccccctctgtccctgcctgcagctcccggtatggcagcaccctgtcccaagaggaggtcaaggcggccctggacctgcttgacaccaacaaggacggtcgcatccagttcggggagtttgtggactggtgggttgagaagtcgggggtggagaccaaggcaactgcggcctagctcaaaggtgatcgcagttcacatgcgacagagagacccttgcccaggaacagcaccctcgtgttcttctgagtctgcactttccatgtggatcctttacgcctgtccctgatgagtagttcactagggagaacgtcgcaaataccttccagtcctgttgcttgcgagtcgcatgnnnnnnnnnngcccctgtccctgatgaatagttcacaagggagagcgtcgcaaatatcttccagtcctgttgcttgcgagtcgcatgccgtagcatgctctgagattgatgcttttgaaaggttgctcaacagatacgaggaaagactgacgaggacagtgtacaggctgaggtgatgcagcacgcagtgacatgtagagctgcgaaattcagcaaaggtcaagcgtggtgcagtccttggaaaccctggtaggacaggatcctgcgggtgcacgacacgaccaaccgggcatgtggtaggtcttggaagctgcgaagccatgcctgagaagcgggtggaggagtgatgccgtgacggcgcatgcacccacagcggctgtggctctggaccatgcgatggcacacccccccgccgcaacaagcgaggtaccttggtggaagacacggtgcctttgcccggcataccttgcgccaggggtgcgctggcttgggctctgagtgcctccactctggcactgcactgccgcacaggtctgtgcatcacgctcaggcgcccttgcaggctcctggtgcagcgcttctgaactcgagggaatcccgtgacccctcgcaccaggcctggnnnnnnnnnnaatgctcaggcgcctttgcaggcttctggtgcagcgcttctgaattcgagagaatcccgtgacccctcgcaccaggcctggccggggtggcgcagtggggacccagcatcatgccgcatgcatcctgaccgtctcctccgtcaggcccatgcgggccagggcatcacggaattcttttcgcatttcttggagctgtctgccctcctcccggatccgctccagcttgaggggctccagagcgtctgcctcatacgccaccctcacctccgtcctcaccatcgcccaatccacctccagcaccatctggaggggggcgagaggggtggtgttggcatgatgaggaagtcggcgcaggcacccagtgttccaacagccccggtccaagaggtggcctgtcgcctgctctttgcgagatccacacccgcgccccagtgcgggtcctccgttcctcgacgcctcgcacactgtgccgccctttcctcacccggtgcatggtcaggggcgtgcaccagacgtgggcggcgcacgcagccagcacagccgcatagtcggagggcaatgccacccagccatgtggacccagcttgccgatccatgtgtacgtgccgtcggcaaggggggtggagtcgggcggtgtggcccctggaccgccgggcgccgggcgcagagaggtgttggtgctgatgggtgccggggtttggggtgccggggtcgccggccagcccggtgcggtggcctgaaggcgccggccggccccggcctcgtcatcatcaccgccgtcgggcctccttgctgccgctgccccgctcgtcgcgtccgcatcgagcgcagtgccgaggaaggccctccccgcccgctcgagcagggcgcaggcctccgccaggtcctccgggcacgagtggccgacaaaatgcttgctccgcaggaaggccagccactccgccaggtcctctcgcggcatggccaggccctggtatgggggtgggggaaagggtgtggcgcaaacaagcaccctgcgccgatccggagggataggcacactggcgcagcccttcgcagacagggccccgattcgccgctcctgccagccccacatgctcatggggacacccatgtccccccagacttggcaccctttccttcaagccagcacacctcggccacattggtcgggccgacggtggcgccgcagcgccgagtcagcgcggccgccgcccagcgcacccagcccccttccggcggggccgcgccacgtttgtccccgcgccacgtctcgccccgccggccgtgcccgtccaggccgtagacgaagcgcagcgtgcacagcacgcaggccatgagcatggcccaggggtgctggggcgcgtggggccgcaggtgcatcgcacgcgacgccggcgggcagtgcaggctggccagttgctcgctggcttccgcgacgccgcacggcaggcccagctcgtgcctccatcggcannnnnnnnnncccggcgggcagtgcaggcgggccagctgctcgctggcttccgcgacgccgtgcggcaggcccagctcgtgcctccatcggcacagccacaggccggcgttcagggggggaaggggcaggcgcagcgcggccgccaggcgcagggcgccatgcatcagcgtcgccgcgttgggggcccctgtgtcgggcgggtggggtgggcgggatgccatcggcgctccaaaggccccggtggtgacgggagatgggtgcgtaccccaagccagcgcaccagcttccctggcaaatgacgccccatggtccaatgccaggactggaaaccctccctcctgcgttcagagactgcaccccctgggccgcccacctgcgcgggccaggtagagnnnnnnnnnnctcgagggtcacatgtggcgccaggacctgcggtgggggccgggagggaagggaggcgtcggtgccgtcatgtgcgnnnnnnnnnngtgccaggacgggaaaccctccctcctgtgttcagagactgcaccctcagggccgcccacctgcgcgggccaggtagaggcggctgatgagggcgcggtagggggccatgaactcctcggagtccgccgccagggtgaggaatgggaggcgcccgctggccgcgctgcgcgtgatgtcgtgcgggctgaccgctgccctggcggtccaagcggccaggaagcagagttcgagggtcacgtgtggcgccaggacctgcgggggggggggccgggatggaagggaggcgtcggtgccgtcatgtgcgacaggggcgaggctggagtgagtttcaggcctggcgcggtgccaggcacctgcacgtctggagctctcctcgacgacaagccctgggagcagaaacaatgagtatgcacacccacacgaccattgccgcacccgtgacagcgtggtcatgaagagccaagcggggccatgcagattcctgccatggatgccgcctgccctctccttggcatccagctcgtgcactcgctgtgtcaggtccctgatggttgagtaagagcagggtcaaaggggggaaagggatgaacacacgagtgaattcaagcgatgcaatggcccgggccatgttggacttgagcagaggcccaaaaggcagctgggtcgtcctcaaaaaagcatggccccaatggactcgatgcccccacnnnnnnnnnnnnnnnnnnnnnnnnnnnnnnnnnnnnnnnnnnnnnnnnnnnccgagctcctccaccaggaccttggcttgtcgctgcgcggcagtttgcagccagaagggtgggaatagggtgttggagaggctcaggcctgcctgttacacaatccaagcgatggctgttaaactgtcgcaaacaactggctgatcagccacacgctcggctcccaccccctaacgctcttgccaggaccccagcacctgcagnnnnnnnnnngctctccctgtacccactggcagaattcggggtggagcaggcgggagtggttcaggcagcggtaccacagggaccgcagcaggggcatgacgccggggtcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacaatccaagcggtggctgttaggccgtcgcaaacaactggctcatcagccacacgctcggctcctaaccccgtacgctcttgccaggaccccagcacctgcagcaggtgctggaggatttccacataggctcgcagagactccttcacgggcaacgccgttctttcctgcacagcccccgactctctggtcttcttgagacccctgcgacagagcgggagggatactgtcgtatcctgggcatctttcaacccacattgctgccatcctcatgtgcatggtcagacatcagtcttgaaacccttctacctctgggtggtccgttgcgagggtcccccctcgaactcctccgtcagttgagtgaagccctgtggcgttaaaaaagcttgaattatatcacaatccgattgacctcggagcacctctccttctgtcagtgataatcgatgccatgacaatctttcgcaccaaatacactcaatcacctggtcgacagagccgcagnnnnnnnnnngaaaaagcttgaattacatcacaatccgattgacctcggcgcacctctccttctctcagtgataatcgatgccatggaaatctgtcgcaccagattcactcaatcacctggtcgacagagccgcagacgtcgcacaccagcatgccttcctggagctccatatggccctgccagcagacctggcacagcgccccatcctcctgcatgcctgccctcccttacatggacagcaatcgagaataaaatgggtagcatggcaggggagtcgcgcaactttgttccactctttgtttcgtatgcgtttgaaacgcagggctgggtctgcggtggcgagcaatcagtggggaaggcaggaaaggcaggaaatcgccttctggatcgcggaaggtcctgggacgccagcccacgcgtgttcatcatgtgcatgcagggaatgccgagtgaccatcattgtgccccacagagtgctgcaggctcctggtaaggctcgaacgacatacaacacagaatgagcgctcgttgccatgtcttccagcctcgtgcgagccttgctccgcatggaaaggggaccaggctgagcctccacagaaactttgcaggcaaggaaatgggatcatgcactgagatgggggcatctcgcactggatccgtggctgtggcaacacccgcatggcctgtcatgcaccctctctcccccttcccctccaccagcaggcactcggctgccccctctccagcatgctcgggccccgcgggcttccccggtcgctgtacaggccaacctcttcggcagggtggttcgcatcgtcaagtcctacaccagcgccctaggttagttgggtgcgatctgcagctctgtgtgcatggggtactgagggagggccctgttccaatcgattgcccactccaccgccgcacccctccccttcacctcttcccgcgcagtgggcgggctggaggaccccgagaagatcctggagcaggcggtctccgacatgcagaacgaccttattcggctgcgccaggcggccgcggaggtgacggccgcgcagaagcggctgcagaacaagcgggacatggcggctcagaccgcggacgagtggtaccgccgcgcagagctggcgctgagcaagggcgacgaggagctggcgcgagaggcgctgacgcggcgcaaggcccacgcggccacggccacccagctggagggccagctggcgcagcagaccaaggcggtgagcaccatcatgggcaacatgaagatgctggaaggaaagctgcaggaggctaagctgaagaaggacacgctgaaggcgcgggcgcagagcgccaagtccgctcgccagatccaggacatggtggggcaagggaagggatggggccatggcgagtcatcgtgtgtgtgtgtgtgtgtttgtgggatacctgagtatggcagggtggatgggtgacatgtggcttccgcagcacctgcacatacgtgtgccgcctcctcactctgtttccccatctccaaaatcctctcgcaattgcaggtggcggggctgaataccagcagcgccctcggtgcattcgagaagatggaggagaaggtgatggccatggagtccgaggccgaggcggccaccatggtgagctgtggttgggggggttggggggggagccggggcagggaaagcgttgtttggtctggatgagaagtgcgaaagcgtgatgacctgacaaggcatgcccaagaggcccctttaccactggtcctccatctgagggcgctgatgggatcgctcactggcatgctggctgtggcggtttcgtagtggtgctgggagtgttgaagtttaagctgtacgtatgtatgtatgtgtgtgnnnnnnnnnnggcgtgatgacctgacaaggcatgcccaaggggcccctttaccactggtccttcatttgagggcgctgatgggatcgctcactggcatgctggctgcggcggttttgtagcggtgctgggggtgttgaaggttaagctgtacgtatgtatgtatgtgtgtgattcggctcctgctaccactctgagcggatgcagtctggtggcctgagttggtgcctttgttccacatctgaattaccaccctcatatcacaccaatgtacgcagctggcgtcccctgacgatgggctggagtccaagttccagcagctggaggctgggaatgtggaggatgacctgtcagagctgcggcgcagcctgggcaccagcaagcccaagcagcaggtgagctgggcagctgcctgcattcagagcgtcagctgagggaggaatcgcagccagaggctatggtggctacagaacctgggctggggggactggagtgggagtgtacttcaatcaaggtgcttaccatgtgttcatcaccacaaacccctcctccactaagatcacatcgtcacccccacagcagctccctcctggccggcctgtgcgggatgccatcgactttgagctggatgagatgcggcgcannnnnnnnnnnnnnnnnnnnnnnnnnnnnnnnnnnnnnnnnnnnnnnnnnnnnnnnnnnnnnnncgaacctgcatgcagcactccagcaagtggcagccccgcaagcgggggctcagctccgcatcctcgccctcatttgcgcccctgtaagtacacctccctgacttccaagtcgctgagttgatccagtaattctttgcaacccccttgcatctgctcccgctcgctgctctcccaagtttctgcacagaaaacccttctccttgcatgtatactccaaaaaatgccagtcatgaaatcatcgggtgtcatcagtgttggggggatgctcggggccccaatatcatgctggaatcaaccaatgaaggagcttggcagatggtgcaaggggtgaatgcggtgcnnnnnnnnnnaggggccccaatgtcatgctggaatcaatcaatgaaggagctcggcagatggtgcaaggggtgaatgcggtgcagcatcctgttcttaccctcaaagcctttgccactgcggttcaaacagtgtgaaggatgtccttccgtgcgtcttacattcaatgccaccgtgggtcgcttgacctcctgatgggattcctcatggagcataaacagatgggtctatgaccatggggcagtcaaggtcgtttgagcaacgaggtaataggaaccattcaacgctgaggatacaatatcatcccctggaaaggggcctcaagtctgtgcgacattgtgggaaggggggagcaacgcaatgcagcaggacagtggatcacctcacgcaagataggtaatttcgctcttctcggaacagttggcagcgaagaattgaagcgtgacagggtcacacgaaaactaatatcgcctggcagcccaggaggattgggagctcgaaatgctggaaaaattgggtgacggcataataccagtccattcagcagtgcacccaggtggactgcacaaaagtgagtgggagcagggacataaaactccggcttgcgtgtgcagctggactgacgccctgccctccgtgcagcgagaattgtggcgcgacgggcggctggcccacggcggtcggccgacggcctgtcctggccaaaaattgtgggacgattagctgtgacgagcaaagaatggaaagagagggggtgggggacggcagtcttcaggaagcgctgcacgcttgtccggcgccgaccccaggatcgccagaggggctcctccaaggcgccgtcaggccaccaggctgcccctgcggcgcagcgcgcgcagcacggcgccgtggtccagagtcaaaccgatgggcagggcggcggggcgctcctgcacgcactgcgccagctggcgcgagagggagggggggcagacatcgcccgtctgccccagctcccactccatgtcggtcagcgagccctcggactgaaaggccaggctgggggccatgctgggggggggggtgggcatcatcatgtagggggacgtgccggcgctgccggcgtcgtggtatgcccagccctctgcatccaggtgcggggtggagcaggagctcaccagtgcgccgcactcgcgctccctgagagtacgggggtcaggaggaggaaggtttggtgagttcaaggctgggggtcagaggcgcgagcttgatcagacaggaaccatccttccttcggcaacactgcaaagcgttgcagatacttcgcactcatccctcttccccgannnnnnnnnnaagaggcacgagcttgatcagaaaggaaccgtccttccttcggcagcactgcaaagcgttgaagatacttcgcactcatccctcttccccgagcacgacctgctgctcgcacacgggcactccctcccccacttgccaggcactcgtccttgcctgtgcctgaacttctgcaggtggctggcaatgttggcccgcgtgaggccccagccccactggcccatgccctccaggatcttggtggggacttgctggtccacgggcagggacctgacgaccccggcaaacaccatgtggagttctcgcgtccactccacctgtgggcggtcgaggggaggcatgcatggggttcatgcgttccttgagaagaggggcgccacaggcacaaggatcagcgagcgactgcttgaacaggtgcacaaactgcgacctccagtgcggctgttggaaagatattgcgctctgaaggaggggtcctctacgcgctgaatgcaaagctgcagcatcatcgatgccccctggttcccaggaagaaatgacagccacaaggtgaccaaacccaacattttttgcccttcatcaggcctcctatgcctgctgaccttggctcgtttggcattgggattggcctcctcctcctccttcccggaatgagggccggggtggtcatggatgaggagcatgttcaaggcaggtgcacagggctccacacagtgcatctccgcctgaaaggggggtcagggggggtacatggcttgagaaacaatggtacatcctcatagggagcctggcccatcgctgctgagagtctgggatcctgtctgcggaacatatggcactcctccacaaaaaccccatttccacgcgaagccctgcctacctgaagggagggggtgcccaggctgtcgaagctgtactcggatcgctgcacagccgagctgggagacgacaggccggaacatagttcgccgcagtgccatacgcccggatccatagtgggcagcgcagtaatcagatcgacctgcggacggcagtgcacaggagtacaatcattatactgaggcgggactcactaaaccgttaccctgcagccatgcgctcatatgcaggcgcgttgcacaagggttcggggggaggtgctctccacgtgtcccagcatggggccccaccgacgtcctgctcgcccgacaccggccgatcggcagcctccctcacctcgaagctcatctccggctggatttcgctgatggggggtagagaggtgtgcaaatgcttccaacacgccaaggaggggctccaatgcctctcggaacaggccagtgtcggcaggaaatctatgagaggcaagggatgtcggcggccaaaacccgtctacccggaagtctgagcaaacgcaaacgggtcgctagaagtgacaagtgcccaaatacgtttgcggtggaggtcgcaagggctttaatgaggtgtcagcatggaggacggagctgtctatatcgcgaggtacaatcccctacggcgcacagacctagatctttcaggagactcgatgtaaccctgggcgggtctgtctgacgcttgtgtcgcaggaagtccgttgaagccgacgctcacctgctcgtcgggtccaggatcgtcccgtgtttgcgcgggaaatggagcaacgtgatcaaagtgtggctcctcaccggattctgagccacaagtttttggagattcgtttgacccggtggaactcgtacggtgttaaacgagtgctggtagctaggccgaaagattggccaccctcgcccccgtcggcacgaccccgacacacagtccaagacgatcctcatactcgaagaaatggggcagaccccgacctcattacaccgcattgtttaacagcgcattgcatgcacccgtgcgccctcaaaagttgccccttgcgaannnnnnnnnntctcattacaccgccttgtttaatagcgcattgtattcacacgtgcgccctcaaaagttgccccttgcgaactgcaggagcccgttgcggggcatgaaggccggaggggtccctatgatgccatccacgatgccaagctccttgctctcctctgctcccaggaaatgctccctgtcgcactcctcctccaccttgtccatgggcagtccagtgtactcagccaggaagctgtgggtggggcattgcaggtggtagggattcgagggaacgctagggagcacatctgagcgagtcatccgcctcccaacccagcaggattgcccagaagctgacacagaagcagtcgctgtccgtgaccaccatcccgggctccacacgcacgtgtacatgagctgcatggtgcggttgagctccgtggcttggatattgacctcatctgcggaccccatggcgcccccattgggctgctgcagcatcacccgtgaattcgccatgatgaagcgccgccccttggcgccgcctgccagcagcaccgccaccgccccacccaccatgcccaccccaatggtggagacaggagcctgcatggcccggatggtgtccaggatgccggtgatggcgtagggggagcccgcgccagcgttgatgtagagccggatctcctcgttggggttgatggagtccagcgccagcagggatgccaccacctggggcgaggaggggtgggttggggttgtggagcatggagggatcgatgaggaggaggggaggggagagtgaagagcccgacactgnnnnnnnnnnctgtggagcatgggagggatcgatgaaaaggtggggaggggagagtgaagagcccgacactgcctggatggcacgacaaggacagtccagagatgcacgaagcacgggccacatcagatccctgacaactccaagcaactttatcaacacgattccccttgcctgggtggccacggcgtcgttgacgcgcttgccgaccatgatgatgcggttctggagcatgtagccatacaggtctatcgcatcgccctgctgagggctgagctggatgtagggcgggatgatggggtcttgcaccctgcgggactgggcaatcaggccagcgccgaggggcctgcaataggaaggatggcagggtgggagggagatggtcttgagggttctgccagcagcgcggtgatgcaggcagcatcaaacacacatgcgatggggataggagactcacaatgagcctgaaatcatgattgatagaatggtnnnnnnnnnngacacacatgcaatggcgataggagactcacactgagcctgaaatcatgattgatagaatggtgtgtgtagaaaacagcgactcacggggtacaggggctgagggaaggggtgaagggtctgggcatggccctgggagccagacgaccagcaccatgcctggtacaaccggccgccgtgctcgagtgtgcagccatggcaccgaccatggacgcggtgtggccgcggggctcacagcagtctcctcggtggaggctcagatggatggcccgtcaccagcccaagcgcgcttcactccagtccgggactccagtctcagaagagcaagcacttggggactctggtttccgtgattgagtcttaacttgatggcgcatctcagccgatgcggcccgtgggtggagnnnnnnnnnncctcagaagagcaagcacttggggaacctggtttccgtgattgagtcttaagttgatggcacatctcagccgatgcggcccgtgggtggagagatgggcgatgggggccatgggcgatgttgggggtggcaggggactcacaccacggcatcctttcctggccgtgcggcgaaaggatgggagccattaggtcgaaccttctctgcctcgtgtggcactcgtcagagggccaggaggacactctgatagggtaaataatcattctgatcaatcatggcgacgctggggtctgttagccccgtgggggtcccggcagcctgcaggctgccccgcctggccactgccttccggcccttcaccccgacagcagcgagggccatgcccctggtgcggcccagcactttccgagcggaggtttctctcatcgtgttgacttgctctggcacaggtgatgaccgcatgttgcgcgaccgctacccaccccgcccccctgcccaacccctgccacagatgcagcagcagcagcagagcgctcagcggctggcccggcccctcacgcgactggcggcctcctcctcccccgatgcgcttgcgacaggcagccccccccccgcggacaccgcggccaaggagcctgcactcaagggcgaggcccacctgcgcttcgtgcgtggctcccccctcaaggtgggtgcgctggtgacggcgcatctgcacagcagcctcagctccctcgtcgaggttccccagtgcctggggtggatggagtgctgcaccgccacgctccccagccttggttcatggccccccttgtgccaacccctgcccaccaggtgcggcgcgtgctggaccagattcgtgggcgcagctacgaggaggccatcatgatcctggagtacatgccctaccgcgcttgcgagcccatcctggccaccctcctgtcggccgccgccaacgccaagcacaacctgggcgccaagaaggcggcgctgttcgtgcacgaggcctttgcggacggcggaccgtccatgaagcgagcaatgccgcgagcgcagggcagggccgaccgcatcctcaagcccaccttccacctgaccatccgccttcagactcgggcggggcgggcatgatggtgtgggttatggttttgtgggttccttgtacatcactgttgtcctgacgcgagtcaaaatcagaagagagtgtgtgtgtgtgtttttttgggggggggtttaagcaaaccagaagtgggatggaagggtccaggggtgaaccagccagaggcgggctggtgagcagacttcagtacccaaggggtggatccctcgccgcacatggcgccaaagccgccccccnnnnnnnnnnnnnnnnnnnnnnnnnnnnnnnnnnnnnnnnnnnnnnnnnnnnnnnccgcccgccctcggcgccgcggccaccgtccgcgccgcaataccgcgtcttgaggaaggcccagatcgcgcgcagggccagcgcctccccgccctcgggccgcccnnnnnnnnnntcgcccgccctcggcgccgcggccgccgtccgcgccgccataccgcgccttgaggaaggcccagatcgcgcgcaaggccagcgcctccccgccctcgggccgccccggccgcggcttcaggttccaacccatggtgtccaagtgcacccagggggactccgccggcgcaaactctttcaggaacagcgcggcggtgatggcgccgcccaggccaccgccctcggggcaggacagcaggtccgccaccggcgagcgcagcgcgtgggcgtagggcgcgtgcagcggcaggcgccagagcgggtcccccgtcgctgccgcggcggcggccagccccgccgccgcggcctcgtcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgagcgtcgccgcgtccagcaccagatccggggcggcgccggcgccgcccgccgccccctcccccgcggcggccagcgcgtcggccaggatcagccgcccctccgcgtcggtattgcccacctccacgctgcgcccagcgcgcgagcgcagcacgtcccctggccggaagctggcggggcccaccgcattctccaccgcggggacgagcacgcgcaggcgcactgggagctgggcctgccaggtgagggcggggctgtgtgagcatgcgcagcgtgcgcaaaaggcgtttgtggacgtggagggggggggggtccgccttccacgcgcaaccagactcccccagggattcctccttcccacctgacccccacctgcatgatgacgtgggccaggccnnnnnnnnnngtgcgcagcacgcgtttgtggatgtggatgggggggggtcgccttccacgtgcaaccagactcccccagggattcctcctttccacctgatccccacctgcatgatgacgtgggccaggccnnnnnnnnnngggggtgggatgcgaggggatgaacggcgaatgagtgaggcctgcagcgcggtctggccgcgctgggaagagcaaggtagggannnnnnnnnncaggacgagcgctgcgccgcccatgtccttcttcatcagccgcatgccggcggcgggcttgatgttgaggccaccggagtcgaacgtcacgcccttgcccaccagcacgagcagggggagggaggcgctctggggcgcaggctgccacctggtaggggtggtatgcaaggggatgagcggcgagtgaggcaggcctgcagcgcggcctggccgcgctgggaagagcaaggtaggaaaagcctgggccccccccccccttcatcccgtacctgaggtccaggaggtgtggggggcaggctgcggcccggccgactgcgtgcaccatgggaaagaaggaatcggcgtgcagcaggtcgtccccgctgaccacgctgagggacgcgccggggtgtttggccgccagggcctccgcctcggctgcgaggtgagctggagctgcagaggtcaggaggggaggggcaggggaggaggtttggtgagtcagacggggagggcatgccgccccagcgagcggagcaccccgcacccagccagccagaccgtctgatctgaagacctgcgtcgctcacagggcggacagcatgctgacggaaccacacccaggcgctcagagctccactcagcaacgactccgaccctctgcgctgggcaagtctgcactcactgaggtcctcggcaggggtgttgatgaggtcccggaccaggtagatggccgccgccaggagaccagcctcctcctgggcgggggaggggggcaccacgagccgccgaggcgctgtggccgcctttctggccgcctcgtccttgtaccgaaggaaggagtagcgctccagggcccaggccagcgaggccgtcgcctcccagtccggcgcctggcggcccgggccgggccgcagcgcatacgaccctggcggcagggtgctggggagcccggccaccgcccaggggccttccatgctttctatggccaccagggcctcgtgccggtcggagtcgggtgtctgggggtgggatgggttggagtgacagctggcatgctggtgttgggagaggggaggatcaggacgcaccaccgcatggggtcgacgagttctcgtcatgcgccgccccaccggtggcagtccctgcccttgctgtgccccaccagnnnnnnnnnntgcaccaccgcatggggtcgacgagttgtcgtcatgcgccgccccactggtagcagtccctgcccttgctgtgccccaccagggatgggaggtgggccatcttgcggtctttggggtcaaatccgatgcctctcagccaggctctacggctctcgggctgctccctcagccagtgctcataggtgccctccgtgaccaggtgcaggggcgtgtggctggcagtgctagaggtcagcacatgctcctcggctcgcaggcgctggtcaaagttcgagtacacttcttgaccagatggcgatgcggctgtggcatgcacccaacaggtctgtcgcccgtgcattctgcgagagccggtgcaaacgacagaaggacgagtgagaagcacgcttcgcgcgatgctgcacaaggatgtggagcgcatatctagcaccactggccgttttgtttcggcctgcccaatgactctacaatcattcgaatattggaagtgatctgggtcgtgccatggcactgatgctgtgatctgtatcgcgcgtggatccgcggccaaggccgaaaaccacgagcactcagctttgaaaagccgctccattcccgcacacacagagcgtcgagagtcctttacagaaattatctgcaacctctcctctactgcctagccagctcaagattcctttctgccatggccaaagtctggatcggtgcgtacgagggtgggcgggcgtgctcccgcagcgcaggggatgcttcctgcccatgattcaatgtattggactcacccccaaagtgagaacgcgtttgtgtgtccgacgcaggcaaccttcccgagggtatcccggagcgggacgtcgaggacgagtttagccggtttggggtgctgcgtaaggtctgggtggcccgcaggccctctggatttggtgagcatggaggcattgggtgaggtgtgggtacgaacggcgctggtggactgcctcgtcagcttggcctcccgcatcgtcgtccttcgctcccgcgctcctcttcggcaccacgcccgccttccaccgtccctccacgagctccatgccacgaggttgagcgcactgcatgccggttgccggcgctgctcgtctgagaggcagggcgacactcttgctggtgaacctctccggccctgtgtcggggtcatgcgcggtcaccctccttccacacgcctgctcctgcagcctttgtggagtttgaggacgcacgggatgccgacgatgcaattcggaagctggacggcttccagggatggcgtgtggagctgagcagggggccgcgcggcgacggccccgcccgacgagggggctttggcggcggtggcaggctctacggcagggatctgaggtgcgtgtgggaaggctcttcccaatctgggagctcgtatcattactgggagccacgttgggaatcaaactggcgtggggtgcaccactggcaggatgctttgaatggaagccgcagtgcatacaaaagctgtcggattccaagggatgttgctaccagggtcatctataaggcccggcctgcatatatatatcttaaaaagactctgatctgttcttcttcctcccaacagccctcctcgcggccgacggtcccccagtcccttgcgccgccggggctccccagtctatgagcctgcccgtggccgcggctccccttcgtacgagccagtgaggggccggaggtcgccctcctatgagccggtgatgcgcaggcgttcgccatcctacgagcccgttgcgcgtaggcgttccccatcctacgagcccgtagcgcgtaggcgctcgccatcgccccgtcgacggcgtgactccaggtgagggaggctgggaatggccgtgcgggtgcctgagcttgcaagacgccccagctgcgttcctcagaagtctgctcatggatctctcaatgcaccccttgggtccaggtcacctgtgaggagggcacgcagccgctcccctctccccgctagacagaggagcccatacccctgagcattgggctagggatgccgtgcaaggtaaccgtgtcatgaccagccctcactgacattgtaaaaaagcatccagcttgaacatggtcaggattatgagagcgcctgcaggttttgtgttccatcgaggggcctgccgcgctatccgcgcaatgaggagcggtttcgcctctggccggctccctgcgtagccaccgaggcnnnnnnnnnnccgtgttcctttcgaggggcctgccgcgctgtccgcgcaatgaggagcggtttcgccgctggccggctccctgcgtagccaccgaggcacacccgacaacatcctcgcgcagcgcgggcaaggctgggaacggccccggcctgggactgtggaactaaatcgtaccctagattgatcggaggtctctcgcagccagcatcgagagtgcgaggcctgcaaccccatgtgcgggagtcttggcaaggagcgcgcattgaccatgccagccttcagagtgtgacagacgctccgtactgacatccaagggatcgaagggtatacttcgacatgacagacacgcctacggcgcgaaggtgggtgggtggctgcatgtcgatggaccttacgaaggcttcatgccggtgccaacctccgagacgctcggtccctgtccccatcccagacgccgagccccttttggagttcagttcaatgccctcacccgcaagaatctggcattccaggtcagtcttggtctgcgattcggcgggttgcaaccccgccaggctcctcgggcaactccccggcctgcatggttcgtccagtcgaccctggacccccaaccccaatgacacagaaacggcgctggggcaccaatctcctcctcgtcgccgcccccttctttatttgcgccctgctctggattctgcaaaatgtgataaaccggcagctggactcaagatccttcaagtgcggctgtcgctgcctgtcctgctgcgactggctccccaccccaggtaaagtcgttccccctcaatgctgtgggacaaggttgctgtcccgatttatgccccaagcttccttcaggcatactgcatgtgattgagccgcctgcgagctctgcaaacctcgcccacccgccctcacccctactggcgctctcaacccactgcagccaactactnnnnnnnnnntttcgtcccccctcaatgctgtgggacaaagttggtgtcccaatttgtgccccaagcttcctttaggcatactgcatgtgattgagccgcctgcaacctctgcaagcctcgcccacccgccctcgcccctaccggcgctctcaacccactgcagccaactactcggccgacctcccgccctacacataccaatgctatgaggccggccctgccctgccctgctcgccgtatgcagactgcagcgcctacgacgacaacgactgcggctacctgtcctccacggcagaccaagtcgggtactgcgcggtaccgcagccaccgctctggcctgcgctactcagcgtccccgccccgcccgccgccggcacggccgccagtggaaatgtggtccagcccctgctcttcacaggttaggggccggggttcaccgtggggataaggcacattgcctttccatctgtggacgcactgtcacagtgtttatgtaggggcgcgcaccacccccttgctcacactcttggccagctgcctcctgcaaggcccccctaccccacaccctctcccataggcaaggaccaggagctggcgacgcagctgatggcgtccatgtggtctcgccccgacaccatctcggccgcggtggctgccgccgcgctctccagctcagccggggggggtgcctccctgccctcctccgcgcccactaccgaagcccagttcgtggaggccacggccgcgctggcgtcgggcctgcaccagtttgggctggtgctgggcacgcaggcaggcaccagcatttccctgctcatggagccggcctttgtggcccagggcagcgaggacggtgcgtcggttgaggggccagcgcctgtgggcctgtgggttgtgggggtgaatcgggaagctgtcccgccaatgcggtcgccagagcctgaccctaccgactcctcccgaggtcctctcccttccgtgcacgcgcccacccgcccacccacccctcttcgaggcgcagatgcgcccgtgaagccatctctgtacttcagcatgggcaactgtagcagcctgtcggctgcggaccaggccgcgctggcgggcatcggtgagagcatcactaacatgactgggttccccgtggcctgcgcctccctccccggcacctggtgaggcggggaccgggctggggaagcgtaggagggcagatgctgcccatggtcaatctgcgcgcagtcccgttgatccacaggtacgacacacacatgatggctcgccatcctcacttgggatcctgcaggcaggacaccccggcggacatgattagcgccgtgtactgcggctgggcggcggccgactgcgtggtcgtggacggcgtgcgcaggtcggctgaccccggccgcacctccaagcggtgagacgtcgggcagggggaccaggcgactgcaggggctcggaagtgatggcagggggggggcatgggcaaggtttgccgggggagagtgtgggtgtggggcctttgttgccagaatcagctgccnnnnnnnnnnagcgactgcaggggcttggaagtgatggcagggggggggcctgggcaaggtttgccgggggagagtgtgggcgtggggcctttgttgccagaatcagctgccatacttggtgtgccaccggggggttgcctgcgtgtaagattccagcgtcctcctcgcagggctgtgcccccctggtgccacccactcatgcccctcaccccaggcacccaccacgccccctccccacccccctcccatccaccgcagggagtttgcctcggggctgtacgactggcgcgacacctcccgcagcgccatgcgcgtcgcggtgtgggtgaacaactcggacgttgccagccgcgccggcggcccgcccgacgtccagcgctggaaccagcccctaaacctggcctccggtgctttcttgagggcggctcggggccccggcgcctccgccagcctgactggggtcaaggacatgccgcgcgggtcgtcccgcctgtccctggacttctcctccctcctgggcccgctgttcatgatgtggttcatgcagatgctgctccccgtcaacgtctacagcctggtgcacgaaaaagaggagaacctgcgcatgatgatgaagatgcaggcgagtcggtcgcgcgggggcctggcgtgctggggtggtggagcgggggggtgggagccccgtggatcctggcgacgacccccagtccagaacctgtgcgtgctgcacgctggtgccaccaaggacaaacccttgtggaggtttgatccccccataacaacactccccacgcccaacagggcctgcnnnnnnnnnnccgacccccattccagaacctgtgcgtgctgcacgttggtgccaccgaggacaaaccattgtggaggtttgatccccccatgacaacactccccacgcccaacagggcctgcgggacggcgtgtactttgcggtgcagtacatctggatggtgctgctgtactgcatcttcatgggcgtgtttgtgctggtgggcgggggcatcggcctcaagatcttcaccatgaactcctacagcctccaggtgggggttgcgtggtgttggtcctgggcgagcgggtacagctgggtctcatctggccgtgctggggccggccaggcgacagaatgatccgtccctgacactgctgtgcccccgcctgcgacaccgctcagctggcgcccccatccctctcacacgcccctttccctccaccccggccaggccgtgttctacctcatctggggcannnnnnnnnntacaccgctcagctggcgcccccatctctcacacacgcccctttccctccacccctgccaggccgtgttctacctcatctggggcaacctgctggcctcctggtccctgtacttctcctcgctttccaggaacgcccgctccgcggtgctcacctccaccgtcatgatcatcgtgacggggtttgtggccaacctcgtcctggtgcaggtgccctgggcccgggtggaaagagaggaaaggggggaggcagggtcgtgtggagagggcgctgaggggaggcaccaaggctgccatgccccgccgacgctgcggaccaccgattccttctttccaccctgccacactcccatgcaccccctgggcagtacnnnnnnnnnnaccgacgctgcggaccaccgactccttctttcacacctaccacactcccatgcaccccctgggcagtacgtggagcatgggccggcggtggtggcacgcatcctgcagctcctcccctccttcgcgctgttcagaggtcaggacggggctgggatggcccaaactgccggggctggggtgcaggagcgggaggcccagcgcacccagcgcagccgcgcctcaacccccccatccccccacaccgattgcccaccaccttgcacctgccgccgccaccgcaggtctgtatgagctggcccagtacgccttcctggcggaccgcaacggcggacccggcatgacgtgggcctccctgcgcgacccggacaacggcatgctgaccgtgtggattatcctgctggtcgagtgggcggtgctgccctgggtgagtgcagggctcttgggaaagacccacgggccagactcggagggcgtttcatggggcccctgcaacatcggcagactctggcaggcgacaggcctggcgcgctgcaggcccaccgccgccccctgcacacccctccccccacctatcaaagcaacacccacacacaccttcatccccctttgcctccccaccaggtggcgctgtacatcgaggcggtgcggggcacggggacgggcgtgcgcaagcaccccttctttttcctgggcctgaaataccggaccgaagccggcccccgtggcgctgctggaggcggcggcacagaggccaacaagtcgccgaggaaggtctgggcctggggcgggcgcacggcctcgccgcacctcccgggcaagggccccgccttccggcccggcgctgccgaggcgggcgcggacctgtcccgcagccagagcggcatctccaccgcctcctcctccttctcctccacgacgggcgcgctggaccgcggcgcgccctcccccggcgacgcgctggcgcactactacggctccgagcccggtgcggcgctgagcccccagctggcgcgcggtgtctcctccctgtccaaccccgaggcgctgcagactctggcggccgtgctggcgggccgcatcggggacggcgcacggcgc

SEQ ID NO: 23632 - DNA, 6753 bp, Chlorella protothecoides
  modified_base (1134)..(1219): a, c, t, g, unknown or other
caccttcccccccgccaccacccccaaccgccccacaggcgagggcagcgcccaccacgtggtcagccagcgcgacatcgtctttggcatgctgctgatcatcatgtcgcaatgcgtgcaggccgcccagctcaccttcgaggaccatttcatggtgtgcggcgtgggtgggcagggtttctcatgttgttgggtggggtagtctgatggacctggctcggccagctgctccgacactccccacaaagcatgggcagaccattgcacggcctcagcaaggcagcttgatcttgcactgcaccttgtcctttcccccttgccagtcgatcccctgtcgtgctcggagtacaccccttccccttcccatcgatacacactcgcccaaatggaacccccctccatgccccatcaacagtccaacatggcggtgccgcccctgaagattgtgggtttcgagggcgtgtttggcttcttggccatgaccctggtgctcatgcccgtggtccagttcctgcccggcagggagggccagggcatccacgaggactccctggacacactgtacatgctatggcacaccccctccatcctggcggtggtgctgctggacctggtcgccctgctgggcctcaacatctccggcatgtgcgtgacgggccacttcggcgccgtcttccgcacagtgctggaaaccacgcgcacactggcggtgtggctggtgggccttctgctctactacacccccctgggccggggccacctgggcgagtcctggaacgcctactcctggatccaggccaccggcttcgtggtgctggtggcggggacagtggtgtacggccgcggcgacgacgtggagatcgcggaggagggcctgcaggccgaatactcggacgcgctgctgccctcgcccgccggcaccggcgcggcggccatgcccgtgtcccgccgcatcgtcacgcctaccgccatccccatctccagcagcctcaagtccaccatgaacatctccgccttctccatgcccagctccatgggtcgcagcgcgggcttccggcacaggtgggagtggctgagaatgggtgtgctggtgtttgtgtctggtgtgggtggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnngaagggacagtgcacaagacacaactctgggagggaagggcggtggtgtaccatccaggaggggctatggccgctggtatcgatgtgcggggcgattggcagcccggaaggccggggccccaccactccggctgcaccccctgctcctctggagcagggcgtcaggtgttcctgtacacactcgctgttctgctaccctgactcttacaactccctgccactgcagggacatcccagtgaacaacggcggcatcgcttgaggggcgaggccgcgtgtttttcagaggtcacccagcatccccatccaggagccggccggctcgccactaccgggcggagggccgagactctgctgtgatgcttccaaaacccatgtcacacccccttccttgtgctaatcaacttccttcctcagggagcacggcacagctagatcggaggtcaggcatggggtagaggggcggcactgaacgagcagtcgcagctcgtcacagctctgtaggggtagaagtagtatagtcatggcagaattctggtttcgggcggtgcgataccgcgtcgcaagccgtgcggtgatcgggcaggaagcaacatgaaggggagatgattgacgcgggtgccggggagggcaggagggttcgacgagtagcgagtgcaaatcagatctcaccacgcgaaccccttcacacggtaacgtcaccgactcgataatactccggaaggcgccacagtaaaccccttatcgactaaatatccacattaacatcccatagaagtgcacgtaatcaagcgccatcgatcacctcgtgaagtcgggctgtcgagaatgcatctgccggccttcatgggcaactgttacagcggtcgtgcgggagcgccgaagagccccaaggcccgcccagccgcccgtttagccacaggcgacatggtatttcttcaaggtgagagtgtaggagcagcatgcgcctcgtcagctgcggtacggggaggggagacgtcacgtgtcgtaaaggggtccagaggtctgcaatgcccatcgccgagggcgtggtgtacactttggtgcgtggtattagtaccttggcatgtgtcctgaggcttgcgacgcgagacgccatcgctcgcctgggcttgtcgagcagattccgctcacgtagcattcgcgccgatttcgcagaggaaggtgccaaggagctttatctcctccgcacacatgacggctggacggccttcagccactgcggcttcgtggtgagctggggtgcactctcacatatgtcacggcgtacttgctcagcctacttgtctcagccactagagtgcggttctgaacatcatgcccgtcctgcattctctgtcagatgcgccgaggatctggcgctgcaggcgtgctgttctgtcacgcagaccttgtgtctggcccagacggtgtgcgacgcgtcgcagcagaaccgctggcagagctcctggcaagcggtgggtacccccttgtctgggactccaggctcttgcacacctctccttctcgaatgggcgtgggagtggcgatgaccatgcacatgctcgtccgcagcatcattagtgtgggtgttgtcttaacattcatcccccgggcctcaagttccccccactcctctcacctcctgcaggtcacttcacccaagccgtggcccgccagctgcgtgtcaccctcacccccgaccagcgcgacctgttgagcgagttcgtgagcctgaacctgggcaagcgcagcgtcaccaccaccgcctccgtgtgcatgactgccggcagccccctcatcccgcgcggcactgagaggtggggcagtgcaatgcatcgtgggatgggagagggagttggtacatttgctgactgtggcgtgaggtatgcccatcggagctacaaattcccagtgggaggaatctacagtcaacatttgagatccacccccccctcccccgtcaccatcgtcacagactgctgtgtagcgagtttgtggcgctgatgctgcacctcctgggcctggcggagccagacatgccggcatccttcacctacatcgccacggcggcttccgggcagctgctgcacccgccggtgcggctggaccaggggctggggggctcaccgcgcagcccacaccgccggatggactccgtcaggaggcagagcacgggggcgatgccgccctccctcgtcgaagcgcaccggggcgtagaggtcgcggccgccacctgaagctcgcccgagtgcgagcgagttttgcggcatgggacggcagggtaggtcccagccctgtacccgctgcgcccctcgcacacagcacccaccgcgtagtatctgctaccttggtagcgccctggaataagcacgcgtggcagtggtatgccccagacgtgcgctcctgaagttttgccccttgttttgcacttggtacccgctacgtgggatgccctttctttcattgcccttaccctgtgcctctacccaaaactgcacaatccctcctttgttgtacaaagcaatgcatcagtctcgcaggcaggggcgtatgacgctggagatgaagaggacggcaaacacccccacctctgtccacatgagggccaccgtggtccgtcgccacccatcttctggcaggtcgctgtcgttgctgttcttggtgacgatggaggatgcaatgatccacctgtgcggagtggtgacatgaagatatgtgtggcaagaaggcaaggggttagcaaggggttttgggcccatgcgcaagccaagaagtactggccaaggcgccgcactcaccaggcagtgccagcagcggcaaagatggtgtccaggatggcgcccaggccgcagaggtggcatgtacagcactggaccagggagatgacgaaggagacgagcactgacactcctaccacagcaaacctgtttggatgtatacggtgggagaaaggggttgttagccgggtgactagggaatggagaatgcagtggcagggcacaaatatctcatgcaatatgactcacacataaacgcagaggctttcgttgtcgtagtcttcgccaaggaggcatgtggaggtgacggtggggtcctccccatcgcctgagacgtccacccggaacagcttgatgccgacaatgacagcgatggccacggcgagtgcgatctgtgcgacacaaacacgtgagcaagaatcaggaggcaaactcaggcgcgggtgggttcacagcacaagggaacctggttcccacacacctgcacgaacgcggcgacatggtgaacgatggtgcaccccacgcccatgcttgatgtcgcaagcacgttctgcaaacactacaaatggtacctcttgttctcaaatagaaaatgcgagaaggatggattgtgttcctaggatggtatgctttcaaacgcggcaaatgtcggcgagattccgggtcctgccggatgggagctagctatagaaccgtacggcatgacacatcggtttcgaagcaattcaccctcacgccagtgcagggtctcatgttgctttataacttaatctcctatgatatggggttcggccactgtgctcatcacccgtgttgtggggagagatgggaaggcttccttgccatgctgctgggcatgatggcagccagccccggccactaatctgcccggaacgctcccctctgaacacctcggctgggatgaagtcgcgacttcaagttagtcagagtcaacataataaccgaggagagaaatccaggaatggcttgaccgcccgatcgatcctgcatcctcctcatgcaaggggtgtcctgtttccagaggctggtgccctgcccatgccgaaccgtcttccagccgatccataccaagagtctcaggaaacctcaggtcggcttggtgaggcgagctgtccccccaaccaagcgggaagtggacgcctccgagacggccactaaagacgggcgaccagatgaggccatgatgcccgccctgcagggcgaggatgcagcggcattcagcctggaggatcagagcctttcctcatgggtcaaattttccgtgctgttggcaggcgtcttcgccctgctctaccccgtgagaggggtgggaacgggggggggtggatggatttgggtgccccccctctgagggttgcctcctggatgccatgggtgactattctgacgactgccggctcggaggaggatggaccctgcaacccaggccggactctagcacgtcatccccctcacacccaccaacagatctggatctccccggatacggggctgggcaaggaactggctgcccttctgagctcggtggggtcctcctccgaggtcaccatggtcctcatcctgaccctgtttggcgtggtgcacagcggtctggctgccctgcgaccacaaggtgagctggagctttcggcagtggtggggaggcgcggggtgtggactcggcagagtgccacccctggggtgaaggagggcgtggctggcggcggggtggggagttacgggctttgatggttgcaggagcgtgtcgtggattgtcctattgccagcagctgtctcaggcgccgcttcgtccgcaagaccactttggagctgatgatccacgacggtcccagaatccgctggcacactcgcaccaccggcatcaatcccgccaccacacacacacaggtgaagcgctgatcggcgcccgggccttcagggtggtcttcgcctccctcagcctgccgttggcaggcctggcggtaatgtacttcatcaatcatcgttacgacggcgtcgcgctctggaacatcaggcgcgtttgtgttctgtggggcatgttgggcttgaagggttgtgctggcggggcatgtcccttagatgccagggtcaaggcacatgcatctcggttctgcatgcccctcagcgtgtcgactcccttgcccacccacaagagtgcctttaaccccccccaccctcccaaacacgcacgccacaccatgcccaggggcctgcccggcgtgcacagcacggtgtgggcactgagttttctctccttctacttcctctacccctccaccttcaacctgctggaggtggcggcggtggacgagccgcgcctgcacctgtgggagaccggcgtggcgcgcatcacgcgccacccgcaggcctttggccagttcgtgtggtgcgccgcgcacgccgcctgggtgggctcctccttcatgatggtcaccaccgctgcgctgctgggctaccacgcctttggctgctggcacggcgaccgccggctggagcgggagcatggcgaggccttccgcgcactgcgagaccgcaccagcgtggtgcccttccaggcggtgtgggaggggcgccagcgcctgccgcccgactactggagggagtgggcgcgcctgccctacctggccatcaccctgttctgcttcgggacctacgccgcgcaccctgccatgcagcaggccgcctactggctggggtggtagtgaagggacgggggggggggggggggggggggg

SEQ ID NO: 23633 - DNA, 62 bp, Chlorella protothecoides
cgcagggcaagctcggcatggaccgacaccgaccatgccgcgatcttgtacgcgctggatgt

SEQ ID NO: 23634 - DNA, 225 bp, Chlorella protothecoides
cccaaacccaaacccaaacccaaaccctaacccaaacccaaacctaaaactaaacctaaaaacctaaaactaaacctaaacctaacccttagcctccacgtccgttctcatcctcactcacacaaccatccacgctctcctgtatgtcctcactcacagacacctgcttacatgtgtattttacaaggacaaaatctcacacatgcaccttcccactactagaaa

SEQ ID NO: 23635 - DNA, 64 bp, Chlorella protothecoides
gtatgcccgggcgctcgtcgaaggtagcgaggaggcgagcaccgcagtgcggcttcctactgca

SEQ ID NO: 23636 - DNA, 255 bp, Chlorella protothecoides
tcgttcggttacacagggcactggtgaatatgtcgtcagtcggtcggggtggtctataggtcaggaaaggacaagtgcgttggggcctcgcgctgggggtgaggatgcaatgcgggtgtggggccggatcgaggatgcgctgatgcagcacggggacatcgatgatcagcagcgcctggcggtctgaatcctcttgtactgtcggccagtcgaaccactccgctctctcccagcggcaggacccgaatctcaagc

SEQ ID NO: 23637 - DNA, 61 bp, Chlorella protothecoides
tctgtcacaaggcaatctcaacaagttaccactcctgcccccacagcaaatcattgatgac

SEQ ID NO: 23638 - DNA, 61 bp, Chlorella protothecoides
ttctcatcgtttcaaaacctccttttgcccaccccccccaacacacactcaggtgtacgtg

SEQ ID NO: 23639 - DNA, 75 bp, Chlorella protothecoides
gcacagtacgcgaccgctgctcgctccgcgacctggtgagttgtatggggagggagtgggggactccagtaaatg

SEQ ID NO: 23640 - DNA, 65 bp, Chlorella protothecoides
gccacaacgccatcgtggtcttcgtcgaccgcttttccaaaatggtgcactatgcgcccaccacc

SEQ ID NO: 23641 - DNA, 73 bp, Chlorella protothecoides
ggtgggggatggggaggccgtggtgggggaccagacgccagcaggtgacggcgccgcggtgggggatggggag

SEQ ID NO: 23642 - DNA, 61 bp, Chlorella protothecoides
ggccttgttgggatagtcctctgagaacgccaatgtcaggaggaagacacctgggatgaca

SEQ ID NO: 23643 - DNA, 108 bp, Chlorella protothecoides
gtgggaacacatgacggcttgaatccctatgaaggatcaatttgtccagaactattcggatgagtgtcgcatatccagggtgtggctggacacctggggcctctctca

SEQ ID NO: 23644 - DNA, 61 bp, Chlorella protothecoides
ctgccgctcctccacgtacgcccgccagtcagcaggtgcctccttcagctgcgacacgccc

SEQ ID NO: 23645 - DNA, 425 bp, Chlorella protothecoides
ccctaaccctaaccctaaggtggtaaaagttatagggtcctgcaaggctctgtgaagagcagtctgtaatatgtgtgcgtcacatccagccctggcagatggccaacagtaaatatcacacatgggatggctgacgactggtctctctgctgatggtctaccatggctagcactacatgtgcaacagagatggtaaagctctgcaggacacatcaagctctccagatggccatctgtgatatctgtttccctgcatgtctacctggcatcagggggaccaggaatatcgccgaagagccaatacacggcgtgcatgggtgccatcagtcaaccactactgtgacgttttagtgtctaaacatggtatttgttggcgggtttgtgtcatgcttgtaccggacaatctgagatattctgcctccctg

SEQ ID NO: 23646 - DNA, 61 bp, Chlorella protothecoides
ccagggcaccgagtaggcaaaggagatgaagctgccgatcagcgccagccccgtgagttgc

SEQ ID NO: 23647 - DNA, 79 bp, Chlorella protothecoides
atcagccgcaacctgcggcacgaccggcccttcaccctcagcatggctaacgccgggcccaacaccaacggctcgcagg

SEQ ID NO: 23648 - DNA, 61 bp, Chlorella protothecoides
acgccgggcccaacaccaacggctcgcaggggcgtttgtgtgtttgtatgtttcgtggggg

SEQ ID NO: 23649 - DNA, 219 bp, Chlorella protothecoides
gctgatgttcaatgctcagtcctacccatcgggcaaatttccgggaaatggttgatataatgttcgatatcgtgagattccggagaatttcgagcttaaacccgcggtatcgaaagtttcatgctggatcacataaggcgcgcacgagctgtcctcggtccacccctccacgataggccatcgctccatagtccactccaaccctatgtcttggatatc

SEQ ID NO: 23650 - DNA, 63 bp, Chlorella protothecoides
ttgatcatctttgcgcaccatcgcagaggaggaatcgatgccgttgagcctcgagcctcatga

SEQ ID NO: 23651 - DNA, 71 bp, Chlorella protothecoides
ccagccaccgcaatatacatacctttctgcattgtcttccagcatgtccaacacccccttcaggtgttgag

SEQ ID NO: 23652 - DNA, 80 bp, Chlorella protothecoides
ccgcccgcagttcaggcctgtgggttgggtatttgtacataggggggggggagggtcgtctgaggtgatgccaggggtcg

SEQ ID NO: 23653 - DNA, 65 bp, Chlorella protothecoides
ccccctgacgcacagactcggcctcagccacaccaagccgacgcatgacatcacccagcatcatc

SEQ ID NO: 23654 - DNA, 73 bp, Chlorella protothecoides
ccccccccgccgaatcccctgcatcccccacccaccccctgcgctgggtgtatgtgtgtggtaaactttttct

SEQ ID NO: 23655 - DNA, 726 bp, Chlorella protothecoides
actgtccatgtcagccatccgtgtgagcaatttggaaatcctgtcagctcgatccacgttgatccttacagccgtcgagtgtctgaagccgggccagaaggcgtgtggcagacagcaatggcaacattggctccgacaacaagggcaagaacaactttggcaccaacaacaccgggagtgataacattggtgagcagggggggggggggcaaaaagcatgcaggatgtgcacagctgctgcatgctcaagttgaatagcctgatgtatgatacaagcctaccttctgcaggtaattccaatgcgggcaacgccaactgggggaacaacaacaacggcatgggcaatcgttgcttcaacaagacagggatcaccaaggtcatcaataactgcaacctgcttgagttccgcaaatatgcttgggtccttagcttcccgccgccacccgtcaagaagtcgccgccgccacccgccaagaagtcgccaccgccacccgccaagaagtcgccaccgccacccgtcaagaagtcgccaccgccacccgtcaagaagtccccaccaccacccgccaagaagtcgccacccccacccactaggaagtctccgccaccaccctccaagatgcctcctccgcccccatccaagaagtctccgcctccacccacttcctctcctccgcccagcccctctcctccaccgagccctcctccctcaccccccccaccacc

SEQ ID NO: 23656 - DNA, 73 bp, Chlorella protothecoides
cgcgcagaaccagaggtcgtcctgggcgggtgcctcgggcacgccatagcagctctggtgcacggtcagcccg

SEQ ID NO: 23657 - DNA, 78 bp, Chlorella protothecoides
gggaggtgggtgagcaagcgcggctcctgggtgcctcggcgccaggcgcagacctggactcgggaaccttgggtgcct

SEQ ID NO: 23658 - DNA, 162 bp, Chlorella protothecoides
cgccgcctcactgtacgccaagacgtcctccagcaggtggggtcggaggtgaaaagggcaccggagggttggcgcagcttgtggatgtaatggggggttggacaccatgacgagggctggcttttcgtggaaggggatgcacaattggccatgatcaggttg

SEQ ID NO: 23659 - DNA, 68 bp, Chlorella protothecoides
tgtgtgtgtgtgtgcgcgcaggggtgcgggtggggggagcctgaggggaagggtggtgtgtatgtgtg

SEQ ID NO: 23660 - DNA, 132 bp, Chlorella protothecoides
caggaaggggagtgatggcctgctctccgccgcagagtcccctgcaaaccagaccaagtgttgcactgaggtgcacccattttgggcgtgtcccctctgaataccaaatttatcacacattgtggctctcct

SEQ ID NO: 23661 - DNA, 135 bp, Chlorella protothecoides
gtagcactgcggcagtgtgtctgtgctagaatttgcattgtggtttgctgtcagcaagatgtggtggccttttggatttcgtgtcaagctcaggctgcatacccctccttcctcatgcggaccacgattcacgcg

SEQ ID NO: 23662 - DNA, 110 bp, Chlorella protothecoides
acatccaagaatagtcagccttcgaccggcgatacttataaaaaggtataaacacgcccggaaggtgtggtcgataatacaacggtggtatgccacccagtgtacccctt

SEQ ID NO: 23663 - DNA, 118 bp, Chlorella protothecoides
aggagggccacgtgagaacctgaagccgtctcactgttccctacctctcagcatcccccccccctgcaaacttccatgtgcaggagcagccccgatctgcggccaggcctctgcgaca

SEQ ID NO: 23664 - DNA, 61 bp, Chlorella protothecoides
tcgggtggcaggcttcctgtccggcacctccacagaggggaacggagcccgtccctggagg

SEQ ID NO: 23665 - DNA, 76 bp, Chlorella protothecoides
cccagcatgcttggcagtgctggcagcatgatgacggtgccgctcctggtccactcctgcacgtctcgcctcctcc

SEQ ID NO: 23666 - DNA, 137 bp, Chlorella protothecoides
cgggctacgcgcccatccccacgcagtagggccgggaacctggtcccccctacacgcgccgagcgtcccgggtctggcgcaccagctccgctcctccgctgccaccctgcgcggatcggcgccggccgcggcactcg

SEQ ID NO: 23667 - DNA, 80 bp, Chlorella protothecoides
acggtgagtcatgagggtgggatgtggccaggagagtcagagggccggacgtggcggagcatggctcccacacctccaga

SEQ ID NO: 23668 - DNA, 79 bp, Chlorella protothecoides
gcccatgggctgctgaggggggttgcatcctagggaagggggggcgaggcgtgaggcggcctgacctggtgcacgcatc

SEQ ID NO: 23669 - DNA, 80 bp, Chlorella protothecoides
acacaggcatctcggctctctctaaggtattgaggccttatagctgcaaactcctgtctcaaccagccaggaggtatgcg

SEQ ID NO: 23670 - DNA, 80 bp, Chlorella protothecoides
cccccccccccccccccccccaaacaaaaggaaagaaaccacacgtataccctgcaggtcggcggcggcacggtgggcgc

SEQ ID NO: 23671 - DNA, 427 bp, Chlorella protothecoides
actgcagcttctgaaacttggccagggtctccccggggaaggggcacagaagggcctcgcctacgcacgtggccagagacgagcctgagtagcagcggcggcaacgccgcacatccacacgctgctgtctcccacggcagtccgcacgccggggggagcacagctccatccgatacctaggcacagcaacacatggaccccccacctctctcttcgcaccctctagattgagctggaccaggttcccgctggaatcgcagatgctgccgtccataaggcacaggtccagcagggcggcagccccagagcgcgtggccgcggccttccaggccgggcaggccgaggtcccgccgcagcaggcgtcaaacaggctctgcgcggcgtcctgctgatcgttggtaatctgggtggcgttgagcgcggcgtc

SEQ ID NO: 23672 - DNA, 73 bp, Chlorella protothecoides
gggcatctggtagcggggggtaggggcccacacctgggtgccatggtcgggagggaggagtcaggccggcaat

SEQ ID NO: 23673 - DNA, 541 bp, Chlorella protothecoides
atccttgtccttgcacccacacgtaaacccgggttccatggcagggatctcaagttcgaggctaacacatcggcaaagcgacgagatggtactgtacgaccaaaaggcgccttcggtgaagaatatccacaagcaattccttctcacgcgacgtttgcttccaccaaggatcaagggtgagacactttacagcttaaagacatttcctactctttgcggtatggcgttggaagttgcattgttagtaccttgcttcaatcctactattcatgccgcgcagggtttcagtagttgggactcacgctgacgctctgttgatagattcagacggtttacctcatgttggctgcccaatctggccgggacagccctactacaacgcgaaggagacgctcactggttccaacaaagctggaaagctgaagggagaagaaacggccatcatagaacaagtcaccgtcatagggggtggtaaaggagcagacatcaagcaagcctccatcaagatgaggttcaacagaaatccagtcattggtgcgcc

SEQ ID NO: 23674 - DNA, 62 bp, Chlorella protothecoides
gttcaacagaaatccagtcattggtgcgccatgtggggccatgtccatgaagtatcctggaa

SEQ ID NO: 23675 - DNA, 61 bp, Chlorella protothecoides
cgttgatcacggtacggcagcgcttggaggggatgcatttgctaggtgtcaaacactttgt

SEQ ID NO: 23676 - DNA, 191 bp, Chlorella protothecoides
gagctggagcaggtgagggaggagtgagactgagaaggagagattttatcatttgtctgtggccatgctcaaggagacacctgtgaattttgcgtggagggcctctgtctctgacgggccggggggagcttcggaatgaccgccctggtgcccaatcccatatcaggagcgcaaggacctgatcaggaaga

SEQ ID NO: 23677 - DNA, 68 bp, Chlorella protothecoides
tctggtgccatgtcacggaggtagtagtccttcggcatgtattgcggcgattgtggctggatggcgcg

SEQ ID NO: 23678 - DNA, 104 bp, Chlorella protothecoides
gaggagacgtgaccgaactgctcaccatcatttttacacctcagacttctccgggggttagggttagggttaggtttagttttaggttagggttagggttaggg

SEQ ID NO: 23679 - DNA, 109 bp, Chlorella protothecoides
cgcagtggggtcatgggcatgccgcagatcttgagcatacacctcactcacgccggcctggatagatatctgcaggccgtgcccctgccaacgcaaatagccccaatcc

SEQ ID NO: 23680 - DNA, 73 bp, Chlorella protothecoides
cctgtttgccacgctggggccggggccgggcccgccggtcatcgccctggtcctgggcagccacgcgccgccg

SEQ ID NO: 23681 - DNA, 453 bp, Chlorella protothecoides
  modified_base (126)..(264): a, c, t, g, unknown or other
gctggccgccctcccctcccgtgctgtattcggatcgcatcattcaggattgcgatgggtgtgtctgtggccggcgcatgccgacattcacctgacggtgaggtgccctggtgcccgtcctcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggcgatgaccacgcacatgagcgatgaggtcgagcgtatcacttgttcacgtcgttccgaaggctgtcgatgtcgagcgcacatctcttcaccctgattagtaatgctctttgtacgtctccatggcaaccctgtctgctgagcctgcgtgatgaccctcccccccaacctctggcgtcttggggct

SEQ ID NO: 23682 - DNA, 211 bp, Chlorella protothecoides
ctcctgggtccagatcctttgccgctgaggagcctgacctgggtgagttgtgctggccgccacgtctgtgggagctctgttatctgaaacaatcttgctgccgctcgggccttcgctcaaggcatcgggctccgtattgccctcgtcacgcatttctgatgccaccacggcccggtagaatgcgcggtctgcgtcaccgacggccgccatc

SEQ ID NO: 23683 - DNA, 1147 bp, Chlorella protothecoides
  modified_base (161)..(362): a, c, t, g, unknown or other
agtgccctgccagctgcacaataagagtgccccttcctaccagcgtgaggtccttttagaacggggtgacaggaatctggtatgccattcctcattcgtgtgtgcgccatggggcacccatcaccgggccgtcaggccccttacaagccaagcccccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttggtgtatccttggggtgggattgaagccttcacccccagtcagtactcctaacaaccccatcttgggccctgaccttgcccgccttgcagagaaactcacaggagtcaatcgagcgccttgacgtggtgccagaagtgacacggatggtccacttctagtcttaagtctcagtgagccaccttcagaacgaatgagttcgtgtgcgacataaagcagcgaaatcttggaaaaagtgagccagagcattgccacatcaccaaaatctgtagcacaggagccctgtggcaatcggaaagggcaccctggtggcttgtgggaggtaccccagcctggcctggcatggagcatgacgtccacgattttgtctgcaattgaaatgcctgtcagcggagcaagcccaacaagggacgtaagactggcctcctgcgcctcttgcctaggccgtaagccctccaataagccgtgatccaggtccaggttgctggaactagccagccccttaaacagggtgatggggatcgatgggctaatcaaggatgggacatcaggatggaaagataacacatctgccagcagacgagatcgggtagttcagaggtcaagcttatgaccagtgtgaggttgaattttgaatcttgagcggctcatacaatataaaaggctggatcactcaagcttaaagttcaaccagcacaatgcccataccctggacacatcaaggattaccctgtgaactccaggattagggaagagtgcaagctggagctagtaacaaagatg

SEQ ID NO: 23684 - DNA, 266 bp, Chlorella protothecoides
ccgccccgccacccattaaaccccccacgcctctcacctcgggcacgtcctcgccatctcccgcacccgccaggaacccggctcggcgcagggagcgcgacatgcgctcgcgcagggcctgggcctctgccagcatgtccggcggcagcgtggccagcagcgcctcgtcagcgctgcggcggggtgtgtgtgtgtacgggtggggtgggggggggcaagggcgcgtgtgcgttgccgggtgaggggcgcagcggggtcctgggatt

SEQ ID NO: 23685 - DNA, 67 bp, Chlorella protothecoides
ctcctgcagacatgtgtcagtgctgtgcagagtcacctggagagctgcatgccgagctgcaccacaa

SEQ ID NO: 23686 - DNA, 245 bp, Chlorella protothecoides
tcgcgcacgccttcgctgtgggggtggcacgcatgtgtgtgtgtgtgtatttgttcagcatcaatgagcaggtgtacagcatggcaggcggaatgcggcgcctacccccccccttcccccctccccatggtgcagagaatgatattccagcaatgctgtgaccaggagagcaaaaaccccttccccttgcaaaacacatccacacccacaggcacgcacctgtcggcgatcaggacgacctcggt

SEQ ID NO: 23687 - DNA, 79 bp, Chlorella protothecoides
ccgccccacccctccattcgcgcgtgcggcatacgactgcacatgcgatccctgcgcaggtactgcaagcggcccgcca

SEQ ID NO: 23688 - DNA, 175 bp, Chlorella protothecoides
gtgagagtcggcatcagtgaggcacgagggggtgcctggtcttgctcctgcactgtttcgatgcacacgggcgccgaggcagcagaaaacgttgttctccatggcgctggtcatgcctcgcaccaataagaacccccctccctcgagcccacagcctcacatccgagccggggag

SEQ ID NO: 23689 - DNA, 72 bp, Chlorella protothecoides
tgcatgcatgctgcggtcatgacgccatcatgctctagtatgggtccgacaccacgatcgtattgccacggg

SEQ ID NO: 23690 - DNA, 76 bp, Chlorella protothecoides
taccctggagacttggtcaatgggcttgctgccgggaccgttctccggtcgggaatccatcgcagacgaaacgact

SEQ ID NO: 23691 - DNA, 61 bp, Chlorella protothecoides
gagttgtgcctcccatgcacagctgcagtgaacacctaagctagccatgtgacctttatat

SEQ ID NO: 23692 - DNA, 61 bp, Chlorella protothecoides
cctctatcgatgcgtgtttggggtgcgcaatccctgtttgggtcatgggcccagccctgct

SEQ ID NO: 23693 - DNA, 256 bp, Chlorella protothecoides
gacacaagtcatacttgttcctgttgcatgtagtccataggggtgttggcatggtcggcacgaactgagtgtgggatcggtccggccgagactcggttgtcgacgtatgcgattgcccgctgtaacaagaccgggatgggctgaggtggcttacgagactctctgcactgagtgctctctcaaaaccagtatgtgggctggaatggctcacttaatacgcagccagttggagttgcgagcatgatgaggtacaacc

SEQ ID NO: 23694 - DNA, 79 bp, Chlorella protothecoides
ggagctcctccatgatttatggaacgtcattaacatcagctgcaacctgagcacgtgacatcaaggtaaacatgattga

SEQ ID NO: 23695 - DNA, 74 bp, Chlorella protothecoides
ggcgcaagaaggcatgcccctccacggtttcctcctgcaccgcctcgagagcccggcgcactgcctggagaaga

SEQ ID NO: 23696 - DNA, 143 bp, Chlorella protothecoides
cctacctgggcattgtcgagtgtctgccggaaggagtgtcaaagtgtgagagctgggacaccacaatcgaggacacgattggcacaggcaacgaaggaagtgctaactggggtaacaacaactttggccaagaaaaccatggt

SEQ ID NO: 23697 - DNA, 125 bp, Chlorella protothecoides
acagtggaggatctacactgacatgggacggaacctggctgcgcaggtgggttgaacagctggttggttgcatggatttccgatctttctgtagagaggttgctgtctgtggtgccctatttgcg

SEQ ID NO: 23698 - DNA, 75 bp, Chlorella protothecoides
tcctattagaggtgtgtgttttgtgttgggggttctggggatggcaattcttcgtgctgcgtctggctttgcacc

SEQ ID NO: 23699 - DNA, 79 bp, Chlorella protothecoides
agacagtgctaccgcgtactgcaagtaggagcagagcagtactgcattgaagtatatgcaagcgactttgaataccggg

SEQ ID NO: 23700 - DNA, 136 bp, Chlorella protothecoides
cttcttgaggaaccagtgagaagagggtggattggatttctatttcatcttctagagcgtgaaacctgtataaggcattaaaatatgtggcatgtgctctctgtgtcacgcagcgggatgtgatccgactgaggaa

SEQ ID NO: 23701 - DNA, 61 bp, Chlorella protothecoides
cttctcaaggtgccctgcggccccttcactaccagccacgaatactcgcacctccacggcc

SEQ ID NO: 23702 - DNA, 61 bp, Chlorella protothecoides
gaccgggatatccccagcgcgactgcttttactcccttcaaggctttcttgagccacccga

SEQ ID NO: 23703 - DNA, 61 bp, Chlorella protothecoides
tcacaaactgtaggtgctcggtgactacgcaacaacctctgtcaagacgacctggaacggc

SEQ ID NO: 23704 - DNA, 88 bp, Chlorella protothecoides
cacaggagacccacctggcgaaaaatatctggtcgaatggttgcagtgccgcatccgcgtctgcctggccagcctgcttccgccgctc

SEQ ID NO: 23705 - DNA, 133 bp, Chlorella protothecoides
ataacgtcgtagtcacacgttttgtattattaagtctcacgattccgagattgtaaacgtgacgttgagctctggggcactctgtgtatttctcgttgagagggcgagcatcccaacactgcattagctcggg

SEQ ID NO: 23706 - DNA, 79 bp, Chlorella protothecoides
cagatcacatacgtggtgatcagtctgaagcatcacagaatttgaaggctttgccgagagtcacatgtaactcttatca

SEQ ID NO: 23707 - DNA, 116 bp, Chlorella protothecoides
cccggcatttgctctcccggcaatccagaacagctataaaccgcaaatactgcacatgtgaaccaactcgagcattgcaggagcatcgcctacccaccatcgatgcctctcagtct

SEQ ID NO: 23708 - DNA, 26225 bp, Chlorella protothecoides
  modified_base (958)..(967): a, c, t, g, unknown or other
  modified_base (1647)..(1656): a, c, t, g, unknown or other
  modified_base (2225)..(2234): a, c, t, g, unknown or other
  modified_base (3045)..(3054): a, c, t, g, unknown or other
  modified_base (3106)..(3115): a, c, t, g, unknown or other
  modified_base (3175)..(3184): a, c, t, g, unknown or other
  modified_base (3374)..(3391): a, c, t, g, unknown or other
  modified_base (4325)..(4334): a, c, t, g, unknown or other
  modified_base (4482)..(4530): a, c, t, g, unknown or other
  modified_base (4691)..(4700): a, c, t, g, unknown or other
  modified_base (5450)..(5529): a, c, t, g, unknown or other
  modified_base (8201)..(8210): a, c, t, g, unknown or other
  modified_base (8619)..(8628): a, c, t, g, unknown or other
  modified_base (8892)..(8901): a, c, t, g, unknown or other
  modified_base (9088)..(9206): a, c, t, g, unknown or other
  modified_base (10319)..(10408): a, c, t, g, unknown or other
  modified_base (10799)..(10808): a, c, t, g, unknown or other
  modified_base (11875)..(11884): a, c, t, g, unknown or other
  modified_base (12083)..(12092): a, c, t, g, unknown or other
  modified_base (12266)..(12275): a, c, t, g, unknown or other
  modified_base (12471)..(12480): a, c, t, g, unknown or other
  modified_base (12960)..(12969): a, c, t, g, unknown or other
  modified_base (13625)..(13634): a, c, t, g, unknown or other
  modified_base (15150)..(15159): a, c, t, g, unknown or other
  modified_base (15621)..(15630): a, c, t, g, unknown or other
  modified_base (15811)..(15820): a, c, t, g, unknown or other
  modified_base (16296)..(16305): a, c, t, g, unknown or other
  modified_base (17496)..(17505): a, c, t, g, unknown or other
  modified_base (18207)..(18216): a, c, t, g, unknown or other
  modified_base (18918)..(18927): a, c, t, g, unknown or other
  modified_base (19665)..(19674): a, c, t, g, unknown or other
  modified_base (20353)..(20362): a, c, t, g, unknown or other
  modified_base (20779)..(20788): a, c, t, g, unknown or other
gtggggtgggtgggtgggtggtaggagcgggaggaggtagggtttggccagcgctggcagggccagccagggcccaggcactcctcaggccagccttcccccctcgccacccccacacctggagcccggggtcgcgcaggttgtaccctgccagcgtcttcagcagcgtggtcttgcccgagccgggcgggcccagcagcagggtcagcacgcccggcctcaacacgccgctgacgttgtcgatgatggggtagctggtggtctccggcgccttgccgatggccttcagcaggggctgcagaggttgataggacggggaggcgaatggaggggggggcctgggggtgggggaggcatggcagcgcatcgtgcaggggaggcccgtgccctggaggccagcaaagcagctgtcctggtgagcccaaaagacgggatcataatcccacacacaccacacacacactcacaagccccacccccccagggaactccgtcacccaccccggtcatgcgtttgacaaagttggtgagggtgggcaccgactggtctcccactatgatggtggtcagcaccgagaggttctggtagcggaccaccaccaccggcggctggatgcccgccttgtccatgcgcgcgcgcagcttctgcaggatcaccaggttgctccccgtgtcctcctccgccaggctctccagcagctccccccgcgtgtggcgatccatcttgcgcgtgtccagcaccttgacagatccctgtcgcggtgaaggaaaggacggcacggggtaagagggcatgcggatttgcaaggggacacatgcaccctgccatggcttggccaaccccatccctgtgccaagttgaaagcaggtcatcagaggggtgcgccaaggccgagatcccatgctcaactgccccctgctcccgctacttgcaccatcaggactacttgcaccatcnnnnnnnnnngggccaaccccggccctgtgccaacttgaaagcaggtccagcagaggggtgcgcctaggccgagatcccatgctcagctgccccctgctcccgcgccttgcaccatcaggactacttgcaccatcaggactacgacagcctgccagcaaacagccacgaaccacccaaggagtctcctcctcacatccttggtgggcagcacggcggcggtgcgctgcttcttgggatgcagctcggccagggccgcctgcttcagggcctcaaagtccgcggcccgcgactcctgggagggacggatgacccccgcattcgaggtggtcgacagggtgtagatcctgtcaccccccctggcccgctcctgccagggccagtcgcccgtgggcgtggaaccgagataatcggccattacagcgccactccgagtggcgtgaggctaccggagtgacactggcctcctcgtaccacccgagtactcgtcagctgtcgaggccagggatgcagcaggtgatagcccaacccgaacggctgatcgcaataataccaacaggagtatctactctttacttttgagaagatcggtaggcttgaccatcaacttcttccgtaccaaaccgagacgtaatcaggcccctccgcttacgttatcctgttgggtccacgagacctggtctaaggcttgnnnnnnnnnncactctttacttttgagaagatcggtagccttgacgatcaacttcttccgtaccataccgagacgtaatcagggctctccgcttacgttatccttttgggtccacgagacctggtctaaggcttgttgtaaagcctcaagcaagcacgaatagtatctttgagcgctgccatagccacttccacttgtaactggcaacgttacatgcgatctagctgcccaagggagtccacaggtttgtgcaggccgttcatgaactgaaaactgcctgggcgaaacctctggatcacattgattttcaggatgtagtctcttccagccatacttcctgtgtcgtcgcatgatctttgctcatggtgagggggtactcatagtactcgaaggtgtaccagccaccccaggacctcactcacccaggagaccatagctcaaatagaagggtcccatcggcaatagactgtcttttaagtgcatacattgccgctctgccgattttcatgactgttggggctggtcaaattgaattggctactggtgtctgcagcttgtcaggtcatgatggcatgacannnnnnnnnnttgctggggcaggtcaaattgagttggctactggtgtgtgcagcttgtcaggtcatgatggcatgacatgtgcaccggattcgaaaaaatggtcacggagccccaaaagatgtcgccagccctcaatcctgacatacaaccacgcgttgattcatgaccctctccagttatcggtggcagccacggattgaacagcgtcgggcccgatcgggagataactttgttcgcttcacgcgtacgggggagttggtgaagccatggccacaacggccatgcgccatgcgcaaattgcaccgcactcccctcccagctccctcccccttcctcatggcatccggggggtggaggccaaccccctctgccccgacctccccatcttcgacctgggcgtgtacctggccgacccccccgcctgccagcccctgtgcgaggccctggctgcctgcctgcacaccgcgtccgcggtcgtggtgcgcgatccccgggtggacgagggcgccagtgaggccttcctggacctcatggaggcctactttgaccagccgcgcgaggccaagctgccggacgtgcggcccgacctggcctaccaggtgggcgccacgccggacggcacggagcggccgcgctgcctggcggacagcgccatcctgcggcgggcggaggcggagctgggggaagccgacaggcccaccccgcctcagggccccgactccaagtggcgcttcttctggaggctgggcgagcggcccgcccagacccgcttccgaggtgagcggtgtcgggggatttcttgtccggtgtggggactcgnnnnnnnnnnccccccccctcccgcgcagaactgaacgctgcccccgtcgtccccgccgccnnnnnnnnnntcccccacccccaccccccccgcgtagagctgaacgctgcccccgtcgtccccgccgccnnnnnnnnnntggcccgcgcaaacccgcttccagggtgtgcggcgtggggggatttcttgtccggtgtggggactcgaaagcgagcgcaggcttgtacatgcgtgctgggtcgcccatctctgccgccaggttgctgccctgcactcccctgctgcctggcagcctccatgctcccgtccaccagctcagcgcccatacnnnnnnnnnnnnnnnnnnttcccagaatggggccgggtcatggaccgctggggcacgggcctgctggccaccatcgcctgcgtggccgaggccgcggcccgcggctggcgcctgccccccgacgccttcacggcgcgcatggccctgggcccccacctcctggcccccaccggggtcgacctggggcgtgccccccgggagggcgacgtgtacgcggggtaccactacgacctcaacttcctgaccgcgcacggcgcggcgcggtacccgggcctgcacgcctggctgcgctgcggccggcgggtggcggtgcgcatcccccggggctgcctcctgctgcaggccgggaagcagatggagtggctgacgggggggcacgtgcgcgcgggcttccacgaggtgggaggggtggagcgtgagggggaagggggagttgcaggggaggaggcagtgtgattggggatcacttgcctgggcactggtccgatggggggctgggaggggtgcctggaccaggggccctggcacgcagaccactctcgtcgaccgcgattgaccccggccacgccccaggtggtgtgcacgagaggcaccctggaggcagcgcagcgtgcgcagcgtgaaggccgcccgctctggcgcgtgtcttccacggtgttcagccagatcgggtcggactgcctgctgcggcccctgggaccgtttgccacggaggcagcgtgcgcagcgtacccggacacactctgcggggagcaggtgaaggcggagctggcggccatcaacctgtcgggcacatctgcccaggactgagggcatcgaggtgacggcatgtggaagcgtgaaagtacgccaagcgcaggagccatgccggccagccggcctgcctcaaccccccctgacgaccatgccatgcttctccatatagattccaggatcagtgacatgccccccnnnnnnnnnntaaacccccctgacgaccatgccatgcttctccacatagattccaggatcagtgacatgccctccctgcgtggtgaagccctcgcagccatgtgacacagcaaaatcacgagggggccatctggcatggcacccaccaaatcggagtnnnnnnnnnnnnnnnnnnnnnnnnnnnnnnnnnnnnnnnnnnnnnnnnnccggggcggccctgaggtggccccagggagctgtttggccctctgaaggaaatttgcagtctggccccctccactccaccagtgtttgacctggatgacatgccacattacttctcttcactcaagcaacagggatcccgaacggaccggtcatcaggctnnnnnnnnnntatgccacattacttctcttcactcaagcaatagggatcccgaacggaccggtcatcaggctgagtcttcgtcctgccagtctctaagtgagagcgaagccggcgggcactgcccctggtatgccggtgatgaaggagtggctccaccaaccagctcggcagcaaaggtaccatggctgcgtcccgtgcatggatgaacgcgtcgacctctttgtctgacccctgctccaggaccagtttggccctattcaatccagccagcaggcattcgtacttcgccgctctctcatcttttgggctgctgggaccatcctcagcgttcagcggcaatgttgcgccgccactgtcctccgggcacaggcaatgggtagtctcctttgccaggtgcggggcatcaatcagagctgactcaccatctgggtggagcctccagtggtagtgatccatctttctgcggtggtctctgcggcgtggcttgcagaacaagatgggattgggccacttgtgtgtcttttcagcactctgcaattactcaacgccatgaactcacgctatgtcctggtatgtgatgtggtggttgcggtagaggtctgggaagtcatgcaggactttccgcaggtggtccggatgcagcttgccctgctcaggccagccctttcccttcctcacaatgttctggatgatgatggccaactccctgttggaatacgtgggattggcattcaggagctccgtcagcttgtccgtcannnnnnnnnnnnnnnnnnnnnnnnnnnnnnnnnnnnnnnnnnnnnnnnnnnnnnnnnnnnnnnnnnnnnnnnnnnnnnnnatgtggcagtagatgataatgctgtctgtcttcccctgctgcagcgtcttgatgacgaacttttgctggcagcccgtcttgatggacatctcccggacctcgttggtaggctgcagccgctgtttcttggtggaccgtgccgtcccggtgggcatgtcggggcccagggcgcaggtagagtacgccttcgcgtcccaattctgcaacaggcggtgatgaaagagacaatgattgagatgtggcaagtacaggaggttgcaagccctgctgagaggagcagcacatgcaggtccgtcggggtggccgtttgaattcgtaccttgtcaggtgatctgttctcaaccttgaagaaggtctgtacttgcgcatctcgccgtgcaggaagtcactaatgcggtctgtaggtattctggcttgggtagagggcgctgcgtgatagctgtccttcacagcgacgccggctgcttccaggtcggccatggtgaagtagtccggtgggggtcgtgcaatttgggccagcccctcatggtaaagggtggtctatttctgcctcgagtgtgactcgggaggactgtcagggtgcctgtctacctagatttattgagattgcaagcctgagccccggaggtcgatcgcccagggcgcgaaaacgcacgtttccgacccccacagcatcgctggccggcatcatgtcgcgtgctcgcttgagtggggtcttcgagcctgtaaggatcccaggttccacgtgctccccacatctccaaccagcggcaggctcgagtgccgagggatggagcgtgccctgaacacctcctgctccctgcgttgcgtgccctttgcccacccagccaggcacccgagggctgccagaggtacatttggtttggggttccagccatgcattgcgttatccgatgcgaggcgagggggctcgtgattgttacacctaccatcattcccttccctagaatctgtccctccactccacacacacgcacacccacccaaacccatgtgcagcccccctgctccgtgccatggccagccccgtggaccagtccctgaacccgctggtggcctccctgcggccctccgccacggtgcagctgaccgacacggcggtccggctgcgggaggcgggcgtggacgtggtggcgctggcggcgggcgagcccgacgcgcccacccccgccgccgtctgcgcggcggggatcgaggccatcgcctccggcctcacgcgctacacgcccaacaacggcaccgccccgctccgcgccgccatcgcgaagaagctggcggccgagaacgacgtgatcgtggacccagcccaggtggtggtctccaacggcgccaagcaggccgtgtggcaggccctgctggccacctgcggcccgggggaccaagtcctgatccccgcgccctactgggtgtcctacccggagatggcgcgcctggcgggcgccacgccggtcgtgctgccctgccccgccgccgagggcttcctgctcacgccccggcgcctggcgagcgcgctcacccccgcctcccgcctcctcatcctgtgctccccctccaaccccacgggggcggtgtaccccgaggccacgctgcgcgcgctggcggaagtggtggccgcccacccgcgcctgctcgtcctctccgacgagatctacgagtacgtggtcttcccccccgcgcgccacgtctccttcgcatccctgccgggcatggcgcaccgcaccctcaccgtcaatggcttctccaaggcctacgccatgaccggctggcgcctgggctacctggcggcgcctccaacctttgccaccgccgcgggcgtggtgcagagccagtgcacctccggcgccagcagcatcgcgcagcacgccgcactggccgcgctgggcctggggccgcacggcggcgaccccgtggcgcgcatggtggcggccttcagggagaggagggactacgtggtggcgcgcctgcgcgccatcccgggcgtcgtcctggatgcgcccgacggcgccttttacgtgtttcccgacgcctcggccctggtggggccgggcgctgaagccccgggattcgggccggtgccctccgtggccgagctgtgcaggtgagggaaggggtgaggcatgcctctgtgtggggcgaggtgtgagggaggggtgatgggcgcgcgaatggtgctcggcagggagagcaccaccagctgatgcactgtacagaaggagtgtgccccattgctcgagactccttcgtgcacctgagcaggtgcatgtgcaccttcatgcacacacatgcacccacacatatctgccccgctctcaaccccgccccgcaaaaagatacatcctggaggtggcgcacgtggtggttgtccccggagaggcctttggcgagccggcctgcttccgcatctcctacgccacctccatggagcagctggagaaggggctggaccgcatcgccgccgccctggcgcccgagaagctgcagcgcccatccgacgtcgcggcgtgagcctcggcacgtacccttgcaactgctccgccccgattccccctcactgctacggtgcctgcccttccattttgtcaagccattcatcgtgactgttccactctcagctgcaggtacctacagccagacacggcatgctgcttggnnnnnnnnnngttcatcgtgactgttccattctcagctgcaggaacctacagccagacacggcatgctgcttgggcatgggtgaggcttgatgcatgggcaccggccaatcacctccatttcagaggatacatcacacctggtcactcgtcgtcatcgctgtccagcaacacggtcctcttcttggcacggggggcggcagccggcgcgggggcctgcttgggggccgacggcttccggggcggggcctctggctcatcgtcgtccggcgccaggaaatcctggatggggtgaggggagggaggcctgagtcgatgaactggagagcgattgtccggcgtgaccgcacaaggtgaccaggacatacaacactctgagtcctgggaatctgccccaccccttgtccccacgcacatcgannnnnnnnnntgtgaccgcacaaggtgaccaggacatactacactctgatttctgggaatatgccccaccccttgtccccacgcacatcgagattgtcctcctcgctcagtccctcgtcctcgctgtcgatggtgcggggccgcgcggttgccggggacgaggccggcgccgccctcttggcacccaccagccgcgccgccgcacgagcctggcagtcggggggggaaggggtccggagggaaagtctcttgaccgtttggaatcaacgacatnnnnnnnnnnggtcgggggggaaggggtccggggggggagtctcttgaccgtttggaatcaacgacattcgagaacacagtgtgtccccgtgctgccgctgagatttgattccgccccgcccacccaagccctcacctccgcctcctcgctgtcaaggccccgggcggccaccccacgcgggccgccacgccccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcctcctccaggtaagcagaggagaggcgcgacgcgcgcgccggcgcggccggcggcgcgaagcgccgcatcgtgcgcgcctggcgctcggccaggcgctcgcggtcgcggatgcggccctcttccgccagctctcgctcgcgcttctggcgcgcggggtcggccagggtggtggtccccttgacgcggcccacccgcgcgctggtgccctccacgctggcggccaggcggcggtggaagccgctggacaggctggcgggctggaagaccagcttggagaggagctggccctggccctgcgagggaacgaggggagtggcttggggattacgtgggaggcacgtgtgagtgtgtgcagagaggggtggggggttccgtaaggtgcccaccatacacggcatggggttttggtatggagccgacacgcagaggtgaggagagcctgggatctggagggctggaagagatggcaaggaggagcccttgccaacggataccttcccctgccccccgataaccagaagacactgcacactcgcgcatcgcccggacctggatgacttgcgcatgccgggcgcagaggtagttctggtcgccgctcacgtcgatgtcccgcacgtccaggacctcggatcccaggagcagctgctgcgagccgtcgctccagcgcaccagccgcgcgttggagcgctgcaccgcggcgccagcggcgtcccgcccccagcgccagcggatggtggtgtggtcccgcagccgctcccgggcggtgctggccccggcctccgcggcaaaggcctgggcgtcgaagggccgagcctcgatgcccaggatgttgctcatcttgaccaggtgcagggaggaggggaggggaacgctgtgcagcgggacctccacctccatgggcgggccccggtctggcggcggggccctgtgtggtttgggtgtagggcagtgaggagctgtgatggccggacatcacgcagacactcttcccaagcagcccatgcgccgattgatgatgggtgggggcaccttcgaccctcaagtccactctccagcaggccggcaaggtgcctgtgcgccctgaatgccccagccacaccccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctaagccatcgtctgcgtcgtcccaggccgtcgcatcgcctccctgggaggctgcctcgtcctcatcgtcactgccaaacaggtcccgcatctggtcttgctcaacaggagcaggtgccggtcccggaccctcgtcatctggcccagcctggggcgcggtcgatgcgggcagcggtccatcgtcatcctcagactcgctcccaaacagctcccgcatgcggtcgccctcctccgccatagtgccggtgcggagaggacaacctctccccgggaaggggagcgctcccgcacctgcaagggatgcctgtgctcgggtgtgtggctaccaatgctaaaagatgcttcctgagtatttatttcgtaagttttttgggaagggcaaagcgagnnnnnnnnnnacctgtgctcgggtgtgcggcaaccaatgctaaaagatgctccctgagcatttagctcgtaagttttttgggaagggcaaagcgagcgaggagccttgattgcaactgagagacctcaaggtctcccacccaggcaccagggcgcgaagatcgttagtttactacacctaaaactccctcaacccgagtatcctgtccactcgagaggcatcaaccactcgaccatcgaaagggcaagcctttccatacgcgaaccattcaggaggggttgctcccggacaagtgtgtcgccatgtcgctcgcggtgctcaggaccgccctgcgttcttggcagccgcttgcacgatgcatggccaccaaggagatcgctaagcctgcatctgatgccgtcgcggtagaccaggatggcaccaccatcctctacccggcccaggccttcaagggggatgtccggtccacaagcgggctgggcatgggcgacggcctcaccacccacaccagcaagtggatggacgtgagtcacagagtctagttagcgctctggtgttgacgcttgagagtcgtgctcttgcagtggacggggcctctgctcagtacacacaaccatttccatcgtcgagacgcaccacccactccacagcaatgccccctacatgcacagggcaacggcaagtccccgatggagtacatccaggcagcggagccaatcaaggttcacggcctgaccgtggcatcgtacgggagtgagtttggatggcgtactgcaaggcttgcccggggccctggtatgggatctgagtgcggggttgaatgctctgccttgaacaaatccctctgcacccctctggtccaggcgacgaccctgccctgggctgccctgtggagtacatcaccctgaagggcacctcccgtgagcacccggcggtgtgcaagtacaccggcaacaagtactacagcgatgactgggtggggggcggcgcccactgagcgaattcacgtccctgcaggctgaatgagtgtgcagactgcccgacacgctgatgctggttgcgtgtgcaatgaaatgnnnnnnnnnntgggcctgtaaccagcctggaacgcaaaacgcccgcaagcctgcgcatcgtggggtggcagcaacacatcgagctgcgcccctggtgtcagcgccgcctctttgggaggcgtgccgcgttgccaggcgtcgagccctcacccatactctccagactgaacatctcgccctcatccgcaaacaggccactcaagccattnnnnnnnnnnctcacgtccctgcaggctgcatgagtgtgcaggctgcctgacaagctgatgctggttgcgtgtgcaatgaaatgtagcccagacccctcgggcctgtaaccagcctggaacgcacaacgcccgcaagcctgcgcatcgtgggatggcagcaacacatcgagctgcgcccctggnnnnnnnnnnggagccctcgcccatactctccaggctgaacatctcgctctcatccgcaaacaggccactcaagccattattctgcgagaggataggtaggggtggcatgctgacgagaggtgtgtacggggatgacgctctcgtgggtggtgcagaagaaatagggtgctcatgatccatgcacacatgcacatcacactacgcnnnnnnnnnntggggtggcgtgctgacgagaggtgcatatggagatgacgctctcgtggggtggtgcagaagaaatagggtgctcataatccatgcacacatgcacatcacactacgccctgggtgcaggtaggggcggactcggcttgctccatgcactctgtcacatccacctcccagcacgtaccgcctgcccctccgcatctgcttcatgcacggctgcagcgccctcccgcttggcctgaatgtcggctgcgagctgcgcctgctgcgccgcctctgcagcagccccctccacggcgctctgcagagcggcctccacggcggcagcgacgcccctggcgctgtccagcctggagcagatcagggcattgggtggggggtgtcgataccggtctacccaccggccatcggcagaaccgcaacacaatctaatgcacaaatgatacaatgccacggtgctcctgcaccccaggccttgcggggcgcnnnnnnnnnnagtctgccccccggccatcggcagaactgcaacacaatctaatgcgcagatgatacaatgccacgatgctcctgcaccccaggccttgcggggcgcaatggccccgattttgccctccatgctgcacccaccaggcccccagggatgcggcgatggcactcaattgggccgggctagcatcccttgccacgctctcctcgacgaggaggcactgctctgcctggtccaggcggccacgaaccagccccgcaccgatgcagttggtgaccaggatgtcctccagatcacgcacgtcctgcaaccccaaggcgggcaggagctctgcataagccagcctctgatgcccagggacggaggagggaggagggggggtaggaacgggagtctcagccgtgcagcaatcatggcaagtgacgatgccacctgcaggcagggacgagagcaggggcgcaccgcatgccctgcccagagcgcatgtttccaaagcgcccctcacccgtctcgaggccgccaaagacagcacggtcagtgctctgagctttctttcttgggctgctgtcagacgcaagccgctggcctggcctggtggtgtggcagggccacaggggaaagtttgtgatgtcaggggttcagacccagaaaggggcacctttctnnnnnnnnnnccccagggggaagtttgtgatgtcagggttcagacccagaaaggggcacctttctcccagacgtcgctgtatgcagccacagcgccctggagcggtcatgttacctgaataatcttgccaagtaccgtaggagaacaggttcagcagactcagagcggcagcatcctcagtgttggagagctgcggtggggcagagtgaagggaggtgtcaattgcgtcgtcggtgtccaaccgcgtggtgccgccatggaggtagcacccccagggtctccagtcacccaatctcacctcctgtacagctgtgaggtggagcaagtccccgaaggtcgccaggtctggttccgtggtggcgcgcgagatcagttcggctagaggtcggccccgcagagatcgcgcgagctgggcatactgcacccgcttgatgtcggacggcatgtggcagagtttaggattggtaacagctatctcagcaaggccatctcaccaagcgctgtgccaggtaagctctgccactcctccacccgggaaattcggaggggagcgcgccgagcaacgtattgatgatatgggcaagggacctttgcgagttccggtgaccgggggtgtacagagatacaaagtgcacgcctgggtcgtaatcgcgctcatgatcaccgcatgctttgcatgggggggtcgcatgacatggcgctgatctggagcagtcgagaagcatcctggcagtaacaagcttggttttgaatgtcccccatttgcatgtgcgtgagcccctcggtgtccgtcgcagcttctggcagcatgacgttggggtcggtaggggcctgttcttcgcaccgcctgtgcctgtcacccacatcgcctccatgcgagtcgcatctgagaatatatcaatctcggataacatattcgagccgattatgtaggactagaaagccctcgccatgtaccctggctgctctgtccgatggcgatgacattctcaaaaagtatggcatcgatgctgctgtcactgaggtggcccccagcgccgtccccttgaaaccccaggcgccacgtgcgagggtgccggcgcagcgcaggaagggcatgggcaacggcgtcttctccctgctcctgctcaattttggagtctttgcggccgcccgcctgctcaatgcgcccatcctggcagccctcccgctgcaccattgggcgccgcagtggtggcagttcatcaccgcgaccttctgccatgccagctgggatcacctgagcgggaacgccttctccctgctcatatttgggcgcataggtgtggagggtggtgtttcttggagcctgcctcaggttgtgatgatggaccccgctgccagcatcggaggccgaggggttggatagctgctgtggggccgtccacatttgtcactccatgtgcgtcacatcatgcagacatgttaccccctgttgaatgactgcctgccctggaaacgccctccacccaccccccaccaaaccccaaacccagtcgaggacgagnnnnnnnnnnattgaatgactgcctgccctggaaaggcacttcacccccccacacacacaccaaaccccaaacccagtcgaggacgaggaggggggcgtgggcgtctgggcgacctacctcctgtgcgggctggggggctgcctggcctcctacttctcggctccacacactcacaccgtctcgctgggggcctcggccgccgtgtttggcctctttgccgttgcggtgctcaccaagttcaagcccacgctgcggcaccttttggaggccgtggtgctcggcacctttgtcatgaagcagctgctcaacgtgagtcggagtgaatcgatcgtgggctggtcagcggggggtaccgaccagcagtgctcgaggaggctggcttggggcgagggtctggagtctgctgggagacatgcggccttgctgctgggcctcaattgaatggggatgatgtttaggtttgaggcaccnnnnnnnnnncggagtctgctgggagacatggggccttgctgctgggcctcgatccaatggggatgatgtttaggtttgaggcaccggggtccactaggtgaatactcatgatcataaactcatgtgccctccaatgacccccgcgcccttccccatccccctgcccaccccttccccgggaacaacaggnnnnnnnnnnctactcatgattataaacgcatttgccctccaatgacccccgcgcccttacccaccctcctgcccaccccttccccgggaacaacaggaggtccacatggtatccagcgggagggcgttgaccctggccggggtccaggtgggccacctggctcatctggccggcgccctcgtcggcgtcgtccttgtgctgatcctgtcccgcctgcccagcggcgaggagaagtgaggtggagcctcagtgttgcctggcatggagcgtacaagttacagtaatcgcgatcagcatactcaaatgggggaaaaggggttccccgagtaccgaagaagggagaaggcctgggatatgtgcatttggtcgagggcgccagagagggaatagttctggcgcagcagcttggataatagatactagtgatgggaggagtcctggtatggaatgcataacctgaagaaagctgcgtcgcggcttggctnnnnnnnnnnctggataatagatactagtgatgggacgagtcctggtatggaatgcatatcctgaagaaagctgcgtcccggcttggctgtagccataaatatactgggaccgggcccgggagaattgcgcgcagtggtcccaaacactggccatggattgaaacaatttgccttgccccccgcatccagcccctgcccagccctggtcccatactgtaagccccaccaggcgcctacatgcctagctgcgcgccgcccactgcccacacgacgtcctgcggggtgaggacgccgtgccggttgcgcccccgcccgtgccagctggcgctgtaacggtggtagcccacgacgcccggcggggcggcgcccgcgccgcgcgcgatggcgacggcccggtggcaccgccggtcgtcccaggcgcagggcgtgaggaaggagcccaggggccagacgcggagggcgccgccggcatggctgggcgcatgcaggccggcgaaccctccggcgccgtcgggcagacccagtgcccggcgcgcggcggccgccagcacgcccggccccgtctggcggtcgatgggcaggtcggcgcggggcgcgcgccgctccagctcccccgccacgtccagccagagctggtggccggggacactggccatcgcgccgttggtcacgccctccatggggccggtgccctggcgcaggtggggtgtttggcttagtttggtggtggtgggggggggggggctcatctgctgcggtccccgagtgcctcgtgtacttcacagagacagcagcgcggccctctgtcaccgaacaatcccgtctcacctgcaacaccacgtcggcccctgccagcatgggctccaggggtgcaaagcactcgatgtccaggtccagatacacccctccgagggtgtgcaggaggaggggtcggagggcgtcggagcgactgacggggtggtcgtaggacaagaaggtggccaagaagccgggccagaactgcaaaagggggggaagaggttgatgcggcagaggggagtgggcgggtcaggagtgcacgagcggggagggagggagccccgcagtgccctgctgtgtgggctgctgagtcagcatagctgcacaatccacacagcagacgctaccaaaaaaggctttcttcaatgattcatgtacccaaagatgcctgcacgcgccctnnnnnnnnnntggagtgcacgagcagggagggagggagccccgcagtgcaggattccctgctttgtgggctgctgagtaagcatagcggcacaatccacacagcagacgctaccagaaaaggcttttttcaatcatccatgtacccaaagatgcctgcacgcgcccttcggccatgacccttccctgccttggcccccctctgtcaatccccctccttgatcatgcctcagtccccaccttggcgacaaaggccttggcctcagcctccccccagaagacatgctcccagtggggatggagcctcaggcaggactcgctccaggcggggttggtggcacttcctttcccctgtgcgccgcggaggaagctggcacggtccgggaagtagatgtggtggaggatgggagggatggtgatggtcaggttgctgggctggcaatgtctgcccagctgggcatgcatccattggacggcgtccgatgcaccactgccctccagcggggtgcacggcggaggagggagctgggtctgtccatccgcatgaggctggggtggggcagggtctacctggaggatgcacaggcccaggagcaggccggcgatcgcgcaaatgcagaacacacgtaagatcgcgtggtgcatgggcaatgagagggtcggcgcccctcaagcaccggctgctgcactgactttggacgttgcgatgacgcnnnnnnnnnnaagcccctcacgcaccggcttctgcactgactttggacgttgcgatgacgcgcatccaaggtgccggtgccccagccagttgtgaagccgagggcccacctccgctcactcctcgcggagcacagggtccgttcctgcagcccaaaggccttataatgctccaggtccttgggttggattattctgcaagcccatctcgaccgatcccaaacacggtacagagcagcacggtcacgtatgtgggtcttgatcccggaccacttgaaaaagcaatcgtcaggcacgcacaagtgcgatcatagactgcggccacggagcaagtgagtgccgcccacactttagactggtgtgcagtgattattgaaataatttctacacctcgagcccaaccactgaaaggtgtcgctgcgcgtctcgccaggagtggtcccgggatgggacaaactacccaggcctctccggccctgcactccgctttgaaggacatccacaacgtccccaactcttctacagcgcgtaaagtatcccagcacaacgctctaggtgcgcgatgacggtgagggttccgccctgtgcctgccagcactctgggtcgcccctgtgcacccgattgcaaggcacagcagcacacatcctcttccccagcacacgccttctgtacagacgtcacagacctgctaaaaaggcggatgctggcccccnnnnnnnnnntgccactgtgcacccggttgcgaggcacagccgcacacatcctcttccccagcacacgcctcctgtgcagacgtcaccgacctgctaaaaaggcggatgctggcccccaagctgcgctgcacggctgaggaggctggcgtgcgcgtggagattcccccgcccgacgtcgccgccacggaggaccacctgcagtccaacccggtgtactcccccgccaactccagcctggcccacgctgcctcccgcctggcagccctgcgtgcctcccgccaggccgcaccacccgccagcccccacaggcagtccgccagcgcgccctgcagccccaagggcggtgcacccgaccaggccagcggctccccgacctcgcgggaggacggcgcgcgcgccgcgcggcgctcgcaccgcgccaggcgccagtccacgcgcgtggcggtgcagcgctacggcgagtggttcacgggggacgaccaggaactggaccggaagctggcagactacaacctggacgtggccgccggcagccccatggcagaggtgcagcaggcaaggcgcgccgcgcggcgcgagtcctggattgctcgcacccagacctacgcaggctcctctggggcctcgcgcggaggggtgcgtgcctgggtgtgggtgggttggagtagggggttgaggagggatggggggccgaagaaaatcactggaacacactcgcagcggaaacatgctcgggtcgctcgtggnnnnnnnnnncggggcagaagagaatcactggaacacactggcagcggaaacatgctcgggtcgctcgtggatttcagtccatctatcgggacccagggcctccgcacgcacccagcatagcttgtcctcccgaccctcaagcccataacacgcccatccacaggatgatgtagctggccaggtggcagacgtcgctgcccagctgtgcgcccagctggaccagctggtgcccgagcaagaggccgcggaggatagcgcggcgccgaggatgtccctccgagagcagctgcaggcgtcctggaacggcaaggtgggtcccctttgcaacgtggcgctgctgggccgttggcagatggcgaggcctggcgccttttgtgagggaacagaatggggtgttcagcttgccatattccccgccctccgcgcccccctgccacctgctcccctcctctgcgcagacctactatgagcgcctggcggccatgaccagcgaggacgcggccgagcttgagccgccgcgttcagaggcagtgccggcgagcgacgtgcgcccgcgggaagcccggtcggcggccgcgacggagatcagccgggaggggcacgccatgcctgcctccccaggcccccacgctcggcctgcgaccgacggcgccaggccgggcggggtatcgtcgcccatgcccgactnnnnnnnnnngcggaagcccggtcggcggctgcaacggagatcagacgggaggggcacgccatgcctgcctccccagccccccatgctcgccctgcgaccgacggcgccaggtcgggcggggtatcgtcgcccatgcccgactccaagacgcccggccgcgcccgcaggctctccaccttcaacgacctgaccgaggggctgaaggcactgcgcgtgtccggcgccgcccgcgcccggcgcagcagcctgggcggcctggtcaaggcgctcacccccacgcgcgcgaaggagggcgtccccacgaaccccgtcagggcgccgccccgcccggcgccggcctccccggcccgcagcagaccggcgccagcctctcctgcgcacccctccaaggccctcgcctcccgtctggtggcacccagccccagnnnnnnnnnnggcacaccactcaaaggcccccgcctcccgtctggtggcacccagccccagtgcggggcagcggaccccggcgcggacctcgcgctttgcagaggaggggcgtgagttcgggccccccgtgacggaggagctggcggcggccagcgccgccgtcgccgacctgcaggcccgcctggcaaccgcggaggctgcggccgcagaggccgccgagggcgcgcgccgcagcgcggcggccgcctccgcgttgcacacccagtccgtgctgaggtgcgggcggggggtgtggggtggaggagggggggcagattcatgaaggcacgtctggactcggtctgcagtctggcaggggtgcaagattgagtaggcggtgcaccgtagtcaccatacacgggaggcctgcgagggcacgtcaaccaaagcgcctctctgcacgccctctccacccgccgtccccctaaaacttgccagggtgtcggagcgggctgctgagctggcagatcgcctggaagcagcagagtcgcagctcagcgtgttgctgcgcgccgccagcagcctgcaggcggtggtcaaggaggcgacaaccgagctggaggaggtccggggcatgctggcctgcgctgtgatgggggtgccggggtcaagagacgggcccggccagcaggcaggcggccttcccccgcggaaccccgctggacggagggcggggaagggcgggggctggcgctgagtgcgagaccctgctctgccccaccgtttgcgatgtctggccctgtcggcgctgcctcccacccccccgccatgtccgtgcctgcctgttacaaccctgttgcatgcggcaccgctccgagacacgcgctggtctacccggctgggtgcaaagaaagtgcgtatcgacgctcgacaaaatgggaggggggttcaaggtgcagcatgctgcgcatcacacataaataatcggtcagagggtgggggaaggggggagtggcgggacgcaaaaggcccatgcagcggatcggctgctccatgtgcatgcgggatgcagcgtgcgggtgggagggagggttcatcggcctggcacttcctccctgctgacctcctcggccccgctcagccaccggcccatgctcaggagcgagtctccggctcgccgggctccgcatcctggccgtcctcagcctcctcgtcggccgtgcggccgccgccggcctcccggcccggccggccggcggggatggtgtcgcgtggcgcctcggcgctctccgcggcatccacggccgcctgcttctggccgtcgctctgggccccagtccccggcagcacggccttggaggcggcggctggcccggcgtccttgtccaccgccgcgggcggttccggctccgccgccgcggccggcgcgcacggctgcggcgtgggcgccccaaggtcccaagcccctcctggcatggagaagatggacaggatggggctgagcacgcccggggcggcgcccgccacccggctcgaggcctccgacccgccgctggtcgacctggccagccgcggcgcgggctccccgcctccgccacagtccacctgcagcgccagggacgggcgcaggaccgcccccggcacgcgcgacgcccggcccagggcggggagctccctccaggcgcccaggcggcaggagggcggcccaggggagcacggcatgtcgaacatggggttctgggccagctgcagcgccccgacggggaccgccagcggcaccgcggggggcgaggagggctcgtgctccagttgggcgggcggagggccggcgcccgtgctggtcctcctcaccagccgccccgccgccgccgtgggcccaaagcgcgggccgcaggcagcgggggcgcttgggtgtgcggaatcgctgcgctccacgtcgccccacagggcctccgccaggtcctccgccgggtcctgcccaggcgggacgctgcgacacgaggcccccgtgctggactgggggctgggccgggcggaccccggcgggcccaccaccaggggctatgtggagcgagggcgcggggagggagtgttgagcggggcggcggcgatcgaacgagcacgcccggcatccggcttgctgcatgtggggtttcagcgcttttgccgcacccctgagcccctcccgcccactgcccggccccacctccttgcacgtcgccagcaggtagatgccgcccagcagtgtggcggagcccagcacaaacatggcggtcgacaggacggtgaaggtgcggtactcctgcagtacaggcacgggtggtttgcggtaagaaagggggagtgctggggagaggcgttggctgtgcagggtcggcactggggcattgcgattttgaagtgggacagaaggaaggggcctccagctcaactccaaggccctacactccctgccaccacacacaatcgcgatgcacccacctggaagtaaaccatgcccgacagcatggagatgaggacccacatgatcatcaacatgggcatcatggtgagcaccgggaagcgacgcatggctgtcgtgcgggaagggcaggggtaaggtgatgcggctgagggagctcggggctcattgcgcgtggccctccaccggcgcgcttcatttctacaaaaacacacacacagcctcatcccgaccccaccaccaccaccaccaccaccaccgccgctcaccctcagagtacttgaccacccagaaggcggcaaaggccaggaagaggagcagggccacgtaggtgtaccagtgcgtgagctgcgtggggccctgcagcgacttgcgcagcagcatggccagggacttcccatacacaatgctctgggtgcccagcgccgcagcgtacaccgcaaaggccaggggcacccagtggtgccacttggggcagcccctgtgtggtggggattagaaggggttggaaggggtgagggatgggttttaagaaggggtgagggatgtggcatgagcatgggcatttggggagggaggtcgcgtacgcagagacaaatgttgagtcattcaaagtccgaaagaacagtaccaacctctcgtaggccttgcggccgtaggcatgcacgccagccgccaccgccgccagcgtcagtagccccaccaagtagccaatgtatgcgggtctgtgggcgggtgcgcagtggggtgatgtgtttgaatgcggagggttgcggcaaaatggagcatgcagaaccctgcgaattcccccacggggcgtgacaaagtgctcgtgacaccagccccagcgcccgcaacatacgcggtgtagaggtggcgcaggtcgtcggcgtccatgacggggctttcatggttgccaaatgccacgaggaggacacagccgacgacgaccacgcccgtggcgcagaggacgcggcgcgtggccacctcgccgttgatcaggcgggcgaacaccacgttggccacgaactggaccacagccagggcggccagtagggactgtgccgcaaaggcaaaggataggaagttgaggacgttgccggcgacgaagagcaacatgccgaggagccacatgcactggccggggcggcggaggtacgccgccagggccctgcggtggggcacagggatggcgagagggaggaatgagggggctctcaaagggagggcccatagggagatgggtggaaccgcccacggttcaccagccccattggtacccagacttgccctgagctcaacaaggatggtgggcatggtgccgcagctgcagctgctcgcgtgtgtcctagctttatgcagttctgcaaggggaggcgaggcggatttggcgatgtaaccaccgtgcggggatatgtgcaaaacgggtttcggcttgcattcgggaggcccccccccgcaaagctggagcgtatcaactcactctcagcccgcccccccatcctcaccgttccgagattgacaattatgccgcctacaacattaatagcggcccctatggcccatgtgcccatgtcggaccggtgtatgctggtccgacggatcaccaggaaagcatgggttgctgggctgcggaggcggttgcaggcggaagggcccctggtttgcagaaatcctcgcaccagatcttcgaatactcgaccacaatattatctcgtgtacttgagcactgcatcgtgacaccgaggctggcggtttactggtgggtcgctgtctgtcactgccttgagcaggccccaaccataatgtatccggggtcgaaggaagtgatctgagatttctcctggagatggcaagagatggtccccatgccatcctgcgtatttttcatcggtccaccagaccattgaatccacacagtccatattcgaagctcgtatgtagacaagctggcgtattccggtggctccgagcggggctcggcacccacgctggagcaggtcataggggagttcttttggaaaggagcacagacggttctcagcgcccgcctgccccacgcgaccccgtccgacaccaaggggagcggcaagaagcgagcatgggtgagcaggtggtgcgggaccatcgcgatgaccctcgcgccttgccacccctctcgtttgccagaaccagctgaacgccttccgcgccgtgcagttcaacttggagctggacgaggtcgagtcggccaacaaggaactagagaaatggcgacgcgatgcaggcttgccactcgtggtggaggtgagggtgctcgcatgggggatggggcttctgggggcatggtggaaggcgggggagggttggatccggggtgctgcgaggtcctccagctctcagcgacaccgctccgcccccaccttttccacttgaaggtcttcttgagaccatggggtgcacaggaagagaaggtggcactgatgtcgggtgacactggcttaggtaagccttgcctgagagcgtcgtggtcgtcacgaaccaggtcttgttgtcttgtctggatgcacagtcgtctgcctgtgcctgtcgtatccgcctgtgatccagaactggagaagaaagagcttgagggcccacgtcctcctccacacaccacagtggagacgctgctggagcgctgggtcttccaccaccagcagctcctccccgactccccttcctccctgtccaaatcagcgctggtgcgcctgagcccctcctctatctacaagcgcctggtcatcctgctgcgctccgtcttcgccctcctgcgcaccctgcccgcccacaagctgtgccgcgccggcggcgccggccgtcgctccgccttctcgctgggctaccgcctgcacagcagcctgcccggcggcgcgggggagggcgggccggaacgctccggaagtggcggtggcggctcagcgggcgggtcgtccagcggcccggcgggccccggcgcggcgcaggctcgtgcgccccgcggcctcg

SEQ ID NO: 23709 - DNA, 67 bp, Chlorella protothecoides
agtcgagtgcctcagggccggacagaaggcgtgcactgcggacaaggatggcaacatcgggaccggg

SEQ ID NO: 23710 - DNA, 83 bp, Chlorella protothecoides
tggggctggggcgccagtccgccagtcgggtcttgtgcagggcgacgtatgcgtggggcgtgacggcagcactggactcggag

SEQ ID NO: 23711 - DNA, 61 bp, Chlorella protothecoides
gcaggatgagccggccagcaggggtcctgatgttgctgggaagcaggtgagctttgaatga

SEQ ID NO: 23712 - DNA, 462 bp, Chlorella protothecoides
tcgaggaagccctgctacctccctgcgcatttggtggggctacagcagcaaggacactttgcactgtcatcttacagcggcacgggatgccagtcactgtgagtcaagtcaagagagagatccgtactgcgcgaactgtggctacacacattgctggagacatcccttacacggtgtctctcggtacagcaattgtgcagagtccaacgcaccttctccctccacagcccacgctagagtgcatgccttcttctcctaaagagctggtagcctgggctatggagaagttgaacccacctgtcatcccattcaccaggttgggaggaggggaatcagcggcacagcatcccgcacgtcaagacaagtcgtgttctcgcaggcatccactgctctgtgaacgggtcacaggggctcgtcaaagccctgactgcagtgaataccttcccactgcggatgcaggga

SEQ ID NO: 23713 - DNA, 285 bp, Chlorella protothecoides
gcggggtattgtgagggagtagaagcggggatgctaacaaaaatgagtggagtttgtgctgcatggcctagggatcgagaatggccctggccctgttgccgcacatactagacttgtacgtgatgccgacacgtgtgccaatcggtgtcgccgtccatgcattcacacccatgcatgcccaggctctgaccgcgccccccaactccagagaaccacctcgcccctcgtctcacaaccctctctcctccccattccccccctcccctccaggcgtggtcttcttcg

SEQ ID NO: 23714 - DNA, 4501 bp, Chlorella protothecoides
  modified_base (781)..(833): a, c, t, g, unknown or other
cgcccgtgcgcggccaggcaggcgcggcggtgggcgcgtccaggcggcgcagcacctcctcgccgtcgtcgcccagcaccagcaccgtcaggctcagcccatgcatggccaggctggtcatgaaggtgcccaccagcacgcgctccagcgccacgccgcgctcgccgcgcagcacgcgcacggccgaggaggccgccgcgcccacctccagcggcgtgctgccacccaggttgttcaccagcagcacggcgcggggggaggcggcgtccagcgcgccggcgtcggccagatggcccaccagccgccccacgatctggtccaggggggccagcgcggtcttgtacgcgccgggctcgccgtggatgcccaggcccatctccatctcgcccgccgccaggcggtcagagggcggcgcgccggggacattgcacgtggacaggctgcagcccatggaggccagggccgccgccgcgccgcgcgccgcagacgccacctcggccatcgggcggccctccgccgcggcagcgccagccacctgcgattgtttccgggtcgggggatggatgggggggagtgtgcgcatggatgggcagaaagcgtccccggcacacacctccgaatcgaattggttggtggtgggtgcgcagggagctcatgaaaagctacaggcttcttgtcccatggcaaggttgtctcttcaggcagctctccgtctgtgcctcctcctccaaccctctcatctacgagtcagagagaaagcgctccccccccccccccgccnnnnnnnnnnnnnnnnnnnnnnnnnnnnnnnnnnnnnnnnnnnnnnnnnnnnngcaccagcactgtcccggcgatgccacgccggttcttgacggtgccgccctcgatgggcgcaacgtcgtctgccacgatcaccatgtccacggggatgccctcgaccttggcgcgctcagcggcggcaccaaaattcagcctgggtgcatgggagtgtttggggtgtggggtcagcagggggggcgggggtgcatagatgcgcataaggggggacctgggtgtggggagcgacgcaagcccaccgggtggcgacagacgaggcaccgggaggtgcgcccgagtgtcttgtcgcactctccccagaggcacacgagggcgagtacatctgcactgagggccccgcgccatcaaccccctcatccccccagcagtacacgcacgcaagctgtgccatgcacctgtccccggtgtagttcatgacgatcaggaccactcccgcgggcccgcccacggcccggatggcggccaggactgcgtcctcggagggggaagcaaacacgtccccagccacggctgcggctagcatcccggccccgacgtaccccgccatcgcgggctcgtgtccagagccaccacctatgtacagccggggaatgcatattgacatataccctgtgtgcctctggtgcttgtctgggggggagatccggggcatgacgcgaacgcacccccctcagcagccttaccggagatgacagccaccttgctggcatcgtggttgcgatcgtacactaccttggtctggttgaggaggagggatcgatgggtgagtaggcagggcagttgcggttcataggggacagcgactcccgaccccccctcccgtcaccaccatacgtggggatagccatccaggcggatgaggtttgggttggagtcgatcaacccttccagggactcctgcacgagttcctcgatcttgttgacaaagtgctgctgcgccatcgtgctcagctgccgatgaggtgcggggaggtgggtgagcggtgtcgtaaaggagactgtcgacagggctcttgaagctggggactaggtaagtttttgtgtgttgtattcgagaacagagaactatattctagtataaatgttccaaacgtgatttagccccatcagcaaataaaacgctgagtgtgcaaattggtgtgcggtagggttctcgatgtcctgccttgggcatgtgatgcacgtgggccgggcgcatggacaaaactttacagttttgacagttccgataattgcttttgggcgtgccgagagagcgcagcactggcgcccgatggatccaaaccgacgcctaggcatggatgtgggacgcaataacccacatccataccttggtttaacgtcgggcgcatgccacctgcggccgggcccacaccgcccgagcaccaccctcactcactgcccggcctatgcaagaatcactggtgaagagcctctccttcccctgatccagcactttccacatgcctggaaaaggggaattgattgcacgctcgcatgccaccccgccagggccctcgacctgccgttgagtcgacctcgacgggggaggagcccgtgcccaggagttcaggagccactcccgccctggggcccagcagtcgagggcacaggcagcgagcgagaacacggcagcctccacagagggcacaagggtgcgtgcgaggggacgcgaattccaaccccacatgcgcctctacatgtacgaccacgccgatgccggcgcatggacgcggcggggcgatgcagttcacatcgcatgctactctccatccatgtgcaggccagagacaggcgccggggaggctgaggcggagctcgcgcgggttcgagccccatcagcccgtcccagggttgttggccagcggcgccatagagagggcagcgaggagagccggcgctcggatcatccgccatcacagcggcaaagaggtagggaatgtgggtgcatgcgcatatggatgttcggtcgccttcattgcgctgcgaggtacgggtcgcggggcgggccgtatttcggctgctgccaggaacccatcctggttagccggctcacaccatgaggtgaaatgcccaccccacgagcaggcagccatgacccggcgcaagcctcagcctccccagaggtgaaaatctggatgtgtggaacattttcaggactgggatcacgcgttcctcgaggatgacgaggggggggtggctgtcggtgttgtgcagtcagcgggggagggcgggggagggactgcacatggcgaatccatattgtcccaatggttggccatgccagcgcagctctcaacccactgttgatgacgcctgtccttcccaggaggctgtgcatgtgccggggccaagccccaggggcgccccccagctgggccagagcctggcagtgccggccgcgctgccagtgcagcagcagcagcgtcagaaactggagtaccaagaacccctggtgtgtggtgctctgaaggcatatgggccccgcctgccatcaggcagatgattgcaagggtgcagacaggccgaactcacatgatctctcttcctcacacaggttgcatcccctgagccggcggcaggggcagaggcagcctcccccagcgctgcagcaggggagagaggggcagaggcggaggaacccgcaggccccagcacccctccccgtcccaaaaggtgaggcccaaggccaccttctttggtggagcaggttgattcgcacgcggggcggcttggaggggctgatcctgcccagtggccgtgaccatccagcgggacctgctcatagatgttgacatccctctcttgctcactttgcagtgcattcttttactacctggaagccttcaaggatcaatggagggtgagcatcctcgcagtgtgcccgttgtggttgagggggggtgggtggcgagcagagcagactgtgttgcatcagagcaagtgaggaaccagcctgtgcccgccctgccaatgggaagaggttccagggccatggagcatcatgcccacttccctctgctccctcctttccaccaggcggagcacccgcgcgcgacccctcaggtcaagacgctctcgcagctagcttccgtctcctggcgggccatgaccggtgcgtgggcggtggtgctgaggaggaggtgtgggcgtgggaaggggcacagtggcgcaccgcccccgtatgctctcctgtgcctccaggcggcaagcaagtgtgggggggcctccgaggcccccaggctggccggtggtgatcccgccaagccttttgttgacctcccgcagccaggaatgcagggccgctcacacgctcctgccgtacccatggaccccccgctcccaatcgcacccccacgctctgcagaggagcagcgcgcccccttccaggctgccacggacgcggcaaaggcggcgtaccgggagcaccagcaggcggagcgggagcgcgaggcggaggccgcggcgtccgcggccgacaaggagcgggaaggcacgcccggggcgggcggaatgcccccgccgcgcggaagtcagcgccccagccgccccaccgcggtccgcgcctcgctctccggcctgctggcgctggggacgccccccgaggcgagcggcgcggggcgccgcgcgttcaactctccgccgggggtcccggcgcgggggc

SEQ ID NO: 23715 - DNA, 100 bp, Chlorella protothecoides
ccatcccccaccgcggcgccgtcacccgctcgcgtccggtcccccaccacagcctccccatcccctgcctctgctccacctcccagcgcaggcggatcac

SEQ ID NO: 23716 - DNA, 73 bp, Chlorella protothecoides
ggtgagaggtatatccatgtgagggcaggctcccacctccctgcccggagaggacccaccgccacccacccgc

SEQ ID NO: 23717 - DNA, 61 bp, Chlorella protothecoides
gtcggagatgcgggagtgtcggggagggccacccgggacacgcctggcaatccacaccgga

SEQ ID NO: 23718 - DNA, 61 bp, Chlorella protothecoides
aggcatatccatgaagaaaacaccctcccactccgccccaccagcacttctcgacaccaac

SEQ ID NO: 23719 - DNA, 61 bp, Chlorella protothecoides
gtgaagctggatgtggtgtgggagtgaaggttggatgtctccccagcgacgccgtgcactg

SEQ ID NO: 23720 - DNA, 80 bp, Chlorella protothecoides
atcgcactccagcagggaatacatcacgaacatatacagttatatagtgttctgaaatggaaatactctctgtatgtaag

SEQ ID NO: 23721 - DNA, 61 bp, Chlorella protothecoides
acgctgcgattgcggcaaagctgcggctgcacctgacgccggtacggcggcagctgctgct

SEQ ID NO: 23722 - DNA, 61 bp, Chlorella protothecoides
aattctgtatcggataagagagtgtcttcaccattgggaaatgttatgcgcagaaggccca

SEQ ID NO: 23723 - DNA, 76 bp, Chlorella protothecoides
tgtggagtcacagatggccagcgtccagcaatgccccctccatgatccccaccctcccttcccgtccctgcaccca

SEQ ID NO: 23724 - DNA, 61 bp, Chlorella protothecoides
tccctccacttcaccccctctctcgacaggtccggactggaagtccttggtggcttccctc

SEQ ID NO: 23725 - DNA, 92 bp, Chlorella protothecoides
agagcgcagactctgggcacggacaacggccaacaagggtatgtttgctccctttcggagcttggccacaggatgaatcccatgaatgcaag

SEQ ID NO: 23726 - DNA, 2647 bp, Chlorella protothecoides
  modified_base (454)..(463): a, c, t, g, unknown or other
  modified_base (1082)..(1297): a, c, t, g, unknown or other
  modified_base (1373)..(1382): a, c, t, g, unknown or other
  modified_base (1729)..(1738): a, c, t, g, unknown or other
  modified_base (1921)..(1930): a, c, t, g, unknown or other
  modified_base (2463)..(2472): a, c, t, g, unknown or other
gcggcgacgtggcgccgccctcgcggccgcggcgcgtgcgcgcggaaccgacggggcgcgcggcggtgtaggccggcgcgggcacctggatgaagtcgtcggcgggggatctccagcgcgcccagtccagcagcacgtcctggaggtaggcgttgtcgcggcgcgtggcgcgcgccacgtgtgcgtggtctgccgccagctggcgcagcagcagcgggcggccgcccggcccgctcactctctcctccacggcctgggttggccgggggttggagtgagggtgattgtggtgaactgcgatgtcccgcatgttcctgtcaggtgcacatccagccagggaacagggtctggcgtcctcagccgtgacagcccccggcgatgccctgtctgcaggcttgctgctactcctccatgcgagcttgaaggttcagcacaccgcgcaagccatgcccgnnnnnnnnnntccctcagctgtgacggccccaggcgatgccctgtctgcagtcttgctgctactcctccatgcgagcttacaggttcagcacaccgcgcaagccatgcccgtcgcccgactgcacccaccctacccccaaaaccaacgccccacctgcatgcggtcaaagatccagaacatgatggcgtcgcggccggaggcgagcctgacggccgtcttcaccaccatggtgggcccggccatgaagcgggccgaggttgcgacgcccagtggcgagccctccatggtcgacaccaggacgctgcctgcgacaaaggcagggccggggcagggggtgcatgtttgtactctggaggtagctcaacaaggaggcccgagtgaagccctcttccatgccaaggagtgcctttcatgaccataccaggtatctgcgtaccttcccagcgagcattggtcgcgcacatctcgccctgggcgttgcgttgcttgatggcagctgcggtgtcgtactcccttgtccacgaccccttggcgcagagggaggtgaccttcacggtcgtgcctgtgtggctgatgaggtccacggaggcgctaccaaaccggagggcagcctgggaggggagcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgaagtcttcggggccgggtgggggtgggtgggacgaggaggtcatatgggcctatcacggctgccttgaacannnnnnnnnnagtttcagtcccaacactcgggtggaagccgtaccttgcggacagtccatggcaaacccaaatccttcaggaaattgttgaaattctcggtcttcaccagcctccagtagccagtgaagtcttcggggccggatgggggtgggtgggacgaggagggcatatgggcctatcacggctgccttgaacaatcacttgatggcggttacatgctacgatcgttctgctcaccagggttgcgtggggcaacggacatgacactgcgtgctagagagttccagctgcagcggcgtgtttcaaaggctagggaagcgacagttttgggtgggtaagcagttgcgaggcccgannnnnnnnnntaaaggcttggggagcgacaggtttgggtgggtaagcagttgcgaggcccgaggatgccaagctatcgtgtcatatttctcaaacttattcttttcggttggcagaagtattcatccagagacaggaagtgatcgcgcgacacgtttaacaccgtgcgggatcttgatcgtctggtccgtttnnnnnnnnnnttcaaactgattttttcggtcggcagaacaattcatccagagacaggaactgatcgcgcgacacgtttaacatcgtgcgggatcttgatcgtctggtccgtttcgagcgcagagtacgagaattccgagacggccttgcccgctgacctttgcatgcgtctcgttcccctcccgggcatggtcgcatgacagacaggaggctcattctggtagcctaccgtagtgtgctgcgctgggcccgggacaacgctgccgtcccgttccagttgcggcggggggatgtgctgctcctcgcccccggcgtggtcccgaccaccctgcaggacgcggcagccgtctcccagatcgcccgcgcagcctttcacctgaacaaggatctgaaggtgagcacagcgcccgggcgggcccgacctgggcccaccctgcggctggggtgtgctctgccacatgggctgtggctgtgactgcaggaaggtgctccgtcggcgccctgaggcctggctcccgtgaggctcacgcttcccgcgtctctnnnnnnnnnntatgggctgtggctgtgactgcagcaaggtgctccgtcggcgcccttaggccaggttcccgtgaggctcacgcttcccgcgtctctccttggcggaatggacctgtccagtgtttccctctgtgtcccattgccttccctgccttccttgttctttccaccccccagaccccccc

SEQ ID NO: 23727 - DNA, 171 bp, Chlorella protothecoides
ggtgtctccttggtgtccttgaagggctgttccagggtcactgccaggcagtcgaacctctgggccacctgcaagagaggggaggtcgagaggtgattatggtcgtcatgctcatgaccctcaccactcctctgttcacataggtgcggcgtcagcgatttatataagtgg

SEQ ID NO: 23728 - DNA, 61 bp, Chlorella protothecoides
gacttgttggggagtgcccccatggccacgctggagaatggggatctgagtccctgccaca

SEQ ID NO: 23729 - DNA, 71 bp, Chlorella protothecoides
cgggggagggtcggggatggatggacctcgactgcctgcaggagtgaagcgacgatctcagcaatgagagt

SEQ ID NO: 23730 - DNA, 66 bp, Chlorella protothecoides
tgtcggccaactcctcggcggacggtagaatggtgccagcgctcgcgctggcctgaacagcaggcg

SEQ ID NO: 23731 - DNA, 61 bp, Chlorella protothecoides
ggggagggcaggaaccgacaccaagatacccccagccgtcctccctccgcaccgagggcag

SEQ ID NO: 23732 - DNA, 61 bp, Chlorella protothecoides
ttctgggtcaggagcatcacaccacccatgtcattgctgcccaatcccttctcccacagga

SEQ ID NO: 23733 - DNA, 62 bp, Chlorella protothecoides
gtgggctactttgacatccccgtggaccacgtctacggcgactccgtcatcctggactacct

SEQ ID NO: 23734 - DNA, 61 bp, Chlorella protothecoides
ctacggcgactccgtcatcctggactaccttgcctccaagcgcatctccaccggcgacctg

SEQ ID NO: 23735 - DNA, 64 bp, Chlorella protothecoides
caagagatagggctgcaggcctcccctcctggcagattcatctcgcgacaccgccaggccactt

SEQ ID NO: 23736 - DNA, 61 bp, Chlorella protothecoides
agaaactcttgcatgcatgactgcccggagtgctgtccctaaacaaaactacttcagcaat

SEQ ID NO: 23737 - DNA, 70 bp, Chlorella protothecoides
caaacagcgtcctaggtatgcatggaaggctttatatctaatttgctcatgctgggtgcgagtgttctaa

SEQ ID NO: 23738 - DNA, 75 bp, Chlorella protothecoides
gcaggaggcgtgagcgcaggcgatgcgcgtcagcgcgggcgcctggcgtgagcggcgcatgccctccgcggcgtc

SEQ ID NO: 23739 - DNA, 70 bp, Chlorella protothecoides
ttcacacccatcatgttgccaggaacagcagcatgggtcgcagggcagaggcggacagcaatctctcgtt

SEQ ID NO: 23740 - DNA, 61 bp, Chlorella protothecoides
ctcccaccagcagctcctgcgacaagtcattaaacgtgtgcaccccgacctgtttctggcg

SEQ ID NO: 23741 - DNA, 75 bp, Chlorella protothecoides
aatggaggccctcagccgccaggcgttcgcgcaagggcgggggcaggcggtggggcgcgcccccgccgccccctc

SEQ ID NO: 23742 - DNA, 111 bp, Chlorella protothecoides
ccagagacccaccatggggagcaatggtgttggcctgctcggcggtggcttcagcgctcgctctgcatagagttctggatgggaatatacaggtgtaacgagcttctcata

SEQ ID NO: 23743 - DNA, 146 bp, Chlorella protothecoides
atcgtcccaagcggcctacgcgccgctggtcgtggacgggcggctggacacctgcctgccccggtctgtggattcggacgccgaggagacgacctgggagctggacctaggcggagggcccctgccgctgctagcgctgggggtga

SEQ ID NO: 23744 - DNA, 103 bp, Chlorella protothecoides
ttgtacggcagacagcaacggcaacatcggttccgacaacaagggcagaaacaacttttgcaccaagaacattggggatgacaacataggtgagagttgggag

SEQ ID NO: 23745 - DNA, 121 bp, Chlorella protothecoides
tgtgcgggtccagtgttggggctcgtggatctcatctggtgtgcttcagcgtcagagtcgagaggaagttcccaccgcaattgaaatgttgccggcgtggcaccctgggcatggtctggag

SEQ ID NO: 23746 - DNA, 74 bp, Chlorella protothecoides
cgagattatatacgtttgattcaagacatggagagtgagatccaggcgatcagccacctacaggcagctggacg

SEQ ID NO: 23747 - DNA, 146 bp, Chlorella protothecoides
ccccacccgaccgccatcggccatcccagccccatccaacgttttggtgagtcccagcatgcacttggaggacaaaccgcagcgtttctgggtggacaggtccgggttggggggcaaggtggggtgatcctgctcaggttacaatg

SEQ ID NO: 23748 - DNA, 162 bp, Chlorella protothecoides
gttgagagttgtctctggttggcgaggggcgtacataggtacgcacgctcgcatgattcttcaggcatgggttggttgggtcaaggttgttgggtttgtgcagcgtgtgaccaacagaaggcgacaggggactcgcgtccacccgacaatcaaaaatccgtc

SEQ ID NO: 23749 - DNA, 77 bp, Chlorella protothecoides
ccccccacctcccaaaaaggcgcccccgccactccctcccgttggatcacctcctccaccaacaccctcctcccctt

SEQ ID NO: 23750 - DNA, 61 bp, Chlorella protothecoides
gatctcctgcatgggtggcaagattggcttcggtgggttgcttcatctggtgcagaggctt

SEQ ID NO: 23751 - DNA, 125 bp, Chlorella protothecoides
ctgggtgctgggccgtggcacccagcataacaccggcggcttcatctgccatgctggtccgcagcaatgcagcgttcttgggcaggccttgcggccaaagggtgggacgtgcactacagcagcgg

SEQ ID NO: 23752 - DNA, 78 bp, Chlorella protothecoides
attctagaggaggacggcagaattgcggagcagcgtggatggagacgtgggaatcgagtggggacatggtcacaagcg

SEQ ID NO: 23753 - DNA, 67 bp, Chlorella protothecoides
atcagcggacgcagggctctcctcagcagcagaagcgggcttcgcctcagctgcaacgacggagttc

SEQ ID NO: 23754 - DNA, 75 bp, Chlorella protothecoides
acaactcaaagtgcccttgaactgagacgggaggatgttcagataagagaggcccgcatgtattcattctggcga

SEQ ID NO: 23755 - DNA, 61 bp, Chlorella protothecoides
gtgtgctccgtggtgttctggggtgcctggaccccaagccggcagaaccgctgcatgggaa

SEQ ID NO: 23756 - DNA, 64 bp, Chlorella protothecoides
ccgcggcggccaagaagggggaggggcgcaacgccggcggcggcaagggcgccgtgggcgccgg

SEQ ID NO: 23757 - DNA, 76 bp, Chlorella protothecoides
ggggggggggagccagagggtgggcgactgatgtcaagttgatgttcttggcacgcagctggtgtctagggatggt

SEQ ID NO: 23758 - DNA, 67 bp, Chlorella protothecoides
accactgctgagcatcccggacaacccggcaccttcacccgagagcgatccagggctcaaggaagca

SEQ ID NO: 23759 - DNA, 78 bp, Chlorella protothecoides
cccgagagcgatccagggctcaaggaagcagtccagaggctggcgaccaggatcaaactgattgcggaagagggagtg

SEQ ID NO: 23760 - DNA, 73 bp, Chlorella protothecoides
atgccttgcgtgccatccctcgtgtcccagccagcaaaggcatcagctggcgtgctcaccaggtaggcaggaa

SEQ ID NO: 23761 - DNA, 112 bp, Chlorella protothecoides
tcgtgtctcgcaggacatgggtaccctgacggtgcccgggcacggttcgatccccattctcccacgacggccggccatggacgaggcctttgcggagctgggcctgctgcac

SEQ ID NO: 23762 - DNA, 80 bp, Chlorella protothecoides
aagagggcgctgatgtctcgcatctggggcaagagcattccaggggggctgggcagtggggcgacaccgtccaccaaaca

SEQ ID NO: 23763 - DNA, 78 bp, Chlorella protothecoides
tggatcggtacggtatgacatcatatttaaggcctgtgtgtaatgcttgaaagtgcacatcttgtgtggacgtgaaat

SEQ ID NO: 23764 - DNA, 70 bp, Chlorella protothecoides
catcaggcccccccaggccatcagcgctaccaacaaagctctccctcccaaggaccatggcacacaggcc

SEQ ID NO: 23765 - DNA, 61 bp, Chlorella protothecoides
ctccctcccaaggaccatggcacacaggccccaccctccgcgtctgaatctcgcagccccg

SEQ ID NO: 23766 - DNA, 167 bp, Chlorella protothecoides
tctcatgctgccctcatggcggccgtccgtttggcaagagggcaggaacaccatcatcccacctgtgctcctgtcgcacaccatcgcactacacatattcttgtgagtttgaagtgatggtggtgatcgcgctcatccattcatgtgtgccactggacatgtgatgt

SEQ ID NO: 23767 - DNA, 378 bp, Chlorella protothecoides
ccccaagaaatcgctacctctcccgccccccgttacatgtataccctcggccagtacaaacaagggctgggagcaccggccccattcaataactctgtgctgagtgcaacttcctgattatttatgagcgacccatatcgctttgtgctggatgggtacccttagaggaaacaggagccgcacccgccttggatgtgcgtgcttaatcctcctccgagcatccgcactgcacgtcgtggtacgtgatgtgtaccaatttgaatcgattcatttatttatatcgcgaagctgccctctcgtgcgattcgcacgtcccacacccactcttgcccctcctgccaggcatcctgcacgtcggccttctacgcgctcccaagt

SEQ ID NO: 23768 - DNA, 65 bp, Chlorella protothecoides
gatcttgattgcaaactttgggggtgccgacgcactgcggtgtgtcaccgcgacaccctgttcct

SEQ ID NO: 23769 - DNA, 79 bp, Chlorella protothecoides
ccacccagtccatcagcaattagagactgtctgaactctgagcagtgattttggcgagtcttccatctggaggccgaat

SEQ ID NO: 23770 - DNA, 79 bp, Chlorella protothecoides
aacggtggtatgccacccagtgtaccccttcggcatccatgtgcccctccctcagaggtcaccaaagtcttcgacgtcg

SEQ ID NO: 23771 - DNA, 61 bp, Chlorella protothecoides
ctccccacaccatggttgagcgcaccttgcacccctgccggtccttctacgacaactccca

SEQ ID NO: 23772 - DNA, 74 bp, Chlorella protothecoides
gctggcgcatgcgtgcgagacgcacaggtggggtgacagtgtgctgcctcgcgtgaatggcggaggcttctcaa

SEQ ID NO: 23773 - DNA, 204 bp, Chlorella protothecoides
ttgactgtgtggattggcacccgaggtaggtctaaagacgcaagggcgtaggtcataaagtattgaaccggcaagtaactcctgaaacggcccactctgtgcctccttgcagcaatcttccaatggaatagatgcaggatatgaggcagcagggggccatgcattgatctctgcaacctttcctttgtccacgtcccgtgcagg

SEQ ID NO: 23774 - DNA, 70 bp, Chlorella protothecoides
gggagcttggaggagagagggtgggggccatgtattaattaagagcgaggggggagcatgacttggtggg

SEQ ID NO: 23775 - DNA, 61 bp, Chlorella protothecoides
ctcgtccattgcagccacaacacaatcaggcagaacaggatgtccactgctccgccagggg

SEQ ID NO: 23776 - DNA, 61 bp, Chlorella protothecoides
gactccctgggattgcccaatgagtgctactgtgacaccgctgccatcacccttggagaag

SEQ ID NO: 23777 - DNA, 92 bp, Chlorella protothecoides
tacttcctcatccccgagaccaagggtgttcccgtggagcgcgtgcccatcatgtttacccgccatgccctctggtcccgcgtcatgggccc

SEQ ID NO: 23778 - DNA, 80 bp, Chlorella protothecoides
cattcagtccgaggaagcatcctgtgagggggtgggcgtgtggtgggagggggcgtgtggtgggagggtctgattataac

SEQ ID NO: 23779 - DNA, 61 bp, Chlorella protothecoides
acgacgtcgatgacaggaggaccaggctgtgcctgacccaccactcttcccttgcttccca

SEQ ID NO: 23780 - DNA, 69 bp, Chlorella protothecoides
cttcgactcgtgcgaaggatatgttgcaaggcaccatggccttccgtaatactggtacacctttatcat

SEQ ID NO: 23781 - DNA, 79 bp, Chlorella protothecoides
tgataagagttacatgtgactctcggcaaaacattcaaactctgcaaaacttcagactgatcaccacgtatgtgatctg

SEQ ID NO: 23782 - DNA, 113 bp, Chlorella protothecoides
gatgcggccgtgaggtggggcctgaaccatggggatgaccggggggtatggaattcttctcactgatgcaagagagaacttttacatcagacatccagtgcacccaatccagc

SEQ ID NO: 23783 - DNA, 139 bp, Chlorella protothecoides
aaccaatggtaattttggataaaggggtttacgatcttccagtcgatgagtatcatgttgggagtcgcactatgcttcatccaacttggatcactctctggtgggtagagcgcgcaggcgggaaccaatcacccagcac

SEQ ID NO: 23784 - DNA, 77 bp, Chlorella protothecoides
cctccgtcatgggctccaagggcagcacctatggtggagggcatgcgcacactgttcagcacctgcttcctccctga

SEQ ID NO: 23785 - DNA, 178 bp, Chlorella protothecoides
tggtcagcgcagcagaggcatgggattcacaggtgtgcatgcctccatacccctctgagccccggctcagtgatgaattggcattaggtcgtagtgggcacccaggccaggaggcagccggaggcatcacccgcagcaactcacatgggatgatgcggagccacttgaggatgaacac

SEQ ID NO: 23786 - DNA, 61 bp, Chlorella protothecoides
tttgacgtgttcgcgcgccttcccgacccctgggtcgggtggcttccggagtggttggttg

SEQ ID NO: 23787 - DNA, 79 bp, Chlorella protothecoides
tttggtggtctcaaccaatcccaccttgccagactcggtgatgcagacagagctggtgccagtggaggcctgcaggagg

SEQ ID NO: 23788 - DNA, 61 bp, Chlorella protothecoides
tgccggcaccgacgaggcgctggcctctgggatctttggggacaatctgacgcgagtgagt

SEQ ID NO: 23789 - DNA, 69 bp, Chlorella protothecoides
ccagattctcgccctttgtccattgtgggtcgcaagggcgtgcgccaaacaattcccaccttcgacact

SEQ ID NO: 23790 - DNA, 495 bp, Chlorella protothecoides
  modified_base (188)..(420): a, c, t, g, unknown or other
catgacaggaatgagggagaggatcacaggtgcgggcgtggactggcctgcacagcgtggggaggggtatcagtccggttaggacgagacgccgtgggtgcgtatcagacctcctctgcaaaaggcgctgctgaattgctctggcagtgtgcagctgaattgctgcctcacatgcgcctgccactgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggtggccaagggtccggcctgcacgatgccgatgttgccaccgctgaaattgcaaggtttgggtgcaggg

SEQ ID NO: 23791 - DNA, 61 bp, Chlorella protothecoides
cggtgcgagcgtgtatgactggagtggctcctgcagatggggctgcactacctgttccgcc

SEQ ID NO: 23792 - DNA, 116 bp, Chlorella protothecoides
tcgccgcccggggatcacacatctcccacatctcatctgttctgctgccgctgcgtcgaccgcaaatcaagacaaagcttcacttgtcatcaatctgcaccgcaagttcatcgagg

SEQ ID NO: 23793 - DNA, 61 bp, Chlorella protothecoides
ggcggtggacttgcccgaccagaaggactccagagcctttttcatctcgcgattgggcccg

SEQ ID NO: 23794 - DNA, 61 bp, Chlorella protothecoides
gtaggccgcagagtagaacacagaggctggattgatgcagaaaaagagcacggcagcgtct

SEQ ID NO: 23795 - DNA, 61 bp, Chlorella protothecoides
cccaagctcttgtgcccattcccccctacccctcacccgaccactcgcgaccaggtggcct

SEQ ID NO: 23796 - DNA, 71 bp, Chlorella protothecoides
ccgcaaacattgttggcacctacatgaaccgattgtgaggcggagcagcaccggtggaccccgcaggcatg

SEQ ID NO: 23797 - DNA, 61 bp, Chlorella protothecoides
aggaaggaatcagtgttgtcatcgagggatcgaattggctctttgcatgtgtattggaaag

SEQ ID NO: 23798 - DNA, 77 bp, Chlorella protothecoides
aacgtgcctgcaggatgcaaactatttcattcatgtatcgatatattgtacatagaatgcatgtgcatcaaatcaag

SEQ ID NO: 23799 - DNA, 71 bp, Chlorella protothecoides
tgcctcaacaagagactccacatgctccttaattctcggagcacagcgctcaccgttggactcctcgacca

SEQ ID NO: 23800 - DNA, 78 bp, Chlorella protothecoides
gctcctgacgccagccgctcggtcccctcgacccatccacccccctcctcccaccatccaggaccgcatagtagggca

SEQ ID NO: 23801 - DNA, 69 bp, Chlorella protothecoides
gcatgggcgaaaagtcctcgtgccattcacactcggattgaacccacactgaatgtgtgtgggaggggg

SEQ ID NO: 23802 - DNA, 144 bp, Chlorella protothecoides
agggaggcaccctggctgtgcccctggtactgatgcaggctgaactacaccctgtgttatgccgtcctcgtccctccccaacccatgtctctcccccacccttgtctgccccccatttgccccacccacaacacacccacccac

SEQ ID NO: 23803 - DNA, 80 bp, Chlorella protothecoides
gatagagcatcaggatctgaacagaccgggtcatgcctcctcacaccagacgcaagacctctcaggggatgtttcgcctg

SEQ ID NO: 23804 - DNA, 68 bp, Chlorella protothecoides
cactttttacgctgggagcttgttgcgtcaccacgtgcagcccagcagaggcacagagcaacatggaa

SEQ ID NO: 23805 - DNA, 598 bp, Chlorella protothecoides
ggcgcaggcgctgcgccccacccaggtggcgctggcgcgggcggggcggcgcgcggcccagcgccgcgcccaccgcgcggtagccgccgtgcatcgtgacggcgtagtgcaggtcgtaccgccccgccgccagcaggtgtccgcgcgagggcatgaccacgtcctcccgcggctcggccagcacttcgctcccatcatcggccagcgcgatcagggtcggcagctccggcgcctcgcgcgacacccgccccgtcacctggttgtaccagtacccggccttcgacggctgggggggcagggcggcggggtccggggtaccgggcggtggtcgtgggtcgtcgccaccccccatgcccctggccccctcgccgcctccatccccgcgtccgacgccccagcgctcctcgccgacctccgcctcgcccggctcctcgaacctcgtccagtgcgcggccacgaaggcggccagctcgcgctgcatgttgtccgcgcagtcccagtagcccgcggggcggcggcaggccgccagccccagcgcggcggccacctccagctggccgccggcgaggcgcaccaggcgcgcgaggtcggcgcggcc

SEQ ID NO: 23806 - DNA, 61 bp, Chlorella protothecoides
atcgtcacctggcagtgtatacctccagcaaggtgccttttgagaccacaagttcaggtag

SEQ ID NO: 23807 - DNA, 96 bp, Chlorella protothecoides
gggactgtataatggagggagtgtgagggtctctgcaatggcatgacgcgcagcatggattgcatccccaactcagacatgaagccatgcagcact

SEQ ID NO: 23808 - DNA, 155 bp, Chlorella protothecoides
gtcgacgatctcgacccctgccagaatcatatgatcacgctcatgataatactaatggttttaaaatcataggagacgaagacaaggacgacgaggcagcggtcgacgagcacccattgatcgattcgtccccgggcgagtaatcagactgggcg

SEQ ID NO: 23809 - DNA, 61 bp, Chlorella protothecoides
gcgggcctctgtggggagatggagtgagcgggaagcagtcgagagcaccctgggcaccacg

SEQ ID NO: 23810 - DNA, 61 bp, Chlorella protothecoides
ccccgcgagaaagccaggcaaccttgcaggagaccgggagtctgccaactcaccatcctcg

SEQ ID NO: 23811 - DNA, 62 bp, Chlorella protothecoides
cctccaagcaccatgctgtaacggggaaaccgagcaagtggcccgggctcagcagaatggcc

SEQ ID NO: 23812 - DNA, 61 bp, Chlorella protothecoides
acatccctgctgtttctggccccaggggcgtcaccccaccactgacacaccatctgggaac

SEQ ID NO: 23813 - DNA, 61 bp, Chlorella protothecoides
tcgactttggggaggtcacaggcgagctgacggaagctctggaaggtgagacattgcgttt

SEQ ID NO: 23814 - DNA, 326 bp, Chlorella protothecoides
cattgttgctgccaaagttatctttgcccttgttgcctgatccaatgttgccatgtaaatctgctgtgcaggccatttgtcctgctctcaggcactccacacccaccaggatctctgttgagcgagccgtattgactgtgaaggggctcatgttgatggcgtcgacagacagtccaaggatgtggagggtactcgtcctgatagagccctgcttgctgtagcccagttccctgtgacgacaaatagcgacatggatgaggtcgaggtggaacgcagaaagcaatccttccttttggtttgcaggacaccagcccacagccacaggc

SEQ ID NO: 23815 - DNA, 77 bp, Chlorella protothecoides
gagtatgaagataaaatacaacactgacgcccagacagtcagcaggaaggggattggttcttcatgaaatgagatgg

SEQ ID NO: 23816 - DNA, 286 bp, Chlorella protothecoides
agcctccgccgacatgagggatgcctgggtcgcagagtggccaaagggatccagttgccaggcgacgcgaggcttcacaccaaaggtctcctgaaggaagctgcgcagaagggtgaagggaacagcaattgaatgtaccgcacatgagaacaatggatggtcatgccccctttacatgcccttggagggcccattccatgaaacagcaaggagtttgcatccttgtgctgacttgtagccttctcattgggtgctctcatttgcaatgctccaggtccagagcctc

SEQ ID NO: 23817 - DNA, 61 bp, Chlorella protothecoides
gcagcaggatgagtggcaggcactcccgggtcttgtgtgggccggcgctgggcttgggagc

SEQ ID NO: 23818 - DNA, 61 bp, Chlorella protothecoides
gcgacccggcaacctggaccagagtgagaacataccaccctcccagacgttgcacttcgcg

SEQ ID NO: 23819 - DNA, 61 bp, Chlorella protothecoides
cggagcttcggcgcccacgccgcacctcgggagcggaactcccggtcgccctgcgcaatct

SEQ ID NO: 23820 - DNA, 61 bp, Chlorella protothecoides
cgttgccacctgaaaggccatgcccgcccaactgcaacctcccttcaaccatgcgcgcatg

SEQ ID NO: 23821 - DNA, 61 bp, Chlorella protothecoides
tcagagatggcagtgtctcaccagggaaggacctgccaacctccagcccagaccatgtcag

SEQ ID NO: 23822 - DNA, 178 bp, Chlorella protothecoides
ccggcgtctgccccacccatgggaccccgaattgtgaccgtgcttgggcccagctccgccagcgcctttcccgccagccccgagcaggaggaggctgcccctgccttccccagcccactggggagcgggacaaaggcgagcgccgacacgcccaatggtaacgccggcacgcctgcca

SEQ ID NO: 23823 - DNA, 92 bp, Chlorella protothecoides
agagcgcagactctgggcacggacaacggcaaacaagggtattgttgctcccttttggagcctggccacaggatgaatcccatgaatgcaag

SEQ ID NO: 23824 - DNA, 102 bp, Chlorella protothecoides
cgatcgatgctgaagccatggggtccgtcattcaattagttgtgttcagatcaatctagcggcctggagaccgtcgaattatcgtccagaatcaggcgaaag

SEQ ID NO: 23825 - DNA, 61 bp, Chlorella protothecoides
cataagaggtcctttgcagtgtggtggatgacccaacgcgtcaggagcagccgctcagaga

SEQ ID NO: 23826 - DNA, 158 bp, Chlorella protothecoides
atcgagcctatttcgaggcttggagccaaatgcgatgctgcgcaggagtcggggcgagaaaaagtagaagactatcatctgcagcatcgctagagaggggctggtgagtgggtctgtagatgtgataaattgagtggtcaacatgcagccctgtaacg

SEQ ID NO: 23827 - DNA, 76 bp, Chlorella protothecoides
gggtttggcgtgcaggggagggggcggacgacaatataacccacctttggtgtggcagagcccggctgcctcatag

SEQ ID NO: 23828 - DNA, 215 bp, Chlorella protothecoides
cgtcgtcttcatcgtgagcttgccctgtgatgtgcagtgaaaagggctccacagcatgaatactctgcccgatagtgtacccgactgcagccctgagggtgccactcagatgcaaatggattcgactctggcacgctgcgtgcattcctggccacagttgctgcttgccctgggcccccaccctcaacaccatgccacaccgtcttgctggcaga

SEQ ID NO: 23829 - DNA, 74 bp, Chlorella protothecoides
cgtccccctgcctgcctcagcgctcaggcctgcgacgccggccaccccttgattctccaggtcccgcaccgcct

SEQ ID NO: 23830 - DNA, 115 bp, Chlorella protothecoides
aatggaggatgtgtgtagagcagaatctgtagggaccgccgtagattctgtccatcccagattctcagggctcaaatgccctggcctggcaggacgtctctgattctctgctggg

SEQ ID NO: 23831 - DNA, 61 bp, Chlorella protothecoides
ccggtatctagtttgccttggatcagtgtgagtggaagtgtctcatctgagggtcctggag

SEQ ID NO: 23832 - DNA, 63 bp, Chlorella protothecoides
tcccaacaccgtaaaccctcccatgctgcaacgctgtcgcagggtattgccagcggggagtca

SEQ ID NO: 23833 - DNA, 88 bp, Chlorella protothecoides
gcccctgatcagcgggacacagtcctgactgtttttgtaatgctcagtaggcaggcttgctgggatccttggaaggggttacaccctg

SEQ ID NO: 23834 - DNA, 91 bp, Chlorella protothecoides
atggccggcctgggtctgaatgccgctgcctaccatgtacgatggagtgcttgccaatcactgcagggctgcgagaagagcacatgggctc

SEQ ID NO: 23835 - DNA, 61 bp, Chlorella protothecoides
gtacgcccgagaaaaaggttatatacaatggatatgctcttgtatctgcacgcgctcgtgt

SEQ ID NO: 23836 - DNA, 17781 bp, Chlorella protothecoides
  modified_base (164)..(173): a, c, t, g, unknown or other
  modified_base (239)..(248): a, c, t, g, unknown or other
  modified_base (1669)..(1678): a, c, t, g, unknown or other
  modified_base (2100)..(2109): a, c, t, g, unknown or other
  modified_base (2397)..(2406): a, c, t, g, unknown or other
  modified_base (2898)..(2907): a, c, t, g, unknown or other
  modified_base (3190)..(3199): a, c, t, g, unknown or other
  modified_base (4888)..(4897): a, c, t, g, unknown or other
  modified_base (5076)..(5085): a, c, t, g, unknown or other
  modified_base (5358)..(5367): a, c, t, g, unknown or other
  modified_base (5747)..(5756): a, c, t, g, unknown or other
  modified_base (6187)..(6196): a, c, t, g, unknown or other
  modified_base (6756)..(6801): a, c, t, g, unknown or other
  modified_base (7603)..(7612): a, c, t, g, unknown or other
  modified_base (8065)..(8074): a, c, t, g, unknown or other
  modified_base (8489)..(8498): a, c, t, g, unknown or other
  modified_base (9034)..(9043): a, c, t, g, unknown or other
  modified_base (9140)..(9149): a, c, t, g, unknown or other
  modified_base (9239)..(9248): a, c, t, g, unknown or other
  modified_base (9730)..(9739): a, c, t, g, unknown or other
  modified_base (10577)..(10586): a, c, t, g, unknown or other
  modified_base (11132)..(11141): a, c, t, g, unknown or other
  modified_base (11694)..(11703): a, c, t, g, unknown or other
  modified_base (12043)..(12052): a, c, t, g, unknown or other
  modified_base (12905)..(12914): a, c, t, g, unknown or other
  modified_base (13241)..(13250): a, c, t, g, unknown or other
  modified_base (13698)..(13878): a, c, t, g, unknown or other
  modified_base (13961)..(13970): a, c, t, g, unknown or other
  modified_base (15084)..(15093): a, c, t, g, unknown or other
  modified_base (15409)..(15418): a, c, t, g, unknown or other
  modified_base (15535)..(15656): a, c, t, g, unknown or other
  modified_base (15903)..(15912): a, c, t, g, unknown or other
  modified_base (16095)..(16155): a, c, t, g, unknown or other
  modified_base (16776)..(16785): a, c, t, g, unknown or other
  modified_base (16838)..(16847): a, c, t, g, unknown or other
  modified_base (17289)..(17298): a, c, t, g, unknown or other
atgctgcattaaactggcaagtgcttggtagcgacattgaccaagctgggacaagggcttgtcatgcattgattaagcaatctcacgctaagcggagtatccgcatcggtccgaggaacaaagtatggaggctttttgcgcacccctgtgggaatttcggtgcnnnnnnnnnnatacttcatattacccgagggaccggaggtgaatcatgctgcattaaactggcaagtgcttggtannnnnnnnnngtacttcatattacccgagagaccgggggtgaactatgctgcattaaactggcaagtgcttggtagcgacattgaccaagctgggacaagggcttgtcatgcattgattaagcaatctcacgctaagcagagtatccgcatcggtccgagcaacaaggtatggaggcgttttgcgcacccctgtgggaatttcggtgcttgttcaaatttcgttgagccctcccttccccttcttaacctcgttcccgcgcgagtttggtctgtcgctaggagcgatcgatcggcgaagccctgaacgcgtcatgaccgaccctgaccgcggtgcccgtcctactagagctatttttggtcattacaagggacagaatcgcgcactggaacgttcgcgaggcaccaggtcctccccttaaagtgtggtcggcccccggcaggtccccgaccgtggcgcaagtgatctgcgctccttccgcactttcgcgctgtcccgctctcccgtacttcccaaaatgcagcgcagtcttcgtaaaactgatcacatgggtggctgggtcaagctgtcactcttgctgggcaccttcctagcaggattcctagctggccggttgggaggcccccgaccgagcgcccccctgtctgctgcagactcgctcctccggcaacaggtaccgaggacacactatcatgctagatcagggccagacactgtgcacggatgcatccggattactgtgcggaaggggttgacggttacgttgcgctgcctcgtggggagtggctgcccagcccctgttactttaacctcctcccgagtactcccctcccacaccaatgcacgcagttccagggcgaggctcagccccagccgtccatccccatcctgggctcgaaaacgggtgagctcaccccttccagcaccaagcccctggtcccacgcagcgtctgcaccaacacctgccccaccgccagggacggtgtgtgccaggacggcaggcccggccccggcgtcgacgccgaggccttctacgccacggcccgcaacgtcacctgtgacctgggcactgactgcgctgactgcggggcctgggtgacggacgccagttcggaggcgctggcctgggcgcccgtagcgcgcctgcgggacgcgggaaatacgctgctggtgaagcgcgtggcctcgcctgcgggctacctcttcggcatcacggaccccgccctcgacactgacgtctccaggaaggtcgatgccaccggcgtcttcgagcccatcctcaccatgatatggtggggcaaggggggctgcaagggagcgtgaggaatctgtgtgggggtggaggagaggggggggacttggtgtggtagagggtaccgatgtgtgtggggttgggagactgagtggagatgattgtgatggcgaggcaagnnnnnnnnnnttaacttggtgtggtagggggtaccgatgtgtgtggggttgggagacggagtggagatgattgtgatggcgaggcaagtcaccttttgcacccaatggccccacagcatgcgactcagcacccccgccgccctgctcctctgctgaccggcagttttgtccctccttgagcaccccccaggcaccaaattttggcagactgcgtgcagcccgacgggagccggaggctggtggtggacgtgggtgccaactttgggtactacacgctcatggcggcctccctggggtgcaggtgggcggagcacagcatgttgtgctcaggcctggcccgaggtacaggatgaattttgtttggtatgttgctattggagggcacactccaacaatccacccccatcacccatccagggtcaaggcctgggnnnnnnnnnngctcaggcctggcccgaggtgcaggatgaattttgtttggtatgttgctcttggagggcacactccaacaatccacgcccatcacccatccagggtcaaggcctgggagccggtcccctcttttgccgccttcacccagtatggcctgctgctgaacaacctgacccatctggtggaggtgggtcttgtcgtgggggcctgtggggtcgagtgcccgacaggcctgtgcttggtgctcgtcggctgtggtgtgcacatgaggcgcccaacatgagggatgcagcggcnnnnnnnnnnagcctgtgcttggtgctcattggctgtggtgcgaacgtgaggcgcccaacatgagggatgcagcggcgctgctggtgtggcatgcacggaccgcgccaactcatgcggaggaatggccactcatcccgcccctcactcctgctcctcacttgctgcagctgagggacaaaatcgtgagcgacaccaatggggccaaactcaccatgagcgtgcctcgcaagggcatctggggcactgccggagtgggcggcgacaaccttgcagggtgtgttgcctggactgactgcggtgggatctctctggggggagggggctggtgtggtgcgctgatgaactggtgcacatcagacggccacgggtagtcaggaggtatggacagcgacagctggcctgcatgcttgacctgaaaagatcataaccagaccatcccttgacccctccctctccatgccatgccaccatgtgcagcgctgccaaggcagactttgaggnnnnnnnnnnttgcatgcttgacctaaaaagatcgtaaccagaccatcccttgaaccctccctctccgtgccatgccaccgtgtgcagcgctgccaaggcagactttgaggagatcgagaagacgacggagcgtctcgacagcattgtgaaggagaatgtgcttctcatcaaggtgtgctgcatgttctgtaagcacactggctgcatcaggcccttcacgtggcgttctggtgttgcagaggtgtcgcaggcatgtttgcatcgggggcctgccctgctgagcattgcagcnnnnnnnnnncgtgctcctcatcaaggtgggctgcatgttctgaaagcacactggctgcatcaggcccttcgcgtggcgttctggtgttgcggaggtgtcgcaggcatgtttgcgtcgggggcctgccctgctgagcattgcagcgttgttcagccacatcgcccccgccacgcctaccatccatccccacaggccgacgttgagggcttcgagcccatcgtcatgcgcagcgcgcgcgacctcctgctcaagcactcggtggagaacatcatcatggagtactcccccggcgtgggcgagcacctgcagaattgggagaagtcggccgagaaccccaggatcatcgctgcgtgagtgacagggtggatggggagcgggtggtgaggggtaggcatgccacttagagcggagggtggagaggtgggggagggaagggctgctctgagtggaaacgggggtggtgggactaggatttgaccaaagtgccagggtgcaggcagcacctgaccgtgcttcctgccatcagaacctgaggtttaccaatttgcccaactgctgatgcacggctctgtctggcagagcccgctgctctgtctacagccagccacaaacatttctcagtcctctccttgcaccccgtccaacctcaatgctgctacaggctgctcaatgcggggtactctgcctacgacgtgccctgggcgctggagaagcagttccctggctttggcgcccccatccccagcctggagagggtggtggggtccatgctcgtgcacgacatccaggacatggagcgtgccaagcgcatcgccatgggctcccagctctttgagcaggtgcggaggggggtgcggggagggtggtagccctggtccgctgtggcctcgccctcgtgcaggggggccatgccagcggacaggtgactgcactgtgccacctcccatgcttgccctcgaagaccggaccaaaaggcggccccctcttcagacaaagtatcaacccctagcatccgccgccgccctttccagctgcccgagcatgccgcctacctggctcccagcaacacggtgcccgactatctgcacccgctgtcctaccactcctccttcggctacaacaccaacatctggctgacgcggcgcaccagcgtgaacgccacgggcaccgccaccgctgcgcccgccggcttcgatttggccagcgagtggtacctccctggaaaccagggcacggggcgccgcccctgcgactggttctcggtggcccagcggctgggcaaccgctgccgctgccccaagggctggaagtgcgggcaggctgccaaggcgctggaggccgccgccaagctgggcaagctggcgcccaagcccatggagtcggtggaggtcacccagttcagcgtgcaggcctggtaagcatgccagcggtggctaacgccggcaaactccgatctcaccccacgggctggtattcatgttgtcctttttcagcccggccatgcctgagaggcgctgtggccgtgttttcattgtgcatggcggcagcaggaccgatggaatttttctagtacatcgagcatgcccacgttggccattgccccgtcaccggaaggtgtaggatgccagtaatgctcgccgatatgttcgtttagggtaccgggcgcgccgtgtaccatggttcaatgctgtccgcacnnnnnnnnnngaggatgccagtaatgctcgcggatatgtcgtttagggtaccgggcgcaccgtgtaccatggttcaatgctgtccgcacgatgacagcgggtaaggaagctggctcctgcttcgcgtccgtatgcagagagggcggttacatcaaggggtgatcaccatgcgaactctgttgcgtgctnnnnnnnnnnatatgcagagagggcggttgcatcgaggagtgatcaccatgcgaactctgttgcgtgcttttggaagagcatggcccccctctgggttgcgtcgatgcgacgtgtaatgctgagcggctccgtcgtcatgctcgcgcgatttgcacgagggccccacaccaggatgcagcctccggacacccgcgcttccacctaagtgctagtgcatacttttttcagaaagacaaaacccgatcatgatcaatgcattaatctgcatgcgtggccttgacnnnnnnnnnngcctaagtgctagtgcatacgtttttcagaaagagaaaatccgattatgattaatgcattaatctgcatgcgtggccttgactatagcttcgaatgtcaaggaggtacgtggcgagcccttgcctgcgcggtcaccgcaagatctaaaaacatagatatccagggtcgaacgaccgcaacgaggagtgtccacgtagaaatcttggacgggcaatagagcggttcccgagccattagaggtcatgcagcggtcaaattttcgtgccttcaaaaagagagaagcgtgcaagctggcgtccacgatttgctcccgtagtttgccatacttttagccgacgtctgcggtaggtgagtgtgccagggcatccctaccctgtcgnnnnnnnnnnagccttcaaaaggagagaagcgtgcaagctggcgtccgcgatctgctcccgtagtttgccatacctttagccgacgtctacggtagctgagtgtgccagggcatccctaccctgtcggggtatcgtgccgcacaccgcaccatggaccgatccatgaagaagcgcttccgagcgagtgtaacggcgagattaagcttcgtcatcttcgtcttccttgccggcgttctgatcggccggcttgggaaaccgctcttgggcgagtccgtgctcgctacaggcgacttccaggtatgtgcgctgtggcatgcacctggcgccggcacggccgagtatccagcagttaaacctgccagatgtagaacgacacatgattttgaagcctgccgctgcgaacccattacccccatactgcgcagcagaccccgagctgnnnnnnnnnngttttgaagcctgccgctgcagcccatcccccccatactgcgcagcagaccccgagctgggagaccaaggccctgaacaaggaggcccagggggtggtcaagggcgcccaagaggtggttaagagcgccttctcccgtgcctccctgaccgggacgtcacgcagcatcaagcccggcccggtgcgcaccgtgtgcgagaacacctgccccaccgcccgtgacggcgtgtgccaggatggccgccccagccccggcagcaacgcgacctccttctacgagaccctgcaccccgtggtgtgcgacctgggcacggactgcgcggactgcgggccctgggtgaccaccgccaccccagaggccctggcctgggcgcccgtggcgctgctgcgcacggcggagaccaagctgctggtgcgcagggtggcctcccccgccggctacatcttcgggatcacggatccagagctggacacggatgtgtcacgccacgtcaacggtacagggctttttgagcctgtcctgaccctgctctggtgagggggaaagagggaggggggtgnnnnnnnnnnnnnnnnnnnnnnnnnnnnnnnnnnnnnnnnnnnnnntccctcaggcggagggcctgatgccagccacccttccctgaatatgcgcctgtcacatgctgccttgggggaaagaaaagctgcaccttgtactccttgcgaatcatgtgccggtgtgtcctgaagagtcccgacctttcctccacccccgccaatccgcacaggcaccagctcctagcaaactgtgtgcagccggatggaagccggaggctggtggtggatgtgggtgccaactttgggtactacaccctcatggcggcttccctggggtgcaggtgggcaggagccgggaagggggtggacgcccttgggctcccagctatcattggtggcgatggattggggcgcgctgggtggtcgccactcttttcctacatgaaaggcaggagcatgccggggcgtgctgcagtagcttgccgcgcacgcattgatggcatcgtttcatgagtgcttgccgaatgtcttgaggacctcactccaaagacctccctcgccagaggctgctgctgagacttatgcgtccgtccctatgccctgtgtcgcagggtcaaggcctgggagccggtaccaatgttcgcagccttcacacagtatggcttgctgctgaacaacctgactcaccttgtagaggtgaggaagggaaagggtttgcaaggggatatgaagcacttgttggctgacaatgccctgaccctgacggcttgggtgatcacgaatctcttccccagagccttctgctgtatcattggcagcccagtcctagacacccgccatttggtctgttctctctcccactggcctnnnnnnnnnnaggcttgggtgatcacgaacctcttcccccagagccttctgctgcatcagtggcagcccagtcctagacacccggcatttggtctgttctctctcccactggcctgagtacacctgtaccatcctcttgcagttgagcgacaagattgtgagcgactctgatggcgccagcctgagcatccacgttccaaggaagggcatctgggggacggctgcagtcgtgccaggaaactccactgtgtaagtcgcgacccactctgcccccttgtactggatgggtcccgggagggcctgggatgagggcagtgcctgctgtgcagagccgagcagcctgcgcgggtctcaggttgcgaagtcggcccttttaccattgtcatcccccaaaaccatcatccccacccctgctccccccaacgcacccttccctgctgcaggaatctcgagcacagccatnnnnnnnnnnagggtcccgggagggcctgggctgagggcagtgcctgctgtgcagagcggggcagcctgcgcgggtctcaggctgcgaagccggcccctttaccattgtcaccccaaaaacccatcatccccacccctgctccccccgacgcaccctcccctgctgcaggaatctcgagcacagccatcagctggtggtcaagacgaccgagcgcctggactccgtggttcacgaggacatcctcttgatgaaggtgggtcgaggttttgtgaggcctggacggcctggcgatgggggtccttgtagatttctgggcagctgcacaggccgggcttctcaattctccacttccaagacgaagtggagttcagtgcatggtcatgaagtggcacgctggtctgcattggttggtggcgtcagcccnnnnnnnnnntcccacttccaagacgaagtggaattcagtgtgtggtcatgaagtggcacactggtctgcattggttggtggcgtcagccccctgcagtctgtcagggatctgactgccattccccgtggccgcccacacaggccgacgtcgagggctttgagcccagcgtgatgaggggggcccgcgacctcctgctcaagcgcagcgtggaaaacatcatcatggagtactcccccggagttggcgactggcagcgtgactgggacaagtcgatgtccaaccccatcatgctcaaagcgtgagtttgctgaggcagagggggaagaggggtggggggctgagagggagatccgcgcgcaggattcctggggcccagcacgggaggccgcccctcgctcagcgctcgcacccgcagactccctgccccgccgacgcccagcgctggagcgtaggaggtcttgggggcgtgcagcgccgttgtgacccgaagctgccactctgttaccgacctgacctttaccccccccccccccccccccccccnnnnnnnnnncgcgcaggaggtcttgagggcgtgcagcgccgttgtgacccgaggctgccactctgtcaccgacctgaccttcccctccccccccccccccccacannnnnnnnnngtcggcaagctgggctgcgagctgaaggaggaggtaagggcttggttcaatggggtggccctagacgggcggtgtttggtgaatgtagcnnnnnnnnnncccctgcaggctcatcgaggcagggtactttgcgtacgacctgccctggtccaaggtgtacacctatccgggattcaacgtctcgatgccagtgttggagcgggtgctcacttacatgctggatctggacatccaggacatgcagcgcgccaagctcggcaagctgggctgcgagctgaagcaggaggtgagggcttggttcaatggggcgggcctagacgggcggtgtttggtgaatgtagctttgggcctcgccaggggggcctgggtgggaggagcgtgcctgagccatgtcgtgtggtcccagtgagcctagggccccccgatcgtgactggcctgggcacccggctgcatgaattgtttggacaccccgcacctcccaaccacgacgatcaaacccccatcgctggatctcccccccacaaagaggtaacgagcaacccccaacgctcccacgcatcgcagctgccggagcatgccnnnnnnnnnncggcctaggtgtgaggagcgtacctgtgccatgtcctgcggtcccagtgagcctaggggcacccgattgtgactgacctgggcacccggctgcacgaattgttcggacaccccgcacctcccaaccacgacgatcagacccccattgctggatctccccccccacaaagagggaacgagcaacccccaacattcccacgcatcgcagctgccggagcatgccgcgtacctgcccgactgcaacaaggtgccccaggcgctgcacccccactcctaccactcctccttcggcttcaacacaaacgtgtggctgactcggagctcggccgtgaacagcagcggcgtcgcctcggtggcccccctgaccttcaaccccgccaaggagtactttttgcccaataacgtggccatggcacgcaactggtgcggctggtacaagcccgaggagctgctggctcagcgctgcccctgtgtggagggcaccccctgcgccgcggcgtccaaggccgtggaggcggcggccagggagggcaagctggcgccctacccggtgcccagcgagaagttcaagcacgagcgcgtggaggcgtggtgacgcgcgcgcagagggcttggtgacacaggaccccctggctgcagaggatggtccctgtgggcagctaggaggagggagggtggcgtccctgccgggctcccttcaagaatacatacaatatgtctgacatccagtgtgatatgtgaggattttgacccccattgacccttcacttccgtctgttaagcagcaatcactcctccagcctagctggtgtgcgccagtgggaagtttgcaccatggnnnnnnnnnntgtacaccatttctgacacgcagtgtgatatgtgaggatttttgacccccgttgaccctttacttccgtctgttaagcagcaatcactcttccagcctagctagtgtgcgccagtgggaagtttgcaccatggtgagtttgccctaggaagggtcgaaagcacctcttctgatgcaggctgggcatactgaggggatgtcaggctgcttgataagtccaggtgcgatatgatggagaactgggatggcaccatcttgttggaggtactggcagtgagctggaggaggctgcctcatgggacgagtgggtgggtgctcacaccttcaaaccgtgctttcaccctccgagcaaaatctctcaaagcaaccggaggggggagcactcagtgacgatgtacgctggaagccactgcatccagatcggtaatattgatcatattatttgcatcgaaacatcagtctgtcgacatgcgtttccaagatgcgacagacaggcaacacacagtattgtagtaaccatcgaatggttcgaccgcagcgcaggtgnnnnnnnnnnctccaagatgtgacagacaggcaacacacagtgttgtagtatccatcgaatggttcgaccgcagcgcaggtgggcaggtcgccgccgctcgaccgctgtcgagtcagggacaacacaaaatacccatgccgtggctggagcggtggccagtgtgaccgatgcggccaggagcgtggtcagccccggccagtacccacaaaatcttgccactgaagctttcaggtatgcgggcttgttgaagctgccgagcgcatgccctccctccgggtcttcaagtgtaaacttcacatttctatgtatatgatgaaagcgtctgatgccccatcgcccgtccagggtgtcggatgtgatccagtcatggacagctttccaggggcagctggcgaccaccctgaatgcatgtcctgtcgctgatcaggtgaggcaagtggggcctttccgggaaacacgatgtattggcgggctgaagctgtatgcatttttgcaagattctaccgactgaccgacaatccctgccgccccttcctcaggaggtggatgtggacacctcagnnnnnnnnnnggatgtattcatttatgcaggattctaccgactgaccgacaatcgcagccgcccctttcctcaggaggtggatgtggacacctcagcactggcggtgcagagcgagcaggatgccctgggggagccagatgcctttggctcccagccgcccctgcctggtgctgcagccgcgctgagcggtgccaagcccatcacggcaaccctgctggggacgtacaggcagcggctcgaggttttccatgcgcagcgcgagagggaacgccgcctggctgccaaggtgaggctgctgtggagatggtgcgcctggccgcagggtcttgtttgatcgcatggcacgggnnnnnnnnnntctggctgccaaggtgaggcttttgtggagatggtgcgcctggctgcagggtcttgtttgatcgcatggcacgggatcagcctgtgcgcgctgggtgagggccttgagtggtgtggtccggaaacgaagagaatcgtggctccctcatgtgatcgtacatctatggcctggttttagttcccactctgatcacccctcctccaccgacctcagatgctgctcagcgtgcaagcatccccactgctctccgatgccccgtcggccagggcttcgcccctgcaggcccaggaggcggcgcaggagcagcgccttgcctgtgctgcagtgcccgaggagcactgcgagggcaaagccaggtggggcgagacaggggtcgcacaacaatctggcttgcctgctcataaatgtggcctcgtgagaagattgagggagaatctgcagcctgtcaggacgctgggtggctcactcccagcctgattcattgccatggagctgctcctgcatgagggtgctgaagagcagggttggagggtgaccaatggaccagacctctttccccccctcatactcagttccgcccctcgtcccgcctccccactccaccttccaagagtcgcgcacgacgaggcgctgctccacatcctcgtccacgtcccctcagccgggaatctggtgtccgaggagtggctggtgcgcgggtctgacacgctgcgcacgctgtgcggctccctcttctgcctgtccgacctgaacgctcgggcggtggaggaggccgagaacgccgcgcggcgcggcgcgggatcggaaagactgagcctggcacagccgtcggcgcacgtatacgtggagggcnnnnnnnnnnacggggtcggagagactgagcctggcgcagccgtcggcgcacgtatacgtggagggcaccttttatgtggacacccagaccccaggggcgaaggactgtaccgcctccctccggcagtacctgaggtgaggcagggatgcggtggatgccagtcgcacattgctttgggaaagcccggcgagggagcgtggccggggcccagccgatggcgggcccctgcggcggcctgtatcgcgatgaggttgggatgcggcgggaagggattggatgcacggctccatggcgaggaattccaagctccagcctctctgccgccggggtgagccnnnnnnnnnncggatgcacggctccctggcgagcaattccaggctccagcctctctgccgccggggtgagcccagcgctctcgtcctgcgggctcgcagctcgctcccaccctttccccctcacaccgacagggaccagggccaggctgcccccccgcaccccttgccagggtcggaccggctcgacatccagacgacatcattcagcgtggccagcatggatgtgccgctctgcgacctgtggctgcgcgtgggtgccgccgccccagccctgtactgccaccaggtggggtgatcagagccaggcatgcaggccatgggggctcctcacggggcacgagtctggcaggcgccctggcgtgtgcatgctgctgtgcattccgctcagcctcgggatagatgccgaggaaaccgtcatggccccgcccctcccctgttggcctgcagggagggtgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaatgtgcatggggcaagggcgttggtgagaccgggtcccagatccgtctctgcaccagctctccaccacaccccatcctnnnnnnnnnncaggaaaccgtcatggcccccccccacctcccctgttggcctgcagggagggtgcgagcatgtgctgacgctggcagatgtacggcgatttgacccagggtgcgacccccccttcgtcagccagtacccgctccagctctccgggccctcctacctgcagcagcgggcgtgtgaggtgggcatgggggccgcggtctgtggcgacgtgcctggggcaagggcgtcggtgagaccgggccccggatccgtccctgcaccagctctccaccacaccccatcctcctcctcgccccggtccgccatccccgcaggtgtgcggcatccactccgcaaagcaggtgacgtacgacgaccgctacgcccccgcctcgcccttcttctggtgccagggctgtttcagggccatgcactatgacgcctccggcacagccctctacaccgacttcagggtgttcccctacgccatggactaccacaacttcgtggtcacggggaaccgccgtgtgaagcggccccctgccgcaggaatcgagcggactgcggcgatgcagcaggccggctgacggtagcgaggccctcgtgcctggggttcagcaggccaggcatccaggccttcagtgaagcttacacctgaaataaacatcaaacacatgcgacccttgcatgtgtctcgcatgtcacgaagctcgttggcggaggctttttgagagaatcctggaggaagtctctgagcacatgagagaggtcgacaggggtggacagcacgcatgtcatggagtgggaagccatgcatgcacgatcgcgaggcatcccgcaactcaaaggcccatgggacagcctacatgggggcgacgcggtgcatgatatcgcgatgctctacgtgccagccatttcatgcttgccagactttgcgagccacctcaatcggcccgcccgaacctgcgtcgtggcctttgccgggcagggcttcagctccaagaagcctgggcctaagacccagaaaaaatcgtcaaaggacccagaaagcacccctatctccgatgttcaggtcagtgggcgttgatgagggaggagcggggggtcctgcagctacagatgcattctgggggcgggnnnnnnnnnngaggtcagtgggagttgatgagggaggaggggggggttctgcagctacagatgcattctgggggcgggccaggctcgagggtcgactgcccactcctgttcaggcaatagacaaggctttgaaggcggcgggagtgtacaaggcaattaatcaggagcaggcaaaaaaggggaaggtcgactttgtcaaggtgaggtggtattccttgcatgcactggtatctgccacgcttgatcagggcacttcacagagtggaggcttctgggccaggggcgccatctgagatctcccacacctttcctttcatcccccaacnnnnnnnnnntttccttgcatgcactggtgtctgccacgcttgatcagggcactccacagagtggacgcttctgggccaaggggcgccatctgaggtctcccacacctttcctttcatcccccaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtagtgagtgattcttacactgagtgataaacatggtgacattctgcccgacaatggaatactgtgctgggaatggctgagtgcatggctgaggatgtgctgcatgccagcttcatcaagctcagcccagcgacgagcctgggcacaaccatcttcacctcagccccggacccatggcctcacacccactccttccccccatacaattccccatttctttagagggctgggcgcctgaacatcannnnnnnnnngccttccccccgtacgattccccattctttagagggctgggcgcctgaacatcacgggcgtgcccgggatgaagcctcttccccccttcgaggagtgggccttcaagctggagcactacctgcagtacctcgtggacctgcacaccgtgcacaaggcactggaggcggcgctggaggccgtcnnnnnnnnnnnnnnnnnnnnnnnnnnnnnnnnnnnnnnnnnnnnnnnnnnnnnnnnnnnnngcgccgcgctggcacgctacgcgccggaggtggggctagccagggccggcgccatcgcccgcgacgtcgccgccctttccagcgagctgccggcggccccgtcccccagcaccagcgcgcgggcctttgcgtcatacctggcctccctggcctcccgggccacggccggcgggcccggggcgggggcctcggggccggccggccacgccgcgcgcctcttctgctgcgcctacttgctgcacctcacggggctgaccagccacgtgcgcatcggcgcggcggccatggagaagctggacctggtgcagcgcggcgcgatggccaccttcaccgagttcccccccgaggccaagaacccgctgggtgtgtttgtggacgcgaccaacgaggccgggcggagcctggggccggaggaggcggacgccgtggcctcggagctggcccgcaccatgcccaagaccagcctgctcctgcagcccctcgcccgcgccgcctgacctgcacgtgtgctgcgcccgtggcaccccctggccgggctgtggtcctggtgtgtagctgtcctggcagtcacagcacatcaccactgtgtttgagtcccctcgtgagcacgtgcagcgctgnnnnnnnnnnacccacccgcccagggaagggccctcccgggcccgccatagctccacggcagnnnnnnnnnnctgccaggctgtggtccttgtgtatatctgtcctggctgtcacatcacatcaccactgtgtgtgagtcccctcgtgagcacgtgcagcgctgaagcatggagcactgaagggggcaggatcctcggttgcaactcggtgggagcactgccaggcatggcccccactgcacatacgtttggtcgccgcaggaggtcagggtcgggagatgtcaggcaaggacgctgccctcctgaaggtccgggggaggatcggttctgggagcagcctggcgcagagtcccatatcacgttggcccgcccagggaaggggcctcccgggcccgccatagctccacggcagcgccaaggagtgcaggcccgggggtacatctgtggcctcgcttggagcgaggcgcacccggcctcgctccgtctcccacagcagctggggccgcgcgcgtannnnnnnnnngacatctgtggcctcgctcggagcgagccgtacccggcctccctccatctcccacagcagctggggccgcgcgcgtagttccagcaggcgcgcctcgctggagctgaccaccagccggcgcagctggtaccactcggcgtccggcccctcccctgccagcaggaggaagagtgggcaggcgatgccgagcaggatggcgggccccagaccggtggcctcgcccgcctcgcagaacaatgcggtggcagggccttggcccggcgaggccgcggtggggcgcggcacggggccggcgacggggcgcacccggtccagggagctggccaggcagcgcctgagggtggcggggcacagccgcacccggtccccggagtggggggcctcgtagatcagtccgtaggtcagtctgccctcgctgcggcggaaacgccaccccgggatgggcgccggctgcgcatcaggcacgggagggaggggggtggg

SEQ ID NO: 23837 - DNA, 950 bp, Chlorella protothecoides
agctgggccgcggcaggctcgccgcgggcctggaggccgccaacccggccacggcgccgggcggggcgggcgcgaccccggtgccggggccgatgacgccggcagcgcagcagtacctggcggcgagcgggcagtacacggcgcaggcgcccagcgcgcagcagcagcagcagcagcagtacatgcaggcgcacgccgcggcgatgcagcagcacgcgctgcgtcagcacgccgcgcagcagcagcagcagcagcagcagcgcatggcgcagcagggcgcgcccgcgtcccaggacccgcgcttgtgagtcgtgcttgcgggtgtagaggaggttggggggcgggggcccgcaggctcttggcggggtgggggtcgggcaggcggaggggtttgcattttgcggaggggaggaggcgcagaaacctgggcccttgtcgcttgtgcggttcagggtggcagcaagttgcatgtggcggcacgtcctggtgccgcagctcgcagcccatcatctcgcagccctgcgcatgcatggctcccttgccaaggggacctttctctgctcagctgcggcccccaaagatctgtccccctctcctcgaacacacagttgggggatgggcggcggggtgcccggcgccgctccgggcagcgtcctgccctcccaccccggccagatgcagcgccagctgtcccccatggacgtgcagggcatgggcctggggcgcggaggccccggacccccctttggcgcggcgggcccgccgttggacctggggcccggcggcgcggaccccggcgcgctgcagcgcgcctccgccctgcagcagttccgggcgcagcgccagctcttggccgcgcggccaggcagcggctatggagaagccgcccccggcgggctcccgcccgggtttgggccggccggctcgctgccgccgccgccgccccccgc

SEQ ID NO: 23838 - DNA, 84 bp, Chlorella protothecoides
gcgggccagtcccggacggcgcgcaacttgtcttcctccatccggatgccatcagcgctgatgacatgtcccaggaagctgacg

SEQ ID NO: 23839 - DNA, 142 bp, Chlorella protothecoides
taaaacattcccttgtcttgcactgctcacgcacttgggattcaggtgacctggctgaggctcaaccctcatgaaaagcactcccaacacaactgacatgctgcccaagtgtgtgagcagtgcaagacaagggaatgtttta

SEQ ID NO: 23840 - DNA, 138 bp, Chlorella protothecoides
tgtgggcgtgccccaggcccagcgctggggtggggttttggtgtgggtgaggcgcatgagtgccggctggattttgtatgcattggactcgacacctttggtcctggctccagagtgcaccccagcatcggcaatgcc

SEQ ID NO: 23841 - DNA, 61 bp, Chlorella protothecoides
ccaactcccttgatgcaggtccagcgaaccacccgcctgtgcgcgtcccgcgacctcagcg

SEQ ID NO: 23842 - DNA, 1282 bp, Chlorella protothecoides
tatgagtgttttgatctgcatcagatagcacgccatcgtccaggagatactcatcgcgaaagagctcactcaaggggcaagttttgtccaaggcacgcagaaaacgggagttggcacagatgtataccagatccattgcacgttcggtggaaagcctaccctgtaacgtgctgtgaacgtattagtaccaactccagttgcattatgcgctcgctgcgcttggttccacacttgctcagcccggccacaccattctcactgtgcgctgggtgtgcctggtcctgataggctactgccatgtcagctcgaaatctcggagttgaaattcgagaatgtgatctccccgaaagtttcgcgccgtttgtctcgagacccgcagtttcggtaaccctggcccccggtgtttggtggtcaagagaatgcgacggacagtgcaggaaaactgtggcattgctgtaaatcagggtcgtcctagtttctgaggtatgcatatatttctcgcgaacatcaatcgtgcctccatccatccgcggaaggagcagggcgggagtgggagttgtggcaatcagtggctatctgcctcatggttcttaggtgtctcggggcagctcactcttgctgtgtgccttgtgatttacagatcagcatcaccatcaagtagccctcatggggacatacatcctagagtaatccagaacgcaatgtttgaaagccatcaatgggaagcaatgcaccagatttaccagttcaaggtcaggacgtttgtgctgccttctccatcattgacggccactccttgggcgtacgacgcgagtgctgcaccggaagcacccaaggtcattgtggctttatacggagggacaggcttgtaagtgtttgtagtcctaattatggcatcatctgtcgtgaagagtgcgaagtagataatggtcgggctgaagctagtgatcgtcaaagagaacgtgaaggtagaacctgttcgactgacggttccagtgatggccccaagcgctggcggtggtggggcagctccgggaggaggtggtgaagggttgagcagaaccagcggcaccacctccttcagggtattcatgttgttgtacaccaaagcggagccaagagaatattccttcatgatcttcaccgacaatgacttcgatacgatggttgtgacggaggatgaggggctgggccacattatctcagaatcataggctagtgtggatgtatacaaggcgcacgtgagggagtaaggaatgtaccccggagtggtaacaacaca

SEQ ID NO: 23843 - DNA, 81 bp, Chlorella protothecoides
aggcagatagccactgattgccacaactcccactcccgccctgctccttccgcggatggatggaggcacgattgatgttcg

SEQ ID NO: 23844 - DNA, 64 bp, Chlorella protothecoides
cgtctcccgcagacccataacacattgacttctgctgcacacttcattcacagatacaagaaca

SEQ ID NO: 23845 - DNA, 95 bp, Chlorella protothecoides
gacatctgggaccccaaaacagtcacagaccaccccctcccccacgcgtcttccccatcccattccccatcagacccacctggttgttgatcacg

SEQ ID NO: 23846 - DNA, 61 bp, Chlorella protothecoides
aggggctgccggcgtggccgagatgacaggtgggtgttggcaaggggcatgttgggctggg

SEQ ID NO: 23847 - DNA, 410 bp, Chlorella protothecoides
cgtgggccacggtggacagcgacgcacccttgcggccctgcagcgcatctatacctggcaaggcatggagaaagacatcaggctctttgcagcacctgcgacgcctgtcaacgaaacaagccttcccaaggcctcagggccggacttctgcagcccctgcctacgccagactacccttggcagcacatgaccctggatctcatcaccggcctcccggatacgcttccaggatacaacgtcgttgtcgtttcgtggattgctgtaccaagttggcaagttggtgcactacgtgaccaccaccaagactgttgtgggggcgggctggcccctacaccggtggaactctgtatatgacctgaagtaggaatcttacagacgaaaccccgaatgcagtgtgtcggtcgggtttc

SEQ ID NO: 23848 - DNA, 79 bp, Chlorella protothecoides
agcctcgagctgaactagacagaggttgttaattgtcactgcatgagctctcacaaaggcagcagatggtcctgaagag

SEQ ID NO: 23849 - DNA, 63 bp, Chlorella protothecoides
aacatgtcggccaacgtccaggtgggtggttgtttgttatgtgtgtgtgtgggtggggggggg

SEQ ID NO: 23850 - DNA, 131 bp, Chlorella protothecoides
cctgaatgatcaagtttaatccctggacggccagtagaatgcatattaaatggtggagctgagctgatgagcaggaaaatcactcccccaaaatggacgaaacccacgaccatcgccaccctcgacacacg

SEQ ID NO: 23851 - DNA, 61 bp, Chlorella protothecoides
tacaggtatgggcgggcgggggaacagaaggggggagaacgtgtagggatgaagcttcctc

SEQ ID NO: 23852 - DNA, 121 bp, Chlorella protothecoides
gggcggtcttctcctctcccttgcccgtccgaaggcactgctgccccccacacgctctccctgcctggttgctaagctcgtcgcttataaccatgggaattacagcaggtacaaggtcacc

SEQ ID NO: 23853 - DNA, 61 bp, Chlorella protothecoides
aaccttcacgtgaatcattgcctggagctcaccctgagcctgcaagccggtccaacccagc

SEQ ID NO: 23854 - DNA, 76 bp, Chlorella protothecoides
acccgggcgcaacgcattcggtacgcggaggggatgttgataattattggaagtgcttattatatctggagtaccc

SEQ ID NO: 23855 - DNA, 75 bp, Chlorella protothecoides
accccacacacactcatcacctggaaacgtcatctttaattctctgcacaaccggaccgggcacggagtctctta

SEQ ID NO: 23856 - DNA, 73 bp, Chlorella protothecoides
tgcaggctgtccataccccttacaacatgcatatcagtattatcatcagcatgtcccagagaatagcaacacg

SEQ ID NO: 23857 - DNA, 5431 bp, Chlorella protothecoides
  modified_base (119)..(128): a, c, t, g, unknown or other
  modified_base (184)..(193): a, c, t, g, unknown or other
  modified_base (249)..(258): a, c, t, g, unknown or other
  modified_base (597)..(606): a, c, t, g, unknown or other
  modified_base (991)..(1000): a, c, t, g, unknown or other
  modified_base (4761)..(4987): a, c, t, g, unknown or other
cttcttgttgggggacggagacgtcttcttgggaggtggtggggacgtcttctttgggggcgacggggatgccttcttcggggggggcggggacgccttcttgggcggcggcggtgggnnnnnnnnnnccttcttcttgggtggtggcggcgacgacttcttcttgggtggtggcggcggctgnnnnnnnnnnacttcttcttaggtggcggcggcggcgacttcttcttgggtggtggcggcggctgnnnnnnnnnnaacgccttcttgggcggcggcggcttcttcttggacggcggcggcgacgacttcttcttgggtggcggcggcggctgtcttagttctttcactatggacttgtggagctctttcagactgcacatgttgggacccttccgggttcccacagcgttgttgcagcgttggttgatgccgttgttgttattaccccagttgaggtttcccttgttggagatccctgctcagttgaaggtttgccatgttaaaatgaggggcacagagagacaggggtatcattccgcttcgtccatctcaggcagcatttgaaaccccagtaacgcccagctacttccctcnnnnnnnnnngatgaggggcacagagagacaggggtaacattccgcttcgtccatctcaggcagcactcaaaaccccagtaacgcccagctacttccctcatcccgctcaccgatgttgttgtcgcccacattcttgttgcgaaaattgttcttgctcttgttcccagttcaaatgttgccatccttgtccgcggtgcacgccttctgtccagccttgaggcactcgactgccaccaggatcctggtggaccggttcttgatgatctcaaagggactcagcttgatggcgctgacagaaataccgaggtcgttgagagtggttgtcttaacagagcctgccttgctgtacccctgcgacctgtggtggttgaaaggggaaagtcacagtcaatannnnnnnnnncttgccttaacagagccagccttgctgtacccctgcgatctgtagtggttgaaaggggaaagtcacagtcaataaacagggcgtgtccttggtctggtctcgcataccaaagccgcggccaagctcgactcattacgcacctgcagatgttgtctgcactgctcaagtccagcatatagacgtggggcccgtaactaacagaggaggcaggagtgtgtggcgagggtgaatgtgcgagtacccggaagcagtattcgttgcccgctccacgcggcaaccctgcgcatcccacatcaagctccacaacccccgggagtaagccatgagaacgacaagccaggttaaattcgctcattctcacgtgacagccgggagtgcatagaacttcgtcgagcacgcgccctgcgggaaaagtgggcgagcgggtgtcaccgtcagtgattgcaaatatcgcgcatcctcctatcaacaaaacgtcatgagaatcgataagtgttatgcaacgtacccttgcgaacactccgaggctgagtagtaggagcatcgtgctccagagggagggccgcggttgcggcgccatgtcgtcacacaaaccctggccaagatggggtaccttcactacctaaaacttgaaacaagatctgatggaagggcaagcacccttgtggtcgatatgtagattattcatgtacgctgatggcacatttcctcaactacgttttacttccggatccggaagggtatcccggcgaccgcccggaggcccatcccctgtcctcacccggacggagcagcatcccctcggcatcgggacgtcgcgtctcatgcacagaaggccctgggtccgcaggcctctgccccggctaggagtatacacatacctccagtgctctgctgtaacaccttatcctagacattccaataggctagttatcgactgaccaggttgaggccgcagaccggttttgagagagcatttagggcagagagccttgtacgccgcctcggcctacccgcgcctatgttacatcataactaatcggatccacgagcatcttgtttcaacccctttcctcgcaacttcttacccagatttcgcgacttcctctactacaacaattttattcaagtcgacatctgcttatcgacgatggctttagcctctgacagaaagtcgatggatctcacatcttcacaaatgctaccctccattgtagacgccggaagttgtaagcagggctcgccatgacagttcaagcctcgagggaagcgtagatatcgctttcgaacattctagcagaaccaaacaccgttggcaaacagttgaaagcgtgcatccgttgataaagcgaggctgccactgcaccccgagacggacctgtcctggtataaggagacgtgcgggtcggccgagtacccctcgcctacatccaaacgggatgaggagcgagcgccaacggcctgcccggcctgtagcggagagctgcgaccacagtggttatggcgcaagtgccctctgccgcctccagagcgctcatttgtctttctggcgttggttttactgcggtgaacatcatacagcattgagcaatggaggccgcgacggccaactacagcaacatgacgccatcggcagtgatgggcaccagagtgtcacccacacgctaccagatcttctccttgatatgcataagggccatacccctctgtgcccaacccgcccaccactacggggaccactacgctgttgggtaagggacaaacgagctcgcaaaggaggagggcctcaaacaaatcattcaggcatcccattaccttcagaacgatacaagctgtgcatcaggaatgacgccagctgatgctagggtggtctgtgagtgaagggtagcaagggaggaggacaaccgcgagcaccaagccgatcgcattccacgcagcgtgagcaaggagtgcaagaaggagctggcatggtaattttgagcatgcaggccaaaactttccaagcggatgttctaacaagcgtgctgactgattttgtgcgccgctgtccacccttgcgaccctgcactcagtacaccttctatcctttaccttgcctcgcctagacatgttgccaggcagcagcaattgctgcagcacgcgagccgtgttcctgcctcaaggtcaagtacagaacgctgcgttgctgcggacccccgagggagacaaaatcggtggtgatgcgcggagtgcctgagcccaacacattgcgtgcaaggaacacacagacatcttggcggaagccagccggccttcccagcttcgttacaaattgcctggcgtccagtgtgtgagagcgcggggcagcagaagccctgaatgggtgcggtggcgtcaatccccgtcccttaggtggacacctctgaatgagctgcgaccactgaggtttggacgtccttgcggaaaacatcctcgcctgctcgccgctctaacaagggctccactgaggcagctttcatgctgatgggggaacaacatagttgcccatgatttgttgcaagggcaagggctaaaggcaaagcttgcagtctcagtcgtgctcactcagatgtatgcagtctacagcaggtcgaacccttacccacaccgatgagcaccctgccacgcaaacaaccaggcagaatgtctcagagtcgcccatttgacagctgcacaaatctccatcggcccaaccctctcaagcacaccttcacttccatgacttctgacaggcgagatgcgtccgatagctgccaaagcagacatcgcggcaccacccggttggttgatggctgtggtggtaaggctgccatcaatagcgcacacagcagccacagctcgttgcatccaacagtacaattcctggcattgcagccactgacggatataattaccctcgagccaggcttccaggccggccaccagccgggtatccactaggcctcttaggcgcaaggtcaggtaacacacagctgcacacagcgacgtacagctaaacgcatccacaagtggtccatgggcgcggtcagtgacgaggtggtgcgcacttgggtggacagtccagctagaagcgttatgtcgctacgtgagcgcagtaggaggcaaaacaccctctcatgggactgtacggtggagagaaggtgaggattgctgccgtaacattacttgcagcatggattgcaacccaggttctgacacaacgttatgcagcactgactcaatgtcaccacattattcccaccacgacggcatcactatgacctgcacacctgggatacttctccaagggtgatggcagcggtgtcacggtagcactcattgggcacttctgggaagaccagagtgagacaccgccaaagcacagacattgctgcaccacgcgctgcagagtccgccatgcgtggtaatcacacggcgcaagggaccatggactgtgcgcctgcagcatccctcagggcagtaagcgtcgccaccagctgctcaaatcctcctgctggtcggtgtcaggtgctccagcacctgctcagaggcagtgggctcacatcaccctccggcaccacgcgggatgctcaatgcggcccgtgcacagagcatgtacaagcatggtgaagcgaggtgagcttatgataggagcagccacgatcctgccagcgcaggaacgcgggttgcccacacaaagggatgggcacacttccgaccatgtgtctagttagactcgccaccctacacagatagagtactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaatgatagaaacacattgcgtgacccaatctcgagaccatctcccttcgcctccgagggtgccgccacgaaccccgctggtgggaggagcactgatcactgatcatccacctctgatcggcattgctcggacactgaatggccttgatcagctttgcgcaccatcgcagaggaggggtcgatgccgttgagccttgagccgcatgaatctcctgcctccgcatgaaggtgctctgaaggttgtgcacagtggacgaggtagtgacctcttacatgctcaaggggtagctgatgtcttaggcagagtcatgactcaacattcatccacccacatccctcatgactgactaccaatgcatctgaacgtgcaaacgtcgaatttcactgcacccctccaacgctgtgcagcattgccaaaggtctgaggcagggacacttgcc

SEQ ID NO: 23858 - DNA, 67 bp, Chlorella protothecoides
gcctcaggggaatgtaggacgtcatcggcacaaggccatcaggtgccaagaacccgcgccacaggct

SEQ ID NO: 23859 - DNA, 81 bp, Chlorella protothecoides
ctccagccctgtgccctcacgctcgccagcagccagccctgcgacctccctatccccggcagccagccctgcgacctcccc

SEQ ID NO: 23860 - DNA, 161 bp, Chlorella protothecoides
atctgggatggggagtatccaggtaagaataaggagctagacgggctggaccagttgagaactgcgaacaggccgtagcatggtctccttcaaggaggggtggcgtgcacagtggcgtatcccacaggtttgcagttgctaatcttcctgctgcttacatc

SEQ ID NO: 23861 - DNA, 312 bp, Chlorella protothecoides
ggctgtacagtgactccccgatgcgatgctggggattccccctttaaccggatgggttagtttccgtaccaccgagattacgtcaatcatcacatgcgctcccaagccgcaaaaataaacaagagcacaatccacatcgcgaggaagtcgcgctcgaaagaactgcaaatcgtggattctgaggtgctgggcagacggcggtgttgtcagcgtcaacctccgttcggccgtcgtagcctaaccaggtcgaggctctcacagcgcctcctaaaacgccgtcgctggccttgcgatggccattaaaacacagtg

SEQ ID NO: 23862 - DNA, 69 bp, Chlorella protothecoides
agcagggaagaccgccgcagatgccggctgctccactgcctccagtgaggcgtcacctttgcaaggccc

SEQ ID NO: 23863 - DNA, 61 bp, Chlorella protothecoides
gcttgcacaatgacgtgtgtccatggcggggccatgcgcgtctcgcagtcgtcatgtcgcc

SEQ ID NO: 23864 - DNA, 71 bp, Chlorella protothecoides
tgggccgaccagttacccacgcccacgaccatggtcatacccccgggggcgcgaaactgctccgccagccg

SEQ ID NO: 23865 - DNA, 79 bp, Chlorella protothecoides
ttggcagtgctgagaggcggctgggcagggcactggcttgcaagttgtacggggtttgtgcaagaccgtagctttccaa

SEQ ID NO: 23866 - DNA, 61 bp, Chlorella protothecoides
gcatgcacaccccttccccctgaccccacacgtgcacaccaaaaccacgacaggaaggacg

SEQ ID NO: 23867 - DNA, 63 bp, Chlorella protothecoides
cattgtagggtctaacccgcccccacaacacacgcaaggctgcttgaacagggcctgctcaga

SEQ ID NO: 23868 - DNA, 61 bp, Chlorella protothecoides
gccaccacccttgagctgccaagtgtgttgagcgttggcaccctcaatattgattcatgat

SEQ ID NO: 23869 - DNA, 1542 bp, Chlorella protothecoides
  modified_base (125)..(134): a, c, t, g, unknown or other
  modified_base (414)..(423): a, c, t, g, unknown or other
  modified_base (696)..(705): a, c, t, g, unknown or other
  modified_base (1195)..(1204): a, c, t, g, unknown or other
cagggaggaggtggtggcgcggcggcgccgtgcgcgcgcctggcgcctgctggcctcgcaggccgccagccccgtgctcatcccggggctgccagggtcgcgcggagccatgggcctgttggacnnnnnnnnnncgcgcgcgcctggcgcctgctggcctcccaggccgccagccctgtgctcatcccggggctgccggggtcgcgcggagccatgggcctgttggacgccgtgggtgcgctgctgcgcctggcgctgcgcaaggcggacgacgcgccgcgccgccgcgtcgccctcggtgtcgtcgcagcgcttgcgggtgaggggttttggtcgcttttgggggagggaggaggggaggagtgggtgaggctgggtttccttgttttggggggggctgggtaggagcaaggnnnnnnnnnncgcccttgcgggtgaggggtttttgttgcttttgggggagggaagaggggaggagtgtgtgaggctgggtttccctgttttggggggggctgggtaggagcaaggggccacggccggcgctggcccggtccagttctgcagctgtgctggtagacagcaatctggcagcagcggccgagtctcaagctgaaaagacagccgaattgatgacgtaccagcgtcgtcagcaagctttctcctcccacatccccccatcttttcttccctcaccgnnnnnnnnnnagccgagtctcaagctgaaaagacagccggatcgataacgtaccagtgccgtcagcaagctttctcctctcacatccccccatcttttcttccctcaccgcagaggcatgcctggccgccgacgccgggtccgcgcccgccgccccgagtggcgtgggtagctacggccagccagcgccctccccgcggggtagcagcgcgggcgccgcgccggccacggcggcggcgatcacccgcgtcatgtccgcactgggcggagaggcgctggcgctgctggagggcccgctgagcgggccggagcgcgccgccgcgctgcaggccgccctcctcctccaggtgtgtctgagtgtgtttgcgctttctttctatgtctgctgcgaccgggaggggctttgtgtggcaccactgtcatgccatccatgctcggagcacaatgctcgacacatccacaccctccacgcaagggaatgccccttcccccacaccctcnnnnnnnnnngggcaccactgtcatgccattcatgctcggagcacaatgctggacacatccacaccctccatgcaagggaatgccccttcccccacaccctccccaccatcactcacccaggcggcggggctgtcgtcgggcctgacgccgtccaagatcctgcaggccggggccgcccgcggctggaccccggcgctgcagggcctgctgaacgcaacggtgctggagtgcgcgcgcgcgcggcccgccgaggcggccgccttcctggcccgggcccacgcggtggtgggcatgtgccccgccgcctgcgagcccgcggccctggtcgcgctgtgggacgcggcggc

SEQ ID NO: 23870 - DNA, 74 bp, Chlorella protothecoides
catttgtctgtggtggggggcaggcagcttccctcagatgggttcttgcctgatgaagtgcgcagcaggcatcc

SEQ ID NO: 23871 - DNA, 78 bp, Chlorella protothecoides
ctggttgcagacctctggctggtatgagggcccatgcacaggcactgcggggcagtagcctgggtagtcagcaaacac

SEQ ID NO: 23872 - DNA, 76 bp, Chlorella protothecoides
ctatgaggcagccgggctctgccacaccaagggtgggttatattgccgtccgccccctcccctgcacgccaaaccc

SEQ ID NO: 23873 - DNA, 61 bp, Chlorella protothecoides
attgtaggaatgctacgacagaagtcggcgaactgcctggccattacgctctgcatcgtcg

SEQ ID NO: 23874 - DNA, 94 bp, Chlorella protothecoides
tctccacgacgccagccacctctctgtcagaactccctgcccctcccagcatcccgcccccccactccccaaaacccactcactccacgcaggc

SEQ ID NO: 23875 - DNA, 70 bp, Chlorella protothecoides
gctttatcagtgtcgtttgtactacacgacaatctcaacctctggacaaagttgcgaggccggacgggcc

SEQ ID NO: 23876 - DNA, 66 bp, Chlorella protothecoides
acagggaagggaggctgcaggaggggggaacttgcttcctgtccgctcctttgtgaccatgctcgc

SEQ ID NO: 23877 - DNA, 61 bp, Chlorella protothecoides
gatgccctgtttgatttcgggatctcaggcaccccgcttgccatgcctggccacagccgca

SEQ ID NO: 23878 - DNA, 73 bp, Chlorella protothecoides
gagagtttttcacctatctccaggtgcagagcaggggggtcacacagggtgccagcagcaatgcatctgggga

SEQ ID NO: 23879 - DNA, 67 bp, Chlorella protothecoides
gactgcgggggggtgagcggtgagtgagtgtgtgagcgagttgggagtttggagaggtggagcaggg

SEQ ID NO: 23880 - DNA, 61 bp, Chlorella protothecoides
ggagtagctgccgcagttgaagcagcgcggtgcggtgggggcctcgaccggcgcggcgggg

SEQ ID NO: 23881 - DNA, 69 bp, Chlorella protothecoides
cggatgcaggtggaaagggtggaaggctccctagaggggcccccacaacacgggtgcgagctcagctta

SEQ ID NO: 23882 - DNA, 73 bp, Chlorella protothecoides
atgaacctggctgcggtgagttttggattgaggggtgcggggagggaggggtttaaccagtacgcagcctggc

SEQ ID NO: 23883 - DNA, 61 bp, Chlorella protothecoides
cttcaggctgcatgtgttcgtttaaagaatacctgccatggcaaccgtgcccattcccctc

SEQ ID NO: 23884 - DNA, 741 bp, Chlorella protothecoides
gttaatggtgacgaaaggcaggatgcttgtaagagtgaggatgtgcgtgtacaggagctggacgatgaccatacccatcagcgtggggatgtacgtcgatttgagagtggggatgtatccgagaggatgagtgggtccatgcacttgacagtgaggaagtatctgagatgggcaacgtgactacaagcagaggcatgcatccacacggcggtgaggctgtgcatgtgtgcgagagtgaggctgagcatttgtgtgatcatgtgtctctgtgtacatatacatgtgacacggtgtaggggagtgaggatgtgtgtgaaggtggtgatgggtgtgaaggtgaggatgagacttatagtatggacgtagccaggtgtgtagatagacatagagaggagatatgtctgtgagtgacccagtgtgtatctgatggctggctgggtgggatacatatctggatacctgtgtcgcaagtgtgggaggggctcatggatgtgagcatctccacgccaccacgtcccacacccgcctggccactgtgcacaccaccaccattgccactggggtgagtcccacccctatgcaaatcagttggtcactggtatccagccctatgcgattcagtgtgacgttgaatcactcccctatgcaaatcagttggtcgccagccccctccccttagggttagggttagggttagtttagttttagtttttagtttttagggttagggttagggttagg

SEQ ID NO: 23885 - DNA, 72 bp, Chlorella protothecoides
ggggatgcacttcccgcgcagcatcggtccgtgtctcgggctgtcgacggcatgcgacggcgcatggagaac

SEQ ID NO: 23886 - DNA, 61 bp, Chlorella protothecoides
ctgcgatccggcgccgcgactgcctgatgcactgtgcgggaagggaatcacggcccgggga

SEQ ID NO: 23887 - DNA, 61 bp, Chlorella protothecoides
tacaccccgcatgaccgtcgcgcgccacccaccttgccgctgctttttcatgtcggacatt

SEQ ID NO: 23888 - DNA, 113 bp, Chlorella protothecoides
gaatggagatgttgaacatgagcagctcctaccgtgggggtgttgcgtcccgagaccgcgcggcgctcccagtgcacagcaatgccggcgcacgggccgggcccgctttgtct

SEQ ID NO: 23889 - DNA, 61 bp, Chlorella protothecoides
gaggaggggtggccctgccaggaggggctgacctgcctgccgctggaggggagcacggtaa

SEQ ID NO: 23890 - DNA, 973 bp, Chlorella protothecoides
agagcactgcacattggagcaggacatgcgagtttgcagggatcacagttttgggcctccgcccccaaggtttggtcgcccaccaagtcaccagtacagggtgaagccaagtgcactttgggtcatttgataacatagactctgaagaatatgattcctgcccctgagcatcgatgacctgcccatggtgtgcatggggggccgaggcactcccaggtgctggagccttcacatgcaaaaccgctagcagggcccagcaggggaagacattgacagcgccctgtgatattttagatgcccagtactgtacttgctgggtctgagtccttgccgcttcctggcacccctgcatgagtactgaatgccgggtcatgcccactctcccaggtcgccagatgcaagcacggccaagagcgagatggccgcctctctcgcttcgaaaaagatatgttgtatcttttcaagttaataatggctaacaaacagctcaatgaactcgttcgcgcgacactggctcggtctgggaagggcgcatcagtgtacacgtcatctccactttcttctcccccccggattccctcggacgagaccgctagcccaggctgagggcccttgattcccaacggtttcggcagggatatccatttcatgggccccccctgaatttgtgggcatggtaccttcctgaaacatggcggccatgccaccaccgagcttccgggttcccgagcaggccgagacgcagtgcgaccccgccacctacccccccgaggcgcaggcggtcatcgaggcctttggccaagccatctccacctccttgaagaagagcatagattccgcggagtgagctgcggccggggtcgtgccccggggaccgggtggatcccggacgggcacatgccgggagtgtggcatttgtccacgcctcttcgccctcccctcccccccaacacccctcccctcccctcccacc

SEQ ID NO: 23891 - DNA, 97 bp, Chlorella protothecoides
gggtgagacggaatctgatgcttgcaagcaacgctgaggtcacgccatcctgttggattcagtgtccttgtctgagctcagcccctccttaccactt

SEQ ID NO: 23892 - DNA, 62 bp, Chlorella protothecoides
atcaggggttgagtcttgcctgctggcctgctggaggtgggccatgtaattgcatgcagggc

SEQ ID NO: 23893 - DNA, 107 bp, Chlorella protothecoides
ggaaacccctgagtttgtccagatggtcaatcatcttgtttgcactgggggccccttcaagattcccaagcaggcagatctgcgtggagagatgctggctgacgagg

SEQ ID NO: 23894 - DNA, 142 bp, Chlorella protothecoides
atggtatacggagcgggggcagggaaagggtggccaggtactcagctccctgtcatgctgcttcaatgatcatcccccgagttctcagtcgctccccacacaatcactcgtcggcagggtttcacccagccacacgcaggca

SEQ ID NO: 23895 - DNA, 94 bp, Chlorella protothecoides
cccactcatcttcgactcggtttcttggtagattcaaagttgctcctccaatgttgctcgtgcaatgttgctcctcgttgagtttgtactggga

SEQ ID NO: 23896 - DNA, 75 bp, Chlorella protothecoides
agcatctaggggaaggatgcgcagcatccaaactaggaatgtgatttcatgggcagtcccagagcagcaggtaag

SEQ ID NO: 23897 - DNA, 211 bp, Chlorella protothecoides
attcaattctaatcgagctgccccttcttaactcttcctgcagtagggaacgaggtacaaagccaaaacattgaggcatgccgcgacatgtgcagtaagtaggaacaatcacgccttggacattggacgggatatacatgtgcgttctcacagtctgacaaaccagcccaaatgtacacgtcaagatggtggcaagtggaggatggaggtg

SEQ ID NO: 23898 - DNA, 61 bp, Chlorella protothecoides
aggctggatgcccccacttgcttgctcctcactcaagctgccgctttgtcccaagcaaagc

SEQ ID NO: 23899 - DNA, 84 bp, Chlorella protothecoides
agtcatgcccgggggggggcggaactgctccgccagccgattgatggcccgcttcctgccgacgtaggcctggtggcgcagctt

SEQ ID NO: 23900 - DNA, 95 bp, Chlorella protothecoides
cccccccccgtcgcatccccttttgtgtcctcctcaatcaagtctggcccttgacccccgctcccccttcacagtactgtttcggcaaccggccc

SEQ ID NO: 23901 - DNA, 68 bp, Chlorella protothecoides
ccttcacagtactgtttcggcaaccggcccccacactgcaccccttctcttcttctggccattcccgc

SEQ ID NO: 23902 - DNA, 237 bp, Chlorella protothecoides
gtcccagcgcgcttgttcaaggagttccccatgtccttactttcttctccagttcctaaggttgtatctgttgtgcacgctgggcgtcatgccttgaactgcagcccgtgcccattgctgaagtctgcctattgcgtcttgcatcaccctgccgcccctcatcatcgttttgtcacttggtgtccatcgcaaacacatgcagcgcaagcatgcacatgcagttgggcagtcgcaaga

SEQ ID NO: 23903 - DNA, 77 bp, Chlorella protothecoides
tatctgttgtgcacgctgggcgtcatgccttgaactgcagcccgtgcccattgctgaagtctgcctattgcgtcttg

SEQ ID NO: 23904 - DNA, 164 bp, Chlorella protothecoides
cgtcaaggtgcatggaggaagggggggggaggtggtgggggatggggatgctcgggggccttgacatgcgggacacgctcaccgaggggcgggccgagagtgggtccccctaggcagccggaggcgggggaccaggcaggatacttccctccaggccccagagc

SEQ ID NO: 23905 - DNA, 67 bp, Chlorella protothecoides
actcttcaccacggggccatctgtatgaccaggcctcacccctggcttacgcccattccaactggca

SEQ ID NO: 23906 - DNA, 91 bp, Chlorella protothecoides
cagggctgcagtcgcgctcacgagtcagcagcccaatgaaacgcaaaatcctgggtgcgcctacaggccgccttactatggggagcatggg

SEQ ID NO: 23907 - DNA, 144 bp, Chlorella protothecoides
agccagagtgcatgcatgcccacgctctgtggcgacgcccgccagctctgcgcctcccccctccttgcatggccaggtcacgacaagggcccccactccctccccatcccctgctcaggccatccccggcgtcctcgtggccac

SEQ ID NO: 23908 - DNA, 86 bp, Chlorella protothecoides
tcacgggggtctggggaaagcatgtcagggacagagacctttggattcctcacaaacccaatgcgtgccccgctgctcaggtgtgg

SEQ ID NO: 23909 - DNA, 79 bp, Chlorella protothecoides
tttgtgttgggttgcacaggcagcgcaacaattctgagacaacctacccggtggagagcatagttcgtatgggaccagg

SEQ ID NO: 23910 - DNA, 239 bp, Chlorella protothecoides
gaagaagacgagtatggctgccttcagttcagagagttcctgtgtgccaacaagtacttccatcatggcctgaagcgggcagacgaccccgatcgaatcgccaccatacccctagcctttttggcttggatcgaaatgctcgtaagttacaagggccagcatgctcatcccatgctcagaccactcttgacacgagaccctcaaacgcatgtaggttgaagggcacatcttcaatcttg

SEQ ID NO: 23911 - DNA, 74 bp, Chlorella protothecoides
ttcgcccccctcagcacccagcccccccatccctcggcccccccaacccccactccctctcagacgctgatgac

SEQ ID NO: 23912 - DNA, 61 bp, Chlorella protothecoides
tctttgtaaagtctggagatggatgagaagtggggctgggtgagggagagggctgggttgg

SEQ ID NO: 23913 - DNA, 113 bp, Chlorella protothecoides
aaaaatgtgacaatcgcccgaagtggggctcgaacccacgaccacaaggttaagagccttgcgctctaccgactgagctatccgggcagggaagttccccggtggcaactgtc

SEQ ID NO: 23914 - DNA, 250 bp, Chlorella protothecoides
tcttttcaaagtcaggaaagggaccagcctacttgcttgaaggaagctgtgacagtggtttcactcctttccaggcatacatcccggcgaggagcaggaggtcacaagtgaagacgagtgggaaggatctgacaacaaaagggatggcaatgttgacgagggggatggccaggaagaggtagttgagtgcctccttctccttactgctgcattgccgtgcccgcaaggaaggcacagtgaaaatccagat

SEQ ID NO: 23915 - DNA, 121 bp, Chlorella protothecoides
cgccagcatgtccacaaaggtgcgtcgttggaatataggctctttcatattgtatagttgcagtcgatgtagcgttccaacctgctgccttcgtcgccgcaggcgcccatgagccgtgtcg

SEQ ID NO: 23916 - DNA, 790 bp, Chlorella protothecoides
cccccctccccacccccccttcccccgcctggacagagctgcgaccccgccatcagcatcatctccttgcccacgataaagtgaggcaatgtagagggcagggggttgattgtgtgtgtgtgcaccgtctgaaagtgcaatgagcccccttgagtcccccgctgtggtccgagggatgccccccgttccccttacccagattcggggacacaacatacatggtagctgctgacagccacattgcctactgcgagtgaggagggggcgggcatagctgggcacagacctcatgcaccgtcctgaccgaccaaatcttctcgctgtgccgcctcggcgcctgcatgcatgcttggtcccgcctggtcgccgacgtcaggccctggcaccccgtgcaggctcgtgggctttggaccatcctccctgggcatggagagggtcatgaatgccacgtaccccttcccagacttctccattggcaccatgaaccccagaacctacgaggtctgcgaccccctggatggggtcgactgcccttttgtcgctgtcgcccaatgcgtgccaaagggcatgatgccatgtttccaggattcggcaggcaacatcggaagttacaacctgggccacggcaacaagggcaaccacaacaggggcgacaacaacatgggtaggtgccagtcgtgtgggcggggtccagtgctctgtgcgctgaggggcctcatagattaaacaatccccccttcccctacaggggacgacaatgatggattcaacaacattggcgaccataaca

SEQ ID NO: 23917 - DNA, 80 bp, Chlorella protothecoides
tatcggaagggagagctatgtgtggcggcagaatctagggtgcggggtgaatttttgtagtgcttggtccttacgtcctt

SEQ ID NO: 23918 - DNA, 73 bp, Chlorella protothecoides
ccccccccctcgtgacactcgtccatcaccggcacaggctgcagctgccaagggcaaggtcgacctgaaaatc

SEQ ID NO: 23919 - DNA, 80 bp, Chlorella protothecoides
ggccgctgaagggggggggcaactgaggagctgcaccaagggacacatctgtcgcctgcaggccgccgccctgcccctgg

SEQ ID NO: 23920 - DNA, 152 bp, Chlorella protothecoides
tacaccaacatctttcccgattgtggattttggttggtcccacagtcgaccagtacgtcgattcctgccaacttgtagcgtttcggatcaattcaagccaaatgtatctccacatatcggagttggtttcagcagcttcctatgcaacgcag

SEQ ID NO: 23921 - DNA, 67 bp, Chlorella protothecoides
actgtgtcgtgcgcgggacttcgcgcccagcgatggaggatctgacgccagggtcctggtctcggac

SEQ ID NO: 23922 - DNA, 229 bp, Chlorella protothecoides
gatatctgtcaggactccattcttatgcgactgccgacaatctcccaattctgcagtttacactggacaaggcgctcgagatgtatgtcaagaaatctggcttgcttggaggtggtggtaaagagccgacgatcatctctcccaagcagtatgcgaatagatttcggctggcgatggcgaagtggcttgtctctgtgccaacaggaacagaaagttgtacatcgtagac

SEQ ID NO: 23923 - DNA, 77 bp, Chlorella protothecoides
ggatggcaacatcgggaccgggaacaagggcaagaacaattttggcgacaagaatgtgggcgacaacaacatcggtg

SEQ ID NO: 23924 - DNA, 88 bp, Chlorella protothecoides
ctcccctgggtccggcttgagcatgttggagcttcgagtctccctatgccgccgccctcggtgttgtgggggcggtttagaccctaca

SEQ ID NO: 23925 - DNA, 111 bp, Chlorella protothecoides
agttgacaagaccatctccattttgttgcacatcctctccttgcaccaatgacaagttgctgccccctgcgctgcttgtctgctatgacaggctacaactgccccagtggc

SEQ ID NO: 23926 - DNA, 67 bp, Chlorella protothecoides
tgggtgagacatgggtggaagcatggaagacagtcaatgcgacctgacgtcaccagcgctcgcacaa

SEQ ID NO: 23927 - DNA, 75 bp, Chlorella protothecoides
ttggctctgtgaatcctgttgtgccttgatgccacgtataccaacgtcaaggctgtcaacagcggtagacattgt

SEQ ID NO: 23928 - DNA, 78 bp, Chlorella protothecoides
tgagtctcacagacgcacacatcccttccctcctcagctccagcacgacagcccagccggcggcaggcgccccagccg

SEQ ID NO: 23929 - DNA, 1317 bp, Chlorella protothecoides
  modified_base (752)..(761): a, c, t, g, unknown or other
acaaccccccaaacccccccacgccctcaccatctggcaggtgtagatgagctggtcgcccggggccgcggccgccacagaggagtagaaggtgtcaaagtcggcgatgaggggcgcggtgccgtcggtgaggggcaccctgaccagggtcacgcggtaccccgcccccgccagcccccgggcgatcgaccgcggcgtggccacttcggccacgagcaccagctcgtcgcgcagcgtgcgcctcgcgcccgggccgccgccctcctcctcccgcgtgaccagcaggcggccggcgcgggccgccgcctcgctctccacgtcggcggccagccgctcctccatgccctccagccgctcgcggccgatgccgcggtactccatcaagttcttgaaggggcgggaggcctcgcgcaggacgtagggcgcgccgttgacgtagaccacgggctcctcccgcatcagcgtccacaccgcgcggcactgtggcgtggattgctcgtccatggatgaggggggctggggtgcctggacatggaccccggaccccaaactcacatgtgtgcgccttgcaccggacactgtccgacccctgatcggctgccctcatgttctccacactcctccgggatgaacagtatctgatcctcaccccgttctccccccccccctctatgagtggctcacctggccacccgcggacctgcccctggaccggggcccagcgccgacgtgctccaggatgccgcgcatgnnnnnnnnnntcatgcattgctcgtccatggatgagggggggctggggtgccctggacatggacccccggaccccaaactcacatgtatgcgccttgcaccggacactgtccgacccctgatcggctgccctcatgttctccacactcctcctggatgaacagtatctgatcctccccccgcctccccccccctatgaccggctcacctggccgcccgcggacctgcccctggaccggggccccgcgccgacgtgctccaggatgccgcgcatgccctcgcgcgtggggatggcgccaccccacacgcccacccccggcagctccctcaggttgggcgcaccggggacgatgacggccagccgctccgactggcagcccgggaagtggtcctgcttcagcagcgtgcgcgggcccagcacggcgccggcccgcgccgcgcggtgcgccgcgatctccctttcctcctgcgtgggcgtggcggcgggggacaggccggcgacggggtcggggcccccgctcggcaccgccacgcggaggcggggcgaggcgtccgcaccggggcccc

SEQ ID NO: 23930 - DNA, 76 bp, Chlorella protothecoides
catggtaacggatggtcgagatttcttgcgaatatgagttagctacccagacgggctttggcagagagcagcgagt

SEQ ID NO: 23931 - DNA, 165 bp, Chlorella protothecoides
acctcggccgcggcctgggtgcagcgcgccagcgcgtcgatgtgggcctccgtcaggctgatggcgaagccgtagacatcggaggaggtgacgcgcggctcgccgggagagggggccagcgtcgcatcggtgagcgactccacggaacgcatgcggcggtgcacc

SEQ ID NO: 23932 - DNA, 75 bp, Chlorella protothecoides
agaacagaggggaaaggaaaaggcgcgactgcaggtatggatgcctttctgtgaagcctaagcaagggaagggca

SEQ ID NO: 23933 - DNA, 79 bp, Chlorella protothecoides
ccccctgctgcgagccggtcctctctggtcaccagcgactaccgctttgtgtacctgggtcccgaggtgaggtcactct

SEQ ID NO: 23934 - DNA, 61 bp, Chlorella protothecoides
acctgtgaagaggtagttgttgtctgagccgtaccgattccggtcaaggttggtcgagtac

SEQ ID NO: 23935 - DNA, 73 bp, Chlorella protothecoides
gacgagcaacacttgcgggagcattgggagcccgccgcgtctcggcaggggctgcttacatatatattcaatc

SEQ ID NO: 23936 - DNA, 61 bp, Chlorella protothecoides
gggcgccatctcctggccgttgtacagcacacgctgcgagtacggttgcaggaggtttacg

SEQ ID NO: 23937 - DNA, 149 bp, Chlorella protothecoides
agggtcacgggcacagagcgcttggtctcctccccgccacggtccccttccctcgagcggcgtccacccacctgtctgcatgttcatgtccctgtgtggacccccctcctcgtccgtcgcctgctccccacgaccaccccaccgccaca

SEQ ID NO: 23938 - DNA, 136 bp, Chlorella protothecoides
ccaaacccgaatggtgcgtgcttgaggcttcactggggtgggaggaaggggcggggagcgcccaggtgtcttggagaatactgcatgccgggatggttgacgcccattgggcatgaggaatccttgcttggtcctg

SEQ ID NO: 23939 - DNA, 110 bp, Chlorella protothecoides
cctatgatcctgcaaagaaatcgaaagcaacacgttttacgacgataatgaatctacctcccctgtgccccattattgcccccctatggccccggtccgaggtgctccca

SEQ ID NO: 23940 - DNA, 72 bp, Chlorella protothecoides
agactgcgattcatgcgcagggggtggggtaagttgttgtcggctgtcatgaaatgcacaacatcagcccgt

SEQ ID NO: 23941 - DNA, 102 bp, Chlorella protothecoides
ctctgcacccaagaggcatccgacacaatgcactatattcccataaactagaacaaaaacaaaaaggtctgatgccagtgatgatgtacaactctctccaca

SEQ ID NO: 23942 - DNA, 61 bp, Chlorella protothecoides
cgcatgctgagtctcgctccgccgtgcggcaccctgccactccacgctcccggcatgcgcc

SEQ ID NO: 23943 - DNA, 92 bp, Chlorella protothecoides
caggcatgcgcccctgttcttggcagggtcgtggcaccaggcaggcttgtttctcaggggggattcacttggtggagagccacacctcaggc

SEQ ID NO: 23944 - DNA, 61 bp, Chlorella protothecoides
tgtctcgcctcacacccacccgattccctccctctgccccaggccaccccgagctcatttt

SEQ ID NO: 23945 - DNA, 173 bp, Chlorella protothecoides
gagtgtgtggagcttggtgatttgtgcaagggatggagtgttttcggctccacggcaccctgagacaggcggggcatacctggcgcttatatacatccagcgaccagcgtttgaacgcttgcacaaccatccccggcggccccacccttccgcagacaaactgagcgctgagg

SEQ ID NO: 23946 - DNA, 61 bp, Chlorella protothecoides
ctccgtctcaccgtcccgatgtgccggcggtgatgaagtatgccagactgaccaggatgag

SEQ ID NO: 23947 - DNA, 61 bp, Chlorella protothecoides
agccccctgccggtgagggctgccgccgcaacgccgcacctcgagctgggacagggtggat

SEQ ID NO: 23948 - DNA, 61 bp, Chlorella protothecoides
acatcacgctgcagcactgcgtgccatggcggaggcaacgctggaagggccttccttaagc

SEQ ID NO: 23949 - DNA, 64 bp, Chlorella protothecoides
tcccgagaaaatcatcagctctgccgaaaaccttggggaggtgctgcgtggggaccggatcctg

SEQ ID NO: 23950 - DNA, 61 bp, Chlorella protothecoides
agccgctacccggcaactaacgagaacgagttttgggcagtggacgtgccaggcggagcag

SEQ ID NO: 23951 - DNA, 61 bp, Chlorella protothecoides
gttgcggctgatctcgtcgtcgctggcgcgcgtcgtctccttgatgcgcgacagcatgacg

SEQ ID NO: 23952 - DNA, 64 bp, Chlorella protothecoides
gtgttggggtcggtttttggcgtgtttacccgatgacaaagcggtcgcaagatgcatgactgcg

SEQ ID NO: 23953 - DNA, 91 bp, Chlorella protothecoides
cctgccataaagcaagctcgagattgctgcattgctgtggtacgccatggtagacaaagctgtagctgatttgcgcggtgccagggcccag

SEQ ID NO: 23954 - DNA, 80 bp, Chlorella protothecoides
cggtctctgaccgctgcatgctccttcaccatcctgctttcttgctatcgaaaacgggaaacatgcctgcatcacacacc

SEQ ID NO: 23955 - DNA, 116 bp, Chlorella protothecoides
cgctttcctatctggagcccttgtggagccgaagctcattctcaacgtgctgaaaaatacagtcacaacgaacaatctcctatctggtgctcatgcaaacaatcctgtccattcga

SEQ ID NO: 23956 - DNA, 544 bp, Chlorella protothecoides
  modified_base (173)..(341): a, c, t, g, unknown or other
cattggccccttggatggacgcctttccctcgaacatatccctgaaacacatccaacgctgtctttgcctccagaacttagcagcaccatattttaaacccaaaatacgcatctaggcttttaattcatcagccacgaaggaccctttttcaagtctcctctggaattggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcttgctcctcacctgcattcagtatcctgtgaccattcgtgagagaacgtgcaccacacgtgcggagaagggctagaagaagaagggtttggaaataaagggtcagggaagtttgctcaggcgggggagaatctgcttgctccaggcgcaatgcatggtggcatggtcgtcacagcctagttgtgtggggagagatgtg

SEQ ID NO: 23957 - DNA, 155 bp, Chlorella protothecoides
tgtgtaagtgtgcacactgaacacccagagtggtgattcgtcagcaacaaccccctcaagatcgggcagacctgcatgtgaaaccaagctccagcattgccatgagatctccctttgtcatgcctgatcacagggggtgaaagcaccaccatggc

SEQ ID NO: 23958 - DNA, 71 bp, Chlorella protothecoides
ctgacgcagccacccccaaaggtcctggacgacctgctgtctctggatttcgaccctccctcaccggtgag

SEQ ID NO: 23959 - DNA, 61 bp, Chlorella protothecoides
tgaaggctgagtgtgtggagcgcctggggatgccatgatcacacctgagccgcggtcgttc

SEQ ID NO: 23960 - DNA, 68 bp, Chlorella protothecoides
gcacgcgggcgcgcaaggtgtgagccgtgtggctggcggcaggcatgcctgcccttgcttggcctttt

SEQ ID NO: 23961 - DNA, 151 bp, Chlorella protothecoides
acgtgggaagtccccgtgacgaactgttttcctactttaaaaactttttggagtttcgacgataacagcctctgcgagctggtggtcttttaactcatgaaggtaatttcagatgtgatacgacacagtcattggtggtggaatgacttgg

SEQ ID NO: 23962 - DNA, 104 bp, Chlorella protothecoides
gatggtgaggcggggtggcaaacacattcaaggaccgtgcgacgggtgcaggaaggctgttgtgtgttttcccaggactgtgagagtggcactctgctgtgctg

SEQ ID NO: 23963 - DNA, 69 bp, Chlorella protothecoides
actgctcggcaccgttcctatactataactataaggtaaacataagggcttccgaggcaaggcactcca

SEQ ID NO: 23964 - DNA, 112 bp, Chlorella protothecoides
ggccaggttccaccagcgctggggcatcgaatccgtgtcggaggccccccgctgcgcgccgctctaccttgccgcccgcgcccgccacttcgcctggcgccacgagctgggc

SEQ ID NO: 23965 - DNA, 61 bp, Chlorella protothecoides
aggccagtgcagcaccagagatcagccattttacccttccaccctggcgcatacctgccag

SEQ ID NO: 23966 - DNA, 72 bp, Chlorella protothecoides
ggtgcggaagtttgggatggctcacgcgcatcgtgtgggtgtgggtgctggtcgcctgagtgccagcatggc

SEQ ID NO: 23967 - DNA, 64 bp, Chlorella protothecoides
gcgactgcacctcgcgagcgggtcgcgcgctggttgccctgcattccggccggtgcaccccctt

SEQ ID NO: 23968 - DNA, 74 bp, Chlorella protothecoides
cctgctcaaaccagaccgatgtgtctatgacctttgtggaattgcaggcaagcgcggcctcccacatggccccc

SEQ ID NO: 23969 - DNA, 61 bp, Chlorella protothecoides
gcgaattaccccagcctgacaaagaggctgggcaggtgtgagctgtccagcgcacacggca

SEQ ID NO: 23970 - DNA, 78 bp, Chlorella protothecoides
gaccagggcgggggctgcgacacaggcatggcatttgtttgtagggctgcaggtctgcgtgcagttgcagcactcccc

SEQ ID NO: 23971 - DNA, 125 bp, Chlorella protothecoides
aagcctgcaacgagtcaggtcgatggagtcgcacacggcaaagctgcacctttgccagagacagcaggtgctgtggagggacccgccaagcccgtagcactgagcgagctgggcgcctggggtgc

SEQ ID NO: 23972 - DNA, 139 bp, Chlorella protothecoides
cagcgagcacagcaggcggcggtgcaggcgttggcgcaggcgggcgagcaggctggcggcgccagcgtcctcggcgcccggtccgccagctcccgtggccgtcccatcccggggcgccgcccagacccccggcgccgca

SEQ ID NO: 23973 - DNA, 125 bp, Chlorella protothecoides
gggcgtcaagcgcgaggtgtgtgtcggtggtgtagcgatgaggggttgatgaagggtgtctttggggagccccctccatcggacttcatcacgcctcaagcctggaatttgcagcatgctatgca

SEQ ID NO: 23974 - DNA, 105 bp, Chlorella protothecoides
gggcatgccgtcgatcaagggactgttgacgggatgaccggcctacaaactgcaaccctgcggccttcctccgatcaaacgacgccgccactccccacgcaccgg

SEQ ID NO: 23975 - DNA, 120 bp, Chlorella protothecoides
agcaaaccctcctccccaacaggggagagactggacctgctgaagctgtactgctcctttgggctagagcactggggcagcgacgcccggggcgtggaaagcaccaggtgcgcatgtggg

SEQ ID NO: 23976 - DNA, 63 bp, Chlorella protothecoides
tgaagatcgttgtttctcttgcaagacatggtagaagcatgcatacgtgttcccatggcttgg

SEQ ID NO: 23977 - DNA, 70 bp, Chlorella protothecoides
cccccaacgaaacagcgatcgcgtgccagccgccctcccgcccacccatgcaaggctaggtttggccctc

SEQ ID NO: 23978 - DNA, 243 bp, Chlorella protothecoides
cagggcacaccatcaagctcctcagcgcagatgtcgcaggccaggttggcatcaagcgccgagtgcaccatcggctccatggactggaggaatcgcaccatgaccgccgcttgtgcatcatccaattccggcatggaagggagctcggtctgggtggctgcatggacagtccccaccaacgccatgacaactggtgagtgtgtattaatgactgtcacagcgcatgcgtctgtcccaggaagc

SEQ ID NO: 23979 - DNA, 525 bp, Chlorella protothecoides
  modified_base (255)..(354): a, c, t, g, unknown or other
ctgacggggccctggccagttatggatccccaaaatacaacggcaaaacgaccactttcaccaccaccctcgaggcggccgtgttatctttggtgtcatatgcccaagttgtggccctcaaagatacaggcggtagcaccaatgtcctgaccctgaactggtgatcatgcagactgatgtttttgcatggcactgaatcacatccattgcgcgccttatgtaatcgagcatgaaattttcgataccgcgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcccgatgggtaggactgtgcattagacatcagcccgcgctgtgtatgtacatatttcttgggtccgtctgctataagcgctgtgcttctccgaagtcgcactggcgccgcgacaagccccataacccggtggatggaggatgtgtcgagcaggcttgttgacgagcg

SEQ ID NO: 23980 - DNA, 69 bp, Chlorella protothecoides
cgctgtccctgtgcgcattccccggtcgcacccatgcctgaaggctacacctcgccgtgtcccacaaac

SEQ ID NO: 23981 - DNA, 74 bp, Chlorella protothecoides
gaaggtgcgaaaggtcctcactgggatcggctttttcacaggctgagggcattgcagagcgaccacaaaccctt

SEQ ID NO: 23982 - DNA, 144 bp, Chlorella protothecoides
cgctcgtcaagacctcgacctaatagtggttcgcatgagctcccgggcactgtgactcagaaatggcctgggacaatgcatgtgccgcaaagtcagtccacaacagtcacaccgacctgaacgacatctgcccacagcgtatcc

SEQ ID NO: 23983 - DNA, 331 bp, Chlorella protothecoides
gctggcgcggaggggggcgctggcgtcgccagacaccgtggcgcgctggctggtgaccccacgccgcgtcgaggcggcggaggaagccgaggacccgggggataggctggggaggaaggaggcagcggcgcaggtgctgcagggcattccggccccctgaggctgccgcggctcgctgaggccatgatagaggcacccggacgccggggctcctccatcggtgctcgtaagactgtcgatccgcctagagtcctttttctacctgctagccgtggcaatgaatgtcatgggcgtcacaactctcccaaggtgtttgtgtacatatcctgta

SEQ ID NO: 23984 - DNA, 61 bp, Chlorella protothecoides
ctccaccgcgactcacccctcggaatattcggcctggaggaggtcgaggtatgtgtcccac

SEQ ID NO: 23985 - DNA, 122 bp, Chlorella protothecoides
ctcagcgtgggactgttgcgctgcacagccgctcactcctcggtattcctgggaccatgtctgtgccattctctgtggtctgttggggattgctgacgccatggatcatcacccctctggac

SEQ ID NO: 23986 - DNA, 205 bp, Chlorella protothecoides
gcggcagaggcacaggtccgctgacacctgggcgggtttggggggcccgatgccaggcccgcggcattgcgtccccccatgcaatggtcatgcatgctcagatgcctcctctggttgcgtgtcccgtggtccccgtctgcgctgcatacggctgttgagatactgttgcaccgatgattgtgggggtcacagcaagaggctgagg

SEQ ID NO: 23987 - DNA, 61 bp, Chlorella protothecoides
ggaactgaatgttttggtgtggatggaggctgcaggcacccactggcgcccaatgacattg

SEQ ID NO: 23988 - DNA, 146 bp, Chlorella protothecoides
caaggccggcggcgggcgcctgggctggggcgaccgcgaggacgtgctgcgcggcggggccgcgcagctcaccatcctctccgcaccctaccacccgccggaggcggggcctgtgacggcgggagcccagaggcctgctccacccg

SEQ ID NO: 23989 - DNA, 155 bp, Chlorella protothecoides
ttccaggagtgaacgctgaaactccccttgaggtggtgctgacaactcaattcagcaatgtgaaccagtgccatcctgtgcaacaagcgcagacacagaggagatgaagattagtcgagagtactcaaatacacagggccccacatatggtgcaa

SEQ ID NO: 23990 - DNA, 68 bp, Chlorella protothecoides
ctgtcttcaagatgatcacctcagcgggtcataacctgggggatgtcgtcaccaccatcaagggagac

SEQ ID NO: 23991 - DNA, 150 bp, Chlorella protothecoides
tgccctcctgatatgttgcagtggtcgcagctacccagcaatgcactttataatcggaagagatcggactaaggaatttcaaatatagacttatcggagatagtgatatgtaccgtccttgaggcagtcccgctgaaatttctgatctcg

SEQ ID NO: 23992 - DNA, 61 bp, Chlorella protothecoides
cgcaaacagcttcatctgcagtgggacgggagaggatggtccttccgtggaaggggagaag

SEQ ID NO: 23993 - DNA, 172 bp, Chlorella protothecoides
ctccaggatgcccggccgctgcaccttcacagcgacttcctcgcccgtggacctcagccggcccctgtacacctacagcgtgtggacaagggggagcgaagatggctgatgggcagacgctggcagacgacactccacgcatcagatctgcagcaagcgtgggaccaagcat

SEQ ID NO: 23994 - DNA, 97 bp, Chlorella protothecoides
aggcacaagctaggtaaacatgtctgaggcagcatgcaggtcccctatcctcgtgcagggtcaggttgtacttcaagggcgtagtcaccatgttctc

SEQ ID NO: 23995 - DNA, 76 bp, Chlorella protothecoides
ggggttgggggagtgggttgccaaagggctgcatccaacaagcaggggctgtgtcgtgcgggcattcacggtggag

SEQ ID NO: 23996 - DNA, 61 bp, Chlorella protothecoides
ggggcgaggggggggccacctcacgttctcaccccggcacgcgtgttcgaccgctttatat

SEQ ID NO: 23997 - DNA, 131 bp, Chlorella protothecoides
cccaccccctcctgttcatgcgcaaagaatctaccatgcccctcttccacaacagtgggcggcggtcatgttttgtaaacatcgcagcacagcagactaagggtactcaactgcaggtgacgtgcacgcca

SEQ ID NO: 23998 - DNA, 403 bp, Chlorella protothecoides
  modified_base (135)..(274): a, c, t, g, unknown or other
ctggacgcagcgcagcaccgcctccagctgtggcaggggggaaggcagggggatttggtcttttttggggggggggggttctggtcgatagcagttgagtcgcgtggaatcggtgtcgcatgctgagcggaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactcatttctgctgctgctggcgtcatggacttggccgcatgggggccgtgacctggcggctagtggacctggcgtgagcagtacttgcacgagaggctttgttcccagccgtgcaagcttccccttt

SEQ ID NO: 23999 - DNA, 73 bp, Chlorella protothecoides
atgaaaccctgcacgtgtctccaggctggtgagcgtccagcctggggatccctgtcaccccaagggcatggca

SEQ ID NO: 24000 - DNA, 63 bp, Chlorella protothecoides
aaagcatgtcagagggaagccgtgggcattcccagggaagttgcaccaacctgttctggctgg

SEQ ID NO: 24001 - DNA, 61 bp, Chlorella protothecoides
gccactgacgaggaccttgcccagcgccacgtaggcgcggccgtcagtggggtccatggcc

SEQ ID NO: 24002 - DNA, 61 bp, Chlorella protothecoides
agagatcgctgtggcagcttagattgcacgtgggcagaccccattgccactgataccaaat

SEQ ID NO: 24003 - DNA, 103 bp, Chlorella protothecoides
ggctgtcgattgtggacttgaaggccgtgccgacggcggacgaggggaatccggaggcacgtctactctgacggcagcgggacaatagccctgagccttttca

SEQ ID NO: 24004 - DNA, 61 bp, Chlorella protothecoides
tgatcaaatacctgggtgtggataccggaggataaggatgtagatcgaccatcactagaca

SEQ ID NO: 24005 - DNA, 566 bp, Chlorella protothecoides
cccccccacctggtcgaggccccaggtgccgaggcgcaccccccccgccagctccagcacgagctgatggggccgggcgggttcgtcccaggcgtaccccaggctgcagtagggccgcagcacgtcctgctgctctctcacccggcgctggcgggcgtgcagggtgagcaggctgcagttctccaggcggtagggcgcgaagcccgcgggctgatggctcagcgtcaccgccagcgtccccgccgcagcggcggccacgcctacgcgcagcagcatggtctcgccgcggtcgcggtgccggaccttgatgaaggtgtcccccggcgagtccaggccaaacccgccggaccagagccagccagcctcctgcaggcggacacacagccgcagcggcagccccgcatccgcccaacgcagcgggcagctcacccctggccccagctccgcctccgcgccggtaccctgctgccggtactgcagcgccgcgtccagggagttgagcagcaggtagcgcggcgccaggtgcaatgccagcaccccgccggacccggccacgggccccgccg

SEQ ID NO: 24006 - DNA, 61 bp, Chlorella protothecoides
gaggcgctgtcgtccacctcgcccccgctcgcaccctcctcctcctcctcctcctcgctgc

SEQ ID NO: 24007 - DNA, 63 bp, Chlorella protothecoides
cgccgagtaccagccgcagccctcgaagcgccggaagttgaacaggagggcgaagaaggccca

SEQ ID NO: 24008 - DNA, 103 bp, Chlorella protothecoides
agcggtgctgagacgggatgcattcacccttggatccctcacaccctgtcatggcaacccccaatgcccccaccccacccagggtacggacgcacgatccagc

SEQ ID NO: 24009 - DNA, 74 bp, Chlorella protothecoides
gaccccctgggcctggccgacgaccccgagacctttgccgagctgaaggtgaaggagatcaagaacgggcggct

SEQ ID NO: 24010 - DNA, 80 bp, Chlorella protothecoides
catgtccagcacccggcactacagccgagggagggcacgtaccgcctccctctcctcgacctcgatggggatgccatcca

SEQ ID NO: 24011 - DNA, 61 bp, Chlorella protothecoides
ccgagtgtctcgaaagaaagcggggcggggtgacgttgccatgcgccccaacttacagatg

SEQ ID NO: 24012 - DNA, 78 bp, Chlorella protothecoides
tgcctcaccctgacaacaatacccactgaaagcggacaccctgaacggtcatgctcccctccctctcctcccccactc

SEQ ID NO: 24013 - DNA, 72 bp, Chlorella protothecoides
gcgcttcgtccatgctggcgccctgctgcgatgcccagacttccgaaaggaatatggggggtgctgcggaaa

SEQ ID NO: 24014 - DNA, 61 bp, Chlorella protothecoides
ggtggagctcaacaagaggattggcaagggggaggtgccctccgatgtctccaccgcgctg

SEQ ID NO: 24015 - DNA, 64 bp, Chlorella protothecoides
agccggattccagtcactctgcaacagtgtcttaaattgggcccctcaaggatacatcccaatc

SEQ ID NO: 24016 - DNA, 117 bp, Chlorella protothecoides
aagatagcatgccacactcggcgtgcatcggtgtaggccccttggccgccgtcggactttcagggaccattgctgtacacttgctgacgccatttatcccggggcaagcgtgctacc

SEQ ID NO: 24017 - DNA, 67 bp, Chlorella protothecoides
tattctggctccggccgcacgtcttcggtattaataacacctttccacccgctctgtaaggcagagg

SEQ ID NO: 24018 - DNA, 797 bp, Chlorella protothecoides
ccccccccgggatccagcttccccgacgtgcacctgctggtgggggtctgcaacgacgaggtgacccaccggaacaagggcaagactgtgatgacggagggcgagcggtacgaggcgctgcgccactgccgctgggtggacgaggtggtccccgacgcaccgtggcacatcaccgaggagttccttgacgcgcacgccatcgactttgtggctcacgacgcgctgccctacgcggacgtgacgggggcctcggacgacgtgtacggtttcgtcaagcgcctggggcggttcaaggagacgcagcgcaccgagggcgtgtccacctctgacctcatcctgcgcatagtcaaggactacaacgagtacgtgctgcgcaacttgtcgcgtggctactcgcgcaaggacctgggcgtgagcctgctcaaggagaaacgcatcaaggcctccgcctccatgcgcgacttctcggcgcgcatgcgcgacggccgcctgcgcgttgctgacggcatccgcaagcacatgaacccgcgcctccgcgtgctccctgccgaggtggagcgcaacgtcaaggactttgccaccagcgtggagagcctggtggacaaggtggcctccggcgacctgggcgtggagctgatcgagaacatggaccgcctggtcagcggcttcatcggcaactttgagcgccgctactcgcgcttcgagaagagcatcaagtcgctggggcggaacatgcgccgcaactcccaacccctcctccagagcccatgatgcggagggggtctcggggggggggg

SEQ ID NO: 24019 - DNA, 66 bp, Chlorella protothecoides
gaagaaaaccccgccgcctccagcaaggagacatcccccgcctccgaagaagaagtctccgccgcc

SEQ ID NO: 24020 - DNA, 61 bp, Chlorella protothecoides
gtgcaacatgaggacggtctcgtccccgcccctgccccactccagatacctaaggcgcatg

SEQ ID NO: 24021 - DNA, 61 bp, Chlorella protothecoides
gcccttctgggccctgcagcagaccctcagacccccgaggaagccgagagagaccgaggcg

SEQ ID NO: 24022 - DNA, 1789 bp, Chlorella protothecoides
  modified_base (1133)..(1196): a, c, t, g, unknown or other
  modified_base (1268)..(1277): a, c, t, g, unknown or other
ggatgcgcaagctgcaggcgggcaagctgtccaagggcgaccgcctggcgcccgcggaccatgcgtccatcgcctacgcgcccttccgccgcaacttctaccgcgagccggaggccctggcgcggctgggcgaggaggaggtggcgcgcatgcgcgccgagctggacggcgtgcgggtgcggggccgcggcgcgccgcggccgctggccaactggcaccaggcggggctgagcgggcggctgtacgagctgctgcggcgcgacgggttcgaggcaccgctgcccatccaggcccaggccctgcccgccatcatgtcggggcgggacaccatcggcatcgccaagaccgggtcgggcaagacgctggcctacgtgctgcccctgctgcgccatgtcaaggaccagccgccgctggcgctgggcgacggcccgatcgcgctggtcatggcgcccacgcgggagctggtgtcccagatcacgcgcgaggtgcggcgcttcggcaagcccctgggcgtgcgcgccacggcggtgtacggcggttccggcgtggccaaccagatctcggagctgaagcgtgggtccgaggccgtggtgtgcacgcccgggcgcatgatcgacatcctggtgaccagcggcggcaagatcacaaacctgcgccgcgtgacctacctggtgctggacgaggcggaccgcatgttcgacatggggttcgaaccccagatcgcgcgcatcgtgaacaacatccgccccgaccgccagaccgtcatgttctcggccaccttcccacgccaggtggagggcctggcccgcgcgctgctggccgaccccgtggagatccaggtgggggggcggtcggtggtcaacgccgacatcgcgcagttcgtggagctgcgggccgaggaggaccgcctctggcgcctgctggagctgctgggcgagtggtacgagcgcggcaagctcctcgtcttcgtcgccagccaggagcggtgcgacaacctcttccgcgacctcctgcgccacggctacccctgcctctccctgcacggcggcaaggaccagagcgaccgcgagagcaccatctccgacttcaagtctgatgtctgcaacatcctcatcgccacctcgggtgattannnnnnnnnnnnnnnnnnnnnnnnnnnnnnnnnnnnnnnnnnnnnnnnnnnnnnnnnnnnnnnnttctggcccccagcatacgacaggaccctcgtatttgtcaccatcatgtaatcccatcccctcctcacgccnnnnnnnnnnctctggcccccagcatacgacaggaccctcatattagtcaacatcatgtaatcccatcccctcctcacgcccatccaacacacaccccaccccagtggcggcgcggggcctggacgtgaaggacctggtgctggtggtcaactacgatgtgcccaaccacctggaggactacgtgcaccgcgtggggcgcacggggcgcgcagggcgcgcgggcaccgccgtcaccttcatcgcgccggaggaggagcagcacgcgccggacgtggtgcgtgcgctgcgcgagtcgggggcagcggtgcccgccgacctcgccgccctggccgagtccttcgaggccaagcgcagggcgggcaccgccaagctgcacggctccgggttcggcgggtcgggcttcaagttctcctctgccgaggacaacctggtcaaggccctgcgcagggtggggccccggagagcggggagggaagggggtgcggggagggaagggggtgcggggaggaaagggggtgcgg

SEQ ID NO: 24023 - DNA, 128 bp, Chlorella protothecoides
cgcatgatgcgaaggagtccaaacccaaggcacattcttgtttggcgttctgccctggggaggtgggtcctgagcaggctgtgttatgttgaatcagcctctggccagggtgctccaggcgtctcact

SEQ ID NO: 24024 - DNA, 61 bp, Chlorella protothecoides
tctggagccacggcaatgtggagcgaatgatatgatcaacaaaatattgcgtgattgtctt

SEQ ID NO: 24025 - DNA, 155 bp, Chlorella protothecoides
ggacccaggcgcgctgcagcgggcactgaggtcgggggcggtctggctcctggagaacatggcgagcggcactcggaggccagaccgggaacatccttcactgtccaacccaggaaaacactcctgctatccagcccatgcctgaggaggtgccg

SEQ ID NO: 24026 - DNA, 142 bp, Chlorella protothecoides
gctggcagaggcacaaaccaccgccgccaactgtgggtctagcgcaacgagggcccgagggggaccctggcagcttctaacagggcggttctagagtggcccccaggacctcacttgatgaattgggatacccagcggaagc

SEQ ID NO: 24027 - DNA, 61 bp, Chlorella protothecoides
agggcacacaggctttcctggaggtccctagaggggctgagcaaccattgtgcacggctga

SEQ ID NO: 24028 - DNA, 136 bp, Chlorella protothecoides
agaccacagcagcattggttcggtggcaggctgaagttggtaccattctcgcagcctcttgacattgcgaccaaccccaatccaccacgagctggtcaccgctgccatacggagtaggatgagctggcttgcccgg

SEQ ID NO: 24029 - DNA, 76 bp, Chlorella protothecoides
agcccatgcacgcagcctcctccatcacaggcaaagcaaggccccggcagcgcaccttccgcttcggaactgccaa

SEQ ID NO: 24030 - DNA, 72 bp, Chlorella protothecoides
ggcctcctctcatcctggctccccctgggcttgtcccaccgacccagaatcatcgtacatcacgcacctgag

SEQ ID NO: 24031 - DNA, 124 bp, Chlorella protothecoides
tcaattacatctatgggatgaaagatgcgtcctcatgaggcctgagataacgattgaaggtacatttgactccataattaagttacagtatgctgtgaggagtgcgggcggcaatgctatcaat

SEQ ID NO: 24032 - DNA, 129 bp, Chlorella protothecoides
gagggagcgtgctgctgtttccagccgccgaggcgccacagacaatattcgctccatggcacccaacaggtggtcgtgaccgctcatgctttgctggcggatgggggcatcatggcgccaattggcatg

SEQ ID NO: 24033 - DNA, 350 bp, Chlorella protothecoides
gccgtcggaacatggactcggttccagccctcgcgtgaccaggccgtgctcgaggccaactgggcgcgacaggccgatgggacaggggtgacacctcagccaccaaggagctcctcagcttgcgtgcaccatgtgggccagacccctgcagacctttaatggcagctcaaggattttggtatggtgctgtctgccccgacaaaacccacctgcgggttcacgcccagaccacaatctttgcaaagacctccagaccagtggcgtgagggtcgagttgtcacgcggatcagatcacaccaggaactctgtcacgagtcgtagtgcagcctcaccaccaaccacactccagg

SEQ ID NO: 24034 - DNA, 172 bp, Chlorella protothecoides
tttgcaggacaccagcccacagccacaggcgttgcccgttgtaccccccaggatctcacctacagaacggtccagcgctcgtggcagtaagaacggagacatgcgctccgtatctgcagtgttgacattagaaacggtgctcagtgagcaagcgatccggactggaagctgc

SEQ ID NO: 24035 - DNA, 126 bp, Chlorella protothecoides
tctgccttctaagcctcgctgttgcaagcacggtaattatttcaccttgtgatatgtgggtcactcgaaagtaagggtcacatgcacgtccgtgaggcccacccttcaccatccatcgaccccacc

SEQ ID NO: 24036 - DNA, 74 bp, Chlorella protothecoides
atcgaccccgcgctcaccgagaccagcatcgtccggcacctgggcagccactacggctcctgcatggggacgct

SEQ ID NO: 24037 - DNA, 3816 bp, Chlorella protothecoides
  modified_base (549)..(558): a, c, t, g, unknown or other
  modified_base (1032)..(1041): a, c, t, g, unknown or other
  modified_base (2221)..(2230): a, c, t, g, unknown or other
  modified_base (2416)..(2517): a, c, t, g, unknown or other
  modified_base (2716)..(2725): a, c, t, g, unknown or other
tctgagttgacattccaagcatccttccgaactcctctatcgcacgagagtacgcatagttatacacctgctcctagacgacgatttaagcccctgccacaacattggatctctcatcttcagggaggctaccgtgcgttgtcaccaggcgattttatcaccttccactcctcagagagaacgtagaccccatgaatctgctttgcggtgggcgtttcaactaatttaaatagctaccagtgatggctgagtgcagctgggggcctctggaatccacatcaagccaggtaactcactgaagactatgacctaagcagaatcttcactcaaaagcccaaagtagacaaagtgggctgcagggtcctcgtcgtggtcatgacagcagtggcttggcagaagtggcaggatccaacattcataagtttccacctgccattgcaaggattgaggcagacctgacgatgctggtcccagtttgcaatgggaagaagatggagggggggtgcagcagaggaaatcaatgggctctctctgatgcaggaacagtannnnnnnnnngctcctctatcgcacgagagtacgcataaatatacacctgctcctagacgacgactcaagcccctgccacaacattggatctctcctcttcaagggttattaggccacatttggggggaaccccgattctcgtttaaggcccctttttgctccctcttgcccactctcgtgactcggatcagaagaatgatgaatataaagacgaattaagcttgttagaggtcaatcgggtctatggagtcatagttaccgagtgtcaaaatatcacgtgataccgggcccccattacgtcatcaccccagccgtccccgagactttcggaagtgccaagttgagctatattacagattggagctttcttggtgtttcaacccgggaacctttccacatgcaatcattgcaatgaaatgcaataatgatattgctttgcagggttgaaaaaggtgggaggagagcactgcatcctggcaagtnnnnnnnnnncctgcacacccagggcgaggaaccgctggtgcgtcacaacaaccagcctggcaacatcgccaccgctgcctttgtgctgactgagttggggatcaacatcatgactgtggctcacggtgggcccggcgctgacgccatcatggccatcggcattgacggctcccccgacaagcagctgctgggggccatcagctgcatacgcaccgcgcaaggaccgcagccctgagcggccacggtgcgtggtgcgggagcaagggggacgaccaaaagccgtgtgcctcttggattgcgcattgtgtgacaaattgagggactgtgaggggcaggcgagttcactggcgacttcatagcgtggggggcttgtgcaaagaaacacgcccacaccttgggctgggtcgctgcaggcttgcagaaaggatggctctgcacgcctctactggcaccccaggccgagcccttggctccctcacagcagcctgcgcttggcatgcttatggggggagtacttggttcgcttcgatcccgagcctttccccctgacgggcgggggcagaccgaccggcgcgtgcgcccccgccaggattcgttcctccagttctcggtatgcgcgcgtcagcgtcgcccagtgtgggcctccttccagccgctccgcacggtccagcagaccctgcaccctttgtcggaaggcggggaagtcggcgaccacgtcgcggcagggctgggcgcacgagctgctgggcgtgtcgagcaaggacggggtttgcgggctgggggtcatgggcgacaggcaggtgctggccggggtggagcaggtgcggcggggggtggtgcatgccgcctcggccttggcttcccgcttgcgcattgtggcctgagctccactgccttccggtggcgggcctgcagattgagggggtggatcgaagagcagcggggttgattttgatacagggtccgtgtgggttgctgagacacagttgcccgtccggctctgtgcaacaagatccaacatgcagggaaaccccccacatcggcagcaggccatggtcggagcgagagggttgcaacacgacagactccacctccctcgcacgggccccacactccccctttcctccacacgagtcacgacccacccctgcgctctgcctccgcagcgtgggcccacatgtgctccagnnnnnnnnnnggtggtctgagctccactaccttccggtggcgggcctgcagattgaggtgggggatcgaagagcagcgggtttgattttgatacagggttcatgtgggttgctgagacacagttgcccgtccagctctgtgcaacaagatccaacatgcggggagccccccacatcggcagcaggccatggtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccccatgcaggagccgtaatggctgcccaggtgccggatgatgctggtctcggtgagcgcggggtcgatgctcatccagacggcgatggagtgctcgcacaccgcgcccctggtggacgcgaggcaggagcagccgtgcacctgggaggcgtccacgcggtggccttagggttagggttaggtttagggttagggnnnnnnnnnntctgggaggcatccacgcggtggcccgggtccgggtcccccgtctgcgagcgcacggtccacacgtcaccgggctcgtccgccagccggaccacggcatcgcgcgggacgccccgcgcctcgcggcacgccccacgcaccgccagcttgcgggccttgttgtggcgtttgccgcgcaggttcagctgcagcttggtgtgcgcctcggcgcacaggtcctccagcacctgcagcaggtagtccactcggcgcccggtggcggtgctgtgcgtcgcgcccagccgccgcttcagggtggcattccagccctcgcagcagcagatggaggactgcccgctggtgttgtaggtcctgaaccccgccacccaagtctctggtggtgggaagaggtgtgtggtgtgtgggcggtgcgggcgagtggagaaagggcgccggagggatggctcctcgcaagctgccgcgtcagccacgactgcagcatcctggtgcacatcgagtgtgcagactgcgccctggcctcccaccccgccactcacccatggggtacgccgtcttccacttctgctcaaagtagtccacaaaggcctggccagggaagtgagatcgccagacccgggccagggcctcctctgccgcccgccgtgccagcgccgggtcccagggcaggcacaagtcacgcacccggaccagcgcccggcggagctctgggtagtcgatgcctgtgcagaggcggtgatgcctgtcccagtcatgcagcaggtgccagtggcacagggctatcgggacccggtcattccatgcatctctagtggagaaggtagggtggggtggggggttcagaagatgtgaagaatggacgtgatcggggcgtgcagtcgccaggtcgctcctgagcgcaggcatgcgtggaagccgcttcggatcaggagctcggcctggcgatggccacacacagtccccccattgacgcaccgtatggccatgtactggggccgcgactggtcgttgaatacgcacgagggcctccgggctggcccagccctctcaacaacgccagcaagccagtgatggatgagaccgtgtgtgctctgg

SEQ ID NO: 24038 - DNA, 70 bp, Chlorella protothecoides
atggggaattgaaatggagaagggaggaagtccgggcggcaagcaaggcagcgaaatgcttgcgtgatgt

SEQ ID NO: 24039 - DNA, 116 bp, Chlorella protothecoides
ggaggggggaaggtgagcctggaaacaattcgacagtctggtcatgaaagggcaggcacacacacaagaaagtggtgaactacgccgaggcagctattacacatgttggtcctgca

SEQ ID NO: 24040 - DNA, 142 bp, Chlorella protothecoides
gcgagtgttgagcggggagtgtgcaagggggaatgggatgccagtggacagcaccgagtgctacatccactcaggggcaatgcagacaccagggaggaggagcctgcaagcggggcactggaggcgctgcctcaaacacaca

SEQ ID NO: 24041 - DNA, 61 bp, Chlorella protothecoides
gcatgcaacgacgccgagtgtgtagtctgacttgtatccgaggatcctgcctgcgcgatgg

SEQ ID NO: 24042 - DNA, 127 bp, Chlorella protothecoides
cttaatccatgcgagggagatgtgtgagcatttgcttaccgccacaaatgctttatctgatccgggaaacgcaggaaagtatcctgcctatagtgggatgttaacatcttcggacttcccccccccc

SEQ ID NO: 24043 - DNA, 74 bp, Chlorella protothecoides
acgtatcccacaccttaagcatcgactgatttggaagatgaattgtcaccttgtttgcctcagcttctaccaca

SEQ ID NO: 24044 - DNA, 75 bp, Chlorella protothecoides
tccaaacggattctaattaggaccaccccggatcccaagtgcaccccccccttgcaccagactcacaactccagg

SEQ ID NO: 24045 - DNA, 69 bp, Chlorella protothecoides
cggtcacagctgcccaaggccaccgccctggccaccttcccacacctcgtcaagtgcgcggggggggtg

SEQ ID NO: 24046 - DNA, 68 bp, Chlorella protothecoides
actcatagcatttctggcatctctgatatcttaggtcaccctgtattacatctggacatgcagccatg

SEQ ID NO: 24047 - DNA, 79 bp, Chlorella protothecoides
tgatgctgacgcctgtggctgggcggggtgtgaggctttcccaaggcaagaaacggactggaccactgcatggcgccca

SEQ ID NO: 24048 - DNA, 74 bp, Chlorella protothecoides
ctgactcgtcgcaggcgacgggtgtcgagattttagctctatcggaaacactcccagcacgctcagcatgaggt

SEQ ID NO: 24049 - DNA, 130 bp, Chlorella protothecoides
gatgatggagatgggtgtaatgggagtaggtcttgggggcctgcatagaactctgatggatgggactcgacaacctcttgggccagctgagtccggtggcatggcgtgagtacctttgccgacacacccg

SEQ ID NO: 24050 - DNA, 101 bp, Chlorella protothecoides
gcgttgcaccgccttgaatgtgtcctctaattcttcatgacggcgaatatgcccgtaccgacccacatgacacaccctgcgcctcaccgcttccaagtcga

SEQ ID NO: 24051 - DNA, 61 bp, Chlorella protothecoides
ctcaggctggctgctccaggctggcctgggtggttgtctggggtgaccagaccatgccatt

SEQ ID NO: 24052 - DNA, 76 bp, Chlorella protothecoides
ttgagcttgcgttgtaacctagttgtcgactggctcctcgagaacaaatccaagcaggggaccacacgctggatga

SEQ ID NO: 24053 - DNA, 61 bp, Chlorella protothecoides
agaccactttgaggaatgtagcagaatagatgccccacccaccataccgagatgtgggtga

SEQ ID NO: 24054 - DNA, 68 bp, Chlorella protothecoides
tggcctgacaaccccaaacaaccaatgcctcctcccaccctttcccacggtcatcgcagtcaagggct

SEQ ID NO: 24055 - DNA, 66 bp, Chlorella protothecoides
ttctttcgttgagtgtactggcgcccgttgaagtgcaggcacatgccctccctggcctttttggag

SEQ ID NO: 24056 - DNA, 77 bp, Chlorella protothecoides
ttggttggaaaggatggccattcgtgaggcgaaatcaccacaccaactccgactactaaacagcaatagttgttgtg

SEQ ID NO: 24057 - DNA, 76 bp, Chlorella protothecoides
ggtgtgggtgaagcctgtcgacttctatgtccaattgcacaggacttttttggcataagcctctgctcaggcccat

SEQ ID NO: 24058 - DNA, 62 bp, Chlorella protothecoides
tgatgatttccggttcgccatgtcggatgcatctcccagactccgaagggatcttctctcca

SEQ ID NO: 24059 - DNA, 117 bp, Chlorella protothecoides
cgtggactgaatcccttgtcgcgcgcgagacatacccagggtcgaaggaggaatcacagcaccaaggtattgcattccgtgacgagacttgttcgacattgaaatagctttcgtaag

SEQ ID NO: 24060 - DNA, 72 bp, Chlorella protothecoides
agactgcgattcatgcgcagggggtggggtgagttgttgtcagctgtcatgaaatgcacaacatcagcccgt

SEQ ID NO: 24061 - DNA, 167 bp, Chlorella protothecoides
acgatcgacaccccaaagatgagccctgagtgggaattgaagggggggggaggggcccatgggattagggtagtgacattctgtccggcattgtggcagacatagttatcccgtggaatgcagagcccaaacacccctgacctcccttgtccttgcacctgcatact

SEQ ID NO: 24062 - DNA, 3175 bp, Chlorella protothecoides
  modified_base (1270)..(1354): a, c, t, g, unknown or other
gccaggcgcaccaccgcctcggcgtcgtgcgccaggtggtcggccaggcccagcgccgcgccggccaacgccgcgcgaggaaagagcggcgccagcgccgcggccgcctcggccaccagcaggcgccgctccagtgcgtcggcgtccgcgccggagcacagcgcgggcagcagctccagctggactcgggtgggggacacggccgacgccagacgcacgcacgcacccaccagcatctccctctgtgcgtggttttgttgtgtggtggtggtgggggggctggatggagagggggcttgtcaggcgcgagttgagggtgggcaagcgtgcaaaggggcttgatgggtagatgtgggggcgacgctagcacggcaggaccacaggcacgggtgcgcagaggaagcggtcggcccctgcttgttcacaccccaagcacccccccttctcccctcaggcagacctgctcggcgctgggtttcttgatcaggttgaagaggcaggcggccatggcgctgcgggtctccagctgggggtgctcccgtgccagtgccagcagcagcggcaccgcctctgttgtggggagggttggggggagggggggcaagggcccggtgatatccccatgcgttgcgcagcgggggcataacggcagccaactcctcgagcgtaggccggcgaaggatcccaggagagagttcaagtcgggcaccggacgatcctgcaaataatctacaatccccgccatcggaggcctcccccctccacgtccgagccggagtggcccactcattgtgaaactccacaacacaatatacacccatcaagccctccttcaacgcacacacaccagcacacaataccaacagctcacgcaccttgtctccggttgatgaggacatgcgggagcagcgcgggcagggaggccgccacctcgtccagcgcggaccgcgcggccgcggcggaaagcgctgcgggggagctcccccgctggcccttgccccagccgtccccgtcctcctcctcccccgctccattcccccctttctgcgccagccgctcctccaggtcccgcacccggctcgcctcgaaatctaaggcagcctgcaggcgctgcccctcctccgccgcgctttccagccggcgctgggcctccgcctccgcctcgcgcgcgtccgccagctggacgcgcgccgtgcccagcgcgtcggcagtggccgccagctcagcgcgcgcgtccgccagctgggcgacggcgtcgtggcaggggggnnnnnnnnnnnnnnnnnnnnnnnnnnnnnnnnnnnnnnnnnnnnnnnnnnnnnnnnnnnnnnnnnnnnnnnnnnnnnnnnnnnnnccagggtcccaggcgcggcggtctgcgaggggggaacgccggaccccgcctcggcgcgcagcgtgcccgccgtcacgcggtacccctggtccagcaggtaccgcatgacgatgtcgttcaggacgcgccgctgcgtggggtccagcctcggggagcgcggccgtgggggggctcctggcaggggagggtctgtgtccttgttcggggccccgccgtcgggccctacaggggccctggagccgtctgcagggccgccgccgtttgcgccgtgatgccccgagctgtgtgcctccaggtcctccctggccaggcggaggtcgtactccaccaccgccagcctttcctcccgggcccgcgccgtggcttgcaggtccagggctgggattttgggggatggggaaggtgataaaagcttgcagcacgtccaggctcagggccagctagaaagagagcatgatgggtactccagtggcatctgaccgcgacaccggtgacgtgcaggcgcccacccacccaacccctcccaaaccccactccaaacgctcggctcaccttcacgccccgtgaacaccgccatctgctccggcgggaagagggtggggtcggagaagaggtgctccagggtctccacctccgcctcgcgccccgcctcccctgcctccatgagcagctccagcgcggtgagcaagtaattgcgctgcagcagccattgggacacctggaggggggggccagggcgaagcttgaatcagcagcctgtgggcgtgcccctccctgcagagcacccgcccaagcgcgccccctaccccacctggttggcactgagcaagtgatcgctgtggcgacgctgcaccgtcatctccatctcaggaatcctgggcctcaacacgcgatcattttggaggaattcaagatggactcatcgcgcatccagcgaggcgggctcctgcacagggaggagtgcgctccggcgcgcactcccagccatgggccgtggcagtgccgccaagctcgcacgctcaaggagcagtggtggaatgctgcgtatttttgagtcacctgtttcaccttttgtactacatctaccatctggtaagcgccagggacgggggttcgccacatgcccggccccccccgatctccgcgatcaccagcttcgtggttcccagcgcctgcaagccgcccaccgcctcacccgtcccctgtaccacgacatcccaaaccttcagccctccccctccactaatggtttgtgggatgtacagcatcagccgagcatcgtgatctaagcctccacgggggcgggcagcgccgccacctcctcctccttgggcgtgaggacggtgacgacgtcgggcagcggtgtgcgaggtccgacctttccagtggggtcccactcgcgcatgatcttcaccttgatgcccagcacgccctggcgcagcagcacgtgccgcaccgcggcgtcgatgtactcccgcacagggttgccgctggacacctggtacccgtccttgaacttcatggacttggcgcgctgcgcgcgcagcttgccggagacgatgacctcgcaacccttggcgccggcctccatgacgaagcgcagcacgccgtagcaggcgcggcgcacggccaggccgcccagcagcttgtagcgcagggactcggcctgggccacggcgcacagcccgcggttggccaccttctcggcatacagctccaccgcgccctcagggaacttgaagcgcttctggaccacgctggtcagctcgcggatacggcggcccttcacgcctgcagggcagagggggggggggggggggg

SEQ ID NO: 24063 - DNA, 137 bp, Chlorella protothecoides
agtgcatcgtgcttgggtgggaaagagcggcaagacgctcgagccaggacgggggcgggacgatgggtctggagccagacgatttcacagggccgagattgccataaagttcagggccatgcccagtccttggcaaa

SEQ ID NO: 24064 - DNA, 185 bp, Chlorella protothecoides
tctgggagatgtttgtaaagaaaacacgcgagtgggctcatgtgttttggcgaggcgctcggcaacaggcagacacaggagtcaagcccttgcatgatgagacttggaaccacttgcaggccgattcggtaacaaacatagagggtaatcaatcaaaacctatctcatctttaagtctcgtcgta

SEQ ID NO: 24065 - DNA, 68 bp, Chlorella protothecoides
attctgatcgacctcgccggtggcatcaaagactttgcagcgtcccttgactgcgcagcacgggccaa

SEQ ID NO: 24066 - DNA, 118 bp, Chlorella protothecoides
tggtgtgattgcaggtaaacctgaagctgcggccctcgcccggcaggaactcatccacccgctccaagggaatcgtaacttgaggtttaagggatcaatggaagcgatacttcaaggt

SEQ ID NO: 24067 - DNA, 61 bp, Chlorella protothecoides
aacccagggaagggtcaagaagttgctcgcacacgagcccctgctcctcagcaggtcgcgg

SEQ ID NO: 24068 - DNA, 128 bp, Chlorella protothecoides
ccctgacgggcctaccgtctggcactcgacattgggagaggtgcgcatggtgacggggtgcattcgattgttggatatgttacatcagatcatgctcttgtggactcgctgatctccgcgcagggctg

SEQ ID NO: 24069 - DNA, 67 bp, Chlorella protothecoides
gcgcatccaacacgcgctgctgctgctgccccatcttcttcttcttcttcttcttctccttcttctt

SEQ ID NO: 24070 - DNA, 348 bp, Chlorella protothecoides
cctgccacgcgccgccggcctcccccgcccccgccgccgccagcaggcgcggcgcggcgcccaccagcgcctcctgcaccgcggcgcagaagcgcgaggtcagcgcgccgtgcaggccgttgagcacggccactgcgctaggcgcacgccccgtgcccagcgcgcgctcgccggccttggcaagcacgaagaagacgtcgtccaccgcgctggaggtcaagtcccctggccccgcgcccgagatggccagcgccttggccacgctctcctccatgtagtactcttccaggctgatgtagtgggacagtagctcgcggaccgccgccgcgaagccgccgccgcggatgc

SEQ ID NO: 24071 - DNA, 118 bp, Chlorella protothecoides
cccgggcctcccaacctccattgcggcgaccgtgccatcaagaggatcctgtgaggcaatcgaagagcgctgggtgaccagggccatcgggatcgggccccgatcgctcgggtcgcga

SEQ ID NO: 24072 - DNA, 74 bp, Chlorella protothecoides
cctcactttggggttgcaaagtagaatcatattagtcgtctgttctgcctctccaccatgtatctcgtatgccg

SEQ ID NO: 24073 - DNA, 105 bp, Chlorella protothecoides
ccttcgccaggtgggagcatgtgtccatttcggtgaatcgggcctgggtagttggccttgaggggtgcacctgtgccggcaagggcaggtcccactcgttttgat

SEQ ID NO: 24074 - DNA, 61 bp, Chlorella protothecoides
tatgccaagcaggtggacgacatgccaccgttgcaagttcccatccgtatctcttgccttt

SEQ ID NO: 24075 - DNA, 73 bp, Chlorella protothecoides
ttaccagcatcatgcacctcggatgtggaggtggacccctcatgggaattttgcgcatggtgtgaagttgcgc

SEQ ID NO: 24076 - DNA, 74 bp, Chlorella protothecoides
agccaatgagaatgcgtaatttgtccttgaacctgtgccttacattcactgcagtggcatcatggagacaatag

SEQ ID NO: 24077 - DNA, 61 bp, Chlorella protothecoides
gagtggatgtcttggggctggatgctggagggggggaggatgcggggctgcctgccgggga

SEQ ID NO: 24078 - DNA, 71 bp, Chlorella protothecoides
gagcatccatcaagggcgcaacactcgctgaaggtttccagaggccaagcatcccttccttcacggcaggg

SEQ ID NO: 24079 - DNA, 115 bp, Chlorella protothecoides
tcaggggatggaaaggaggcccggcgtgctgcaatctgcagcaacatgtccaggagatgggggaagccatggcaccttccgtgcgacgacgccagcccttctcacatggatcttg

SEQ ID NO: 24080 - DNA, 61 bp, Chlorella protothecoides
acattttatcatacgtcacaaataatagggtttgaatgcactatctcaagcgcattggccc

SEQ ID NO: 24081 - DNA, 324 bp, Chlorella protothecoides
cgcttgctgagatggagtttcagggtacaaacgtctagtttcgggctgccaccatgtgccccgacgtaatcatgaggagcttcggtggttcaaaggggtgacatcaacgttcatgcccatgaggtggacatcactttgcccttgaagagctgtcaatgtgactgaatgatgcacagtacgacatttccgtcaccacgcaacgtgattataggtttaagctcgtctttttaatcttgcaggctgctacacacaccatattgctaaagcaggatccattgaatgtggcgaaagatagggcagtgtggtagaggagctcgccgactg

SEQ ID NO: 24082 - DNA, 268 bp, Chlorella protothecoides
tgacccatttctccttccttccctccccattcaaacgtacgcagggtggcagccacgtgcaggtacgactgcaggccctgaccacgctgtacaacgtgctggagtcgggcgaggcgcggcacgccgtcctgctgcgcacgctgggcttcgcgcgcgccacaggctccgccgacgtgctgctgccggtgatccgcgcctcggccgccacctgggcccgcgacctcggtctggactgggtgagggagcgggagctgctgtcagccgcggc

SEQ ID NO: 24083 - DNA, 76 bp, Chlorella protothecoides
gcgcaggaagtcggcgacgacgcgcgcggcaacaggtctaccccccgccagctccttgccggccacgccctcgtag

SEQ ID NO: 24084 - DNA, 61 bp, Chlorella protothecoides
aattctgtatcggataagagagtgtcttcaacattgggaaatgttatgcgcagaaggccca

SEQ ID NO: 24085 - DNA, 66 bp, Chlorella protothecoides
gcgtgagtggatgtgacgcaacgttgttgtcgaaaggggcttggacgaggtttgcagcgtccagag

SEQ ID NO: 24086 - DNA, 75 bp, Chlorella protothecoides
ggacctgctcaccagaactgatatgaccatcgcatgagattgacctgtgcagcgattcgcctggcgcaggggtgt

SEQ ID NO: 24087 - DNA, 189 bp, Chlorella protothecoides
aagtacgaggtgggttcttcatcttgatgcggaagggcgcgggggggtaggtcggtttggaggggaatgtgattgggtatgccagtcgacgctgcacctcttggcgcttgccgacgactgccgatacgatgtatccccttctggcaggtcctcaagacgccgctcactcgcctccactggtggagggtc

SEQ ID NO: 24088 - DNA, 70 bp, Chlorella protothecoides
gcttgatcaggtcaacacaggttctcactttacctcaggtagagctcaggctccacctgccacctaatgt

SEQ ID NO: 24089 - DNA, 61 bp, Chlorella protothecoides
cctgtgtaggtggaaagcgtggcgcggggtatcatgtgcgagtgaaggacaacagacatgt

SEQ ID NO: 24090 - DNA, 528 bp, Chlorella protothecoides
  modified_base (433)..(442): a, c, t, g, unknown or other
cggggaggccttcttggggggtggcggggacgccctcttggggggaggcggggacgctttttgggggggaggcgggaacgccttcttggggggtgaaagcggcgactggttgtaatccttgagcacagatttgcggagttccgtcaggttgcaatcgtttataatattcctggtaccaatcgcattgttgcaacgaagcctggtgcccttattgttgtcaccccagttcagatttcccttgttggagctccctgtggacaaaggggtccagaaggtaattcagatccacaccatcgtcatgcacagcatcccgctgcatctgtctcaggcaccaccttcactccagtgtccccccaccgccttgcccattcttgctcaccaatgttccagtcgccaatgttgtagtcaccaaagttgttcttccccttgttcnnnnnnnnnncacggtcacaatgatcttggtggagcgcgccttgatgacctcaaaggggctcatcttgatggcaccgacggaaaggccgaggacat

SEQ ID NO: 24091 - DNA, 73 bp, Chlorella protothecoides
tgccatgcccttggggtgacagggatccccgggctggacgctgaccagcctggagacacgtgcagggtttcat

SEQ ID NO: 24092 - DNA, 66 bp, Chlorella protothecoides
caccctctggaaaactcccctttccgcggcgggcaccaccaccaccatgcctcaccatggcgttct

SEQ ID NO: 24093 - DNA, 61 bp, Chlorella protothecoides
cttctgacgaggcatcccagtcagtgtagattttcagtagggttctgacctgagttatgag

SEQ ID NO: 24094 - DNA, 93 bp, Chlorella protothecoides
cagcgcgtgcgcgttggtgccctggaaggcgaacgccgacacgccgcccagcggcgcgctgccgacgccgctgtacgcgctgggcaccggctg

SEQ ID NO: 24095 - DNA, 64 bp, Chlorella protothecoides
ccagccggtgcctcgccaccaggggtttgccctggaaggcctccgacacgatctccacgctgcg

SEQ ID NO: 24096 - DNA, 69 bp, Chlorella protothecoides
aggttggtgactggattgatctgatcagactatggtgtccagagggatgtccgcccatgcgcccgttcg

SEQ ID NO: 24097 - DNA, 61 bp, Chlorella protothecoides
cagcgccaacccgcagccggtgctgtccttcgaccagcacagcgccaacgtcaccgccgtc

SEQ ID NO: 24098 - DNA, 78 bp, Chlorella protothecoides
ccgcacaacgtctgtcggcagcagccgatccaacaggccccgtctcctcacgcccgcgccccattcccacaggcctca

SEQ ID NO: 24099 - DNA, 190 bp, Chlorella protothecoides
gggagccagggaaggcaagcgcggtgccggcgcacatgggcaccacgttccaagcttggtcgccgccagagggccgcaggacgcccagcagggaaaggtacggcgatggggaacgcaccgccgcaagaaggggggtccagccaggggacagagggcatcaggggcgtggcgatctaaaaatggaaagaat

SEQ ID NO: 24100 - DNA, 114 bp, Chlorella protothecoides
catgatcgtggcactggtatgaggggagtcattctcagtcaagtgcaactgttaccaacccaatacatcctgacacagcttcacgacacccccttcccagatgctcaaagcagt

SEQ ID NO: 24101 - DNA, 136 bp, Chlorella protothecoides
cgtcggtccctacactgtcactgtgctcacaagcattcccccacctccgccgcccaccccgcccagtccaagcccttctccagcaccaacacccgtcgacgtgacactgagcaacgcatggtgcacgcagcaggag

SEQ ID NO: 24102 - DNA, 74 bp, Chlorella protothecoides
tctggtggggccccgagcgcgagcgcaggccggtgcaggcaatggcgcggccggcccgagggtcggtgggtggc

SEQ ID NO: 24103 - DNA, 78 bp, Chlorella protothecoides
gcacagtcaatggtagcggccacagtggcgcagccatcgttacaaaggcccattcccgcgtccagcatggcggacggc

SEQ ID NO: 24104 - DNA, 70 bp, Chlorella protothecoides
cccccccccccccccccccccccctcttctcccaaagactgcccaccgtagaagatgtccccggtctgtg

SEQ ID NO: 24105 - DNA, 72 bp, Chlorella protothecoides
gtggtttctgcagggatgatgacggtgctcggaagcaggtttatggatggatattcaggattcgggcatgca

SEQ ID NO: 24106 - DNA, 125 bp, Chlorella protothecoides
atggatggatattcaggattcgggcatgcactcccgtcgacacaaccacttgcactcgggggaaattaattgtatcacactcgaagctccaaaaatacctgagagacgtcgaccatcctggcccg

SEQ ID NO: 24107 - DNA, 61 bp, Chlorella protothecoides
agatgccagcatcgtgagcgagccgcagtttcagtccatcagtgtctccgcaaacctttgg

SEQ ID NO: 24108 - DNA, 62 bp, Chlorella protothecoides
cagtccatcagtgtctccgcaaacctttggatgcccatccaggaggtgccaggtgggctggg

SEQ ID NO: 24109 - DNA, 79 bp, Chlorella protothecoides
gccgtgccccgcgttgaaggccacgtagaggcccccgccatcaaactctggcagcgaaaaggccacgaagcggccgtcc

SEQ ID NO: 24110 - DNA, 131 bp, Chlorella protothecoides
ggatggcgaattgaagtttctgtgaaatgattttatggagcgccagcagcatgcagcacgctagcgcgcctctaagctcgagcagcggtagatgttggcaacgagtgtcgtccccacccttcacccagcgg

SEQ ID NO: 24111 - DNA, 71 bp, Chlorella protothecoides
cccaagcgagaagcaagcccaccagcgtctgacccctcccatcctggcaaggggtttaaccccctcccccc

SEQ ID NO: 24112 - DNA, 146 bp, Chlorella protothecoides
ggggggggggggggagggactggtccagggcgactcgggggcatgacctgtgggggtggacactgggaggccagggcaggtggtggggtggctggcagcacatgttcccgcgatggtgcattttgggcgggagccgtgcgccgtgt

SEQ ID NO: 24113 - DNA, 76 bp, Chlorella protothecoides
ggtcaagttcttccagatgggccgaaatgtcctggctctgcccggaaagtgcctggtggtgtaccgcaatggtact

SEQ ID NO: 24114 - DNA, 70 bp, Chlorella protothecoides
tccatgtggcctgcttgacttggcggttggctggcctgaacatgccagatgcatggctttgtaaactgcc

SEQ ID NO: 24115 - DNA, 78 bp, Chlorella protothecoides
agacccagcaagtacagtactgggcatccaaaagagcacaggacaccgtcaatgtctacccctgctgggctctgctag

SEQ ID NO: 24116 - DNA, 91 bp, Chlorella protothecoides
cgaggatgtcatggtcaagagagtgatcccacgatcaggcgcggcacgcagcggacagtaagattagattcatcgaggcacaatccagcga

SEQ ID NO: 24117 - DNA, 133 bp, Chlorella protothecoides
aactcccttggaccgctcatgtcaagcaaggagttgataatgatcaaacatgatagttgtagtcttgcatccaaaaatggatcttaatttgccaatcgtgccgagaagtagctagggtttttaataaagcagt

SEQ ID NO: 24118 - DNA, 213 bp, Chlorella protothecoides
gtcaggatgcagaattcttgcccacatccatacggtgtcagcgaatcaatgcacagccagtgatgctggcagcttgatgaaaggcagaatgtcacccagttgcggcactcctggtaacaagaagtgggacttggagggtgacaggggtgaagggggcaagacttgaaccccattgtatccttcaaagtttgaaatgtagcaaaccccaggagt

SEQ ID NO: 24119 - DNA, 80 bp, Chlorella protothecoides
cgctgggatcggggggtgctgggcgggtagagtgtggtaggccagctcctgcatggaccagatgacatctaccttttctg

SEQ ID NO: 24120 - DNA, 71 bp, Chlorella protothecoides
caaaagcagcggacgctgcagacccagtgcgtgattgcagatcaggcaacattccgcatcgcaccttctcg

SEQ ID NO: 24121 - DNA, 244 bp, Chlorella protothecoides
cattggtaccaggtagagagcctgcaccccgcttctcaacatggacagaagcaccggatgcagcggtggttcaccacccacccttgccaaaagtgtccttcctaccatccctcggacccacctgggttccggatgaagtgaaaatggaagcgcccttcccaaccagggccccagaggcccagtgcccccccgtggcatccaggaacgccttgaactgagcaggggcggtgccaaacctgtgtcg

SEQ ID NO: 24122 - DNA, 72 bp, Chlorella protothecoides
gaaagtcagtcggaactctacatgtgcccgggaagtatgcacctgcggtggcaatgcaataacacactcgag

SEQ ID NO: 24123 - DNA, 73 bp, Chlorella protothecoides
tgtgccgtgctttcttacttggggaacccgtgtggtggagggggcccgaggggacgggcgtgcggatgaggtc

SEQ ID NO: 24124 - DNA, 61 bp, Chlorella protothecoides
gcggcagctcggcagccatgctagcattgcgtagctgtgtggtgacgggggcctgagtggg

SEQ ID NO: 24125 - DNA, 95 bp, Chlorella protothecoides
gactacttcctggatgtgtcgggtgaggacgtgtctgtgtttggggggggggggcgatcacttttggggtcaggggaaggggggcggtcacaagg

SEQ ID NO: 24126 - DNA, 61 bp, Chlorella protothecoides
ggcacgctccaagatgtcgagagtggtagggttagctccatgcccatttccaaatcctttc

SEQ ID NO: 24127 - DNA, 319 bp, Chlorella protothecoides
tgagcgtcaggcatctgcgccgtgggtgggtgtgtaaatgggtgggtggttgtttggcggctgctctaccgcgcatgccgctgcaacctttctgtggcaacgtgtaccagacagcatcatgccttgctgatcaaatcagcagacactacaagcagtcatgggaccctccttcctctatcaaacaaggaaaccacagcaccggtgtgcccacaactcacccccacccttttcccgcccctctctgatcatccgcgcacgagacccacctcttaaaaaatgtcaggtcgagtggttgcagcgccgcatccgcgtccgcccg

SEQ ID NO: 24128 - DNA, 61 bp, Chlorella protothecoides
cgcatcccagggcacaaggttgtaggggacaagggagcggtgcataccatgactgcatgtc

SEQ ID NO: 24129 - DNA, 77 bp, Chlorella protothecoides
gttggatgcgcttcgaccgacagtggacgatgtcgtggccgtcgtcaccgagttgcgcaccgtcggcgacctcttcg

SEQ ID NO: 24130 - DNA, 75 bp, Chlorella protothecoides
aaagggacgcacgcctccagactctgctcatttgggggcggttaatgaggaagagggatctgaatggcgttccaa

SEQ ID NO: 24131 - DNA, 61 bp, Chlorella protothecoides
tcctggaccgcggcggtgaaggcgtcggcgtcccgagcctccagcgcatcggccagcgcgg

SEQ ID NO: 24132 - DNA, 68 bp, Chlorella protothecoides
tgcaggcttcgagagcagcttttgtagaggtctgccaacctccctggcgtcatgcaccgaggcagcct

SEQ ID NO: 24133 - DNA, 66 bp, Chlorella protothecoides
cagggcatcgtggggtccggtatcaggagtgctcccggaaacaaggagctctcccgccacaataat

SEQ ID NO: 24134 - DNA, 85 bp, Chlorella protothecoides
gccccaccctgtgccaggaaccacactggtgaggctgcgatacgttggcgccaatggggcagaggtggcgagtgggacccggacc

SEQ ID NO: 24135 - DNA, 61 bp, Chlorella protothecoides
gccaaggacacgtagaggctggggggaaggtgcggcacatccctgctgcccagaccctgga

SEQ ID NO: 24136 - DNA, 94 bp, Chlorella protothecoides
agcctatgcgcgtccactacccactgcaagcaggcatgaaggcttcagcaaggcgggtccatccgcacctccacccttgatgccatggggctgt

SEQ ID NO: 24137 - DNA, 611 bp, Chlorella protothecoides
ctccccccccccgtgttccggaacgaagcacagaaaccgagtccatccgcccccacccacctggcttcgggtcttggcgcccaccaccttgatgtcgatggtgctggtgttggtggccaggatgcaggcagggcgcgtgacacgctccaggtccgcgaagatcctctgcttcagctccacctgctcgatggcggcctcgatcaccatgtccaccgatccaaactcgtcgtaggtcagggtgcccgtcacccgcgccagcgccgcgtcggcggccgcctgcttcaggctgccgcgcttgaccccggaggccaggttggcgcggatgcgcgccaggcccgcgtccaggaacccctggttgatctccttgagcaggacctcgatgcccgccagcgcgctcgcggtggcgatgcccgatcccatcagcccgccccccagcaccgccaggcggcgcagcccgcgcggcgccaggcccacgtccgtcaccccgcgcacgcgcttggtggagcgctgcgcgaagaagacgtgcaccagcgcgccgtgcgtgggcagcgccgccgcggcggcaaaggcctcggcctcggcgcggaggcccgccgcgccgccgcgctcca

SEQ ID NO: 24138 - DNA, 61 bp, Chlorella protothecoides
gatggcggcctcgatcaccatgtccaccgatccaaactcgtcgtaggtcagggtgcccgtc

SEQ ID NO: 24139 - DNA, 61 bp, Chlorella protothecoides
gtaacgattgcctggcaaagctgtctcactttccactcttccctagcccttgaataacctg

SEQ ID NO: 24140 - DNA, 64 bp, Chlorella protothecoides
atttcattgcagggctgctggaggattgggtttccccatccaagtttctctttgcatccacccc

SEQ ID NO: 24141 - DNA, 61 bp, Chlorella protothecoides
ataccagggaaaggcaaaggacatggcctcaaccaccttggccccgcagaactcttcaggc

SEQ ID NO: 24142 - DNA, 160 bp, Chlorella protothecoides
atttggcagagccctcaatttcaccctcatttggcgttttcaagcttcctggcttgaataaatcaagttccacgcaggattgctgcctagacgatgcaggcgcaaaacagccataccttcatccgtcagattctgctgcactccaaactgcgcatggtag

SEQ ID NO: 24143 - DNA, 61 bp, Chlorella protothecoides
acaaatctcggcatgcctcccgagaggcaggctgggcatcattggatgatcgcatgagcgt

SEQ ID NO: 24144 - DNA, 61 bp, Chlorella protothecoides
tgtgggcctgtgggggaagtcggagggaggtatttccttcgtctggacgctatctaaagat

SEQ ID NO: 24145 - DNA, 124 bp, Chlorella protothecoides
gcagcaggggagggccggcacccggctcgcaagcgcattcggcgaggggccggatgggcccccccgtccccctctgccagggacggggatgacgagccgcccattccctgtcccaggctcacca

SEQ ID NO: 24146 - DNA, 62 bp, Chlorella protothecoides
gcagcggggaaattgaatggaagatgggaagtagaccctcgtgagcgagagctgtgcatgtc

SEQ ID NO: 24147 - DNA, 61 bp, Chlorella protothecoides
agaccctcgtgagcgagagctgtgcatgtcaaccaatgtctcgctgcaatggcagtgcgcg

SEQ ID NO: 24148 - DNA, 61 bp, Chlorella protothecoides
aggaacccacgtgcatcccttgtcgactcgtcccacagcagcctctctgttcatcatgggg

SEQ ID NO: 24149 - DNA, 126 bp, Chlorella protothecoides
gtctccaccacaaactccttctccacggggcggtgctcacggatttgctccacacgctccttcaccagagaacgatcctcggtgttggtgtagtaatcctggccaaggacctgctccttgccctgc

SEQ ID NO: 24150 - DNA, 300 bp, Chlorella protothecoides
tgctgtgctgacatgcctcctgaagctgggtgggtggggcgtgctgctttgtctaccattcaccacagccggccacgcatcgtgtgcttagtcgccagtctatcaccgctgcacacccgtcgcacgccaggaaattgaggagcgcagggtgcagccggagcagtacccatatggcagccgcggccccgtgggcgcccactacctggcggcaaagtacggcgttcggtggggcgaccacaactccgacgatctctgaccgggccccgggtggtgctcccggcacggcgacgagactggctg

SEQ ID NO: 24151 - DNA, 61 bp, Chlorella protothecoides
cccatgagaggagcactcggtgtgaagggctaggggtctgcctgaatgtgtgggtgcattg

SEQ ID NO: 24152 - DNA, 230 bp, Chlorella protothecoides
ccagtggcaccagtggtgagcgggcatgctccaggatgggacatggaagggatgggaagggagggtgcgcatgtcgtcgttctcaagcgcatcggggtgcactgtcgtggaaggtgggcgtgcacgggcttgtgtgatcgcggcctggcgatgccgggaccctcccctgcggcctccatgcccgaacacacacaccttcccccccttcccttcacccccttcccccaccc

SEQ ID NO: 24153 - DNA, 70 bp, Chlorella protothecoides
aagggaatgggaagatccgtcggcaccccacatttgccccctcgaggagcgctggcctcctcttgcatga

SEQ ID NO: 24154 - DNA, 165 bp, Chlorella protothecoides
acgatccactgccaactctgggtctgctcaccaacacgaggacctaggggaagacgcaggttgccatgcaggcggtccttgctccacctcgggaggcgacaggtagggagccaccaccacaccccatcacggaacactgcaggggttggcgagccaggaaaacaa

SEQ ID NO: 24155 - DNA, 78 bp, Chlorella protothecoides
gtgatgcgccagtctcctcagtcggtttgcatacagcccgtgatgatccactgtcagtggaggaatacacaagccatt

SEQ ID NO: 24156 - DNA, 68 bp, Chlorella protothecoides
tccatggcgctgtgcgtcgccgcccccattgccgtttccccctgccctgctgcgacgtgcaggaccgc

SEQ ID NO: 24157 - DNA, 259 bp, Chlorella protothecoides
cattgcttgtaggcaatgaggtccctgtatgggcgatcaaatcgtgatccttcctcgcttgggagcggtggtgcagtcactcttagagttgaaagatcgcccggctggcggggcctacgcggggatcagaatcgcatagtacgcacaatgcggcggtattgcgaatgtttgccgttgcctgtgatcaagcgttggccccaggtacaccgtacacaggggctctcacttcagcgcgcgcaatgccacgtcacggggcggt

SEQ ID NO: 24158 - DNA, 98 bp, Chlorella protothecoides
catggcacgggacaggcatgtcactctaccaagggttggtgacttgaggacgatggcacaccatcgccctgcacttcatgcaggaggtggaccccaac

SEQ ID NO: 24159 - DNA, 62 bp, Chlorella protothecoides
cggaaagcgctcagcggtgtgcctgcccctggccctcccaccgccaggcgtcccgactacaa

SEQ ID NO: 24160 - DNA, 171 bp, Chlorella protothecoides
tgctggccaggtgaatcacaaggaccttctggtccgggatagtgtgggcactctgcaacgggatgaatctgcgtaggattcgcattgcattaaagtatgtgcgtgcgttttggatgtccacggttcgcttacttcttctgtctcctttccaacatcccgctcctgtcatgt

SEQ ID NO: 24161 - DNA, 61 bp, Chlorella protothecoides
tatccaccacatcgaaggcctgtgacagaagtttcagggcaccctagggcctttgcgcttc

SEQ ID NO: 24162 - DNA, 81 bp, Chlorella protothecoides
gggacccccgacagcatagatgccgcttgggtctccgggtggccagggccggttccatgccagattgcaccgatgcctcag

SEQ ID NO: 24163 - DNA, 87 bp, Chlorella protothecoides
agtctttggaatggctgcaggttggggcgccacgttaattttgatcttgactgcgataagtgggactttagtgggtcgatggctgga

SEQ ID NO: 24164 - DNA, 92 bp, Chlorella protothecoides
ctgctcaaggggtagctgatgtcttaggctgttatgagggttcctcttgaccggaccactttcccactttccacctgttcccgctctgcacc

SEQ ID NO: 24165 - DNA, 76 bp, Chlorella protothecoides
ggccatgcatgcccggtctgggggcgatctagaggttatgggagttatgcagggcaaggtcctgggcgacaccttt

SEQ ID NO: 24166 - DNA, 76 bp, Chlorella protothecoides
cctggtgcatgccatcaggacgcgccacccatgtcagcccatagctgccatggaggctgctcagccctactacgag

SEQ ID NO: 24167 - DNA, 73 bp, Chlorella protothecoides
tgtgattctggccaagggagatgggcggtgggtcatgcgtgcgtgattatcaagtatgcaggactcctttaca

SEQ ID NO: 24168 - DNA, 165 bp, Chlorella protothecoides
accctgctccagctcatggcgctggacctgttcacccccggcgcggtcaccaccatcaccaacacgctggggccatgcctgcgcgcctgcaccgcggcggacgcgggcgcggcggagatcaccaccaacgtcttcgacctggcccaggagtacaacgtgtccctc

SEQ ID NO: 24169 - DNA, 80 bp, Chlorella protothecoides
cccacctcctgttcagtgatacccctggaatgttctacaccgtgcatgaaatgtcgcgatgtgatttcttgagctgcatg

SEQ ID NO: 24170 - DNA, 77 bp, Chlorella protothecoides
caccacaccggctgcgacccccaggctcgccatgtggtggtcgaatttggtgcagctccgatggtttctgtgggccg

SEQ ID NO: 24171 - DNA, 61 bp, Chlorella protothecoides
ggcactaccatactggatggagtccagcgaaaaggtccaggcacgatggaagctagcaaga

SEQ ID NO: 24172 - DNA, 247 bp, Chlorella protothecoides
gggtatattcgatgttcatagaagctccgcctatcgttttaagatctcagcataaatctaccgctacggtgcaatatttgttcctggattggatatccaccagtatttaccagatcttcccgatctccatgcaaatgcagaccggagatttcttttgggggcctgccggagctgctatctcagatacgacgagatattgggattgcacgcgtgcagttggatgatccagagcttcaagccttttctc

SEQ ID NO: 24173 - DNA, 70 bp, Chlorella protothecoides
taccccgcactgggcgcggtcatgggtgacggcctcctaggtggcagacccaaccgcgacaggttgccca

SEQ ID NO: 24174 - DNA, 65 bp, Chlorella protothecoides
aggcatttcggccacgccgactctcctcaccgcacccctaccgggcttgcgccggttgcacagct

SEQ ID NO: 24175 - DNA, 167 bp, Chlorella protothecoides
cgagccgcccgccccgccatgggccgagccctggcatctttgggcagcaggcgtacctttaaggtgttttcaacggcgcaggaggatgaaggcgcctggatggttgtgggcctgggcaacccgggccaaaaatatcatggcacacgacacaatgtgggttcggtggc

SEQ ID NO: 24176 - DNA, 282 bp, Chlorella protothecoides
tcttcccaggcggccgagcacgcttccagggtcgctgcccagcctcacgccagccaactggttcaggggctcagggtgcgttattgtaactggggagcgagcgaggggagatggttgagtcttgcacggaccagcccacgggaaggtcctgccgtggctgtgtcgggtgtactgcctgcctggagcatcagggacccccctcttcctgcttcccttcacacaacataggaggcatgggcggagcacaagcttgagcaggcggagagtggaaagggcgagctg

SEQ ID NO: 24177 - DNA, 17856 bp, Chlorella protothecoides
  modified_base (136)..(227): a, c, t, g, unknown or other
  modified_base (931)..(1021): a, c, t, g, unknown or other
  modified_base (1742)..(1751): a, c, t, g, unknown or other
  modified_base (3566)..(3575): a, c, t, g, unknown or other
  modified_base (3933)..(3942): a, c, t, g, unknown or other
  modified_base (4369)..(4378): a, c, t, g, unknown or other
  modified_base (4810)..(4907): a, c, t, g, unknown or other
  modified_base (5015)..(5024): a, c, t, g, unknown or other
  modified_base (5579)..(5588): a, c, t, g, unknown or other
  modified_base (6111)..(6120): a, c, t, g, unknown or other
  modified_base (6901)..(7001): a, c, t, g, unknown or other
  modified_base (7140)..(7149): a, c, t, g, unknown or other
  modified_base (7260)..(7330): a, c, t, g, unknown or other
  modified_base (7438)..(7447): a, c, t, g, unknown or other
  modified_base (7826)..(7835): a, c, t, g, unknown or other
  modified_base (9717)..(9726): a, c, t, g, unknown or other
  modified_base (10370)..(10379): a, c, t, g, unknown or other
  modified_base (11296)..(11305): a, c, t, g, unknown or other
  modified_base (12022)..(12031): a, c, t, g, unknown or other
  modified_base (12801)..(12810): a, c, t, g, unknown or other
  modified_base (13867)..(13876): a, c, t, g, unknown or other
  modified_base (14459)..(14468): a, c, t, g, unknown or other
  modified_base (15243)..(15252): a, c, t, g, unknown or other
  modified_base (15501)..(15510): a, c, t, g, unknown or other
  modified_base (16312)..(16321): a, c, t, g, unknown or other
  modified_base (16927)..(16936): a, c, t, g, unknown or other
  modified_base (17170)..(17179): a, c, t, g, unknown or other
  modified_base (17640)..(17649): a, c, t, g, unknown or other
ggtccgcgcaccgcgcggacgcgtccccactccgcgccggccacgacgacgtcgccggcgcgcagcgtgccctggcgcaccaccaccgtggccacggggccgcgccccctgtccagccgcgcctcgaccaccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccatcatctccgcctgcagcagcagggcctcctccagggcgtccaggcctgtgccgcgcggcgcggccacctccaccacctgcaccgtgcccccggcctcctccagctccaggcccagggagagcagcgcggcgcggacgcgcgcgggcgccgcgcccggcacgtcgcacttggtcagcgccacgacgacggggcagcccgccgcgcgcgcgtgcgccagcgcctcgcgcgtctgcggcatcacgccgtcgtcggccgcgaccaccaggaccacgatgtcggtgaccgccgcgccgcgcgcgcgcatggcgcagaaggccgcgtgccccggcgtgtccaggaaggtcagcgcggtgcccgaggcggggagcgggaagctgaaggcgccgatgtgctgggtgatgccgcccgcctcgcgcgccgccagcgccgtgcgccgcagcgcgtccagcagcgtggtcttcccgtggtccacgtggcccatcaccgccaccaccgccgggcggggggccgcgtcgggggcgtccctggatgacgacgaagccaccgccgccgcctcagggtccagcaccgccgccacgccgagctccatggccgccagctcggcgtcctcgggcgacaccagctcctgctcggagccagggggggagcccaggctggccaggatgccctccagccgggacagcgggcagcctgtggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagaaagatgaacggtgtggggggtgcgggtgccacttggtagggagaggaggcgggctgtgaggcacgcgagtgaggaaggccgagccgtgcgggcaggagccttgggcatgagggagacccacaagccctgccaaacacccagagccacgacacccaggcacggccatcgacctgcgctgctcaccaaacaggctggccagacgcagcacggtcacgtccgcggggatgaccaccggcggctgcaccgccggcgccgcgcgcacgggcttgggtctcgtccccgacccccgaccatcctgcaggtcggcgtgctccccccacagctccggctgtgggtgcgcctggcgcggccgccgctgctgctgctgctgctgctgctgctgcatgtcgccggcgctgccccacctgggtgcctggtcaggacccagcttcccctgcgcccgcagccactctcgctgctcctccggcgtgcgcgggtgccggcgcggctgcgccccggcctcccacagcatcccgtttgcccgcagccactcgcgctgctcctccggcgtgcgcgggtgcttccacgtcgcgcccggcgcggaccggtctacccacttgcccgtggccttgagccactcccgctgctgctcgggggtacgagggtgccgcgcctcgcgccgggacgcgcctcccggcgtggccctgcccggactcgctgcagcacgcggagcccnnnnnnnnnncgggtgccgcgcctcgcgccgggccgcgcctcctggcgtggccttgcccggactcgctgcagcacgcggagccccgcccggcggccggggggccgggatgtggttgaccccgggccgttgggggggcgggctgggcggtgcggtgcgggggatgtggcgtggccgcggcgcgggcggcgtgtgggggccggctgccctggaccgaggcccggactggggctgctgctgcggcccgggctggcgctggacgttcccattcacctgtgcgcgagcggtggaggtcccaggggtgtgcctggtggatggaccagccgctggggagcctggatggttgagggggggtgattgtgctgtcgggagggtgggtgtacgcaacacggcatgtgttgggacgcgcagggtggtggacctgaaccttgacctctcacagagatggtgagacagttgcgttttcacacgtccaggaccaacctgaccaaacccgagggccatgcaaaacgtatagccactcttgtgcccatcaaagtggcggccaactatcctcaactactcaccactcccccgaggcccaaacccatgcgatcccagtctcaccctggttgtgactaccgcgggccttgtttggtggcgctctgggcacactcctctccacggcctctgcctcctgggccgggagggcggagcgcagggctgcccgggtggctgcatacccacgtcgggcagagtccgcgaggctggcgccagcactgctcctgatttgattgaatgtttccaaggaccaagacgaatttccctgctgaaagtatgcccgcagcagaggtgtgagggaagagctgcgtgggggcatgcctgcctcgcctcgggttcctccgcctccaagccaggatcaataattatgcatattatgagaccaatctagtccaatgttatgcctgatggctgagctgtgcgtgcgcaggcgtattgtcatgtattcatcgcgggttgcagctgagagcgcgcaatggcagcagcctgattgcgggtggtcaaaggcgcgatggaagcattcacatccatcatcaggacatccacgttcaatacggtcaccaaatccttacaagtgcatagtaacagtcaggtgtgtagacacacagacttacgagcccctgttcgtgggctccctcgcctcgatggcaggagagtccgtcgggctcgactccctgggcccacaggagctagctgaagtggggaagcagctggaaggcgagatcaatggattcatccagaatgctctcaccttgcagcagacggcggggaagtttgccgctgcagggcagtcggtagagtacctgcaagagcagaaaaaaggtgaggagacctggctgggatggatttaggactagcaggcagagaacttgatcacatggcttggtatcatccccgttgattgaagctgtgaaagggagaatcggctacatgtggagttggagtgcattctgatgttacacccataccatctgactcacgtccctgcccactccttgctttgatgcaggtcagccccttctcctccccctcaccgaatccctgtacgtatctgggaccttagagtctgtggaaagcgtgctcctggagattggtaccgggtattttgtcgaggtgggctgctctggaagggggggcaaccatgggtgcattccttggtggttagaccattcatccacatccatcctatgagccaaccctttgaaagttctgcataacgtctatcagtgtctattctacttctaagcaagccgtattcccctcgcttgcatgcagcgtgatctggannnnnnnnnncgtcgaggtgggctactctggaggggggggaccccatgggtgcatttcttggtggttgaaccattcatccacatccatcctatgagccaaccctttcaaagttctgcataacgtccatcagtgtctattatatttctaagcaagccgcactcccctcgcttgcatgcagcgtgatctggagggcggcattgactactgccgcaggaaggtgctgctcgtgagggacaagacggagcaactgtctcaggtatggatgggtgccgatgctagcaggaacggccgagaacaggctatgtatctagatccagtttgcctgccatgacaaccgcggctgtctgattgctaccaggacggcttnnnnnnnnnnatacctagatccagcttgcctgccatgacgacggcggctgtctgattgctaccaggacggcttaccctgccatccagcttagtttgtccccatcccatttaccatagttacactatcgcactcctcccgcacacagctcatcaagtcccggcaaacagcgctggctcaggtgaacgctcttctagagcagaaggtgggcggtcaggcaggccaggcctgaggaatcggatggcatccatggacgcgtatggtcatggttgtgcagagtgtcgcgctcaacaaagcctctttcagtgccgaagcctcaagagctattcatcctgcctgcgtcaccagtgtcttccttcagctcattttaaagcttgtaatttgtcacagtgatttaaaaacattactttgggttccgaagacactcatcagagtattnnnnnnnnnncttcctgcgtcacctgtgtcctccttcagctcattttcaagcttgtaattcgtcacatagattaaaaacattacattgggttccgaagacactcatcagagtattgctgaaaacattgtgacggcacagagtcaggtcagctaagatttatgcacttccaccccatcaattccacccactcagctttcctccgtctcgctgtcaagctggacctcctctgggttctgtggtccaagcacggcggccagcgaggcgaggagagggggccttccgtcgctgccgcacaggtttgagttttgttccgcctctgcattgtccttgacctcctcctcagactcgaggtcgaggtcgatctcctccgggttgggctccgaggctctggtagcctgcggcggcgtcgggcctcctgcggcccagcccccgtgcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcggcgcggcacgcggcatccgcccccgctgcccgggccggcccgggtcatgcgccggcgcggtggccacaaagatggtgggcacggccaggtcgccggtgggagnnnnnnnnnnaatggtagcctgcggcggcgtcaagcctcctgcggcccagcccccgtgcggcgggccgggcaccgcatcgaggtccaggtcataaggcaggcccaggcggcgcaggtactccagggtctgcgggttgcgcggcgcggcgcgcggcatccgcccccgctgcccgggccgacccgggtcgtgcgccggcgcggtggccacaaagttggtgggcacggccaggtcgccggtgggagaggcggcgcgcagggccgcctcggccgacgcgacctccgccggggtcacgggggccggcggcccgcgcggcagcgccgtgggcgctggtgcgaggttctgcagctcgtgcgtggcgcgcaggaccgccgcccactccgcgtcgtatgtgaactcgtgcgcgccggaggcctcagggaagtccagcacctggaggaactggcggcgcggcaggcacttgtccagggacaggaagcgcgtggcggggtggcggccccggacatgaggagctgcatcgctgcttgtgggctcgggggtgccgggtgacgagcctttgggtggatnnnnnnnnnnggctgcattgctgcttctgggcttgagggtgccgggtgacgagcctttgggtggatgcttctgtgggacctcttgctcgggctccgcagcgtgtcgcactagcgcggcaaacttggtgtgcaggtgggcgctgaaccagtaggcagggcgcaggtggtggagcagctctgctgctgggggggagcccaaagagttgtcggtgatctggacggtgtgagggtgggacaaggggggtggcagtggataaatggaggtgtgggtgatatgctggcgaccttttgaaagctgggtgatcaccacatgcagaagactggcaccgctcgaaggcacagctgggcagcacagtcgctacaactctcgctcagcaaggcgtggggtccacaggtctctttgtgtacacaccagggtgatactgaaggaatgcagggctgctgcggtattgccagcgtccagcccatctccccctcatcgcttctgcacacaagatcctgcctctgatccccacctgccctctcctcaccannnnnnnnnntgctacaactctcgcccagcaaggcgtggggtccacaggtcttgctctgtacacaccagggtgatactcaaggaatgcagggctgctgcggtattgccagcggtcaccccatctcccctcgtcgcttctgcacaagatcctgtctctgatccccacctgccctctcctcaccaacccctaaacccaggctgcccaccccctcttcctgttgttacctcgctgcgcaggaaggactttcttcgcagcagggcgtccaggtcgccgtggcgcgcgatgccctgcggccagtcgtggctcagcatgatgtccggggcggaggccagcctggccaggcggtgtacctccagcgagcgcacgtggtaggcgctgcgcatgctgctgttgttgtagggcgggcgctcaaagtggcccagcggatagtggtgtgcggcaaaggtgccggagaggcccgcaatgcgcaggccgccaaagccgaccacacccgcggcgcccaggtacaagatgttgggcgcggcccagccgccgtagtgcagctcccagaggtggttggccgcctcatggttgccgccgatgaacagggtggggatgggggcccgggcctcgcctgagtagtacctgtagaaagactggattgcccggtattttggcgggcaggccatgcattccaggtcatccagattgcggaccgcctgtgtgtgggggagggcggggagggggatgagaagccatggtgacgccaggcaaagcgggcatgtatgaaggcaggcttgttcttgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctgtagatggcgtccagctctccatggcagcagccttccacggctacctgagcagggatcatgtccatggtcaggcacagcatgctgcaaaggcaatgcatgtccgggtggggttgttgcaatgcttgaacagccnnnnnnnnnnaaggagtggagaaacagatcacaaaaatcaaagctcaacagacctggaagtcgccgcagcagatgagcaggtcgatggggcggccgtcctgctctgcaagcgcctgcaggnnnnnnnnnnnnnnnnnnnnnnnnnnnnnnnnnnnnnnnnnnnnnnnnnnnnnnnnnnnnnnnnnnnnnnngtcagtaggtgcccgtaggccgtatgcgagccgcgacctgcatgccgcagtttattcgctgccggtttggggcacggttgccgctccctgcccagctgcggacggcannnnnnnnnncgatcaggcagagcatgctgcaaaggcactgcatgtcggggtggggttgttgcaatgcttgaacagcccaaccttccactcgccccatcgaaacacacccggagacccgtcatgacgtttgaggaatcctccacgactctgctcaataggtgcccgcaggccatgtgcgagccgcgacctgcatgccgcaaattgttcgctgccggttttgggcacgattgccgctccctgcccagctgcggacggcaaccggtgaaaaatgaagaactaatcgtcacgatataactgcattggcagacgtatgtactccggtgcatggccagccatgcagggactgaaacaccgccagggcgccatggtcacctccagattcgtgttnnnnnnnnnnggacgtatgcactccggtgcatggccagccatgcagggacgggcacaccgccagtctgggcgccatggtcacctccagattcgtgttcggagggatcccagagcaggcaccgcacgggcaatcctgggccgcgcgcgggcaatcacatccggccccggatgggccctgtcagccagatgtggccacgtgcgggcttcgccatcccgtcccccgacaggggcttcctggcgcgcctcagccgcgggtccggcgccccgaccccagacccttccgccccctgcgaccctgcgtgaggctcacccgctcctgccactgatccagtcatccccctggcctccaggtaacttccccacccttgaccttcccccccacacacctgccccccgaggtgccgtgcctccgggtgccatgattcgcggccgcaggatcgcgacccgactcctcacggagattcggtccctggcccccgccactcatgaccccaccaccctcccggcccagctcccaggcatgtcccggtccgcccatgactccccccgccccgcctccaaggagggcaaggccatgcaccccgacctcctgaacgacaacatcctgaagacgcagtatgcggtgcgcggcgagctgtacacccgtgcccaggagctggccaagtctggcggggaggtgatctacaccaacatcggcaatccacagcagctggggcaggagccgctggtgttcaaccgccaggtgctggccctgctcctcgcccccttcctgctggaccacccgtcggccagtgcgctgttcccacgcgaggccatcgaccgcgcgcgcgagctgctggccgccttcggcgggcgcatgggcgcgtactcggacgcgcgcggcgcgcccgccatccgccagcaggtggccgccttcatcgaggcgcgggacgggcagcccgccaacccggaggacatctacctcaccgacggcgcgtcggtgggcgtcaagtacgcgctcaacgcgctcatccgcgacggcaatgacggcatcctgtgccccatcccgcagtatccgctctactccgccgccatccagctgttcggcggcaagctggtgccctactacctggaggaggacgcgggctgggacctgaacctggaggcgctgcgtggcgcagtgaagaaggcgcgggcggagggcaccgtgctccgcgccctggccttcatcaacccaggcaaccccacgggccaggtgctgacgcgcgagacgctgcgtgagctcatcgcctttgcccacgacgagggcctggtgctgctggcggacgaggtgtaccagcccaacatctaccaggacgagaagccctttgtaagcgccaagcgcgtgctgcgcgagatgggcgagccctgggccagctccgtggagctggcctccttccacaccgtgtccaagggcatgctgggcgagtgcggcctacgtggagggtacgtggagtgggtcaacatccacccaggcgcgcaggcggagctctacaaggtggccagcgtcaacctgtgccccaacaccgtcggccaggccaccgtgtccctcatggtggcgccgcccacaggcgacagtgaggccgcgcgccagtacgccaagcagtacgaggacagcctggccagcctcaggtaggattgagggtttgattgaggggggaggtttagatacgggagctggggttgaatagcctgttgcctaccagatgtttgccagcgccgggccagaggcattccgtccccggcccccccctcaccttgctctcctcatgcattgcgtaccctgtgccacctgctctcaaacactccttgaaccagccgtgtgttctccccctgatcccggccaccctggtttcccaagcacccccagcacnnnnnnnnnntggggctgaatagcacgatgcccaccagatgttccccagcgctgggccagaggcattccgtccccggttcccccctcaccttgctctcctcatgtattgcgtaccctgtgccacctgctctcatacactcctttgaaccagccgtatattctctccctgatcctgcccaccctggtttcccaagcacccccagcacaacccccaccaccaccaccccatcaccgccaggcggcgggcccacataatgaccgacgctttcaatgggctggagggcgcatcctgcaacttcaccgagggcgccatgtactccttcccgcgcctgcacctgccggcgaaggccatccaggccgccaaggaggcgggcaaggaccccgacaccttctactgcctggccctgctggccgacaccggcatcgtgaccgtgcccggatcgggcttcggccaggtggagggcaccttccacctgcgcaccaccatcctgccccaggaggacgtcatgcacgagttcgtggacaaattgaggaccttccacaagtgcgtcccgggtttttggttttggtggtggtgaggggggtagatggggggttgatgatgctcttgagtgtgtggggggagattgctgctgaggggtagggaagtagcannnnnnnnnngggtgggtagatgggggttgatgatgctctcgagtgtgtgggggaagattgctgctgaggggtagggaagtagcagaaggtgaacgacacggctggcatacaggaccaatgtctattgtattttaccaagttcccccccgccccctctggcggtggggactattggctgagctgggggtgggcgccattgctggactgtgctgcacctagtggcggagcccgctcaaccacacccacccccctgtgcatcctcaggtcattcatggccaagtacaaggactaaatggcggtggtaagaccgggcctccacgcatatcctctgcacactgggcaaccccccctctgcacagacgggctcccggaggattcagctcggccggtgcgtgcaaaccattcggccggccgcgagttgcccttctactcggatcgctggtttacggtacatatcagactctctgaggcatacgagttaggatgaattgatcttgttttgtaaagagaccccaataatcgcaatgccctctgttgaccccccgaccaacacggaggtatgggcgcggcttttgcagaagcgcttttgtttcagagattgcattcgataccctagacgcaacgcaaagaagaggctgtagctgtctaaaaacgtagagttgtgctcggggtcacggattgagtgataggtctttctggacagctcagcatcggccagaccggcacgcgggctgtcggcgcccatcagcgaagctgccaggactcgatcagcgcgcatagtcccagcactagagccgttacaacagatgaatagtatcttgagacctataaatgcacgttcaagcccccttgttcaggaaatcgtagcatcctgtggtgctgattgcgcaaatactccggaacgtcagctaatccggtacaacccnnnnnnnnnnagactcgatcagcgcgcatagtcccaccactagagccgttacaacatatgaatagtatcttgagacctatgaatgcacgtttaagcccccttgttcaggaaatcggagcatcctgtggtactgattgcgcaaatagtccggaacgtcagctaatccggtacaaccctcgtactgccatggggtccatgccccccgcgcccctcgccacagcctacataacccttggctcgccccactcaccctagagacttcagacaccaatccccctctcacaatccatccgacgacatggctgaccaattcgtggtggcaggtaacggtggcatgaagggcgacgaggaaagccctatggccaagttctcttccggcgaggactctgacctggaggcatcccggcacggcaactgggttaccggcgtgttccatatcatcacagcagtcgtgggtgagactccgggctcggctctctgcttgggcggggaataggacccgtcggctgcctggggctggtcggcgagggcagcccctggcggtacatgcttccgacccctccacgcggggagagcggatgctggccgggaagtcgaccgaggagctgctcactgcctgggcgcggtcgatcacccccaaattttcactcctacgaccatgcccttttcgatccgacaggcgccggcgtcctgtcactctcctactccatcgcccagctgggctggnnnnnnnnnnaggaagtcgaccgaggagctgcccactgcctgggcccggtcgatacccccaaattttactcctacgaccatgccctattcgatccgacaggcgccggcgtcctgtccctctcctactccatcgcccagctgggctggatcgggggcatgctcgtcctcctggcctttgccgccatcacctggtatacaacccgcctgctggccgacgtttgcctggtcaacggtgtccgtcagaggtcctatatgggtgagtggtggttctgtggcacctggtgatagggttgcgctttgcagaaccagtttttgaagagtatcgtgcgaggttcaggccgtgccatgctgctgtgcctgtccaggagggttcaaaaagctctgtcctttggagggattagcgtgtgcaattcgccgtccccatctcaaccatcatgccatactctcatgccctgcaggcgccgtgcgcaccctgatgggcgagacccactgccgcctgctcgcgtgtgtccagtacttcaacctcttcctcacggccattgcctgtgagtgtttctgtttctgcgggctggatgcgggaagtgagatctttggcaacaatcttgggactgctgcagagaaccctccagcacccacctacagcatgccctgccctgccggtctggcatccccctggcttgacagccacatgtgctgcccctgccgcgccaatctgtcgagcctcactgagccttcttttaaactcacaccgctgcagacaacatcaccggcgccacctcnnnnnnnnnnacctggcttgactgccacatgtgctgccctgccgcgccaatctgtcgagccccactgatccttacttcaaactcacatcgctgcagacaacatcaccggcgccacctccatgtccaacgtggcgaagacctactgcaacgccgagggcgagggctgcttcgacaagtactgggtgttctgcgtcatctttggcggcgcccagctggtcctgtcccagctgcccaacatggactcgctgtgggtggtgtctgccatcggcatgttcacctcctttgcctactccatcatcgcgctggccctggccatcaacgagggcagctccggggagtccagcatccacggcgtgcccaacacccccgccggcaagatgtggagcgtgttcaacgccatgggcgccatcgtcttcgcctactccttctccttcatcctggtggagatcaccgacaccatgcgctccgcaggccgcggtcccgttttccacatcaagcgcgcggtcaacgtgtcgatggtcatcatcaccagcttctacatcgcggtcgcggtgtccggctacgtcgcctttggcaacgaggtctgcggcaacatcatctcctgcttcaccaccccggtctggctcatccgcgccaccaacatcttcgtcctcatccacatgctgccggcctaccaggtcttctcccagcccctgtttgagttcctgcagcgccagatggcgagcgtgaaggccttcccgccctgggtggcctccgtggcgttcaggatcgtgttcaggtcggcctacgtcgcctttgtcgccttcatctccgtctgtctgcccttcttcagcgacatcgtcggcctgatcggggccatcggcttctggcccgccaccgtcttctaccccatcgaggtgggcagggttgggtgcggtgggaggctgggtaagcgggagttttgctgcgtgcgccgacacagtcggccctcgggccgggggcggcgggattgcccatgcagcagggctgggaaagggacgcatgcatcaatggggtggaggggtaccggtcccaaagggcaaggtgcnnnnnnnnnnacagtcttctaccccatcgaggtgggcagggtcgggtgcggtgggaggctgggtaagcgggaggtttgctgcgtgtgccgacacagtcaggcctcgggccggggcggcgggattgtccatactgcaggcttgggaaagggacgcatgcatcaatggggttgaggggtaccggtcccaaagggcaaggtgcgtttgtaaagccgctgaccaactgtctgtggggccctccacgagcattgccatctcaacccccacctcctggacctctccgcagatgtacatcaggtaccgcaagccggggccgagggcgcgctacgccctggaggcactcaacatcctctgcttcctggtcaccgtctgtgccatcgccggctccgtccagctcatcgttgcagactccgcagactacgaggtgtttggtaactagagttgccgttgctgctgagggacgctcatcggccgcgggcaggcatctgctgatcgcaggatgggacttgcccctgcagaggactatgttgacacctcaccttgaccacccatctggctcctgagccactttccgcggcgccggtcgagccagctnnnnnnnnnncgcagactccgcagactacgaggtctttggcagctagagttgccgttgctgctgagggacgctcctcggccgcgggcaggcatctgccgatcgcaggacgggacttgcccctgcagaggactctgtcgacacctccccttgacaaaccatctggctcctgaaccactttccgcggcgccggtcgagccagctcgcaagcgatggtgtgcacaaaacccacccgccccttgtggtgtggcagttgatacatcgcgcctctcaactcccttggcgacatgctgcctctcagcaggggtcgtgctgcagggctgcccaacgtatcttgctcgtcaccaagacccctttgcgcttgcctgccacctgggtcatgcactgacatcaaacccaccagcagaactcttgactcgcagccctatgctctcctccttgtgaaagaggttatacctccccaagccttgtctctgttcccccggcgtagtggctctccttcgtgtggggcaaacccaacccccgcccctgttcctcgcagcaaaccctgaaccgctgtcaatagcggcgctgtagagtgggctccgaggcttgatggcttctcaaccccctctgcacaagaacacctggtttctttttctgtattctaaccttatgccaagtcgacagctggtgggttttaagagtgggaggttgggaagatcagggatccatggtggagatttccctcttacatttcgtcccggagggcgcgagaaattgaggtggaagcgatcccccgagcaannnnnnnnnnatggtgtcttttttctgtattctaacctcataccaagtcgacagctggtgggtttgaagagtgggaggttggggaggtcagagatccctggtggagatttccctcgtatacttgtcccggagggcgcgaaaaattgaggtggaagcgatcccccgagcaaccatcacatcggattgctctccgggaggtaaatttgtcttgtaataccatcgagcatctccagtactagcactcctatgctgcctcagnnnnnnnnnnacggaaggtaaagttgtattgtaataccatcaagcatttccagtactagcactcctatgctgcctcaggcttccatgcatcggaaccctagcacggagcattctcgtagcacgctgtagtctcagcacagagagagtccgagtgtcttgaggtcaggagtagcatattcactcgttggtaaacacactgtggagaacagcctgtcgctgtgagcacaggaccggaagggagccacggtacgggtgcaatgaatggcaaggggggacacgactctacccctttatgtgaagacttccatgcacatgacttcagcatcgtctcctggggctagtatgttcagcacattgcggcgtctcacatgcaggttccaggccaggcacggctatggccgaccgggcggggccagccactgaggggccaggggtggaggagtcgctgttgctgctggacctcccggaaacctgccccttcccccccgccaactccatcctgtgcctgcacgggctgcaggggctgagccccaccctgcgcatgcccgacggcagccagctcgccggcagcctggccatgccggcaggcagcacgctgctcatgtcgggcacggaggccacgggcctccaattcctgggccaaactcgcaccaccgtcagcttcgttcccagcagcgaggcatgacttctgtatggctggctgaaagggcggggcccggcatgggaaagccaggcgcggatgcccaccacaccgatgggaggagggtttccgggactggccggctcgggtgccgccctccagcctggcagtnnnnnnnnnnctcccagcagcgaggcatgatgactgtatggctggctgaaagggccgggcccggcatgggaaagccaggcgcggctgcccaccacattgatgggaggagggtctccggggcctccaggctcgggtgccgccctccagcctggcagtgcgggtgtgaccgctggctggcagtgcgggtgctcggcggccataccttgcttgcctgtttgtcagcgagtgtacagcgaacttgatgacaaatcaggggcgcgagtggaatgatgtgcatggatcgcagacgccagacgggtcgatgccgccagaggggtcctgtctcgagcagcgcctgtgttgggggtctaccgcacagcatgcgtcccgctggctgcacgccccgcgtgccgctcggccctgaaggccatctccgccgccaccagccggctcaggacctcctggaatgtgggccgcttcctgggagcgccacgggcagaggagatggctggaggtgcatgtgctggacgtgaggcgaccccggtcgcggtgcaacgccgggtggcatcgacggtggtttggctggcaacatgccctgcgctgcacgcaccgccgcccgccgtccctgcctgctccnnnnnnnnnnttggaggtgcatatgctggacgagaggcgacccggtcgcggtgcaacgccaggtggcatcgatggtgatttggctggcaacatgccctgcgctgcaggcaccgccgcccgccgtccctgcctgctccatcgacgtcttctctgatgggtctgctgaacccccctcccccacctcttgcccccccaaacccacgaacaaacgcgaaatcacagaccctccaacccaccaggactnnnnnnnnnntccccctgccccacctcttgccccccaaaacccacgaacaaacgcaaaatcacagaccctccaacccaccaggactcctgtgcccagcagtcgcgcgccagggcggcgtacgccggcgggcagccggggtcaaagatggggcggagggtgccctggaccacgccggccagcacggcgtgctccctcaccccgctgtgcacgctgcggcagtgatacatctcccacactgcgcaggcgagcagggcaggaagaggggtcggaggaggggcgaggggtgtggccacacgaggacagggttgcagcgaggagtgccggtgccagcctgtaggacaggcctggcggggccgctcgtcagggtgcccccaagatcatggcccgcatctcacagcattcatagtgcaagcaggtgatccttccccgcccagcggggcccctctcaacctccccccctctcaacctcnnnnnnnnnngagaggggtcggaggaggggggagggggtgttggccacacgaggacggggttgcagcgaggagtgccggtgccagcctgtaggacaggcctggcggggccgctcgtcagggtgcccccaagatcgtggcccgcatctcacagcattcatagggcaagcaggtgatccttccccgcccagcggcccccctctcaccctcccccccccg

SEQ ID NO: 24178 - DNA, 65 bp, Chlorella protothecoides
atacaggacaagccagcaaggtcaaggtgtcgcacatcacccattcagttctcgatactagtatc

SEQ ID NO: 24179 - DNA, 268 bp, Chlorella protothecoides
ggcgtgggcctcacgtccgggaactcctccagaccgggggaggatccaaggaagcagcggggagtgttgtgcacccgaattgcgtccctgtgcgacgcattgtgagcaaagggttcagcatccgaggccctgtactctttcatgacggctatggtctcccactccatgacctgagcagggagctatgcatccccttcacctacgctgccgctcccttttgcgcgggtcgtccaaacctgctcagtatcccaggtcacacccctcggcc

SEQ ID NO: 24180 - DNA, 70 bp, Chlorella protothecoides
cgccagcgtggacgcgcgcatggccatgcttgtggaggctcccgccgccgtggatgacgcgctggcctcc

SEQ ID NO: 24181 - DNA, 61 bp, Chlorella protothecoides
gcctggcgcacctcattgatcacatccttctccagccgttccagcgcccgcttctcctcgc

SEQ ID NO: 24182 - DNA, 112 bp, Chlorella protothecoides
agcgatgcggtgagcaggcagcattctttactatgtatagacttggcactgatccaaactgcaccagccattgcttgtactgttaaggagtctcgcctgcacggcaactcca

SEQ ID NO: 24183 - DNA, 98 bp, Chlorella protothecoides
ggggacgttggcaagcacatgccttgcaattgtacccaccgacgtaggccagcacactcacctttctatgaggagcgcattgctcagtgccagggcac

SEQ ID NO: 24184 - DNA, 73 bp, Chlorella protothecoides
cagtcgaagtgatctgggggcaatggcatgttaacacgttgttctgcaaacctctggtgaacatccacacaaa

SEQ ID NO: 24185 - DNA, 61 bp, Chlorella protothecoides
gagggcatgaattctgtccatcagccacaaacccgctgccgcaggtcacgcacagccacac

SEQ ID NO: 24186 - DNA, 80 bp, Chlorella protothecoides
gaaggatgtcctgaacatgcggccctcgccatgcaggaagtcatacaagaactccgtaggaatggttgcctgcgtcaagg

SEQ ID NO: 24187 - DNA, 61 bp, Chlorella protothecoides
ggaggacgatggcaaggtcggtcgatcgccaggagccacggcctgacaatccatgcccatg

SEQ ID NO: 24188 - DNA, 177 bp, Chlorella protothecoides
tgtcaggtgtcagggcacgctcttcatctccatagtggattaccttgtgttacacatgaattcaactcctcactcaggaggcaagaggaaacgaacaaatgcttaggctcgccctcgagataaatgcatgcaaccatgcattttgagaacaagacacatactgttcaacgcttactc

SEQ ID NO: 24189 - DNA, 107 bp, Chlorella protothecoides
tgcatatagtgatggacagcattgctccacgatcgtggacctcgggtggtccatgatatgcgccccctgcatcaaacgcacaacaggatatccatatatcaaggcga

SEQ ID NO: 24190 - DNA, 398 bp, Chlorella protothecoides
  modified_base (163)..(301): a, c, t, g, unknown or other
atccatcccaggactgcgtcgtgagcattggaggaacgaaagaggccatactcacgtctgaactcgatgaggtgagtgggcctaccatcccagttcgagcatgcatggagcccctgtctcagctaccgtccggccatgcacacccgcatctactgacatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaagacgcaggggcacaggccgcggcgccagtggcgaccctcggcgcccatccaccaccctccccagtcaccatctcgctgaacgactgcctggcc

SEQ ID NO: 24191 - DNA, 80 bp, Chlorella protothecoides
gggggggggggggattgtatcatgcgagttgggcacattgaaaccagacctggtgcacggcatgaacgggctggaatatc

SEQ ID NO: 24192 - DNA, 61 bp, Chlorella protothecoides
cacacatacacatgccgttccccttcaataaccccccacacatacacatgccgttcccctt

SEQ ID NO: 24193 - DNA, 113 bp, Chlorella protothecoides
agtcggatgaatgcgggcccatcggtgtctcgatagttttataggcaaccaagtgctgcacgctgcgatgggaaacagccggaggtcagatcctgccgcctgcaccctgcgat

SEQ ID NO: 24194 - DNA, 80 bp, Chlorella protothecoides
tgggtggtggggagagtggggatggagaagatatgctgggagggggtggttttgctgtgggggacggggatactggtgat

SEQ ID NO: 24195 - DNA, 66 bp, Chlorella protothecoides
ctgctcactggtggcgacatgggacgactcctcaccagcaggctaccttgctgtcaacgaggtgag

SEQ ID NO: 24196 - DNA, 61 bp, Chlorella protothecoides
cacttcacgccccgcatctcaccggcagggtcacggtctccctcctttcccacacagagcg

SEQ ID NO: 24197 - DNA, 75 bp, Chlorella protothecoides
aacaaggtcgaaaggtggccgctggacaccttcacgatacattcatggatgactacagcacggcacatcgacaag

SEQ ID NO: 24198 - DNA, 61 bp, Chlorella protothecoides
agatcctggcagacataggtgggggggagttgccttgtacgtcgacttgctgctgtgtgga

SEQ ID NO: 24199 - DNA, 79 bp, Chlorella protothecoides
agcggagggcgagtaggaggacaggagcgacagtactagaaaagagagacgattcgaatatacaagttctggtcgcaac

SEQ ID NO: 24200 - DNA, 126 bp, Chlorella protothecoides
gcaggagtgactacagcaagctacatgcatacacacaagacagcacacagtttctactaatcttgtttctttggcactccattattctcatgtcgtcaacccaatgtgcggagtggcacaatctct

SEQ ID NO: 24201 - DNA, 156 bp, Chlorella protothecoides
tgtttcgaggtgatgtggggatcgagtgcaggtgccaaggtggggagtcggcacggcagggggagctcatgatcagtgtagatggtctgagcgagcatgcacccccgtgagagaggcaagcatgtgtgtgtgtggaggcgccattccccagcgcgt

SEQ ID NO: 24202 - DNA, 69 bp, Chlorella protothecoides
cacaaggtcgcccatccacacccaccctcgcacggcgctggccagtcggtgcgagagccgcgccaggtt

SEQ ID NO: 24203 - DNA, 121 bp, Chlorella protothecoides
gaggctgtcagccgggactgggcccccagcgcacccacctgtagctggatcagagcgttccatgaaccactgcaggaacgcagagacggcagcctcgtcacaggtgtcgggacacaggcga

SEQ ID NO: 24204 - DNA, 70 bp, Chlorella protothecoides
ggcatgaccgtgttggtcgcgtactctcgccggggtgttttcacgatcttgtgaggagggcttggagccc

SEQ ID NO: 24205 - DNA, 61 bp, Chlorella protothecoides
ctcctcggggctggggatgggcgagggtgatgcctcagggctggggctgggtaacgcctcg

SEQ ID NO: 24206 - DNA, 61 bp, Chlorella protothecoides
cgggcgggagaagtcagcgatgttggcaaaggtgatggcccacttgaaggtgggtgcccag

SEQ ID NO: 24207 - DNA, 151 bp, Chlorella protothecoides
gctggaaggtcagagttgtttgtatcctcctgacatgatctttcagtagacaattcgcacggttatgatctccatgtagaacaaatgatcaaaccaacgttcgtcagtggatgcatgaccttactgagaaactattggaatacacaatgca

SEQ ID NO: 24208 - DNA, 93 bp, Chlorella protothecoides
ctccatgtcagctattcgcgtgagcaactttgagatcctgtcggatcgctccacggagatcctgaccgccgtggagtgcctgaagccaggaca

SEQ ID NO: 24209 - DNA, 61 bp, Chlorella protothecoides
atctccgcggctgcgtgcggaggcgggggatggggtcatggttaaggcggcagcagtgtgg

SEQ ID NO: 24210 - DNA, 3050 bp, Chlorella protothecoides
  modified_base (94)..(103): a, c, t, g, unknown or other
  modified_base (239)..(248): a, c, t, g, unknown or other
  modified_base (593)..(602): a, c, t, g, unknown or other
  modified_base (1156)..(1165): a, c, t, g, unknown or other
  modified_base (1592)..(1601): a, c, t, g, unknown or other
  modified_base (1676)..(1685): a, c, t, g, unknown or other
  modified_base (1934)..(1972): a, c, t, g, unknown or other
  modified_base (2376)..(2385): a, c, t, g, unknown or other
tgcaaatgacatctgcactgtcgatcgtcgttagataagcatgggctcccagactacaagacatcaaacacatgagtaatgatgacatgttatnnnnnnnnnncgtgcatagatcagggtgtgcttgtcatggtacttgtaatattccatgccctcctgatggtgagattgactgggtctgctccgtgatgtgccagcgcatactctgatgcccccccccccccccccccccccccccnnnnnnnnnntgcctgatcagggtgtgcttgtcatggtacttgtagtataccatgccctcctgatggtgagattgactgggtctgctccgcgatgtgctagtgcatactctgatgcctcccccccttctgcggtacttacttgcaaatgacatctgcactgtcgatcgtcgctagatatacatgggctcccagactgcaagacgtcaaacacatgagtaatgatgacatgttatcgggatgaagtacctaaccaagattcgactcgagtacaaggtttatgtgcgtgaacagaaaagcaggcatgccgaaccgctaagagttgggtgggaacacggatactggggcccttccggnnnnnnnnnngtatgtgcgtgaacagaaaagcatgcatgccgaaccgctaagagtttgagtgggaacacggatactggggcccttccggagccatgtgcgcgggtcatcaggcggagaaggacgtcaccggtgccgcacgtaaacccgctccactctccgacccaacagcccccaaatgaacaaaacacacgtctcacattgcactggggagggcgatgaaagtggagctgcatgtggcctgcggcggccgggaatgatgaggaagtgggtgaaggaggggcgagcgcagaatggctgacgtgggatcgaccagcgagctctccaactcaccgcggaggcacatctggtcaataatagcacgagaccagtcatgaagatacagttcctgacggccggtgacattctgtgctttgcggtgctgtcactgttccgcctactgaacgtgtttgcggtacgtttggggtgcactgcctttctgtcagcactcctttaccacgctgttcagtggttgaatactcccctgcaaggcttgggatgattcttctgtgaatttgctttagctnnnnnnnnnntctgttccgcctactgaacgtgttcgcggtacgtttggggtgcactgcctgtctgtcagcactccttcaccatgctgttcagtggttgaatactcccatgcaaggctttggatgattcttctgtgaatttgctttagctatggtcgcaaggtatcgcgttcgacgcagaagatgcttgtcgcggaaatccggagggacccttccggtgccaacgacgaaacggagcccggtgaacgaggagtccgatctacgaatcgacctcgcaaggtacagaaatccaaaaatggatcctacaccagcacatcacaggcctcgtcgtccgttggatacccaatagaatattgatgagaatgaaagctttgaaaatcttaccgccgcttcaggattagcgccgctgcatctggaagaccctccggcatcctcgtgnnnnnnnnnnatgtcgggacaccctcaatggtttatctttgatagacaagtattatttcagtggatcactcgctgcctggtccannnnnnnnnnaccacctcgcaaggtacagcaatccaacaatggatcctacaccagcacatcacaggcctcgtcgtccgttggatattcaatagaatattgataagaatgaaagctttaaacctctcatcgccacttcaggattagcgccgcggcatctggaagaccctccggcatcctcgtggaatgtcgtgtcgtatcctgcagagagcaacatcttacatagaaaaccccaaccagcagtgcggcttgatggcgggnnnnnnnnnnnnnnnnnnnnnnnnnnnnnnnnnnnnnnntgctcttgaatgagcatgccccaggcgagcaatgcgtgtatatctggcaacctgtcggaacaccctcaatagtttatctttgatagacaagtatgatttcagtggatcactcgctgcctggtccatccgtcaggtgaagcaagcccaacgcccttttcacactagcgagtggtttcaccagtcgctcgagagcgaggatgtccgtggagacgctactgctcggaagatacttcaacaacttaaaatctttttaacaaacattggcaggcaaacagttgatttgagacgttcatcggagtttgttatgtacgatcatgctccgcaagatttgacacatgaggctgccggagggtagtccggatgcggagatgccattcctgaggcggcgctgaggagttccaaannnnnnnnnnaatgtaatatcatgctccgcaagatttgacacgtgaggctgccggagggtcttccggatgcggagatgttaatcctgaggcggcgtcaaggagttccaaagctgccatcgtcatcgggtgacttgtcctgaatccaatggtatatgaggcctgggattatgatttaaagtgctgaaaatcggttatcactcccttgcgagtcaactgaatagatccaacgccgctttcattctgcatcgttttaccatggggaccggcagaatctctccggatttccgcgaggagcatcaagggcgccgctcatactcccctgcacctataaatgctgcaagcgcaggggcccagtagattaatttcaacacttgcagcttgatattcgaccgatttccagcgaaaaaaaggcgtaccgacgcaaggcaacgcatctcatcctgaccgcgcacacgtcaacagggacagtgacgcgaggggcgggatgccaccgaccaccaggaaccctctattcctgattggcctcgtgctactggtgaccagatgtgcctttgcggtgagttggattgctccctggtggatgtcgatcccacgtcagctcccttgtgcgagccacccatcttcgctcactccccccgctttcgcgcccaccgcaggccacatgcagctccact

SEQ ID NO: 24211 - DNA, 86 bp, Chlorella protothecoides
caggtgccagcacccccggcaccccgcagctgccagcttaaatcactcacgtcctagaacaaacacccgcccaaccactcaacccc

SEQ ID NO: 24212 - DNA, 61 bp, Chlorella protothecoides
gggagagggagagggagactcctcggggcttgggctaggagagggagactcctcggggctg

SEQ ID NO: 24213 - DNA, 78 bp, Chlorella protothecoides
cgcccttgagggtccgctgcgtctggcactagtccatccttgagaccccccccctatgaacccttccatcatgccgaa

SEQ ID NO: 24214 - DNA, 75 bp, Chlorella protothecoides
gggtgcgtgccgggccaggtattcacgccgagccatgaaaaacacagcccagagctctgaccaagcttgcctctt

SEQ ID NO: 24215 - DNA, 61 bp, Chlorella protothecoides
aggcttgattggagaacacacttgataacatagtgttcatcgagcacaatgtcaccgcttt

SEQ ID NO: 24216 - DNA, 73 bp, Chlorella protothecoides
gacaccagtttatgcatcaacaagtgctccaaaagagaagggcaatgttttctaccacccggaacctacatgt

SEQ ID NO: 24217 - DNA, 75 bp, Chlorella protothecoides
aactaggggcatccagagcctcagtcgaggggcctctccgggctcgagccctccacagacccaagctgcgcacaa

SEQ ID NO: 24218 - DNA, 8660 bp, Chlorella protothecoides
  modified_base (6247)..(6256): a, c, t, g, unknown or other
  modified_base (6782)..(6791): a, c, t, g, unknown or other
  modified_base (8145)..(8294): a, c, t, g, unknown or other
gggggggggctggcggggggtttttgagagcactgacgcggcgaaaaggaactcacacgcccagatggtgcctcttggcaggacggcacgccgcaatgcacgcgtctgcccagcttgaaggttgcctgggtgcacattccctgcacagcagtccctgcagcgcctcgtcggccagtgaaatcacccctcccccgcccagatcaccatcggacccttgcattcccacaacactctggcggctacctgcaaggcatccgccatgacgtgggatatgctgggcgagtagactccgaccaagccataggcggcgtgcgcagggttcagcagtgggcccagcaggttgaatacggtgcggatcttcagcgccctgcgcaccggcaccaccgcctggacgtttggggagggtgtcggaggatgcatgatggatgcggtttcgtgctggggcgtaggcatcggtgtgcccgggaacaaggtggggaaaggcaggggggcatagaacagcagggtcggagtatgcaaccgagggccagagccagcctgtggaattacacacggcagggcctagcagcgacagcccacaaccattcccttgctccagattgctgcccaccgcctgccccccaccgcgcccgcccccctgccctcgtgagccgcaggtccatttcatcagggcccaccttcatggccgggtggaagaccggcgcgtacatgaagcccacgccgacctcgtcgatacagcgggccacccccgctgcgtccagctccacagtcacccccagggcctatggaaagagcgatggggggaagcgtgggaagccggaaggaaggtgcatgtggggtgcaggcatgcgcagccgggattcaccatgtgctgggggctgttgtgacctacatgagctcagccttccctcgtctttcaggcccctggactcacctccaggacatctgcgctcccacacaggctcgagacggagcggttgccgtgcttggccacccgcgcccccgcggcagccgccaccacgcatgccccagtggagatgttcacggagccgatgccgtcgccgccggtccccacgatgtccaccactgcgcatgcacaggagaggcatacgctgaggggtcgggaccgctggcggggcccgggcctgcccaggcaggtcagcactccccatatcactttcccggtgaccgcaccgtcgtgtggcgtgtccacgcgcaaccccaactccagcatggcctgcgccagtccggcaatctcctccgccgtttctccctgggcgagaggagacggggatgagggtcatgatcgcaccccgcacgaggcggttgtccctgggagcggccacatgagacaccacagacgcctacaggtcgatgcagtgtgtgcccacatggcaatgcgggtgtaacatgcgacactgtgagccgtcccagagccacagaccttggccctcaggaggacgaggaaggcggcgagctgcgtgggcgatgtttcagcaatcatgccgtgcagaaggcttttgcatgcgtcgaaaccgagatcctcgcgggctatgagctgctccagagcctgcgggacaggcgagccgaggggtgttctggctcgggagatcctcagcggggttgcctacagggagagcaccccatcgccaacccctgaccctcctacgcgacgcacatgtctgagctccagcactggcgctccatttctcaaatcagacgatgctcgagcggcaggagtgcgaatgcagggcctctgctgggggggtgatcgacgcaggaatacacccactggaggtctgcaggcagagttaattgccatgcccaccaccatcccgagcggcagagcctgatggtctcccgttgtctttcgagtatcttatgctgaattcaggcctccaactgtgtcatgtcgactgtccccgattaagtgccggtcgctgcgccaaggcatgcgcgcggcggtcatgctgtccgatcacccggaaaagtggatatgcatccgtcctccgacacatgcaccacgcgctaaaaataccccttctgcgctgaatctgatcattattgtcgtcgggatctgcattggcttgctccccttcccttgatgcaagggtggagggtggtgccggtgctgtcctggccagtgcctggtctcaggcacccccttgcccatcgtcgccatgcactgcccctgaaaccacggacacggccatgccagcgccccatcagatcatatcaggagcatgcgtccagggagtcgcccccttcacaggccatcggacccattcagcacctggcctgccccccctggcaaggcagccagcaggagatggaggtgtgcgctcatggcacttgcatgagctgagagacgtcctgtcgagggggttcttggagctttggccccaccttggacgacgcctgtgccttggggggacacggggcggtgccatgcacgtgtcgatgtgcaccctggataccctacatcagctttgtgccaccctttcctggctgcaccccacaccccgcaggcgctccagcagctcgagcggcgcctggaccaggggcggtgcagggggcggtacacgcgggacaccgccgtgtggttcctgcgagacaggcggctggacgtcgcagaggctgccgggaagctggaggccatgctggactggcgagcccgcatcgggtgagcaccgcggtcaacagaggcacggggcacgcattttacaccgtggtatttggccccgctgtcgcattgacatgtcccctctcatgtgacccgtaatcttccaatccgctcgccgccgctagggcggatgggctggactgggcctcggtcgccaaggaggcggccagcgggaaggtgtacctgcacccgcatcgcgacgtgctggggaggccggtggtggtcatccatgtcaggaagcatgtcatgggtgggtagctcgagggtttttttatttgggggggggaaggggatgacgtctaagttgggcatgccttgtcaggacaggccccagccacttgaatgggctatgtggggggaacgcaggcaacgcagatacccggcaagggaacgcactgagggctgccaaccaggggtgctgctccccgatgcctgatgcttggtccgccgggctgcccagcaagggaagcaggttgacctgccagcatgactcccatggtcatgagacccccaggtgcgtcccccggcgctgacagccagcggctctgcgcctggatcctggatgctgcgctggctgcgctcccaccagggcaggagtgcgtgctcgggatctttgatctcaagggcttctccctgcagaacgcagatctaggctttgcacggttcctggtgaggtgtggcccgccttctttcttgggagtctgacagtggctggcccttttcgtggcagttcaatcacaggaagcctgttctgtttgtgctgagtgatggggcccattatggtcaaggtgtccatcatgtcccttgcacctgcaatgtctgtatgtatcagggtgtccgccctacgcttccctgttcccagctttgacccagcaattcaccctccacctcgaaggtcgatgcgctgttcacttattatccccggagactgggccaggctgtgctggtggatcccccctgggcgttccagccgggctggtctgttgtgaagccggtacgcgggggtgcatcttccgcacgtgcggcagctaccggactttaagtgcccggtgatccgcgtctttgccctagcccactgggaacctcatgaatctgtgccccgcagtggctcggaaagtatggcgacctggtgagagtttgctccgcgcgtcaggtgggagtcgagtacttccagcctggcacggcaccaaggggcttcggaccatcctagcccagacggatgggaggcatgccaactcgagcaccttccgtgtaataatataacagattggcatgcgctaattaagatttcgcatggctgtatgcctgaatgtggaacgtctgccgaaggcgcacagcgtgaggcccgcgaccctgtggtcggcaaccctcggtcgctttcggccagccccaggattgcgctgtgatgactgtgcataatggcagtacatgcgctcgctcgcgatctatgcacaatcgactcccttcgctatctctggtcgaaattcagagccgggggacgagcgttaatgagtttccagatatagtggggcctgagcgacagttcccctaggggccccctcccgaggaccccgggatcccgttttccagtcggggacgagagagctcatcgcttacgtgcccccgctgaaaagcgtgtctgcgtcgttcacatctgctaaatccgtcctaattaggctttgtgtggccatacaggaggaagttttgcctgtgtgagccgcgggcatccactattattcgattcccgacaaggcactcaagggaccatgtcggcaggacaggagccaaacacagatgcgcaggatgcttacgactctttcgactcgaaacagcgtcgcaggaagaggacaaagcacggtgagcggggtggcgaggtgggtgcctgcccggtaggtacccatcccggctcacgacggggcaggctcacgcgccccatctactctcggcaggtcgatacgtcgctgatattacttacgaagagctatctcgatgctttaacatggtgtggggggagcatttgttttggacctcacatgcccctttcacgcggtgccgcaagttccaggcatggcagctgttgcggatgcgcctgcatccaagccagtcccgtgcggtcgataacctcctatttttctctgccttgcagccagcgctgcaggcgtgcgcggagctgggcatcggcctgacgatggtgaagcgcctgtcccggaagtatgggatcatgcgctggccctaccgtaagaacagggcggagcgcagagtggccggctgggacgaacagcatgacgtggccaactcttctgacctgggtgagtacgaaaaaggagctcatgggagggggcctcatgggtggtgggtgtacagcatgcctcgcctgtgcaccccagtgagtgggcctgcacggagagccatggaccccaagctgacgggtgctggtgggtgagcctgccgactgaacgccatgcccaagccctcgccatgcacagcctgtggcctttgctggtctggtgcccgaagggctgcacgagggggggtcctccacgtgcacacatgtgttgtatctggcgtgagcctgcgtgccgtcctcgcccccatgccttggaacccatcccacatgctccctccctgcagacgtgacagtcggtctgtctgaggggagcctcccctccctggaggccatgccttccagcacgtcgggctccggcgctgtgcccgccccagtcgcccaggaaccccggtcccagggcgagctggtggaccgccggtgggcctcctccgactcgtcgcacgtcaactaccatgccgtcgcagccgcagccaggtccccaaccgcccccgccccctccgcgctgggcttcggcgcggtggtggccgaggcactggcccgcgcccagcgaggcgcgcgcccggtcgcccccgtcgcgacgcgggccgtcaccttggaccgctgggcgccccctccccctgccgcgcgcccgaccgacccccacccgccccgcggccgcggcgcggcgctgggcgtgctggcggagctgagcaggtcccatccccacctcatggcccagctggtggatgccctggccgccaaccaggccggccagcgctccgctgggcgcagccccctacaccaggcgccgcccgcaggcctggcgcagccgctgaggatccgcaccggggtcacgcccgcctctccattcttgccagacacgggcacatgcccgctgagcctgggggcctcccagcccaggccgcgccccgcgccctttgggagcaggcggtcggccttttccgcgctctcgctgtgaagccgttgccccagcagagttttctctcctacctatgtcatacctgccagcagccgccgcacgtgacgtggcacgccccctctccgctgcatgttccgactcatatatagtgcctggtactccaccctccaccctccaccccctctccgccctctcccaaacatttcccctcaccttgacgccatgcgccccacattcaagtgtgttttctcatcccctgcgctccaaagcgcgcccttgagtgctctttctttttctnnnnnnnnnngcccctctccaccctctctcaaacacttcccctcaccttgacgccatgcaccccacaattaagtgtgttttctcaccccctgcgctccacagcgcgcccttgagtgctctttctttttcttttttggtgtgggtgaagttcttcctttgctacctggaaaggacactacccttgcccccgctgctgctgcccccacttccattgctccctgcggcgaatggaaggcttgcacaagaggctgacaccctggggtataccttccggaccctctcatctgcaaagaatcccctgcttttggcaaactactggaggaatgtgccttcagggtcattagattgactttatccaccccacattggagcccccttcaaccatgcataggttggaatgtaggcaccacatgatcctacccctttctctttgccatattggcgcagccctgtaatgcgatgaagcgcaacgggtgcatgagccttggtgccagcccaaggcagtgatgcatggcaacagcagaatatccgccatnnnnnnnnnnagaatgtaggcaccacattatcctacccctttctcttttccatattggcgcagccctgtaatgcgacgaagcgcaacgggtacatgagccttggtgccagcccaaggcagcgatgcatggcaacagcagaatatccgccatgcctgagcactgagcaaaccacattgtccccagacatagtccgaatccccagagagagaggctcacactgttcttgtgtgcaagaattgtctcgtacatgcactaagggcaagtggggatgaacccgtgcacttgcgcgcttagaccccggactgccaacacagccaggcggcaatggcttgccagagttgtaaatcgcccccccgccctccttctaaccctctttggtactcggaagggcacgacgtaggctaaggtaggcactcgcaggtcgtgccggagagagaagcataggcggcgactgacacacggaggcagacccggtgtcgcgatagctcggcccgcagctctgacccgcccctcggcccgacgtgcccaccacagatggcgaaggacaagagccgcagcacggagcttgtctcccgggagtacaccatcaacctgggcaagaagctgcacgacatctccttcaagaagagggcgccgcgcgcactcaaggagatcaagaagttcgcctccaagcagatgaacacctctgatgtgcggattgacatcaagctgaacaaggctgtgtggagccaggtgcgcgaaggaggatggtagtgttggccaccactggggcatgttgtcttgggagtgggggcgacaagcacttccccatgggtgcagggtgggctcatgtgaccgggacgatgtggtatgcggcagagttggtagtgacactgcacaatgtgctgcattgttcgctgtatgttgagttggaagcatgctggggtggcgaacggctgccgacggtgttctgacttgcgccccctgaccctcccttcctcgcgccgtccccgaacagggcatcaagaacgtgccccgccgcctgcgcatcgtcgtgcagcgaaagcgcaacgaggacgatgatgacaaggtgggtgaccgtgcggggtgggaggcaagggtgcggcatggagggcgctttgcagtcttgctgaccgcatgcctccagacactctctcctgcctcactcgtggacattgcaggagcagctgtactcctttgttaccctggccgacgaccagaacaccaagggcaagggcaccgtcctcctggatgcctgatctcgcctccttcgccgtgctttcattctgggtgcccggcctgtaatttgttcgcacaagggtgcacctgaactgggtgacaggcggggcaaaccttgaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccatatctggtgtgagagttgcattgtaagacacccgacattgaggccctcgtaagtacggcatgtcttcccggctcttgcaccatgatgcgcacagtctttggcccaggagtttgagtgccagcagattgacgaaagcatgctgccaggccacaacaggccgcaccgcgccttccagttaccatcgctgacagcactggcgtccaacccagcattccctggagctgccttcagacccgagaccaaagattctcccatccccacctcattcctcacctcccacacttccctcacgctgccactccccgcaccccaatgcgacgaggtgtgcgggtccaccccctcgacccccccccccccccccc

SEQ ID NO: 24219 - DNA, 3889 bp, Chlorella protothecoides
agcgcggccagcgcggccgccgcagccgccgcgtcggccgcgtcgggcgagcgcgaggctgcggccacgcggcgcagcacctcctccaagctcgggtgcactgcgccgtgctccacgcccagcagggcggtcagcacggggagcacggcgcgagggggcggagacccctcatccctggcggggggcaggccgagcaccgtcgagcccagcgcacacagcaggccacgctgtgccctgctcgcgtcctggctgggctggtaggcgccgctagggcccaggctggccgtcagcgctgccaggggcctgcgatcggaggtttgagatggatgggggggatgaggggagatggagggggtggtccattggcaatgaagagcgtgcctggataccttggaggcaagcatgaggctgggggggcagccatgccgtgcaaggagcaacagaaggggcgatggagagatgcagggtgtgttttgcaaggcaaggctactccccagacatgcagtagaggcacacaaagagccacccccaacccaccccccacacgtaccccagtgcgtggtcgggcgtgccccagcagatgccgaccagggcggcgtaaaaggtgaagggcacgacgacggcctccctgcctcccttggcatgggcagagcctcgatggcctgcagggcagagtttagcaacggggtgctcagccctggccgggtactttgtggacggggagagcagtgaccgagcggcctgcacccggcaggggcttgtgggcccagcagccccaaccaccagtctcactccacctgcatcgccgcggcctgaggaccccaggacggcgtggctgtactcgctgagcatccagaccagggtctgggccgccaggtcgggccccagcccctggctgcccagcaggtccctcagccgcctcgataagtccttgaaggtggtgctgcgcttgaagccgggccctggcctgtccgactctgggaccgacctggccttggcgctgctcgctcccgcccccaccctctcgtccaccgccgcgaagccggaggtcttggcctcggcggaggcccagtcgctgatggccggcagcagcccggggtcgaagagggcggcccggagcaggccccgggccgaccgccggacctgttcgcaagccgctgcgctgcccggcggcgcaaacgccatctcacacagggggcgcagcagcttggaaagcagcaccgacgagaccttcttcgagttgttggaggagaccacggcagcctgggaaagtggtggggttgggtgggttcgtggaagggattgtcattcgcatggcagggccgagcatcgtcccacagtctgggcgcagggcaacagcatgccaagttcacctccctgcacagcaccgccgtccgcatcctgaggcacagctcctagtatccagcccaaagcaaaggctatggctgtgggtcccttaagggcatcctcacccccctccatcttgcagcacctgcaccagggacagggcgccctccaggcccagctgctcagcggcttctgcatcttggaccccccggtcccctgctgcccacaaggccgccactagggcggctgtggagtccaggcctggatggtaccgcccctcaaacttggcgacgaggcaagtgacgatgcgaccggcagccagtgccccgggcttgtggctctcgagggcagccgtgaggctggggaccaggctcaggggcagggtctcggtggcaggtagagctgggtgctccagcagggatgccagatgggtccaggccgcgggggtgccagcggtgcctgatgaggcgcccagggcttgcaacatggagtgcaggagggagctcgcgctgtgcgtgcgcagcagtgcaggcagggaggtcatggacaggtactccaagagtcgtatggcagccttgaacctatgccgagtgttgagaaatcaagcgagcgtcagcctggacagggctgggacctgttgcaagtcagaaggcagcgctgcccatgcacttggcagccactgtcagcctgtagagtctaccaatgggcccactttctatttccagtgaatgcacacctgcattcatcactggagcagcccttcatccgtgccagctcggcaccgaggcccacgcacaccgccatcgcgccctgagactccggcagtgccggcttggccatccgtctcacccctcgaaaagcacaagatatggcattcctatatgttaaatgtagaattatcggctgcgccaatttctcttgcgcatttctgcacgttgtcgtgccttgttgcatcggcacatctgatttctcacattgcgccccgccccgccccccccccacgtaagcacagtgcccaacagatcttctggtcacccttacccgcctcacacatggtgtggctgatgccaacatgtacttggaggcagcacgagaagcagcaggcatcttgaagtaatatttgtatggcatgaggaggaggtgtgagttaacgtcatgggcttgcccaccctggctctgtcttgctgatggccacgccaccctcgtcggtcgccctgccttgggggagtggaacttgggaggcaccgcacacgcacacacagggtcgcagcatgctctggcactggacggcggcactcaggcaactcttgcatgccctgggctcgcatgcgcaggatgccagcgactccccaccttgtgtcgagctcgatccttgcggggcgcagggaggaggaccatgcaaacagacacacgggaagttgcctccagggcaggcacacacagacacaggcaccgggagcaggctggcatgcagacgaggctcagcgcatgcacgcgagacaggcaggcaaagcgtccagggaggcagtcaacgtctgtccaggcaggcagtcaacgtctgtccaggcaaacagtccacgtctgtccaggcaaacagtccacgtctgtccaggcacgcaggcactccccacaggcacagccggcgcgtgcagtggtcctcaacgcaggttccaagtcagagccagggcgtcagtcaggccagctccccatgcatccgtgtcgtcgcagtccgggcagcaggagcacagcgtgcacagcatgcacgtacctgggggcatcgcaggccctcatcgtccgggctgcgcgccgcgccgcgcctcgccgcgacgccgccccttcctccccgccccacgacaacacaagcatcgtcacaggattccgcgctgcacagggctcagccgcgcgccttctgccctgaaaaacacccgcccgcctcagaggtcggcggggcgctcccactgcgtgacgccggtggtggcgttgtagtagtatgcgcggccctggtcatcgtgcagctcctgccactgcgaggcgccgccggcagacgctcccggcaaccctccggccgcagggcctcccgcctgcgcaccgcctggagcacctgttgaaacgaagggggaatgctgagtgactctgccggaaggagttgcatgttctgtggacaggcaaggcggagcatggacaagagccgacacgagcgggagaaatcccctcgagcagcatgcggcccgccaacaaaggccatgccatcttcagaccgagctatgcacagggatgggcgggtgctgacttgaacaaatcccccacatccacagtcacattcccaaggtgtcaagccctgcgcgaccttgccccccccccacctcagaaaacaaaacccaaacaaacacatcgcacctccgtatgcggcggcgccgtagccctgcgctccgccgtaggcgccgtacgctccggcggccgcgtaggggtcgcccgcgccagcagcggcggccggagcgccgtagccaggcgcggcggcggcggcggccggggccccgtaccc

SEQ ID NO: 24220 - DNA, 67 bp, Chlorella protothecoides
gggggcgggctggcccccacaacggtggactgctgtgtttgacctaagataggaatgttacaggcaa

SEQ ID NO: 24221 - DNA, 61 bp, Chlorella protothecoides
gtcgctctgactgatttgaatggtgccatgcttggatgtgtccttccggggacctgctgcc

SEQ ID NO: 24222 - DNA, 76 bp, Chlorella protothecoides
tgcaagggtggacccacagcagggttgtctagcggcagaaactccacacacacgccctcacctggttgttgccgtg

SEQ ID NO: 24223 - DNA, 77 bp, Chlorella protothecoides
atcctccctgcgcccagatgcgccgcccttcactgcagaaggtacgcggggaggtggcactccgtggtctggcggca

SEQ ID NO: 24224 - DNA, 220 bp, Chlorella protothecoides
gccatcgcaggaccacacaaagccgagggttgtggctagacactcccgccgccagcgaatgcatggtgctggtcccaaggcaaccataatccgccagccccaatgacacctggcgacagacagcgatgtagcgagcccaccttccttgacgtctgtagattgattcgtgaccaatctgaccccgtcctcctgctcattctctccaagctttgacccctaa

SEQ ID NO: 24225 - DNA, 65 bp, Chlorella protothecoides
ccctggtgtgggggatctgcgggagcaccccgcctctccactgctctccgtgcacctcctcctcc

SEQ ID NO: 24226 - DNA, 134 bp, Chlorella protothecoides
aggtgcgcaccacagtccgacctggcacgggtgcctctcacctgcagcccctcaagcagctggcccaggcactcccaggtgcgacttcttgagttgggataaattccagcattgcctcaagggctctctgtacc

SEQ ID NO: 24227 - DNA, 65 bp, Chlorella protothecoides
agtaccgtaacggctgctgatctgggggggtggggggtggaggagggggaggcaccatgagcttc

SEQ ID NO: 24228 - DNA, 78 bp, Chlorella protothecoides
ttccacaccacgttggccgtctgtgtgcggttgctgggggatgtgttgtgcggggtgtttgtatatatgcgcaaggca

SEQ ID NO: 24229 - DNA, 61 bp, Chlorella protothecoides
tagggatgcaacctccgtgttccctacagagtccgtcaaggcggaggtggagagccgagcg

SEQ ID NO: 24230 - DNA, 112 bp, Chlorella protothecoides
tcagcgtgttcagaaaagcactgaaagccttggggtgcttgattccagcggcgaggcgttcccagtcagccggcacgagcgcgcatcagtcgtgcgctccacccccccttcg

SEQ ID NO: 24231 - DNA, 93 bp, Chlorella protothecoides
tccatcatcattgttgcagcctgcagggatcggcaagtccggctgggaccctctccctgatgtggagtggttgctgaggctcttgttcccctt

SEQ ID NO: 24232 - DNA, 61 bp, Chlorella protothecoides
accaccagggtcaatcccccttgtcaccagtgcccacctgagaaggccagcgcggcctgct

SEQ ID NO: 24233 - DNA, 71 bp, Chlorella protothecoides
ttctcaccctgccactgattataccatgcaaacggccaataatgcagggaactccaacatgggagacctca

SEQ ID NO: 24234 - DNA, 61 bp, Chlorella protothecoides
ggtgtagtctatgccggtagactctactcccgaggagtgcatgtaggcctggacagcaggc

SEQ ID NO: 24235 - DNA, 80 bp, Chlorella protothecoides
cctcggaaggctgctttggccgccagggacactccccatgcaaaccctgcccacaccaaacacaggactgctatgaccag

SEQ ID NO: 24236 - DNA, 2613 bp, Chlorella protothecoides
  modified_base (186)..(195): a, c, t, g, unknown or other
  modified_base (1165)..(1174): a, c, t, g, unknown or other
cggggcgcgggagagaacggggcgaggccggcccgtgggccgggggggcctgcccccgtgccagtccccataccaagcgtgcgtgtcgcagggttggggtcgtgtctgatgccttgcttttggtcggcagggtttttgggacgggtgtgttcacatggcaagccggagcaccggtgggggctgggnnnnnnnnnngtggtcgacagggggtttgggacgggtgtgttcacgtggcaagccggagcaccggtgggggctgggaggcagcgcacggggatggcatccgggagtggggcttccttggacgggctgggctccatatgtgaggagccaccccctcagaccccttggcaccgcatgggctcatgctcccatatgccgcttgccctcaacctccccacccatgcatgtgcaggaggactttgactttgagggcggcctcgccaagttctccaaggagaagatcgatgagggggtcgttgatgccctgcccaaggagaaggtctaccaaaaggacgacttttttgacgagctgtcctgtgacgccctgagccgaggcccccacggtgtgtacatggcgtttgctgtcagtcggggtggggctgctcagggggggtggatggcggatgcgcagttcctgcctgtacagtcatgctgcgccccccgcatgggctgggaatgttactgatctcgtcttctgggtgttggcagtacggggggtgcttctgcacgagcagtacggagcctgttcaatgatttcaaagtccttctaaaggtttgacattgagacatgatcatttttgtcacttttcaggcgtgcggccggatggcagggcgcgtgcaatggcgcagcgcaagacagactttgagaccttcgggaagaccggggatgtaaggcggggaggcttcggacgaggcgacagggtgagcggggaggacatttgtttcggggatcgattgagagggtgacagttgggagcgcattcacttgtacaatggtatggttgcgcccgtccgacgcgatcgcctcgtatatcctcacccagggtcgtcagcgcggtcgaggggggcgctccaaccccgttaatgctgctgcttaatgagcctctgaatgcaggttctgtaagaggccgtccactccttcagccattataaaaccttccannnnnnnnnnccgctccaaccccgttaatgctgctgcttaacgagcccctgaatgcaggttctgtaagaggccgcccactccttcagccattataaaaccttccacgagactcgatgacgtgacgtgtcttgtggagccatactcaagagctagctaggcagtagccgtaacgccatactgcggtcacgtggccttcgcgaacggcgagttgggagccttccttctttcgtgtcgtacacctagaatgcctgacacatttgcggtagggcatcctcacctccaatgggacattatgaggtgctccatgagctccaatatcagcgcagcggcctgacagccgtagagactcgttcctcatactaaggggcgttgacgtgagtgtggggcaacggcggtgaagcgcctcgtcagcaggccagaaatactccacaaaacccactagaatttactgatcggatggccaggtgcgcgcggtgccgtgatgggtttccattggtgatgggcctcgaccgaacccacaaccctccgagggtggactgtacggggggaaactggatgtggcccctggccctgatacgtcggccaccttcatggtcagaattatcctcccaatcccatgcgcacagcagtccacccccgtccggctctaatgtgcctggaacgcggcgaaatggggacccaccccctcccgccggattccgtccaactcgtgctgctggtgggccagccggccagccctccctcgccgaggctgcagctcggcaagcgcagacggaagcaggagacccagagatgggtcatccagagcctcccggccgtgcacatggatccccaggtcccagacctgcaggggtgagttggtcagggcgcaatcagagcagggcatgggaggggtaagcctgctccatggccttaaggtttgtggtgcagtaccctatcttcatgttgttggtatgtgtagaaagtgaacaattaggaacgggccctgggggcaatgcaggtggcatccgcattgataagttgaatcctcttgtgtacaattaatcaacacccactccctccccatcgcgacccccccctcccccccaaccttcaggatcaggcgctccctccctccataacctacgacaacgcgctgcgcctcgctcactccacgctggccgcccttcagcagaagctgtcaaccgtctcaagcatcaccgcgcccgacctgtctgctctgcacagcgcggtgaatgccatgctctcagagcggcggcgcctccccgcccggctgccagtgggcgcccccgccggggagggcccaaccccccccgcacccgcccccgcaccccgctcctcgctttccacgcccagcaccagggccccgggcatggccccgggcgcgctgcggccctacctgtcggagcacacacggctgcagctgccctctgcaggggcccggccgc

SEQ ID NO: 24237 - DNA, 61 bp, Chlorella protothecoides
caacgccccttagtatgaggaacgagtctccacggctgtcaggccgctgcgctgatattgg

SEQ ID NO: 24238 - DNA, 373 bp, Chlorella protothecoides
ggcgttgaagccggccatgaacccgtccagtcgctgcttgcgaaggtcctcgtgcgcgcgccgcacctgcgatttgcgtgtgtgtgtgtgtgtgcggggggaaccagggtcgggttgtatacgtggattcggcggggagaacagcgtagagtttcctcggagggttctcatcgccgagtgtcgtgcagggatgctgaaaatactccattccagagagttccctcactgctgaccctcgtccgtggcgctgcaggtggccatttcaagccaccggggtctggtatcacacccgtaccctcacacaggcccttcgacatgaaacacacacccttccaggaccgatgaacctccccctccagcacctcgtctcgct

SEQ ID NO: 24239 - DNA, 73 bp, Chlorella protothecoides
tccaatctgcgagggaagtgatgggcgccagccaacagatgcttatggcaagggggagcggagcacggaagac

SEQ ID NO: 24240 - DNA, 61 bp, Chlorella protothecoides
ctctgcctccagcgacccggggtcgcgcagggcgccgcgcgccctgcggtccccgatctcc

SEQ ID NO: 24241 - DNA, 71 bp, Chlorella protothecoides
ctgggttgttcaccagtaatgatgaggagcagcatccggagcggtgggcccatccgcgacgagtcagatga

SEQ ID NO: 24242 - DNA, 136 bp, Chlorella protothecoides
tggtcctggcggatcgggtgggtcggggtttggggttcagggtgtcagggtttggggtggtggtggtggtggagaaggagggggaaggggggctggccacctgggaagggatgggcgagaggcaggccgctgggga

SEQ ID NO: 24243 - DNA, 141 bp, Chlorella protothecoides
gcttgtattgagctatggctttcctgcatctggtgatctgcatggctgggaggcaggggcccattggcatttgtgggccagctttagtaactcttgctccgacccactgtttcttggaaactcacccagtacctccacccc

SEQ ID NO: 24244 - DNA, 75 bp, Chlorella protothecoides
cttggctgaagaagagtctcctgtgttcaaacgagatccaccctttccctgcagggcgacgtgtgcccacctgca

SEQ ID NO: 24245 - DNA, 61 bp, Chlorella protothecoides
ctgttgacctaggagtcaaatgggccggccccccctgtcgaatggagtgaaaaggggtgtg

SEQ ID NO: 24246 - DNA, 67 bp, Chlorella protothecoides
attctagaggaggacggcagaattgcggagtagcgtggggaatcgagtggggacatggtcacaagcg

SEQ ID NO: 24247 - DNA, 81 bp, Chlorella protothecoides
aagcttgactcagcgggagcaagaagattcgtgtagctccaagatgtgtgtctccgtggcgcgtcggctgtctgtgtcggg

SEQ ID NO: 24248 - DNA, 5164 bp, Chlorella protothecoides
  modified_base (491)..(582): a, c, t, g, unknown or other
  modified_base (1497)..(1506): a, c, t, g, unknown or other
  modified_base (3215)..(3224): a, c, t, g, unknown or other
  modified_base (4283)..(4292): a, c, t, g, unknown or other
agatcgcatggtagccaacccggacggaaattttccgacatgcccgcaacgactagcacccaaatggggctgtcggatcataacccccctccataaagcatattcccccaaaaagtttaagtagtccattcagtatcctaatggtggagcggcaggtccttttcggtgccattaggttttacctcccagtctagattatcctatcgggggattcaaatcgtaacgtaatccaaatggggccggctatctgcatcggacagtctatattataggctctgtatccctgtttggtacaagtaacgtccctgagagcccgataatgatagattaggcgaaaaaaaattcaatcccaagcctgcgcaaaccgcggcccgagagcatcgtactcagtatggggcgatgggcgtgtactaggttcgcccactgttcctcctaggtctccaccaggtccctcagcgacccgctctagaggtgcttcggtaccaagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgggtgctgacgaggccctctatgaacacctgacataagtattccgacgtcaatccgagaatatctctatatgaggttgacatccaatgtgtaaatgtgcataaagagtagtaagagtctcgcctacagaaacgtgttccattccaaaccctaccctcccatttagtttcagaccccagtcacctgcgttgggctggattaagtgcacatgcgcctcccaatcgaccggagctggtcatagaatcgaccttgaatgccgacccgtgcatgagaatccgagcactacgcttacatcgcacctgaaacggcttgcaccgacgcctcagtccacaccttcctcgcttgcatggagtcgccggcaggacctacgagcaacccgaccccccaaatcatctccagcgagacactgatacgattcgaacaacgccatcgtacctgaaagagttattattttgtataggaaacaactgaatctggcatggcaccggtgtgtcttgtgaccatacgccggcttgcccatgcgcgcctctcctgcgactccaatgcatactcatggaagccaggaggtgcagagtggagagtccacatgctacagacgacctttgaccatgccattccaaaatccggttgctacgcaggcgccttctctacatgatggtaattatcggctacccttatgagtagctctgagccaggaggaatactggtgtacccaggtggtggattgtctcgtcccacaacagatgaatggggatggcatctgaaacggttcagtgggacgaggcaatgtgtgaggaagacagtctgttcacagtgacgttgtgcagtgcagtctccccttaccaagaaattgcagcatttagtcccagacaagcgtggatggagttttacggaacagcatgcactgattcacnnnnnnnnnnccgggtgctgacgaggccctctatggaacacgcagcagctgctgacataaggattccgacgtcaatccgacaacatccctatatgaggttgacatccaatgtgtaaatatgcagaagagtagtaagagtctcgcttacagaaatgtgttccattccaaaccctaccctcccatttagtttcagatggagagtaccgccatagttttacggaacagcatgcactgattcacgtgggagggtgtagtgcagcaaagagcctgactgggcatggcactggtagcccagggtatctgcactagatgtcaatgtcatcatctggatcctcatccgagtcgtgctccgagtcagagtcccgaacatacagcacatggtttgtggtggaccccctgccgcccgctgcacgcgggaggtactcgcggaagtcggtgcccagttgctgcagggcctgcgtgggaaggatgagtgtgtttgtggacatggctgtaagacgattcggtcaagggtgtgccagcacaggtgtgtcacagggatcgctggaccgcctcactcccctgaggacaaggatcgaggcccctcagatgcacaaggcaccacctggggatggctcgccctgccccaatactcgggccgtcacatgcatgtggctagcacagggagagcggcggggtgggatctcggcagcatgtctgcgtcgagggctcacctggccctgacgctcgtatggcagctgcaccgaactccgcgccgcgctttcctccggcgtcaggcccagcttcatcccccccgccacccctgggcctgggggaggggccgccccgggcgccacccctgctcgcacgctggggcctgtgccgtcagggacgggaatggaggggccgtcagccaccattgtctcgatggagaggggcggcgtcttgctgggtggcgcactgcttgtccagggactgcatgcacaggcgagcagcagtcccacccccggggggagggcacagcagcccggacctcctcgtgtgcgtcagtcgcagggctgcaggagccggcctcgggccctcctgtgacaatagcgcacgcagcggcggcgccgacgcgctcccactcacctcgcgagccttgccctccagcctcctctcccacgcgcgggcctggcgccgtcgcggtcgtgacgggcgcatacatcagcgaagcccccccctgaccgggctttccttgctcgccgacctggcccgcgcggctcacggcgacggcctccaccctgggcccggcgcgggccctcggtgtcgcacacagcgcgacgcacagcgcctccggccctgcccccgggggcgggggcaggagcgccacctcggcgtgcaccgcgcggcgcagcagcgcgcacgcgcgctcttcgtgcgcgccggggcgcagccgcgccaggaggccgaccactcccggcgagcgggccaggtcggcgagcaaggaaagcacggcgcgcaccccgtgcgcgcccacccacccatccagtccgtccacgacgcacgcggcgggggcggggccggcggcgaccgccgaggcgacacgccccgcccacaatccgggcggggcggccagggtgcctgggatggcatgaggggagctttgtaccccggcccgtgcccagcagccgtgggcatccgagtggcagtcgaacagggtgagggcaggggctgaggagcaggcggacgctagctcgnnnnnnnnnnagagctttgtaccccggcccgggcccagcagccgtgggcgtccgagtggcagtcgagcagggtgagggcgggggctgaggagcaggcggacgctagctcggcggcggggccgtcgatcgccagagccacgacggctccggagcattgccgcatcgcagagcaggtgtctctcaccacctgattgaggagacaggggattccttggcgtccaggggtggtgacacatctgcaaacacgatgttcaggggccggcaggcacatcccaaaccctccctggcccaaggactcgggccatgcctgctggaagacttgatggcctgccaggacatcgaggtcatccaggaagaggaggatgggcgcgggtgacagggggtcgttcgtggccatggcggagacagccgaccgccagggcgcccgggtcccggctgccgcctggaatcgggcttgcgccgttggatgcatcgtactgcgctgcaaagtggacgatttcagtaatgcatgtgctgcatgcgcctgtgcgtcgtcacttgccatggaacatgcggagatgcctgggcgcgaagaccaatcttcctcgacaccgggcaggctggccatgctctggccatgcgcagcaggagagtcagcaggccctcacacagtgcggtccctccgtgcttccctgatcactggttcttacgccaccagagtgatacatgcaattattgatttgattttatgtgctctttccatcgatagagggtggccgaatgaggggctggacaaccctggtccccctcctgcgtgacgtggttgcccgcgcgcggtgcgcgggatccctgcatgccgccaagctagacatccgggcgttcacgagcctgtcacatgcggcacccctgggagcggcgcccccagctgtcaccggcctgcgccaggtgccagaggctggcatgggagagggcgcccgcgctccatgcatgagcacctgtgccactatgtgaggtgctggtgcttccccctgcagtgctttaccacacctcaccgcactccctccccactcccacccatcgaacagctggnnnnnnnnnncccatgcatgagcacctgtgccactgtgtgaggtgctggtgcctccccctgcagtgctttatcacacctcaccgcacttcctccccactcccacccatcgaacagctggcaaaggcagccgggtcggcgcccggcctggcctcctgggcggctcgcggggcgctcgccgccgcaccctcgcccccgcacctgctccatggtctgcgctgggtggcgtccctggcgggaccgggtcccgctgccgccacgccctacggcgccgcggcgctgactgcgggcctgtcggccgcgcagcgccgctggctggccctctggctgggcggctgcagcgcctgggtggcggtgctggtggtgctgggcggcgtcacgcgcctcacccgctcgggcctgtccatgaccgactggaagtttggcggcgagcgtgcgccctccggcgacgcggagtgggaagccgagttcgcgcgctacgcggcctcgcccgagttccgccgcgtcaactcgcgcatgaccctcgacgagttcaaggcgatctactggatggagtttgcacaccgctactggggacgcggcctgggcctgctcttcgccggccccgccctggcctttgcggccggccgcgcggtgacgacccccctggcccgccgccttgccctactattcgccatgggcggcacccagggcctggtgggctggtggatggtgcggtcggggctggaggaccccgccgaccctcatgccgtgccgcgcgtctccgcctaccgcctggccgcccacctcacctccgccttcgccatctacgccaccctggtctggaccacgctggacgtggcccggcccggcgcgggggccggcggcgcggccgccgccgccgc

SEQ ID NO: 24249 - DNA, 5840 bp, Chlorella protothecoides
  modified_base (277)..(286): a, c, t, g, unknown or other
  modified_base (607)..(616): a, c, t, g, unknown or other
  modified_base (1096)..(1105): a, c, t, g, unknown or other
  modified_base (2050)..(2059): a, c, t, g, unknown or other
  modified_base (2311)..(2320): a, c, t, g, unknown or other
  modified_base (3325)..(3334): a, c, t, g, unknown or other
  modified_base (4004)..(4013): a, c, t, g, unknown or other
  modified_base (4765)..(4774): a, c, t, g, unknown or other
  modified_base (5259)..(5268): a, c, t, g, unknown or other
  modified_base (5567)..(5642): a, c, t, g, unknown or other
tatggtatggcagcattgcatgtatcatgggatgatgcaagcatcaccattcatatgtcacaaacaaggatcaccctctggcatgcgccagttgccatcacgcttcttcccaagagggtcctgtcgttgcaaagctgctgcatacccatggcagaatcttgggacctcccaaagggaagagtgatggccactgcacttttatgactcatgatcaccccacggactcaagcactgctaagattggaatacctcgtgtatgtttggcgttgttaggacnnnnnnnnnntccacggactcaagcactgctaagattggagtacctcgtgtatgtttggcgttgttaggacttgcgagtttgtcttgcacggcttgtggtcattcatggaggactggcactcctagtgctgtggacagttggtcactctcggtgattgcggagacaacctgttagttccgcctcgcccgagtctcaatcttgtgcatgggccccagcatcgcgctcgggtggcacgaccagcgcgctctgggcgcatgggggcttcaccgacaccaacaccgtcccgcaagggcaagcgcggtggggcgacatgacccactcgcccctggnnnnnnnnnntgcgctctgggcgtatgggggcttcaccgacaccaacaccgatccgcaagggcaagcggggtggggcgacatgacccactcgcccctggaccccgtcagcccgatggcgtatcgcgagggcgcatatcgatggcggggcagtctcccacttacctgtccgccgccctccccgagtaccgggccaaactcccggccttctcggtatggcccggcagggccaaggtggccctgcagacgggggcttacatcggcctggcgggactgctccttttcgccaagcctggactcttccccatcatcttcgagacggagtgagtggtgggcggggctacgtacagcatcggagcgaccctggcggtatctcccttgccagccctggcctcccaggcatgcatgcagcgaccgggggcgcgcccccctcccctcacggtctggggctcgccatcgccgtgcagggtcgccaggggctacgtccgtgtnnnnnnnnnnacctcccaggcatgcatgctgcggccgggggcgccgcccccctcccctcacgatctggggctcgccatcgctgtgcagggtcgccaggggctacgtccgtgtgggcgccacgctggcagtgctgttcggcgcctactacctgggagctgcctgtgatgacgcggcgggtaggccccccctgttcatgtacgccgccacggtcgcgggccgggggctcctctccgcggccttctgctggctggtgtggagcgggcagtgcgccgtgcccctgctgtggctggcgggcctgaacgccctcagcgcggctcgactcttgcgggcgctgatccggccggacgacgccccggccgggtaggtggggtctgtgctgagttggcaggcccggagggagggccgacggggccccgagcaagatgccttggggctgtatggaaaggatggcgacgcctggccgccacgcgtgcagcgtgtacccgcgcctctcgaccatgctgccctgccccgggccggctgccctcaggccgagaccctaggaatggtttcagtctcttgccagccgccagctgctgtgcgcagtcctgagccttggtgcgggctgccccccccacccatccttttattgatccaggccttgaccaacacacccagtgccagtgtatgtggcatgaggagtgcagggcatctgcgatcctcgtcacctttcagtcatgactactggcatcctggcactgtgggatgaggcggcaggaaacttcctgcaaaccgttggggcaactcatgcatgtgccgctgctgctgatgtcacagctatcatctcatcctgtacctggatcatgtaccaatgacactcggcgctgcctggacacacacatgccttggagtgtgtgggcgccatctgccaatgctttgggaggtcaaacaggttgcctcaccccgtttggctgnnnnnnnnnngtgtaccagtgacacttggcgctgcctggacacacttatgccttggagtgtgtgggcgccacctgccaatgctttgggagctcaaacaggttgcctcaccccgtttggctgcaattcaaaggacattcatccttcatggtagtatgcacgcctttcgcaaagatgcaatcagcgattgaggactctaggagttgcatctgtgatgttgttaggtactaagactccatgaccggatctacaaacccctcgcannnnnnnnnntgacgattgaggactctaggagttacctctgtgatgttgttgggtgaaggctccatgaccggatctacaaacccctcgcaaggcatcccgagaactggcagtcaagaggaggagcaggcccaccacctacaacaacactgtacgtgacagccgaatcacctgctctgttctcctgcgtgaacgcgcacattgatgctggccacctccccagagtgactctggtcgttcgggttctagccccagcggctgcgctgaagtaagaggaggcaccagcgatcctcggctgcgccgtagtggaattgacaagccatgggaaccccgaatccggaggtccttagggccgtcatcaggtgagaaaggtggagcctccggcgatggctcgtcgcactctcgccgcgcaggccatcgagcgctcctcgatctgcgtggccccattcctctcgttcctcgccacagatcctacagctatgtggtgctgtggatgtccatctccatctccgtcatcctcttcaacaagtggtgcgcctgcgtccgggccgggcacccctacccctgcacccctgcccaccccttgcaaccctccaccttggtctgccctattgctccccgcacgcccctccagaggccccagcccctccatctacaggttgctcgccttcgccgggttccccttccccattgccctcaccatgtggcacatggctttctgctctgcggtgggcttcttctgcatcagggtcctgggcatcaccaagacgcacaacctgagcgtggaggagtactgcagacgcgtcctgcccatcggtgcgttgccgatgctggccatgagatgctaccctaggggccgcggtcccatcctgtgctgttagtgctccaggggcgacccgccactcgttcggccggtgctcctcccatgcgcctgtttctcaccacatcaccacacctatgaaaaccccgccctccccctcccgacgccccccctcacctctcttcctccccccaacnnnnnnnnnngccatgcgcctgtttctcaccacatcatcacacctataaaaaccccggcctccccctcctggcgcccccccctcacctctcttcctccccccaaccccttccacctgcatccaggcatgctgtacgcggcgtcactctggcttagcaactcctcctacctctacctctccgtgtcattcatccagatgaccaagtcgctgatgcccggcctggtctacgcctgtggtgtggcgctgggcaccgagacctttgccgccggctctgcgctcaacatgctgctcattgccgcgggcgtggtggtgtgcgcggtgggggaggccaacctggtggtaaagggtctggtgcagcagctcgccgccctgctgtttgaggtgggcagcggatagggctttcttttttgagggaggggagggaaggtgggggggtgaggggggaaaggctgatcaaccattcagaacgggtctctgccattccatgcgaccccggcgtgctaaagctggccagggattttgagtggcggaagggggcccgcggctgtccacatgcagccccagcgcatgcctggggtttcttcccagccgctagttggcggctttgaggatgccaggcatggcccacgctggcccagctgacagtgcgcctcggccttcgcagctcgcccctcacccannnnnnnnnnccgttgaggatgccaggcgtggcccgcactggcccagctgacagtgcacctcggccttcgcagctcgcccctcacccagccaccacccctcgagtgacttgcctcccctcccaccctccaatccacacccgtctcaggctgcccgcctgaccctggtccaaatcctgatgaactccaagggcctggccatgaacccgctgcagagcctgtactacgtctcccccgcctgcctgctctgcctgctggtgccctttgccctggtggagtactcctccctcctccagtccccgcccgtcatctaccctaccgtcctgctggccaacgcgctcaccgcctttgccctcaacctcgccgtcttcctgctcatcggcaagacctccgcgctgaccatgaacatcgcgggcgtgatcaaggactggatgctcatcttcttctccttccacctcttccatgcccccgtcacggtgctcaacctggtgggctacgccttttgcgtggcgggcgtcgcagtctacaatttccagaagctgcaggtgggttggggcaaccaagggggagtggcagtgctcctgttcatgtgtgttgtgggggaagggaagggaggggggggggtgatattagttgggtgggaacttggtggggaggtgaaggagacatgggggcactagagagggggttatggggcaggagaagagtgggtctcgaggagataggaagactagccgtcgtgggcagcgcatctggagccatgnnnnnnnnnncgtgttgtgggaagagggaagggagggggggggttgatattggttgggtgggaacttggtggggaggtgaaggaggcatgggggcactagagagggggctgtgggacaggagaagagtgggtctcgaggagatgggaagactggccgtcgtgggcagcgcatctggagccatggtcgcgccgggtttgtccctgcgcacgctgtgcgaggctcggagcataccgcgtggttttccctggggctggccaggcatcgtaagccgtttcctgcggcgggctcggttggagcacggcatagcgctgcttagaacatcctcctccccacccctttcaccacccccgtcctccaccgcgccaggtcatcaagcggaaggccatgcaggcccagaaggacggcagcggcgagggcaagcatgacggcgccgaggagcggggctcgctgcccgccggcgccgccccctccggccccggcctgaccatcaaggnnnnnnnnnnacctgcgcacgctgtgtgaggctcggagcataccgcgtgggtactccctgggactatccaggcatcgtaagccgtttcctgcggcgggctcggttggagcacggcatagcgctgcttagagcatcctcctctcccccccccgctcaccacccccgtgcttcaccgcgccaggtcatcaagcggaaggccatgcaggcccagaaggacggcagcggcgagggcaagcacggcggcgccgaggagcggggctcgctgcccgctggcgccaccccctccggccccggcctgaccatcaaggnnnnnnnnnnnnnnnnnnnnnnnnnnnnnnnnnnnnnnnnnnnnnnnnnnnnnnnnnnnnnnnnnnnnnnnnnnnnccccatacgtgacgctcgaaaccatttcgatctgtaatattacatcgatgacggcacagggtcaggagagagtagagggggaagggtggcggggggggaaggagggggtgttaaaggatcgccgagatggaatgaagcatcccccggccaccttccgccagcgtcagcccacgtgcaggtcgaggacctccacggcgt

SEQ ID NO: 24250 - DNA, 71 bp, Chlorella protothecoides
ggtggagggagttttatggagtgtgccgaagagcaatgcaatggagcgtctcgacccataccccaggggtt

SEQ ID NO: 24251 - DNA, 78 bp, Chlorella protothecoides
gggtcaagggactggcctagctggggtgcgtgtcaacggcgtttgtgcagtactttgggtgcttcgtgtactcctggc

SEQ ID NO: 24252 - DNA, 78 bp, Chlorella protothecoides
caaaataacctctaagaagtcctgagcccactttgttttcctgcgacggccccctgtgtcgccgcagctcactctttc

SEQ ID NO: 24253 - DNA, 131 bp, Chlorella protothecoides
cacacgcgcgcaccgtcgtaggcggccagctgtgccggggacagcgcgtgcagcaaggccagggtgtggttgcggcgccgcgtagctcgcacggtgcaggtgacgccggccgcccgcagtacgggcagcag

SEQ ID NO: 24254 - DNA, 61 bp, Chlorella protothecoides
cagctgtcctggagtacctggcggccgaggtgctcgagctggccggcaacgccgctcgcga

SEQ ID NO: 24255 - DNA, 74 bp, Chlorella protothecoides
agcgggagaggaggatcgtctactcgtcctgcacaccatcgctgggccagccccggtgccggctgtcggcacgg

SEQ ID NO: 24256 - DNA, 64 bp, Chlorella protothecoides
ggcgctgacccttgggcccgccgtctcgtgcctcgcggaccagccgattccagccggcggtgta

SEQ ID NO: 24257 - DNA, 61 bp, Chlorella protothecoides
caatgtagtatcggccactggcattgtttttgcgaacaaagcaggtacatagaccgcatga

SEQ ID NO: 24258 - DNA, 89 bp, Chlorella protothecoides
ttggacaagcccagtgaacagcacagcgaaaacctctgcaagatccaagcaacaacagaacccacaaaatggtattctctcataattct

SEQ ID NO: 24259 - DNA, 61 bp, Chlorella protothecoides
cgctctccattgcaggaacattcgccggtctaagaagtccaatccatggatgctggaccca

SEQ ID NO: 24260 - DNA, 207 bp, Chlorella protothecoides
tgagtcagtgcaggattgaactggcagtgggaagtagatcagtggctgttgaggagccgggactgggatcaagaatccaacaccgggtgtcgaagtctaggcgtaggattgcaccatgtaaagtggccgtccttgcagttcaacatacttgatcacagtcacccattcagggctatcactgaagtgtgagattggactggcttaggg

SEQ ID NO: 24261 - DNA, 71 bp, Chlorella protothecoides
gcccccctggactggctggagcaggcgaccacaggcactgccgacctggtcgtggtgaacagcagattcac

SEQ ID NO: 24262 - DNA, 63 bp, Chlorella protothecoides
cctgcacctacaggacctcaaggatggcagcaatggagttccagctgccccaatcgccctgct

SEQ ID NO: 24263 - DNA, 74 bp, Chlorella protothecoides
cctggagttgtgagtctggtgcaaggggggcttgcacttgagatcggggtggtcctaattagaatccgtttgga

SEQ ID NO: 24264 - DNA, 155 bp, Chlorella protothecoides
gcaaggcgtgtgcttgtgattgcttgggcccagggggcatgccggggaggggcagcacgacaagccgggggccaaggatggcaaggggggagattctgcacaccttcctgctgcagcaccgcgcaacgcaacgtcaggctcaatgcaaggctgtt

SEQ ID NO: 24265 - DNA, 150 bp, Chlorella protothecoides
tggaacgcgatatcacagccgaggccggtatcccccatgcgtagacatgcactgcgaggcacagtgaacaacagcaaggcatgcacgcaaccactcggatcacacgccgtcgcaaaactgctccagtgtggcccgcagctccgccgcgtc

SEQ ID NO: 24266 - DNA, 61 bp, Chlorella protothecoides
gctggcgtaccccttttacctcctcgcccgttccccgggaaaagagggctcgcactacagc

SEQ ID NO: 24267 - DNA, 167 bp, Chlorella protothecoides
ccccgtttgaaatctcgtttcccgttgtacgctgcgtgctcccctgtctgagttgtgaaagttttgggagaacacgatccgggttccatggcagtactggcgcggtcacgatctatggacaccgagctccatgtcggacggattgtacccagcacgcttgcatgaac

SEQ ID NO: 24268 - DNA, 61 bp, Chlorella protothecoides
gttcgttgaccccgccgttctctgcggcggtggccgccttgtccagcttctccaggtacag

SEQ ID NO: 24269 - DNA, 100 bp, Chlorella protothecoides
atgtgagggctacactttgtggtttcaaagatatttttatcaaaacatgcatacatatcttgcaggaaagaggccacatgactcacgataaacccatgcc

SEQ ID NO: 24270 - DNA, 574 bp, Chlorella protothecoides
aggcaaagaacttgtttcgagggtcacagttctgcccagggggcggagggctaagtggcggtggcggagggggagcatacaagttgagcgtgtctcccgtcaccagccagaggcggatgcagtgatcctccctggcaaagttgcaaatgaacgagtcgccagtcagttcattcccgatgtttccagagccaacgttattgttccctgtggaggaatgttgatgcaaatgacttacaaaattgtgcagagatgtaaatcccagccgcggcccgccatatgtcatacaccagcattgacaaccttggcatgtgacgtaccgtagttgtgatctcctacattgttgttgcccacgttatacttgccagtgttcccagtcccgatattgtgatccttgtccatggcacacgcaggcacaccatctggcaggcactggacgctgcctatagccgtacaccccggcgtggcgatggcgtcgcagatggcaaaggtggctgggttgagggtgttcatggtgaaagtcttaaaaggaccaggataagacatgttcaaggactgcatgacgatgcctccaccg

SEQ ID NO: 24271 - DNA, 75 bp, Chlorella protothecoides
gtgcaaaggactgatctgtgtgatcctttgtatcccccccaaaatgctcacagccatgggtttccagcccaatgt

SEQ ID NO: 24272 - DNA, 108 bp, Chlorella protothecoides
atgtttcccgtcatgcatagcacgctacccaggttcacttctccggtcttcatccactctgcccaagctgcctcagcggattcacacgtgcatcgcgtccttatccgg

SEQ ID NO: 24273 - DNA, 114 bp, Chlorella protothecoides
caatcgactcccattctgtggccgatagggaaaagggaagacgggccactgagtcgtcggtcagctgtcgtgacaacttgtgtgagcatggcacgcacagcagggaaaccaata

SEQ ID NO: 24274 - DNA, 65 bp, Chlorella protothecoides
acgacactgctggacagactccacccccccccttggtgcgctctgcctgctcagtctcatgtagc

SEQ ID NO: 24275 - DNA, 79 bp, Chlorella protothecoides
ccagtcatgggagggaagccggcaccctggcgacccacgttccgggggatgatcccgggctccctttgctgtgaaacaa

SEQ ID NO: 24276 - DNA, 383 bp, Chlorella protothecoides
acccggtgtggatcccatattagtaaacgaatagcttagcaacgaggcaggcgatgtataggaaggggggtatctagcccctttaagagctaaggagggggaaggcccctgggccaccaggggccacctgggcacgaccgatgtgtggtgacggcgttctatcgctctgtactcgatactcttacgtttatacgatataaacgaattaaaaatgcctcttgcgatgcgttcgtatccctactggccacgacggggtctcccgaaggggcgaaaatggcccccgccggacgggggtcccatcaagcaatgttcgcgcgcgcttgtctcccaacacacaaaatatacatgagcgtttgatcatttcgacaatgcgaagtcggttt

SEQ ID NO: 24277 - DNA, 86 bp, Chlorella protothecoides
caggatgacagttggccctgcagaggcatggggtggtgcagggggactgggcatttggacctgcgtctccatcctcccagcgggag

SEQ ID NO: 24278 - DNA, 75 bp, Chlorella protothecoides
tacgtcaaacaccatggttaacaccatcttcttataactcaagccgtctggcaccagataggttcgcagtatggg

SEQ ID NO: 24279 - DNA, 71 bp, Chlorella protothecoides
tcttgcatgcatgcatgcatgcatgcaagcatgtctccctcgcggaccccacagggcactcatgggcgact

SEQ ID NO: 24280 - DNA, 61 bp, Chlorella protothecoides
cctagccactagacgaaagtgactgtttttcaatgtcacttccgggaattgaacccgggtt

SEQ ID NO: 24281 - DNA, 75 bp, Chlorella protothecoides
gggtagtgctcgaagggtggctaaatcaaggctgtgtttcaaaccgattcgcaagacagcctgcatcccccatcc

SEQ ID NO: 24282 - DNA, 61 bp, Chlorella protothecoides
tgatgcttgcagggtgaaattggggcaccgtcccctcgtgaccaaccctcgcgaatctggc

SEQ ID NO: 24283 - DNA, 75 bp, Chlorella protothecoides
tcgcgcatgggtatcgggtaggggaggaaagacccctgacctaccggtgaggtcaccttgccgaagcacccaaac

SEQ ID NO: 24284 - DNA, 61 bp, Chlorella protothecoides
atcaacgaggccgccatcaggtggggtggttcttcacgctgctgagaggggctcgaggtga

SEQ ID NO: 24285 - DNA, 195 bp, Chlorella protothecoides
aagcagcatctttcacaaccccaggagcagacaccacgtatcagactgcttaaagagaaagtcaactcttccccaggtcgttgaataaatccattcattggctttctgaaaattctgtacaggctcatgcagcctggttgcttctttccaagctcaccataaaatacttcctggcgcaatccacgctcttcatga

SEQ ID NO: 24286 - DNA, 158 bp, Chlorella protothecoides
ccggtacgggaacaccacgaccaggatccagtgccgcccatgccggatcgaagggcgcagggtcgaagatcgcgaatcagaactgccattcaccatctcagcagcccccctacctctgcctgcgggaagctgagccagtccacgtggtccatgaggat

SEQ ID NO: 24287 - DNA, 77 bp, Chlorella protothecoides
ggtcgtcacgggcgcgccctcgtccacgtcagggcgcgcttgccccatctccgccgccacgcggcccgccagcttgg

SEQ ID NO: 24288 - DNA, 411 bp, Chlorella protothecoides
  modified_base (113)..(267): a, c, t, g, unknown or other
tgggcatggttattagtgtgactgcgcagcagacattccttcagggctggcgcaaggataaaatcacatctcgctcaaaattttcatcccagggagcttgccaccacaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggacaatgtggccttacaggtgcactctctgcgcccccactcgcacggacacccaccgccccttccctcacaaggggggggtccaccccccctggaggcctgctttgcccagtttgatgccatacatgcgctgactgggtcgc

SEQ ID NO: 24289 - DNA, 78 bp, Chlorella protothecoides
gggggggcacgtcgggctgccctcccacaagaagtaccaggacccgagtgctcccttacctcgacgccgggcagcgtg

SEQ ID NO: 24290 - DNA, 109 bp, Chlorella protothecoides
tctggcagcatcgacagggggagcacccctacggaaacatactagcgcgcgcgcgcccggttctgcgtacccctttcagaagttttctgacatcctgcatggttcgttg

SEQ ID NO: 24291 - DNA, 61 bp, Chlorella protothecoides
gtggtgtagccacgggtgcgtggggaggggtggggccaccccaccaccagggttgtgctga

SEQ ID NO: 24292 - DNA, 4109 bp, Chlorella protothecoides
  modified_base (646)..(731): a, c, t, g, unknown or other
  modified_base (986)..(995): a, c, t, g, unknown or other
  modified_base (2072)..(2081): a, c, t, g, unknown or other
  modified_base (2459)..(2468): a, c, t, g, unknown or other
  modified_base (2995)..(3004): a, c, t, g, unknown or other
gccgcggccgtcgccgcgcgcgcgtcgcggtcgcccgccgcacccgtcgccgcgttggcctggcccgcgttgatcaccacgccgcggaccgtctcgtgcgcggcaagcacctcgcggcacagcgtgacgggggcggcggccatgacgttgagcgtgaaggcgccggcagcgactgcgggggtgtcggagaccaccagcgccaggtcggccttgtcgcccttggcacgcaggccggcatacatgcctgtggtgtgatgggggggattggagacagggggtggggtctagaggagggagttggcggcgggtttgggaagtccacgcggaaatgccaatagctcagaaggagaactctgaaagagaccacgacatggcacccgcgcccatgtgtgccaacagccaccctcccgtaacctcccttctacaaccctccccccctaattaaaactcaccctgggccttgaagccagcgggcgccgtcacgccaccgtcgatcaccttccagggaccctccgggatgaggatgggggcagcggggatgtcaaagctgcctggcagaccggcggaggcctgctctgagctggcggcagaagccatggtctggggtgcagagtggagagggcttttggtgggtggccagaggagnnnnnnnnnnnnnnnnnnnnnnnnnnnnnnnnnnnnnnnnnnnnnnnnnnnnnnnnnnnnnnnnnnnnnnnnnnnnnnnnnnnnnnccaggatccccaatccagaatatgcatccaattgcacccaccaggaagcggcgagaggtggtgcagtgtagccgaagcactgcgtttttatgatgtggaggtggaacaggtcaggggctggtcggccaggtgggcgagggtcacgggcgagatgagctggaaacccatgcccaggaggcaactcacccctcccaagtgtgtgttcagcttggagaggaatggacctggagcagcggggggcgtggaagcatcctnnnnnnnnnntggcgagggtcacgggcgagttgagctggaaacccatgcctaggaggcaactcacccctcccaaatgtgtgttcagtttggggaggaatgaaactggagcagcggggggcgtggaagcatcctggggagtgaggccgtgtacggtcaccgagggcaaccaaccggccacccgaaaagctcgtcgctgaggtctgcatgacgagcgaatctatatatgaatacgctttctaaaactacgccaatgggtcaggagaagtgccaaattgtatggagatcaaggaggcccgtgatgtcggattgcacgagtgacagcggtcgagggagaacgtgaatgctggatggagaggaaaacccttctcccctggatcgcctctttgctcacgttaccgtcacacaacccttggtcgcgccccacagtgctcactgctcgccatccttgaaccaaaataacggcagctgcggctttctgagccctgtcatcgagcatctgcacgtggtgacccttggtcacacattctcaccctaccttgtcggaagtgccttccagtgcctcccagcgcccatatgtcgggctcggccttcaccaggagggtgaacgacttcaagaccaagttccagtctcttctgggtgccaagtcccaggtcagcggaatgggtatctgtgtgcagtagcctccccctccgatcacttgtcacccagggagtcacgcaaccgtccagaacaccccattcccaccttttatcgcagggatacgatgagttggatactctagaacggcccctgttttcggcgcaggacgagacggatgactacgagcgcacccatggggttgccgcaccccagtcttaccgccccccaaacacgggcggggccaccggcgccgcaagcttcactgctgccgccgctgtgccgtcccaggtgtgaggctcgcggcgcgacaccgctctttgcgtcttcggagtccatggtgcatgatgtgcagggtggtggtggcaacattgggtttgagccgttcgcactgattcacagtagatgcacggctcgcttccgctcatgcatgggctcaccatcttccnnnnnnnnnnagtggtggtggcaacattggggtttgagttgcactgattcacaggggatgcacggctcggttccgctcatgcatgggctcaccatcttccctgctttccatcaggtggatgagatccgggagctgtcggtgcttgccaaggacgccgcaggcatcctgtgggagatggtcgccctgggggagacgggcccggctgcaaccgagatgcggagcacggccgagcagctgcaggtgcgtgcgggagggttctggtgttcctcccttgtgccggcaggctagttgcccctgcggaggatcccccggggtctctgggtttcatgccaagggatctgtcacgacctgcatcacccggaccccctcatcatcactcaggcccaannnnnnnnnntttgtgccggcaggctggttgccgctgcggaggatcccctcggggtctctgggtttcatgccaagggatccgtcacggcctgcttcatccggaccccctcatcatcactcaggcccaacttcgcggcctcattggagattacacggggggtgacgaggcactcttcagccaggcgtttgaggcactggacatgctgaacagctgcctcgcagacccctccgcggcccagccgggcgccgacgcgggggcgcccagcccctccgagccccaggccgcgccggcgcccagcaggagcgacgcgccgctcatcagctttgactgatcacctggttgtcttgttgtggggctggggagccgcgctcgtccagctgggccccggccccggccccggtgtaccctcgttgaccctcctgaccttgctgctcagatagagtgcatggagcattgcgacgccgagcctggtcggcaagcgcttcgcccccccctgaggcctggggtcgggccccgccccggctgctttgcgtcgnnnnnnnnnnggtgtgcatggagcattgcgacgccgagcctcgtcggcaagcgcttcggcccccccccgaggcctggcgtcgggccccgccccggctgctttgcgtcgcgtggcaccgggcaggaaattttgtattgcatcgttgtacacgcaagctatgtggcgtggcgcatcatggcaaggaggccgcaaggtggagggtggggcagcagcgtcgaaattcgcccgcggaggaggagggtggggaaaggcgctgcttgtgacggtggggcgacccaacaggtccccctttcttttcctggagtggaggcaaggccccgcggggtcggagagccggccaccctcgcatctccctctcctagctgggcggtgtgtaagcgtcccagccctgggcggccatggcttcccgcttggccatcaccgtgtcggtcatgccgcgctggtactccaccatcctggcctggatctcggggtctgccacgcccaggatgcgggcggccagcagcccggcgttggccgcgttgccgatggccaccgtcgccaccggcacgcccttgggcatctgggggttggtgtgcgaggatgtagatcgcgtaagttcagggccactgctccccaccaggcggtcaccgccgggggggtgtccaccctggacatctgctcaacccccatccgtttcacatgcctctccaatcgcacaaacacagagacaagcactccttcccccccccaaaaaggtggtctcccaacctggcagatggaaagcagggcgtccacgccgtccaggcgcgcgcccgccggcacgaccggcacgccgatcaccggcagcggggtcatggcggccagcatgcccggcaggtgggccgccccccctgccccggcgatgatcacctgcacgccacgagccgcagccccgcccgcgtactcggccatgagggctggggtgcggtgcgccgacacgatctccacctccactcccacgccaaagccggcgagcacctgggccgcggcgcgcatggtgggcaggtcggagtcggagcccatgaggatgcccacacgcgccggcggcggcgcggcgcgcgccgtgcctcctcgcgccgtcgccggcgcgagcg

SEQ ID NO: 24293 - DNA, 64 bp, Chlorella protothecoides
agggaagggatatgtttcaggagggcagccctggtgctgccagatgcaactgggtctgaccctt

SEQ ID NO: 24294 - DNA, 213 bp, Chlorella protothecoides
cgcctccagcgcctccatgatggccgcggcggcaaacgggggcgggacgtagatggcagtggcggtggcccccgttgccgcccgtgcctccgccaccgtgtcgaacacggggaggcccaggtgggtggtgccgcccttcttgggtgtcacacccccgaccatgttggtgccgtagtcgatggcctgctgggagtggaaggtcccgttcttgcc

SEQ ID NO: 24295 - DNA, 196 bp, Chlorella protothecoides
aaaaaaatgatgatgaatattatagggttgggttacttttaaaattattaacagagttagatggtattgagagtcgtgatggcattgttattatcggtgctacaaatagacttgacgttttagatccagctttactccgaccggggcgttttatacgtaaagtgagattaggtttaccaaataaaaacaaacggtt

SEQ ID NO: 24296 - DNA, 190 bp, Chlorella protothecoides
accaaggcttaggatggtcgagtacgacggaggcttctgtcgcgagggtggagagccgcgcggcgcctgtcgccggatggctggcgaaagtgtgcagccgcagcgctcggcggcgcagcttgtcggtggagcccctcctttgccccttcccaccccacacctccaccctgaacctcttcctttccccccg

SEQ ID NO: 24297 - DNA, 258 bp, Chlorella protothecoides
ggttgcatgcgtgggttggtgggcatacagagatgaggctgcagcgccggaggccatgtgctctggggcaaatcatcctgccctcggcgcactggccgcagcaccctgcatggaggactcacctgcgcgcatctaaatcagtgatggacccagcctcccatacactccctacccttccctccccctggcaggggcaccgatgccttggcgtcgcaggcgttggtgttccagaggagcctcaccagcaggttcatcccg

SEQ ID NO: 24298 - DNA, 80 bp, Chlorella protothecoides
gcctctgactgcaaacagagcgacgcacaggaggccaataactctttcagttttgaagaggtgtccccatcacagagaca

SEQ ID NO: 24299 - DNA, 66 bp, Chlorella protothecoides
ctgggtccatgggaggaaggtgaggggcgaatacaagcttggaagtgggcaaggaggaggcagtga

SEQ ID NO: 24300 - DNA, 70 bp, Chlorella protothecoides
ccatgccttcccgcactctggccgcgacagggacaccctgccccctccagaggatgccaggatagacaag

SEQ ID NO: 24301 - DNA, 75 bp, Chlorella protothecoides
ccccccccccacactttgcagatggagctgcggtacaacgaggcaggacgagcgcgggacatctacgagcggtat

SEQ ID NO: 24302 - DNA, 61 bp, Chlorella protothecoides
cccgctcctcatccccttgaacggcctcaaagacctggggctgctgaaggagacggacctc

SEQ ID NO: 24303 - DNA, 14792 bp, Chlorella protothecoides
  modified_base (474)..(515): a, c, t, g, unknown or other
  modified_base (9401)..(9438): a, c, t, g, unknown or other
cgcccctccccgccaccccccaccacccctctcacactccatgccccagacatcttcgtcaacgatgccgagttcggcgacgatttcatggccgaggtggaggcgctgacagacgcgcccgtcttcttcggcggcgtccccgccgagcagtggggtctgcccgcgcacgtcgaccgcgtggaggccgagacggcgtggcggcgcatgggcgccgcgggcgtgctgtacggcggcagtgagtcctaccgccacatgtgccgctacttctctggttttttcatgaaccacccgctcctgcgcggcttcgactactactggcgcgtggagcccaacgtgcgcttctactgcagcctgcagcgggacccgtttgccgtcatgcgggacagcggcgcctcctacggctggaacatcatcctgactgaggtacgtggtgatggaagggctttttgtggggggggggggggggggggggcnnnnnnnnnnnnnnnnnnnnnnnnnnnnnnnnnnnnnnnnnnctggccaggcagggtctaccaggtgcccaaaggccccacctccctctaataatcccctgtcgacccactggcccccacaccctgtcgcagatcatggagaccatcccctcgctctgggcgaccagcattgagttcctgcactcggcgccctccctgctggccgcccagcccgggatcaaggctttcgcctcgcgcttcaggctggggtccagcctggaggagacgctggccgagtcgcgctacaacggctgccacttctggagcaacttcgagatcgggcggctggacttcctgcggggcgatgcctaccagcgctacttccagcacctcgactcctcgggcggcttcttcatggagcggtacagaggggtggagggtctcgaggaggggaagaggggcgcggggcgtgggagcgatgccggtacaagggccctggggcctgtttttctatattgccgtggtcctcgcccgccattcagagcatcggcccggcggcgacacgtcacggggctgccctcgcctcctgagaccctctccgtgagccctccacacacacccacataggtggggcgacgcgccggtgcactccatcgcggccatgctgttcctgaacaagacggagatccaccagtttgaggacatcgggtacacccacgacatccacacccactgcccccagtcgcgggagctgaaccagcactgctcctgcaacccggaggcagacgtcaacgcccacggctactgcatgaggtactacaagcgccaggtccttggggaggggagcaaggcgtgagcgtatcgcagtcggccatgaatgcatcgtgcccggcagctgagtggagggggcccggagtggcgcggggtctgggctgggcctggagcgcagcaggacagcccttcctccgcccctcaccactctgcgaatatatactacacttaccggccatgtccatcttgacgtgatacaaattgtgagacctggcccaggaacgcattgcttgtaattatgttccatcagactcttcaggggagtatctgaagatcgcgcgcccggaacccgaccgtggcttggagagcatcgtcgagatccaacctcccagcgtgacagcctgtaccagatcgaactgtgaattgccagcaagaaaacgcccttgacttcgaagatgagccaggtggctgcaactggttgatcgcagcctgccccgatgtcgctgcaagagctggaggcgagagttgcgtccctgttcactgtcggggacctgccatccatagcccccctcctggatgaagcagagctagaggtgggtgctttgcctgcgccccgccgccaggtggatcgcggcagaaggcggggttgctgatctcagatccaaaacctcagcccctccttgccgcaggcaccgaccgcgttcgaatcgccagcctggccccatgcgctgcacatgctggccctcatgtacagcaacagactgtgagcaagctggaaggattcatgcacgtgacggaatgctgggtcttcacgaggaaggccggcgcgacgcttgcactctgaaataccagccctcccaacccacgccgcagggaggacgcccgcttcctgtacaaacgctgccccccacaagtgcgagactcccagccgcagctgcaggccgcgtgcagggccctccagttcctgtggcagcgagactatgccggattgtggcccctactacgctccggctgggacccccaccaggccaccctggtccgtggcatcgcctcgaacctgcgtgagcatgtgctccggctggtggccaccgcctactccaccatttccctccaggccctggccggcgcgctcggggccaccctcccagaggcgcagcagggtgagtgggcacacgtgttggctgcgctacatgcattccatgcgcctcctggtcaagcgtgtccttgccacttggcactggctggcataatcggatgccaaacccacccagccctgggcctcattcgagtcacagcactccgctgcagaggccgcagcacatggctgggagctgacaaacgcccccagcggcggagcgtgggttaggataccgccaaaggaggcggccggggaccctgtggcgccagacgcggccacactgcagcgcctggcgagttacgtgctccatctagaggccgcgtagctacggcttgggcactgccgcgttggagatgagggcgcacacctgggtccgatagaggagtgattggtggggagccgtctgggcgggacagccaggcagcgcaggccccgcgcggcgcgcccttggtgggcaggagggccccgcaccacccgctgcattgacgcactgaccctccgtcagggtgactgggtctgcctccgtcacctctacctcactccccagcaactaacctgggagcattctgacaagcagtagttcctggtgtggaagctggatttgaagacgaccagctccttgcgcatactcatggggcccaggcctggcgaccctggggtgtgggtttgaaagccaagcggatgacgaagtggggtgccacagggcgtggcgcgggacaaggcaggcgtcgcagggccaaggcaggcggcgtgggggctgctgtcattaggaacggaggaaagtcctccctgaccacccaggctacacagcattctaccttgaccgcctcgaaggcaggcaggaaggcacttgcgggtgcaagcctgtatctcaggacccttgggtccagccatcagcttactcaagaccttaggcttgcctggggggtaggggcgggggaaaggaggggtcaaggactgcgaagatcatcgcctgcatgtcactggtttgcaccagatgtgcaggccatattgcttcataatcagacgcagctggagatgaagtcagaggagacagcctattcctaacccttcatggggatcacaaagcagtgccgagtctgtggtctgggccgacccacctaagtcctgcgccaactcccccggaatggtctcaaagtactgctccacattagggggcggttgctcacggatgagaaagctggtggccgccagggatggggctggagctatctgtgtggatgatgatgggatgcaggcactgtcaggacctagccagggggaagtgctcacttcatcccatcagggaggcaggtccaggcctccatgtggtggtatcaaagctgatctcagcttgccggaacagtaagcatgcagccgccttacacagcatgtgacgaccatccatgagcatagggagagaatttgtccatgcaagattccgcttgtgcgaggtaaactgtgccatggaggtttgggcgacagggcgagacctggggacggcgttctcgtttgcatggcgacgagtctccaatgcggcagcgcactactcggtggaaggggacatggcatcgagctttcaaaagtgtgctgcacggagactgttgtgccacatcgcatgggcgtcgccttgcatctgtgtgctgtcctctcatcgagccctgccacacccacgtgacttcccaccgggcaggcccataaccacatttattcgagcatgcctgtcccttgggaaaagacatgcatgggtacacgatttgacgcacaacagtagctttgtcattcctgcataagccacccatcttatgcgacaggccagcatatcgttcgcaaggtatccaggcgtgctctgcaccccccgaccgcgcatgatcgccgtcctccgacgagcattcagcagcaaggtcgcagcaagaatggagcatgatgtcggcgcaagtattcagcaggtatgttcatgctggcttgtgggcgaagggccacatcagtcttgtcccgtcccacatcgttcggccgctgtgtatgactgcatgggcatgcttgaactcggcgtaggctcatcctcacaagccagcggtggctcagaccactgtcctggccctattaagaactagtgtgttcggtcctcccattggagcaggtgatagacaagatccaggtggcctcacagggtgcgcgggaggtgacccttgtggcggtgagcaagacaaagccgagccaggctgcccaggcggcgtatgatgcaggacaccgcgtgtttggagagaattatgtccaggtacatgggtggccttggctgatgggtgtctccaggtgcagcgctgggtcacgtgccggtagccatccatgggcgaagatcatcataccgagtatccggaggactcttatggaccccttggccttctcccaggcttgcagcttgccacatcagagcaaatcagtccatgctcgcttatgtacacctgctttccccactcacaccctcgcttgcctcccccctctctcacactccaggagatcgtggacaaggcccccctcctgccaaaggacatccggtggcactttgtggggcatctccagcgcaacaaggtgcgcagcttgctgggcgcggtccccaacctggaggtggtggagtcggtggacggcgagaagctggcagacaagctcagcgcatttgtgctggaggaaggtgcgacggcgctgggctggtgtcaagagggttgggtgggggggctcacatggaggggtgcatgcgcaggcaacgctgcgattccatggcctgtgacgagtcagcatcggttgcatcctcagccaaagcgcaaggagctcgcaacgctgcgcgctcctgttctggctcatcgggaacccgcatcgccaatccactccccccatgcatgtgcagagcgggagccgctgggggtgatggtgcaggtgaacaccagcggggaggtgagcaagtttggtgtgagccccggggaatcgtgcgtcggcttggctcggcacatccaccagcaatgcccgggcctgaagctggtgggcctcatgaccatcggcatggcaggtgtgcaaggtggtggaggggaggggggtgcatgaatcggccggtagccagccacccatatccctggcctgcctctgcatctgggatgtggcttcctacgaaatgcctggccattgcctgccgctggtctcagccgaccaccttcacactggcccctgccccccagactactcgtcccgaccggagaacttcacgtgcttggtggagtgtcggcgggccgtggcgcaggacctggggctgcaggaggcggacctggccctgagcatgggcatgtcgggggactatgaggccgccatcgccatgggtgccacccacgtccgggtgggcagctccatctttggagcaagggattacagcaaggcatagggcagatggcattggtgtcccaggggctcctgtaatgcaggacaggtgaaggagccaaaaaatcctgcatggattagtcagctcagtcatcggggaagggggccccacgcccggtgatagccactcagttgccgctgctggatcgcgtttggattcgggcccatgatgcgacggcccacctccgggagcaatgccagggtggcagcgggcctggtggctttcatgggattaatggcgagctaccccgtctacgtcgcgacccggggctccaaggtgcggtgggaccggacgtggccagcatggcaccatgaacaggcctccatgcatgtacaatcgtgcatgcgcgatgaatcggtgagcgatcgtgacggccccctccctcccatgctcccccgcgcagttgcaagccagcgagcgggccctgggtggggacgccctgatccggggagcctacgtcaacacgggctccaaagacgtcggcccggaccctgcggtgcacacttcccgtcagtgaccggcagagcggcccgggctccggccaggcatggccctgcacctggcaggcgccgcccaggcgccgcatccagcgcctgcaccacgcagctcattctccaccccccccgacatgcgctgcacccctcgccgctacatatgcttcacgcatagaattacgcggtccacgccccgaagcggcgccgccccccgcgcaaccacggcccaggcaggcatcgactcccacacccctcgacgcacggctccgttccccctgctccgcgcagcggcggcggcgggcctggcggcgcttgtgctgcacggcgcgggccccgccgaggcggtcctagtgtcgcccatcgcgcgtgtgccgcggtcggcggaggcggcgctgcgccgctcagtccccgccttcaacccggatgcgcgcgccatccgggaggggctggagagcgtggccttcaagctgcgcatcccgcagcgcaaaccctgggcctccatggccgaggacgtggcggcgggggctgggctcgcagcggacgaggggcgggcgctggcggggacgcccagcccggccctgtcccaggcgcggcgcgcgttgggcgaggtgcgcgcggggctggccacgctggctgccgcggtggacgcgcacgacatcgaccgctcctcccagcgcgtcgccgccgcgctggccgccgtgggccgcctggagctgctgcaggccccgggcctggcctttcgcgtccccggccagtacgagggcctaccgcggctgacggggcgcgccgtggtgcgcctggaggtgcagcggcgcggcgggggcgccgacgcgccgagcccggaccccgacatgctggagctgacgctggacggcttctccgcgccgctctccgccggcgcgctggccgccgccgtggccgacggcgcgctggacgggcagccactcgccgcatcccccgtcgccgtggtggtcggggcccagaccccggacgacccgggtgtgccgctggagatcctccccgccggcgactttgagcctgtgtaccgcacgcccctggacgtcgccgcgggggagctcccggtgagccatgggtttggggatgggagctgagggatttcgaaggtgttgggcgaatggctcgtgcctggtccgggcttgatcgaggacagcgagcgaggaggcaggggctgcatccctcgggatggaaggctcgtgtccagccctgtcctgcggcggctttttccgagttgcgaatactgctcagacccctcaatcacacaacaacccaggtcctgccgctgagtgtgtatggcgcgatagccatgacgcagttgcccgccgagtccgagcagaccccgggcatggtctcctcgcgtcagttcttcatctacaaggtgcgatggatgggctggtgggggcgggcagactgctcatgaactatcgcccactcctctggttttgcggggcctggctggctcgttggaatgccgtccccaagggaatggagtcagcaataccgcagctcctaccgtcccgacccttcccaatcaccctccctcatgatcctctcagtttgatcgctcctctgcggggctggcagggctgtcctttgacgagggccagtttggcgtgctgggctacgtcaccaagggcctgggcgtgctcgactctctgggcgagggggacaaggtcgtctcggcccgcatcatctccggcagcgacctcctgcagcggccccagtagtcccacgctcttgcacccctgttgacctcgtcagtctgtttgccacaataaaccggatgcagtgagcatgtcgagggggcaggcgatgtacaaggctgctgcaaccatgcaggccacactatgggagacaacgggaggaggggagggaagggaggggtgaggaagtttcgtgcatgaccaagaatagagcagggttgatcccctcgcaggcttggcctgctgggctcgtgtctgccaaacagagctccatctagcccaagccaagcgattggggtaggaaggaaggggtgcctggacaacccatgctcagtgtcaaagggctagaggtccatgtcgttggccatgctggtggcggcatcggcctccagctccccctccgtgtcggtgttgtatcgggcgccgtcggtggtctggctcagctcgatggccgacttgctcatcccccggcagctgcaagggaatggaaggcagggagttggtcgggaacatgcaggccctggctattcccccatcccacagatggcgtctatacccgcgaggcacatccccaacaaccctctccacctcccacccacctgaagtacagaatgcgcttcgccttcttgttgtagaaaaagtagttgaaggaccagaccgagcctttttcgccaaatgggtctgattccaggtcgctccggtagctgcaggtggggtaggggtgcagtggatgggtttgacagtgctcctggaatgttacatactaggcggcggcatagtatcggcagagcatcgcgccaagcagcgtgcagagcccaccgctgctctactaagctgaaccctaaggaaaccctggcaacgccccacccagatccgcactcccagacctgcctgtacacatcggactccgccagggagatgacttcgtcgatgcccgcccacaccgcatccgtcagcggctcctcgcccagccccggtgtggactcccagacctatcgatgtgggtagaaagcaaatcgtgctggatgttggggtcagtgctaggtaatggagctcaggtgaggtcctcacaagcttttgatccaccccactccatcagcaaggggcttggtcctcttcgtcttgggcgacaatcctcctggcgcttctcagagcacagcctgctcaccgtcatgcattcaggtaccaacataggaccttgaacccccaacccaccttggcggcctccaggaggcgggctgagacaagctcctggatccccaccaggctctcctccttgcaaaagtgctgggcccgcaggagggtgaaatcgtaatcagggtagatgtggttcagcgttaggatgaggtagatcagggtcttgcggctgctcacggggggggggggggggggggggggggnnnnnnnnnnnnnnnnnnnnnnnnnnnnnnnnnnnnnngtagcgcaagtcaggtctgcttcggatgaggctaacggcatgccagggcgctagagcactggtgtgtgggtgctgcctctgggcactgctcccagtcccatcagtccacgaaccagcatgttcggccaccctaacggcagcccctgtgcacctgctggagtccacgagcgggcccacaggagacttggacagctcagagggggaggaagactccatgacctcttcctccagactcctgctcagcttcttgtccagccccgcaagcttacctgtaatttgatggcaaagaagggaatcaaatacagcgtgccaccctcctgagccacccgtcactgcagccaggccccagcagagcgcccttgcaccctagagcaccagcaaacaagcctgaaaaccaccccacgctgcctcctggcgcacatgagtaggcctccaggttgcccctgaccatgaggtcgcccacgtccacattgtccaggaagctattgattctgcaaggggccagcggtccgcgtccttgtaggtgatctggctggaacattgcatgccgagcagtggcaggggcgcctgttgggtcacctcgttagggttggaatgtcgaggtatttcatggcgaggtgctgaggtggggtcaccagctctgctttatacaccgtcgctcccggagagacatgtcggatgagattcagatattctggtgatgaatcaagtgcgcagcggggacgcacggggccctggaggggtgtgctagatgggcgtggcacctagtgtgaacgccaggtctggtggtcagggcaggtggcccggccaggaggcgtatgaagaattgaagacacgcaaaaatagtcttctgaagaatcaataggttcgagctgggcaggcgatgtcgggccggatcgaattatcctcccctcggaatcgtcactttcccgtgacaccccaggtgtgttcaaaaggacgctgctccacaggggtcagtaacaacggatcaccgaccgcggctcctcagctgggcagcgaccctgtgcacagcacatgcaagctcactccgcacttcagcttcctcgcgcctcctctgcggcggcgtgcgccggcccacgcagcttgtcctgtcgctgcgccatcagcttcagccgggcttcccgcagccggcgccaggccgggtcctccgcctcggcgggggcctttgcggcgcaggccgccatcacctgctccaccaggcgccggcgctccatcttctcctcccgcttcgcacgctggcggctgcgctcctcggccaggcgcaccgccctccgctgcgcgcggcgggagcccctgccggagcgaatggcggcggcggccacgccatcctccccagcgtaggccgtccagctgccgtacacgcccgcgtccttgatggggcgcagcaggcgcggagctgtcatgcagggctcgctgcagcagcccttgagatgcgtctgtggcaggggggggaggagggggaggtgtcgtgtaaggttcggagggtgggcgggtgttcacgatgcgcgcaggcactcttgaggttgggggtgattttatacttctgtccccttacatcccacggatccctcgcaggaagctggtgccctctctgcgccgagccaccgactgtcctcccctttgagaccttaccacacgacgttcccacaccgccccaaaaacacacacacacagtcaccttgcaggcggggcaggcgatgaagagcttgttgcagtcgatgttcgcgcagttcatgtgcgggagcacggccgcgcccccgcacacctggcacggcgccgcggcggtgagtcccgcctccccttcctcccccgtcgctgcggggctgggggcaggcaccgccatcctggagtcaaacacatagagggaccccttccagtgctcgcccacaccggcatccaggtaggactggatgccgccgtcgagagagtacagattgctgtacctgcgggagaggatgcatgcgggtggtcgatgcttctgaggaacaggcggggccactcaaggtggaaagtcgagtgggtggagccgtggcttcaggcagccaacattgttgtctcagaattcgctgggcatacacggcaaactcagcccctggtcactgcaccacttcccctccatgtcttgccccccgcagcccctcacccctgggcccgcaggtgagtggagtagacgtcgcagcgtatgccgccggtgcagtacatcataatgggggtggccgggtccacgccctccaggtggtggggcagcggtgtgcggctggaggcggtgggcgtttcccggaactcgtcctgtggaagggcgcgcgggggtgggggtaagcgtgcttgggtggcacaggtctgcctggcgaggtcgggtccggggcgttgcctggccgctcgattgaccgggcccccagcggtcttggcaacccgacagcccccggagagtagccaggccctcaggcctttccccgaaccaccccccgcccccacctccaagggccgctgcgctccctcaaagtgcccagcgtcccattcataagagttcctgacgtccagcacaacaggtttggtccctgaggattggctctgtgcctggcacggagcggcaaggagggagggtgggatggttccactgctcccatgaaaggtgcttactcaggcccgccgcagggtccgagcaggggtaccctcatcgcccatgggttgagcaggcaccccccccacacccacaccccagggccggcaagcccacctgcgccagcatctccttccaggccagggggtccaagggtgtggcacgcgcctgggcatcggtcaccggcgccgccgccatcccccccgccaagctgatgaggttggggcggaacttcagcctgagccgggggaaggcatggtcgtctgcggggtacagcttgtaccgcaggcccttcaagggtgcatggggaagagcagatgatgaagggaaagaggggtgtcgacctctatcttggtctctgggccggttgggtgggccaccgttcgccgcatcccccctggattctcccccaacggtgccttgccgaccgagatcttctacacccacaggaagcggctgcccacgagccctcacacacctcaaagagggactgctcctgtgccagccactggacgtatgccacggcatccgctgtgacgccgccacactgggcgttgatgccctggtgggagatgtaaatgcggccccgcacctccctgccctccaggaaggcccggtgctgttccagcacctcgtgcggtctggggatgtccacgaggtgatagaagttcaggatgcagtgggaggaggctggtggggtagggttgccagggcgggcttcgctgggcgcactcgctgcctcatggaccgccctctgtgtgacgctcctgagactgcagggtccaggaacaagctgaggcactcggacaaggggcctggcttgtaccaagctccaggctgccagtctgctccccaccacgggggtctgagaccggggcaaaatgcctagcaccctggcgacgcacaggcgacaggatcgcagcagcatcccgcgcccggcctgcacatttgagtaatatgcatgctgggtaatggcctcttctaccaaatgactggcaattggagacggcacgtacatgctgccttagccgcatcttaccatggagacaggcccgctgtacctcgcggagggacccttacggcaatttgctcgaccgctctgctacagagcagctacatttgcttgaatgaaatgcacgataacggtcacattcggggtgcatgccaggaggtttatgggattcacgagatcgagtagtcgcatgcaggtgcgcgcgcaaatctcactggggacgggggtgccagtgggtttgagggaggacatactccaattgacccagatgccgtccttgctgcaggaaatcacctagtgcataatggacggaaattcagtgtgtggacataacacggagactgttgggtccctgcttccacattgataccgactggcctgcatcaagtccttggtggagggcacgccccacacgtttgaaggcatgcgttcttgatgtaccctgtgcagtggaggtttaagttgctgattcacttcaagcggctgagaggggtgcgcatgcaattattgtataccacgccctcatccaatgcgcacctttgctgcaatctccagactccttgtacatgctgcagatctcgagctccagctcgtcgctgcagggttcagttgcatctgccgcaacctcagcgtaccctgtgcccgtggtgcgcgcatcgggaggtcatggtcagtctggggtggtgcaggggcagcagcaccggctcgacacatcgaggtggggattcaacgatgtcctccagtcatttctcacctataaaggagtctgcacgtcccccatcgcaacctgcgagactcagcagcgccagtagaacgatggcggaaaaggcccacctcctcattccgtgggttttctgctgcctcgcatgcctcaggcttcgaggctggagtagccctgtttatccagcgaagtgtacagaaagtgtgctctgacgattcgacggcatgcttttcaaacatatagccccagcctcatctcatgtcgttgtgcggtcctgcattgctcagggcgcgagaacacacaggagggacttgcacaacacattgctctcaagggaagacgatgttacaagattgaagcctacaggggggaaatttaacaagcaggcctataatacaaacaaggagtacaggatgcatccgactatgtgcggtctgctgcttcccagaaaacgctgtgtgggagagggggcatgtgctgccctcctgtggtcatcgagctccagcactaccccgggatgaagtagtccatctgggtgactgggaggttcagggggctcttgtgcgcctgctggtacgacacaaacacaaaggggttgagccccctctggaatggccgccgcccctcgccagcgccctccccggcctcgccctcctccaacaaggagtgggagctgccctccaccccgtcccagctgaagaaggagtccacggccaggcggttgttggccccccgcaccgtcgaccgcagagtcagccgcgcgcgcagctcagtggcccggctgtcgttgtaccgcaggctggtgtgcaccgtactgccccgctgcgcgtagcgccccacgtacacaactggcgcggcgccggccttggcgcgctggtcggggtgggtcagcgagcgcagcaccctggtcagcggctccgggctggtgcggtacacaaacgtgcctgccggggaggggagggaaggggtggggggggggg

SEQ ID NO: 24304 - DNA, 76 bp, Chlorella protothecoides
cacccagctggaggtgggatcgctgggcagaggtggaggtccgagcggcttgcaatcgattcctgcggcgcacagc

SEQ ID NO: 24305 - DNA, 70 bp, Chlorella protothecoides
caggttgatgttggactcgaagaaggactcaatggtcccaatgtcctcccagtagccgttgaagaggtac

SEQ ID NO: 24306 - DNA, 61 bp, Chlorella protothecoides
cggaccagcaggtagtagagggaaccccagatccagaagaagagctggtagatgatgaaga

SEQ ID NO: 24307 - DNA, 61 bp, Chlorella protothecoides
ttctttggagcttgattttgagaagctcgctccagatcatggggttttgattgcccgaggt

SEQ ID NO: 24308 - DNA, 136 bp, Chlorella protothecoides
cgccaggtcatcgcttcgctggtcgtctccatggaccccacggtcgtgaacgggcgggcgaagagggtgagcgggccgctggcgggcctgcagctcctcctgctgcgccagctgcaggcggccgaggcagcaatgt

SEQ ID NO: 24309 - DNA, 61 bp, Chlorella protothecoides
cagcttctcggcggcttcctggggtggaggtgaggtggacaaggggtggagggcccgactc

SEQ ID NO: 24310 - DNA, 70 bp, Chlorella protothecoides
cggggccccagttcagggcgcggtggtgatcggggtcctagcacccaaccccggcgctgcgaggcgccgt

SEQ ID NO: 24311 - DNA, 68 bp, Chlorella protothecoides
gatgtgcttgcagatccaccctcttttgagacctttgccaacctggatcattctgcccatcccccccc

SEQ ID NO: 24312 - DNA, 66 bp, Chlorella protothecoides
tgcctgatgcgctgtgcgggaagggaagcacggcccggggagcgccaagaccgcatacatcagaat

SEQ ID NO: 24313 - DNA, 170 bp, Chlorella protothecoides
cgcctgggtggggcggtcgccgtgtgagtgggagggtgcgggggagagggggtggaaggcagcgcgcgcgatgcagagatggagcacggggagggggggatgcggagtgaggtgaggcctgcgcaggatcctaggcgcccgctgtcgagcagctgggcgagggcgataac

SEQ ID NO: 24314 - DNA, 77 bp, Chlorella protothecoides
cgcgctggcgtggccatcttgagcgtttgcgcggggaccgccggcatactcgacgctttgagcgcgaatgtaggcac

SEQ ID NO: 24315 - DNA, 61 bp, Chlorella protothecoides
tgcatattatagtccctaagttattcggttcctaataatgtgaaggtcctcccaagtataa

SEQ ID NO: 24316 - DNA, 161 bp, Chlorella protothecoides
ccaactggatttccaagcaacccccgcccaattgtcccgaggtaataactcccgaggatggagctggccactgcctttaaattcgcgtgccacagggtggggccaggcctggcctggtgggtaccctcgtcacatctgtcactggccactggacagcattc

SEQ ID NO: 24317 - DNA, 62 bp, Chlorella protothecoides
aggggcagtctctgctttgagcttcactttgtcaaagtctgcctgcaccttccaatcaccct

SEQ ID NO: 24318 - DNA, 101 bp, Chlorella protothecoides
ctctgtcgaaggtccggtcgaggtacgcccacaaaagttgtcgaggcttcgaaaggccaaggtgagggctcccatccccaacgacgaaaatgtcgcacaca

SEQ ID NO: 24319 - DNA, 115 bp, Chlorella protothecoides
taggctggtggcctgcatgggtgaagggagggaggggtggtacctgtgcgacctgagtgttgcagggttctgagactgaagcgggtcgaggctgatgccgccgaggatgaagggg

SEQ ID NO: 24320 - DNA, 214 bp, Chlorella protothecoides
aacggaggacaagatctggcttggtatgggtcgagcggaagggtatgggagggccaggtgtggtcggcaaccgcggtcctggaactcaatgctgcatgtgtatggcacagcctcatggtcctgcaagcccccactcatacacacacattcgcagtgcgcggacctgggtgcatacaaggccgctctgccctggtggaagatcgtgctggcgggc

SEQ ID NO: 24321 - DNA, 80 bp, Chlorella protothecoides
atgcttcagctccagctcactcatgcgcacagcagacgggctagcatgagtgcctgggtggctcactgacaggggcgggg

SEQ ID NO: 24322 - DNA, 156 bp, Chlorella protothecoides
tcggttttgatgcttgcgagacgcgatggataaatgggagcaaatattataaattgtgggtgaattgtaccctcgaggcgattcctttagcagcctgtcgtgacccttggcctgtataactgcgatttgccctcctcctccaccagctacccccat

SEQ ID NO: 24323 - DNA, 136 bp, Chlorella protothecoides
cctctgtgcatggctgctgaactttgctcgccccagatgtcctgctggggtggaggggattcggccaaagctttcccactgccatgtatggcaatcaggattcacattccgcaattgagccacccctcactcggtc

SEQ ID NO: 24324 - DNA, 3867 bp, Chlorella protothecoides
  modified_base (1673)..(1717): a, c, t, g, unknown or other
ggggaggggggtggttttggggcgggaggccgggggctgggggccgccccgacgtgtgtgtgtgcggaatgtgagctgtgctggggtatggtgtgccgatgccctggccctggtgcccaatcccagcatcactgccactggcgatgcaggactatggcgcgctcacctggtcgacctggctggtggccgtgtgcatcctgtggtcgcccttctggttcaacccccagaccttccagctggagaggtgcgtggctgggtgcaggaggaggcggagggggagcagggcgctgccctgcgaatgtcaaggctggcagccagcctggccccgcctcccacgtcaccgcgcaggtgcaaggacgacttcgaggcctggatcctgtggatgacggatgtgattgacagcgaggctggcagcacctggtgagtcgggtgcactgtctgggagagggaagccccggcccaccacctcgacacccagtctgcgccgtgtgtggtcagcgtacggtgggtccctcctgcccaagccccaggcatccttgccctgacgtcctgcaggggcggacccctgctcccatgatgagaaattccagacctgatgttctggggatggtcggcaaccctgcgccccatcccaaccccaaggctagccaatgatctgaccaccatctcgctgacgcaggtactcatggaacaagtccaacctggaacgcatccgcaatgagaagatgagcctgaacaacccgatggccaccagcctgcgtgggatcgccggggcgctgccgaccgccgtcctcgccctcgccgccatctccaccctgaccaacaccagcatcaaccggtgggtggcagggtgtggtggtgatgttgggaaagctggagagcggttgaagctgggacacaagggcacgtgtctacacctggtgcgactccactcccggactcgacccctgcacctgcaggtgggtcatctttggcatcgcgtcagggggcttctggacgttcatcctcgtggtgtgggtggtcaggcgcgtgctactctccaactactactaccggctctggagggcgatgcgcacgttctgtttcctggtagccatagccttcctggtgagtgggagcggggtttggtggcttggccgtggtcagacaacgcacatcgcctgcaggaacgcagtatgctcaggtgcagcctctcaccaggagcagcacctcgactgcaacaacctctccccaccctccttcaggtctgctgcgtcatcttcatcccaggaggcttctcggccggggtcggggtgaagaacctgatcatcatcatcttcgccaacatgtctgccgtgtcggtggcgacacaggtcggtctggaggctactgctcccgcatgacagggatcgggaggcaggggcagggaatgggggtgatgcaagcactggccggcccatagcagcctgcttggcacccccgaaatccagcacccctaccatgtgtgtctcgccctccaccccagatcctgctgtatggttgccgagactccatcatggctcggcacatcgtggatgcttcctacaggtctgtgctggcctgctgacacggaggcttctggtccgtgcagactcgcacatgcaatgcaatcctggccctccgccaatcatcacctccccccccccccctccctnnnnnnnnnnnnnnnnnnnnnnnnnnnnnnnnnnnnnnnnnnnnnatggccacctaggacactggactggatcctgggttacattttcttcagcttcctcttcctgttgtccttcatccaagtcgtcgacatgctgcaaggagccatgctctacaacatgaagttcgccaaggccttgcaggtatgtgccagggtcccccgcctcccttgtaataatcccatccatgcccatgctccccactgccccaactgtggtcctcgcccctccccaacacacagcgctctcgcctcatggaatccaatttcctgcccagctacgtggatagagccatggagcgactgtcccgtaccctccaggaggagattgtggtgaagacccctccaaggccgaagccgacaaaaggcatctgagggccccgcattggagatgagatctacattgccaggcgtcatgcgccgtgtcactcaggccggtgactgaaccgttctgctttgaagagattcttatgccaatggctgttcccttgggacatcaatcatcctcggtcacatgcagtacttgcgctaagcatgactctacatggcttcaattcgtgctggtacagacactgacattcaaaccccattatgcacatttaatctttactaaagctcacagtatgcagagaaagctgtgggatggcttcttatcgagatatagtagcaagagctgttggaattccctttgatcagatctgaccgcgcgcgctgtctcggaagtggtggtcgggggaccagatgcccggccgggtgctcgtatttctcactcatacgttggaatatgggtatatataattccaataaactatcttgctcgcatatgctcccgaggactgcatgaggcggggaccttgcagtcatggacgcattcgacgagagcttgctcacagacagcgacggagaggatgacaagaatgtgggctggatggggaggatgcatgggaacagcaagcgttctccgcctgcatgccctgcaatatacccgcatgcgtcatgcatgccaggccatgatgcacgtcccatgatctctccacaggcactggctccagcgtcaaaggagcagctggtcttcctcatccaagggcacgagagtctgttggagcttgctaacctggaagacgaggtgaaggagaggcattctcgctttccctggctctagcttaggaagtccccgggctgcaggctaaggagaccagccccctcccctgacacaaactcacccttcaggagtttgaggggctgacatggctgcaaattgcatgccgcgtagttgctgccatcctgcgccagaaggtcattgcctctggtgccgacgaggtggcatgcatattcttcaacacggtacgaggtctggtgggttgttttcgacagtcaaccaattattaggtgagccctgcacatatctcagagctccatatcttgcaccgtctgccctttgctgcctgcagaagcagtccgtgcgtagcactggtgtgggcgacttcatccatgtcttgcaggaccttggtcagccagatgtcgagcgtatccagcagcttgaagccttcgacggtgaggaggtgggagcgaggtatatggtgcatccacctcaccacgctgtccagagattgtggaccctctcaggactcatgatgccgctcctacattccatgcgcagtgccccttttccggaaagaagtcgggctcgctgaggactgcgcgactggtgctggtctgaagaatgccctctggcagaccaacctctggtttggccccctcagtggggcccgtgtgtcccggcgcatcatctgttttgctcccggggccgcccctgcccaaacaggcacccaagtctggtgcgtggatggaagtttcaggaagtgaatgcctgagcatgggggaccttgacggcgcggaccatgaccgaagtggtcactcaggcccctgtccctgcaatgtcgagtcggccacgccaacctgggttgccacgtccccaccccacgccgccaggaagggactgctgcgcaatgtggaggaactggccggaaagggagtaactctccaggtcattcccctgcagcgcccgggctccaagtttgggtttgaggctgtgtggcagcacatctttgacaaggtaccggccctagctgggggggttggggggggggggggggggg

SEQ ID NO: 24325 - DNA, 80 bp, Chlorella protothecoides
ggcatgcacgaagcccttctggatcgacccatcgtgcaagtgccggcgctgtccagaggcggctggagggcgccgggttt

SEQ ID NO: 24326 - DNA, 65 bp, Chlorella protothecoides
agccaccccaaagacaaggcaacaatgcaaggccgttttcacccaccctctggcttatgatatcc

SEQ ID NO: 24327 - DNA, 16834 bp, Chlorella protothecoides
  modified_base (12537)..(12546): a, c, t, g, unknown or other
  modified_base (13978)..(13987): a, c, t, g, unknown or other
  modified_base (16312)..(16452): a, c, t, g, unknown or other
gcttggggaggggctggccacagggctgggactgggagaggggctcgcactgggtggggacggagacgcaggcgtgcacctgccacaggtctgcgcgcagtagtcaccggacagcatccatgactcactggtgggaggaagggttggagttggggtcagtctttcaaatacacgaacaaccctgcccgccagcagacggcagactatgaatcatcgcccaatccaagttgacatctgctgctccaagcctccagcacaggcaagacaatggccagggcccagcgcatgcgtagacatgccatccaggcaccacgcggcgtacttgcacttgccccagccggcttgctgggcacaggtgtagtcggccgagggcggcacgtccgtgcaggccgggggcgccggcgaggggcgcgggccggatggcgaccgcggcgaggccggggggctgggggaggagacgaagccctcgggcagccaggcggtggccaggggggggccgggggtggccacggcgggcgggatctcgttggccagggccggcagggcggtgaaggaggaggagaggctggagacgacgttgtaccacccgctgaagtagcgagtgccagggatgaaggcgcctgccttgctgaagaacgagtcctgcggtggttgggggggacggcggtgtttgcgcagggtgctgagagggttggtagaaccactgtcgcggcgcagacgctgcaggacgcgtttccagagcaggacgcaggaagcggggcgttcccagggacactgtgcggcgtacaagatgaacaccagcgcccctcacctcggtctcggcatcgccggggtcgaccaccttgatgtacaggtaggtgcctgcaaagacgagggaagggagggttcccgctgcagatgtgctggcaccctcgacgcaatgcacacagcttccagcctgccatgactggagcgtgcaccccctgccaccagccccaggcccttggggacaaatcaaacatagcccacgcaccatcgaaaaagtaggtggacatggcattgctgaccagggcgctgagggaggtggcagcgccgatgttcacgttgttgccagggtagtactggtactgccgcgagatggtgaaggtcgtgcctggggtggatggaatttgaggagggggggtatgggtgcacatggctgggcacgtggaaccctgatcacagacactcaagaactgagtgacctctgtgctcgcacctgccgggtagcgggtggcaaagatgatggaggtccccttcagcagctgcgtcaggtacagctggaaggtcttgggcgcgccagagtcgatgtgggtataccacccagtggtccctgcgcaaggagggcggaggcggcgtcagcgggaggcaggcgcggggaacctggtgttcacagcgccgtgtgtggtcacatctccggatcttttgccaggccaatgcccgcgaaccaggcaccctgcagcgtcttaaagccaccccgccctcacctgtgacaccggtgatgccctcgttcctcgttatgaccatgctccgcgccgccgtgccctggtacccaaactgggagatgaagccgatgtagttgctggggtcgggggatgcggcagtgcccgtgccccactggttggtgtacccggggatgcggaactccagccttgctgggatctgggcgtcgcgctgggggcacgtccacgtgttccagttgctctgcaggtgtcagggggggccacgatgtggattactgagccagcactgaaggcggtggaagggggtgtggggatgtgggcgagccagcactgcaacaattgtcatggtgtggtgcgtcgggggtagacacttcagttctcctgcttgattggtaacttctctgccagaggtgaggggcgagcagaccaccttgcaggcgactggatggacactcctctatcctcggtcccacacccctcacctggaagaagcagtccgacgccaggttccaccaggtaggccagccgcccacaatttggggtccggtggacagcgtgacgctgccatcccagtctgcgagccggagacgaggggttggtctgggagtggcacgagggagggggtgggcaggcgccgcagagcaaggacccgggtcgacaggatccacctcacccagcagcacgccagaccccccacgcctcctcaccaatgaagttgaacatgcgggaggcccccgtctgcttcacgtccagccgcatgatggcgtcgtagtccacgttgacgtaggagatgtccttggccaccgacatgtacagcggcttgaactcgtcgctgtgcgtcatgctctgcagggaggttttgtgggggtggagaaagtgaggagggacgagtgtgcgagggttactagagcgtcgacagagaggaaagccagcagaatgaggtggactgggctcctggccaggatccatgcactctagtggagcgcgcccatgcatcggctctcctgcccctcgacccccagtcttcaagatatcctcctaagacaccatgctcacgtagaacacgctgggcctgaaggtccccaggctgggctggtaggtgtagtttgcaaaggtggtgtcggcgatgatggtctgggtgctagtgtcgtaccactggaagccggctgccggagggagatcggcggtggcccctgggaacgcggagttggggttggcagaggagtactggatgtacccgtcctggatgagagcctgtggggtgggggggtatgagaagcatgtagattgagatgcagagagtctactgtgtcaaagagatgggccagcgcacacagttgccccatgcccttgcagtcagagatccaggtacgaggttcctgtaccttcccaaagaaaatacgtaaatgctcaccgatccaaacatggtggccccgcggacgatgtcgtacgcggtgtagttcaggagctgcatgcgcgcgccccacgacatgtgccccgacatgcacaggaaagacttggtgttggtgaagtccatgaagcccttggtgacgccatccagggctctgtgcagggggcaatgtgtggttgggggggggttgagcatatgtacagtgcattcagagtctgaaagatatttcacctgagaggtggtcgacttggggccagcccaacgtgtccaagcgacttgctccttctcatgcaacacttgtctccatcgtccccatctggccgacccgaccgcacctggtgtcaaactccacgcggccagagtagtaggtgaggtcgttgccgttgtagtacagcttgccgccaaagtagatgcacccagcgttctcccagtagtagcctggccagggttgagggaagtgtgggttcaagaggtccaggtcatgcagtcagcgcgtcccacaatgtcctgacggcacggcaatggcgatgcagagggtcgagcccatcagagaccagcagtggtctgcccctctactcagcgcacaggggggcagcgcgccagcatccccccccatccactcatccacatctgccttcgtgcctgccccaccccgccacgcacctgagctgtgcgccgtgttggagtcgaacttgagcagggggcgctgggagggcaccagctgcgtgctcctgctcagcccgatgggggcggggaggaccgggtaaaagaagccggagtagccgcccgacgcggcgttattggtcagcgtgttataggggttcgtgatgtagaagccggcggccgagctgtcggaggggttctccaggcccgtgcccgaggtcgtcagcgtcaccccactctggtcgatccccgctgcgggctgtggtcagggcggacgagggattggtggtgaggtgctcggggctggatcagcgtccctgtggtggctcgccacgttcctgtacaccagagacggcccagccgccggacccctcccacaccatcgccatcaccgtaacacccaccgtccccaggatgttgacaaacatggccaggttgcggtcgatgacgttctgctcctccacgccgtcctccaagtagtagcagtgcccctgactgttgaacgccacgttgttcttcaacgtggcaaagctggtggcatgcaccacgtagcaccggaagtaggacctgtgcatgtgggtgggtagatggcggccatgggaatgtggtggccaggctgaacctggaatttgctcgatggatgcccggcgacttcctacgccggtcccgacctccccagcctcccccttcccactcacttgtagacactgttgtccgacagagtcatgccggccccgttgccgatcaggtggtagtgaaaggggtaggcacccatgacgttgtactgtccgccacgatagacctggtggaaaggaagggtgaggggatgtatgcgctgggaccaggctccacgacggcggatgggagcatcatcttactccataccaggggtgaggcccaggagagcagttcccgcgccacgacgccggcttcccactcatgcaatggaccccaggtcacggcacaggggccaaacgacgatgaccatgcgcagcaggcaagtcacggtgcgcgcacctgcgtcccagagatgctgccgccgccctcgatccggatgtgggggcccagcttggtggagtccatactggcctccccagcgatcaggatgttgcgcgagagcaggccgacctctgcctggtattcggcgcccctgggagcaagcagggacggaagaatcggggcggtgccggcgtggcaaacacacacagggcccctggtgttggcagacagacccaagtccaccacaaggcaccctcaatagcgcctgccctgtgcagttctcccgtctacccacccgtagtggtagaactgggtccctgctgtcagggtgagggtcttgccgtctgcagagacagattggatggtgcggacttcgttctggttgttctgggcgtccctccagatggtggtggagatggccacttgctgccctggctgccagtttaccgcctcctgcggggtattggggccggaagcacggcagggattgagcgtctgtgggttcttggtgggcacaggatggattaggagactcctacaccacactccagcgttggctccctcgtcggatcgctgaccttgagggtgacttgggtgctgcctggggtgatggaagcccccagccgggtccaggtgggcgtgtacagcgcgccatgcagctggatggtccccccgggtcgcacgcgaatgccaaagaggaaggtgctgatcccgttgacggtgtggaacaggaaggtgaggcgggagttgaggcggcaggttgcgctgccaccgcgcagggcaccatacacgtcgatggaccccaggttccacaccagggtgttgtcatccaggatgagctgcgaggggagcgggacggcatggaagttgggaccagaggatgtgcacgggtaggaacggcgcgagcatggctctcaccatctggagtgcaaccctgcatgtgcccctgcgaccagccaccgggtcccagccctcccatgaggcgcatggttccgtggtcatgcccatgctcacctcgctggtggcagggatgatgacctgggtgtaggtcgcggtggcgctgatcatgcatccggagagtaggaccttgctattggcggggagggtgatcgaggtgccgggggaggggactgtgccgccccaggtggcgggatcgttccacctcttcagaccgctagccaggaaggggcagtcggtgcgcccatcctgtggcaatcgggacaagggacatgatgagttggatgagatgtgagccagtttatggttgctggcgatcgccgcatgacgcatcccaccctcaatactcaccgctgtcggggcggtcgaggggcaggtcggggttgggtacgtgggatcggggtagacggggtcggcattgatcaccacctcgcccgctcccatgcactcgtcgatggatgaatagattccccatcctggtaatggaggcatggggggtggagaaggaatggggtgccggggccacagtgcgatggtgtggcccaccgtgcatgaaggcacgtggtcagctgacggcagcttccccgtcttcacaatgcggcagcgggatcgcccgatgccaatcgaacggcaagcagggcggtgcatcaggtctcacggccattacctcggagacagatgttgcagttgacgctgccataggggtccgagggattgcaggtgttggcgacacagccgcactgccgggggaagaggttggtaacaatgatgcagctgctcaccccgccggggcttgtgaggctgtccacggacacagtggtattgcatgtcggcacattgccttggctgccgaggccaagctgggctgaggccgaggaaatgagggccagcagcagccccgccaccagcgtgcagggtggccggagctccatgatgaggctttgagatgtcaagccggggcccctgatagttgcatgagcttcaacgctgggtaattagtgatctgaatgttaacaatgcccagaaccggggcgtttatagccctgtcgggtgagcccatgccccggggggcgagctcctgttgtgccgaccaaattcaaagtcgggacacctttcacacctcaccgcgttcggtgtgttgttatcgctgctgggacacgcaatagtggcggggcacgccagcatcgtcaatacaccctggagaatcacgagctttattctctgatatctaaaagctacctcatattccaatagtacgtcaagcggcaccggcggcggcgcaccctcttacggcggacatgaagccgggacgcaccatggcaacgcaacgtaaaaaccgaatccaccggccgtaaggatctcgctttgccagattgctgtttggctgacacaggatccggatcgcatcaatgtgacgctcttgactggggtgctccctggtcagctcgtgttgtagattgcggtggacccttcaacagtcctgggtagcgcaggggcagctgctgaactctctgctcagggtgttgtgaaccccgtgctgcacaatcactacatgacatcctgacctgtttgtgtggggtatgagctcaaaaaagggcacccgaggagtccatggagcgggacttgtgtgctgaccctaaactggttgcggtcggcagttcccaattgataccattttgatcaggtagggatacacttgactctgaatgcattgccacaccagtcacattgcctgctcctgcgcccatatgatgatattccactgggctgagaatgataggccacccagactgcattgctgcgaaacatccgaaatggtcacttctctgtacaggattttggctggattcgttgcaccacccccacaagccacatcagccctgaagaggctgagctcgcttggtaagcgtgaggctaagggacctgaatcatcacatcaggcaacacgccattgagcgagcgcaccgcacatgcacacgatttggagaccgctcaacctttctgacgtatcaatttccaaccaaagcgacttaatactctcaactttgtcggaaggagtgaatgctgcttgagggctggcgcgtggcactttacacgccacctcctgccctcacgaaccaccagcatgcccatgcatggtgccgcgtcctctcccaggggagttcaccgtgcaggatggcaccgttgcggtgtacgtccgccgctgagcctttcggcgcccacatggaggacccgcgaactcgtcattcccttgcccaagccgggctcgccatgcgtgattgcatcaagattggcaggctcggcgcgggtgctggaacgactaaccagattcgcctgcgctggagaacatcagaggtgggctggtgaagagcttgcatttcgggacccagctgtcgtgcagctttgatcccttcggccgatctgtcccgtaagtcccctcaccctccaggtggtcaggctacgatgtgctggcaagcctgctgctgacatgaagtccctggctcaggcattggaaactgccactggtgggcaggtggtgtaccggtcggggggcacaatcatactgcatcgcggtcagcactggcagtcaggagcccttgcacagccactgtgctctgcagagcctgtagtgctgcaaggggtctcagacgaggaggctctatgcaatcaagccatgccagcagacacggcagatttgcctggcccgcaatcagcgacctcctccctcgctggcttgctcgcctcaaatggctagcttgcccaaaccctcctccgctttcttcttggcagctgccgcacgccgctttgcattctttgccgctgctttgctcagctccggtgtggcctcggctgtgccagaagacatggagggtgggaagtgtgttgtcaggcttttagctggagacggacatctcaaattgtctcctcatgttggttgtgctgttgtgcaaagctggggtccacatgtgaggacatgtaagaacagacaccttcatgggaagacaagatacacatctcaggccgcaaggcccatctgcaacagctttcaggtagcgtgtgggacctgtggcacgtcctgccgcacccagccccaactcccaaccccgcaccccacctccgggcggaagcgccggctgcattcgagcggccgctggtggggcgcccaccaccccgccgctggtgatcttgccccctctgtcctcggcgtcccgcgccagcgagaacttggagcgcgcggcggcagcggccgcagggttgccgcgcaggtgcgggggtacataccctgtgaccgccggcgggggcggcaaggccggctcggcgcccgctgcaccccctggtgtttgaaggggcgcgtcggagaacgaccccggcgcggcgggccgccacgctgcctggagcaggatgggataggggcgggccgccagcctggcggcatctgcccggaagacctgaattccgttgtcgacgcgcagccggggcgcggtggtggaaaccaagaccatgtggccgcagggggaccactccagcgccacgccgttttcggccctggagcaggaggccaggggagtgcgggagactaggtggtcgctggcccacaaacggcctgagtggaatcgggtccagtgaatgtagcacgatacagctgggatgtcaacagagcattctaccttgtcaaactgagcctgcccaataacctgtacacatgcgtccccacacccccctccacgccatgcacttccagcctcacctagtggtccccatgggcttgcacttgccatccgccttcttatcataaaacgccaggtcgccgggcaggttgccgaacccagccagcacaaagtatcggccaaaggggttccaccggaccatggagaagggcccagaccctgggggggccgaggacgtacttgtgtcagggaagaaacctccccagcagcgcgtgtaggctgtggggcaagtcggccgcctcacctgatgggcggtgcacagcacccaggcatgctcgtgccccaccattaaatccaccagttcagctcacccaggtcgaacttggggacacacgcgctgttgaagagaatgaccttggcgggcatgaagcctgccaccacaaggaaaaagttgcccttgggcgaccactggacgtcgtggatggggccctcctttaccaagggggtggagggggcacagaagatgaatctatgtttgtatgcaagtctcaggcaagacgtggtctgagacgaacaccactccttccagacatgcttatcccctgttaggcgctttgacagggaatttttcgcgccacacccgtgattgtcaaatggatggcccttaagcctcggcttccactggcaacgtcaggtttcgcatgcaatccactgactgcagatcaacctgtggcgggtctagcatcctgcgacgacatttgccacccctcaccctcttacgctcacacctttggcagctggacagcgcactcgttctggccattggacgccatgaagtagagcttctgctccccgtaatagctctggttggtggcatcgacgtccgacgccgccagtgccagcaccgcacatccgctggggctccagaggagctgcgccgagttggactgcgagtttgaagggagcatgaggctggtgggcacaaaggttcccctgcctgggatgtacaaagagtgcgcagggtctgatgcagcaagggtccatcccaaggtcagccctcttgctcctgcacacaggcaatgggcatggcctgccagtggggagggcgctcccacaaatccccggatcgccatccctttcctgcacccttgccccgcgctctcctgtgcctcacccggaagaagttcttgcggcagatgggcgtcccatctgcccccggctcggcagagtagaggcccacgctggcggggctgcccttggcctccgggcagtaggcggcgagcagcgcgcccccgccgccagacggcctgggcgcaaagctggacacgcccttgatgggcacgcggtgggtcacgcctgctcgagcgtgtgtaggaagggagggggggtgcacactgatgcgtggattgcccgggcctgtttccctgccccagcacacccccgtcacacagccctatcaagacagctgcacagcagcccctctactcccccacaccgcaaggtccacaaccaggcgcaacgcccgagggccacttttaccacccccccaaacaagaaacacctccgccctctcaccgttgctgaagtccgatgtgtcgtagacgtgcacggcactggtgacctggtagtaggccagcgcgtcccgcaccccaaaccggatggccggccattcctcgcgccgaaagtgcttctggtgcagggccaggcgcacggccccgtcctccaccccccagagcttcaggttgcggtcctggtcgacgtccttggccggccgggcctgggtcagcaggaagcggccatcgggggagaaggaggccgccagcgtgccggggctgggcagggcatggcgcagagtccggctcgcggtgtcgtggatggccacgccagacggcgtggtcagcgcgaagagcgtgccgtcggggctgaacaccaggccgctggagtcgccgctgttgtgagggtggaaagggggttgcgtgtccagctggaggcatgcatgcagggtgagcatggacggggggaagctgggcgtacagacagctggacgaaggtttcggtgacagacgtgcgaaaccaataattggtttcaaaagttgatttggatacgcagccccttccgatcctagccagagcacttcaacctggccatggcttgcctatgggtgtggagtgtctccagggaggacgtgccactggacagtacatggatctcgccctccgtccggcctgcgcggggatcggggagctttcaatgtcagaccatgcaaaccatcaagcgcgatgaatgcaggccgagacgagcagcccaaaggcgcacagtactcacagaaaatctcctgctcggcagccatgctcctgaatagccttcggggacctcgactgcacaggcggtgtagttctggacgtcaagacctggtacaagtcaccaatactccattcaatccttccataattaacgcatcggaagtgttggagcgagaagaacgacatctctctagcgcctcgaagcaacccgcgacttcgcgccctgtgaccgtgtcatgaagcagtaaatcccattgccccatgatcactgcattatagaggatcccatttaccaggtcatagctgccgtattgccatcggtttcgcaattttgcctgaaaattgaaaggggcgcacgaaagaggcgcatcagctcgtcagcggcgaactatggtgccttgaggagagctcgacgatcctgcatcctgcatggcctccatcaggcatgaggcggatagtgacttgcagcaagggaatatcctacccgttggctcgtccggaaagctttcaataaaccggaaggagcgagactgggcagcatccggggtgagttgctgaggaaggcggatgatcttggcgatcctctccttcccagcagggcgttgatttgtgaggctatgactgctccgatgtgctcgacaatgcttgccaatatctgtgaaggccggccctctcatggcgccccccccatgttcgacgccatgcgagctctgcgatgaccctgacgacgccgtctgccaaactcttcagcctgtgcaggggcctgagggaacaaagcattcccaggctgtcatcgaattctcgcccctggggcggcaggtccagggcccgcggcccctcctgctctttgacctcaacggcgtgctgctgcagcatcagtatgggggcaaggggcagcattccttcgacctgcgccctggcctgatccacatcctgcgtctcctgccccactaccggctgggcatcttcacctccagcacccgcaagaccgtgctgaactcggtgcagaaggtgcacgccaatgtcagcaacacgctgcagcagctcctcgccnnnnnnnnnngctgatcgatgactcgctgcacaaggcggccccaggcgaggccctcaacatgatcgtgatgcctggctgggccgggccgggtgtaggaaagcgcgacgattacctacctgttctcgttgaagccttactggacctggctgcgagtgaacaggcccgggccgccgctgggaagcccccgccggacctgaggcggcactcgggggccatcagcgcgcgcctggcggaactcaggcgtaatgatgctgtggatctcgccctccatcagacctgcgcaggcgttggcgatctatcattgtcagaccatgtacctcagagggagcaatgaatgctcccaggcgcccccctccagaggcgtgtagtgctcacagagatattgtgctcggcagtcctgctcccgagcaactttgggaggacacgacgtccagaagtacactgcctgtaccatcgaggcctggtgctttccaccggtagcctccatgcttgttgcgcactttcggaccgatggtgatggccaactctccacgcgccttcgtgcaacccgcgccttcgcgcccaatgtgctcttcataccgaaatgagagcaatgaccccatgcaattattcaaacaaataacaaaaaaggcgccagcatgtaaagccatcccacgttcgtgcctggaaaccgatcgggcgcccgacagggccataccggctggccaacaatgacccgcagggcttctgctggggggcatgacctccccacagattacttggcctctgatggatccatggatgaaggggatggcgacttagagctgggaaacgtcctcccggtgggcccgccagggacgcttgctctcaagagggacgaccggcacttggcagcatctgaggtgcgatgctgagcagggctcgggccacaggccatctccctccggagcatggagccgaagagggcagtgtgactgcgccatccctcgaggaggcctgcttgctgtggtggcaggggttcttcctggccctcttcctcttgagccaggtccccagcgacggtgccttcccaaagtcttcctcacagcaggtgcacaagaggataaagcactcccaggctgttgtccagttctcccccctggggcgacaggtccagggctcgcggcccctcctgctctttgacctcaacggcgtactgctgcagcatcattacctcggcatagggcagcactccttcgacatgcgccctggcctggtccacatcttgcgtctcctgccctatttccgcctgggcatcttcacctccagcactcataggacagtgctgaagtcggtgcacaagctgcacgccaaggtcagcaacacgctgcagcagctcctcgccaggcgggcgagtgagcgggcacgggcatgcgacgccgccgcctccttgaaggacccgatgcgggcccatgcctggccnnnnnnnnnngaggcccgggcacgcgacgacgtcggtggcgccgcctccaagaaggacccgatgcgggcccatgcctggcccgaggccgtccctgcgcaactcttcgagctggtgctgacccgggaccactgcaagcccgccagcgcggccgccatcgcagcacggggcggcaacccatgggacacggtcaagccgctggcgcaccacttcccccgcctggatcaggtgctactgatcgacgactcgccgcacaaggcggcggcagacgaggcccccaacatgatcgtgatgcccggctgggccgggccgggggccggaaagggcgacagcgccctgcccgtgctcgtggaggcactgctggacctggctgcgactgggcaggccctggccgccgctgggaagcccgtgccggacctgaggcggcactcgggggccatcagcgcgcgcctggcggcactggccgtccctgccactgagctcagggcgggtagcgccctggaggcgtccgacgacgcgagctcggcggacccggtgaggagctccgctggcgcgcaatcggccggcacaacgcctgcggccgacgtcgtgggcttggcccttgtgtggagcgaggccggcgggtcgacccaggcctgcgagggaggcgaggccctcgtggcgggcgagcccctcgtggcgggcgaggctggggaggcgagcacaggccgccgcaagcgcagcaaggccggcatcacgagcgagttccctgaggtgacccaggctgatgtggatcgatttgcggacatgtacccgccgcaaacgcccggcgtcctgccggagtgggccgtgcaggcggctgtgacgctgctcggacatgtcgtagaggtgcggtgcgccgttcaccacttctcctggtggtggccttgggtggctgccgtggggtgcacagaccctgcatgccatgcagccgggtgccaggggagtgctcctgcgctggcacccacagttgcctgctgcacgccattggatgccctgcagtcgcttgcttggccctggacccggccggggattgacagagggtcagcgagccacgtctcaatgggactcctcctcggcttgctccgccggagtctgccgcccctgctggccctgacagccgtttgactgaagcacacaccccgcgagagcccacgcccctccaatcccaaccccctccctccgtcacccctccccagaggctgtgggcgagattcccacccggcaccggcatagacagactgaacaacaagctcgacaccaacccacaacttcgcgtactgttcggcacctctgtgcgccgggcgctggacgcctgcatggcccggggctcgctgagcatggcgaccctgccctccttcgggccctggatcgcgctgggcggcgcggcaccccccctcgatccggagcgcgacgtggtgaaggaggcgctgcaggagctggcccgccacgccagccacgccgccttctgcgcagcgcaccgcgccccggcccctgcgggggtcgccgagccggccgagccgccggccgggccgcccgggaagaagtggcggcgcatgcctgcgctcgacgaggcggccctggccctgcaggagcgggtgctggtggccctggtgcgggggctggcggcgcccaaggtcctgccgtacgaggtgctcccccgcgccctccgcgacctggcgccgggggcgccgcacgggcacccccttgtcagcaagggcctccgcgacggcatcgagaggatcttggccggggcagagcaggtgcggccggggccggggcggcgtcctcctggatgaacgttggggatgctcagggggtgggggggcagtgtgaggagggtatcccaggaaacccgcagcgtatcagccccgcacggggcatgggcggcgtcggtgcggccgaccgccaccaccgcctccccctcacacacaccgccgcaggccggactgttcgcagtgcgcaggcccggccccttcggcggccacgcggaggtggcgtttcagcccgggcgggccgccgaccccgtgccggaggagcagctcaaggaggcgctggccatcttcaggctggcggtgcaacgcctgctgggcgccgtccatccggcgccacccgccagccgggatggtgaggcaatccagggcggcgctccctcctcggcttccgtcccggaagaccagagggccggggcggcccagaccagctctgcgccgtcgaaccacggggcgaccccgggcgagacagcccccctgcccctggacgtgtttgaggacagggccagtgcgcccgcacagccccagcccggcggtgtgggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcggaccctcacccccctgcatgccgaggtgctgagctttgcgcggcaggccgcccccacccggcaggaggttggagacatgaagcgtgccctgatgagcctggcggaggtggccacccgcctgtggccccactcccagaccatgctttttgggagtcaggccacgggcctgacgttgccggggggcgacctggatgtggtcatcctgggggtcggctccgagctggacacggcgggctcggggttctcagcacgcgagcgccagcagaaggtgcagctgctggaggacctgctggacgcgctgctcgccaccaagctgctgcaggggcgcgtggagctgatcgacgcgcgcgtgcccatcatcaagtgctgcatggcc

SEQ ID NO: 24328 - DNA, 78 bp, Chlorella protothecoides
gggtgggcacgtcgggctgccctcccacaacaagtaccaggacccgaatgctcccttacctcgacgccgggcagcgtg

SEQ ID NO: 24329 - DNA, 446 bp, Chlorella protothecoides
aggttggcctaggtttacgggtctccggacagggtgaactgtgcaagcaaagcccgcacggatggtgggctcaagctcaagtactaaaacagagccttgctatcgcggggaatagtggtgatgctatcacaagcttctttaggttacagtctactggtaactgggaacgagcgggaaactccagcgcgcgagcttcacgtaactgcacagtcacacactaccgaacaaaagtccagcggtacgtggtttccaactctgaacaaactgatttattatacacaaatccccagaaacggggcgatgagatctctgtggcgcgcgatgggtccaggcagtcgtctcccactctcgccacaacgagctcggcaacctcccatcctcgcaccgcgtgctttccagaccgcgaactccagcattccagcccagctggatgggctacgagtgct

SEQ ID NO: 24330 - DNA, 77 bp, Chlorella protothecoides
ccctgcccctgctcgcgtcggcgcagccgttccccaacctgcgcgcaatccccaccaggccctcacagcgaaggcga

SEQ ID NO: 24331 - DNA, 76 bp, Chlorella protothecoides
tcatccagcgtgtggtcccctgcttggattggttctcgaggagcccgtcgacaactaggttacaacgcaagctcaa

SEQ ID NO: 24332 - DNA, 79 bp, Chlorella protothecoides
ggggctggccctggtccagccctccctggcaggcgcaggtgtgtgggtgactgatctgagtgaatactctgatgtgagg

SEQ ID NO: 24333 - DNA, 83 bp, Chlorella protothecoides
ttgccagtcccttggaccctcgccgcccctgacctcccatgcgctcttcccaccatacctcgcgcacacacacacacacacac

SEQ ID NO: 24334 - DNA, 69 bp, Chlorella protothecoides
caggaatgattctgtgtgcgcagggatggggggtggggtgggggtggagggatgggaacgaggatcgca

SEQ ID NO: 24335 - DNA, 84 bp, Chlorella protothecoides
ggcgcgtcggctgtctgtgtcgggtcgcctgtcagtatgggcgaggatctgacttactgcactttgcccacagtcaaggctaca

SEQ ID NO: 24336 - DNA, 127 bp, Chlorella protothecoides
ccccccgcctggcgggcatccgcctgcgcccctcgccccaggcccctgaccagctccaggcccccgccgccgtgccctggcacctggaccgcctggaccagcgcacgctgcccctggacgggcagta

SEQ ID NO: 24337 - DNA, 147 bp, Chlorella protothecoides
tgaggattgggcttcagccttgtggcactgccatggatgagtgcctggagggggaagaggagctcgtgcggcaccttgacccccagctttgcaccgctcctcaggagaagaggttggacatcctggctgtaaattcccatctgatgg

SEQ ID NO: 24338 - DNA, 61 bp, Chlorella protothecoides
gctgaatgtccatctcgtctgccacacccacgatgacgctgggtggctgaagaccgtggac

SEQ ID NO: 24339 - DNA, 63 bp, Chlorella protothecoides
cctcaggtcggccgcgcagctgctgcagcctgtgatccacccagacaggtcctccatcctgga

SEQ ID NO: 24340 - DNA, 61 bp, Chlorella protothecoides
agacaggtcctccatcctggacgccatcctatactgacatgctttgtggtgcctctgtgct

SEQ ID NO: 24341 - DNA, 73 bp, Chlorella protothecoides
accaccagcctcaccttgaacagcctgcgcggtgtcggcgtgccaggggaggagggggaaggcatgtggaagt

SEQ ID NO: 24342 - DNA, 61 bp, Chlorella protothecoides
accaacacgctggactggcagtcgggctccgcggacgagatggggtgaggggcggaggcca

SEQ ID NO: 24343 - DNA, 182 bp, Chlorella protothecoides
cctaccagttgcagcccacctccgtctgacgcggccgcctcggctgcctcggcggctgcccacacattcatcccggggcagcaatttatctttctgccgaggtccctacagagggagcgcagagcatgttacagccgggtcacaaaggattcaagcaacacccttcgatcacccaatgccat

SEQ ID NO: 24344 - DNA, 98 bp, Chlorella protothecoides
caggttggatgccatcctggggtgctacatgaggtgatgatgcaggaaggggagcctggcatagcactctcgcggccctatgccgctgccaagcctgg

SEQ ID NO: 24345 - DNA, 78 bp, Chlorella protothecoides
ccatgaccccactttccgcctctcctatgtacctgaacccttcagattatcaacaagagcatggttggcatcgtgaag

SEQ ID NO: 24346 - DNA, 61 bp, Chlorella protothecoides
tgtcgatgtcgatgtgtggatgcagcagtggggacatggacctttgagcctgagaatatga

SEQ ID NO: 24347 - DNA, 61 bp, Chlorella protothecoides
tcctgtgggagaagggattgggcagcaatggcatgggtggtgtgatgctcctgacccagaa

SEQ ID NO: 24348 - DNA, 118 bp, Chlorella protothecoides
aaacccaatacacttagcaacacccttgcgacgaatcgattacaaggggtaccttaaaaaggaagtatgtgacttttatagttccacagtcgcgcgcacaaagcatgcgggaaatcca

SEQ ID NO: 24349 - DNA, 77 bp, Chlorella protothecoides
ctcactcacgatgtactttgcctttgcttgggtgccagcaacaagctagatgaattggtgtcggaaatgtctcctgc

SEQ ID NO: 24350 - DNA, 73 bp, Chlorella protothecoides
tttccccttgaccgggccctttccccacttcccacatgttccagctcggcaccgagtccacgcctccttgcga

SEQ ID NO: 24351 - DNA, 61 bp, Chlorella protothecoides
ggcggggatctcgcccaccgcccgcgcctgacccgcaaacttggtgtagggccgcaccgcc

SEQ ID NO: 24352 - DNA, 74 bp, Chlorella protothecoides
cccgcaaacttggtgtagggccgcaccgccgccacctggtccagctcctggaaggagcccttgcccacctcgcc

SEQ ID NO: 24353 - DNA, 151 bp, Chlorella protothecoides
cgccagcctccaccatgccgcgcggtgcgatgtctgaggggtcaagcacttcaagacagaaaggggtgtgggtttgggctgtggcgattctctcgtgcggtgaggagggtgcctgcatgcacggagttgaacggggaatcgatgtcggagg

SEQ ID NO: 24354 - DNA, 77 bp, Chlorella protothecoides
tgccgccttcagggctggggctggttgcatgacgagactgttccgtgcacaccagggactacatgtcagcctctcac

SEQ ID NO: 24355 - DNA, 63 bp, Chlorella protothecoides
tcaatcccagtctgcagggtggccttcatcagcttgtcagccacaatccgatccagttcctgg

SEQ ID NO: 24356 - DNA, 602 bp, Chlorella protothecoides
  modified_base (137)..(249): a, c, t, g, unknown or other
cacatggagcattgggctcgaggctgtggcaccagacccgagtcttccccaacagctcgtgcctgagtattccgtggaaggctgcgcttgggccaagtattctccattgctgagccctcttggctccctgtgggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatacatcgtcagatccagaaaagctgaggtcgatactgtggaatgtggtggcatggcatggctgttcattggtttgggggtgccatagaggaggtgtgaggatcaccccactccccattgggcagaaccttcagaatgctgagaactgctgagcgtcgtctgcatccgatggtataagcctttactatgctgtgtgataggcccctcggttgtgcgtcatgcaaacactccgaagagatgaggagaggcatgagcaggaggcaagcatgacatcccacagcagcctgtcggtggcttcgggtttggggggcaccatctctgggcaataaacgcaagcggcaaaattcgcgc

SEQ ID NO: 24357 - DNA, 92 bp, Chlorella protothecoides
atagcatgctagcgtccaggagatactcatggtgaaagagctcactcaagcgccaagttctgtctatggcatgcagaaagcgggagttggca

SEQ ID NO: 24358 - DNA, 70 bp, Chlorella protothecoides
tagtgagagacaggacattattctgtgattctattagtgaaaatataatattgtgtggcgattcaagagt

SEQ ID NO: 24359 - DNA, 72 bp, Chlorella protothecoides
gccatgccctgcagtcacaagggagactgagggctgtgatctctgatcattgccaggggcatgtccactgct

SEQ ID NO: 24360 - DNA, 61 bp, Chlorella protothecoides
gcagcacgtgccgaggggcgcgctcgcctcggcgttcgtcgcactcctgcccatcagcgcc

SEQ ID NO: 24361 - DNA, 117 bp, Chlorella protothecoides
cgtgctgggcttggcagtacttgaaactccagcgggctttgccgagggagctggctcaaaaaaggcacggccgttccagcacatcaccatcatggatctcagatcatgcgcattggc

SEQ ID NO: 24362 - DNA, 74 bp, Chlorella protothecoides
tgacctggagcaagcaggctcactcatctccgagtcgtggctgggtcaccaaggtccacctgccccacctgtgc

SEQ ID NO: 24363 - DNA, 77 bp, Chlorella protothecoides
tgcgaattggcacgcaaaggccccagacttcgttaaggagctgaacaagtgagtggtgattggtttgtggagtgtat

SEQ ID NO: 24364 - DNA, 61 bp, Chlorella protothecoides
ggacgatccatgcgacccgcgacaggagcatctctgtgctcgctgtcttataggtcgggca

SEQ ID NO: 24365 - DNA, 82 bp, Chlorella protothecoides
tcagtagagccacgcatgcttggggacactacagtggcccccggagccccttctccaaagtggcacaccaagtcctcacaca

SEQ ID NO: 24366 - DNA, 20097 bp, Chlorella protothecoides
  modified_base (146)..(155): a, c, t, g, unknown or other
  modified_base (1410)..(1419): a, c, t, g, unknown or other
  modified_base (1529)..(1538): a, c, t, g, unknown or other
  modified_base (3785)..(3794): a, c, t, g, unknown or other
  modified_base (4473)..(4482): a, c, t, g, unknown or other
  modified_base (4568)..(4577): a, c, t, g, unknown or other
  modified_base (5421)..(5430): a, c, t, g, unknown or other
  modified_base (5519)..(5656): a, c, t, g, unknown or other
  modified_base (5759)..(5768): a, c, t, g, unknown or other
  modified_base (5836)..(5845): a, c, t, g, unknown or other
  modified_base (5948)..(5957): a, c, t, g, unknown or other
  modified_base (6208)..(6275): a, c, t, g, unknown or other
  modified_base (6663)..(6672): a, c, t, g, unknown or other
  modified_base (7840)..(7975): a, c, t, g, unknown or other
  modified_base (8069)..(8078): a, c, t, g, unknown or other
  modified_base (8969)..(8978): a, c, t, g, unknown or other
  modified_base (9497)..(9506): a, c, t, g, unknown or other
  modified_base (10620)..(10629): a, c, t, g, unknown or other
  modified_base (11267)..(11276): a, c, t, g, unknown or other
  modified_base (12180)..(12189): a, c, t, g, unknown or other
  modified_base (12797)..(12806): a, c, t, g, unknown or other
  modified_base (13503)..(13512): a, c, t, g, unknown or other
  modified_base (13881)..(13890): a, c, t, g, unknown or other
  modified_base (14414)..(14423): a, c, t, g, unknown or other
  modified_base (14667)..(14676): a, c, t, g, unknown or other
  modified_base (14905)..(14914): a, c, t, g, unknown or other
  modified_base (15279)..(15288): a, c, t, g, unknown or other
  modified_base (15737)..(15746): a, c, t, g, unknown or other
  modified_base (16258)..(16267): a, c, t, g, unknown or other
  modified_base (16654)..(16663): a, c, t, g, unknown or other
  modified_base (16964)..(16973): a, c, t, g, unknown or other
  modified_base (17214)..(17223): a, c, t, g, unknown or other
  modified_base (17460)..(17469): a, c, t, g, unknown or other
  modified_base (17827)..(17836): a, c, t, g, unknown or other
  modified_base (17906)..(17915): a, c, t, g, unknown or other
  modified_base (18245)..(18254): a, c, t, g, unknown or other
  modified_base (18403)..(18412): a, c, t, g, unknown or other
  modified_base (18645)..(18774): a, c, t, g, unknown or other
  modified_base (18860)..(18869): a, c, t, g, unknown or other
  modified_base (18924)..(18933): a, c, t, g, unknown or other
  modified_base (19158)..(19188): a, c, t, g, unknown or other
  modified_base (19457)..(19466): a, c, t, g, unknown or other
taggggggggtcctgaagggtggggagggggggccaccgatttgagcttgggtcgtaatgtatgcaccaccgcgccttccagaacattaccccctcgccgtccctaggcacccccccgcctcatctcaatcttcctccccccttcnnnnnnnnnngcggggggggccaccagtttgagcttgggtcgtaaagtatgcaccaccgcgccttccagaacaacaccccccctgccgtccctaggcacacccccgcctcatctcgatttcccttcccccttcccctcctcaccccaggtgcccgaggcggtgtgcctccgccacctgtcctatcacgaggcctgggagatgtcctactttggcgccaatgtgctgcacccgcgcaccacgctccccgccatgaagtttggcatccccatcacctcccgaaactttttcgacctggtgaggccggggaggggtggggatgaagggggtgaagggctgatcgggcgggggtgggaggagagcgagtgtcaggcccctgacgatcccccgcgccgcacctgtcatgggcgagcgggctcagagacccggggcaccctgtccttcccccatgtctggaccctgtcgaccccagctttgcctcgcgtgtctgtccccatcaccattcagcccattcccttgttttcctagagcaaccagtcccttctccctcccccccccccaaaaaaacaccacatctctccaatccaaagtcggaggccgggacgatgatcagcgacggcagcatcccgcaggcggagggcgtggacctgaccggggtcaagggctttgccaccatcgacggcgtgtcgctggtgaacgtggagggcacgggcatggtgggcgtgcccggcacggcctcggccatctttgccaccatgcgcgacgcgggggtgaacgtgatcatgatctcccaggcctcctcggagcactccatctgcttcgcggtgaaggccgcggactcggcgcgcgcggtggccgccctgcgcgcccgcttccaggaggccatcgcggcggggcgcatctcctgcgtcgccgcgctggacgactgctgcgtgctggcggcggtgggcagcgccatggccagccgccgcggcgtggcagccaccatgtttgccgcgctggcccaggccaacatcaacgtgcgcgccatcgcgcagggctgcagcgagtacaacatcaccgccctgatcgacgcgcgcgagtcggtgcgcgcgctgcgcgccgtgcacggccgcttctacatgcaggcgctgaccatcgggctggggctcatcggccctggcctcatcggctccaccttcctccagcagatccaggaccaggcgaggaggttttttgggggggtggggagggggtggaggtgtgtgtgtgtgtgtgtgtgtgtgtnnnnnnnnnngggagggggggtctccacacccacgctcctcgacacacacgcatcagcccctccttccccgcttccttcccaccaaatcccaggccgccaagctgcgcgacgagtaccannnnnnnnnnatataggttgggggcccgtgttggtagggggaggggggtttccacacacacgcttctcgacacaaacgcatcagccactccttccccgctttcttcccaccaacttccaggccgccaagctgcgcgacgagtaccacctggacatccgcgtgctggccatcgcctcctccaagcgcatgctgctgtccgacgacgccatcgacctggccgcctggcgcggcgagctggaggcgcggggcgagccgctggacgaggagcgcttcgccgcacacctgtccgacaacttcatccccaacgtggtggccctggactgcaccgccgccgaggggcccagcgagcgctacctggagtggatgcggcgcggcatccacatcatcacccccaacaagaagatgaacagcggcagcctggagcggtaccgcgcgctcaagcgccaccagcgctcctccttcatccactacctctacgagggcactgtgggggcgggtgggtgggtgtggggaggggacgggaggtggaggggggagagctggggctgatgggcccgggaggactgggaggagggcaggggtcgcagagctggcgtgcgctcaggccggcggaggctctggcgtgcgctgacgccggcccaattcccgaagtattcaccgggagcgcattctgctgtgcctgctcacagaactccctccccacaccgtcgtatccctgccttccgccccctctgctccgcaggcctgccggtcatcgccacgctgcagcacctggtgcagtcgggggatcgggtgcagcgcatcgagggcatcttctccggcaccctctcctacatcttcaacacctttggcacgggtgcgtgcgtgggggaggggggtcttgcttgtgtgtgggggggcagtgggtgtctcgagtgctgcatcgtatggcgggggaatccagcgtgagacagagcatggctggcggagtgtcttgtctggtttggatttgaatgagccagctccagcaccccctcatacacacacccgctccccccccccaacgttcccccttccactaccaaacaatccagacgaccgccccttctccgaggtggtcaaggaggccaaggcggcggggtacaccgagcccgaccctcgcgatgacctggcggggaccgatgtggcgcgcaaggtgaccatcctgggtcgtgaggcgggcctccccctggagctggacgacgtggcggtggagtcgctggtccccgccccgctgcgcagcctgcccaccgccgccgacttcctggcgcgcctgccggagcacgatgcggagatggacgcagccctgcaggcggcgcgcgcggcgggcgagtgcctgcgctttgtgggcgtggtggacgtggcggggcgggaggggcgagtggagctgcggcgctaccccacctcccacccctttgcgcagctgtcggggtcggacaacatcatcgccttcacaacgcagcgctacgccgcgcagcccatgatcattcgcgggccgggggcgggggcggaggtgaccgcgggcggggttttctccgacctcctccgcctcgccgcgtacctgggggcaccgtcgtgattgcatttgaccacggtgtgaggtgtgaggtgcagaccagacgctgtcgagtggggtcgggtggcgagggggtgctggggaacagcagcacgcaagcagcgacgatcagcagcccagtgcagggccttcctcgctgaagagtgagtggtggatgtgggcgctatcacatccgacagccgaacctccaagtaccagggacccggggaacccctgcaagacctcaaaccccgcctgggggtctggtgacggcgatcgcgcgcgcgcgaggggcctccgcaaatccgccttatcccacagcaccaggcacctatcccgggcgaggacccgtgcagaagtagcactcctcgctcccagccgcaccccacacacctccaatgtcggtcctgaggcaggcaagcatgcccgtacggctggccttcaggggggcgcccctgaacctggcacccaaggccgcgccacaccgaccccgtgccgtgcgagcacgtcgcgttgccccccgggtaggcttgagagtggattttatcagaaaatactctatataagggcgtccaagcccaatatggggtcccaggctggactccgatcacggctcctacggcgctcaaccccacaccgtcgccaccccctcttcccgcaggccgaggctactcaggtgggatnnnnnnnnnnggagtggattttatcagaaaatactttctgtaggggcgtccaagcccagtatggggtcccaggctggactccgatcacgcctcctacggcgctcaaccccacaccgtcgacaccccctcctcccgcaggccgaggctactcaggtgggatccacctacgccaacgccctgatcgaggccgctcaggccgaaaactccctggaggatgtgcactccgatgtggatgccctggccgggctgctgagggagaacaaggtgtgaaagggcactggggtttggtagtgcttgggatcagggaccatggatcctgctggcactcctttcccacgcggaaatcccctcacgccctcgccatgtcccacacctctgcctcatgcaggacatcgcggagttcctgtccaaccccaccatccgcgtggaggccaagaaggagctgctgaagcgggtggggggcgaggtcgggttcaaggactacaccctcaacttcctgaacctgattctggaccgtaacaggatggactcgctggacgacatcgtggaggcctttgagaccgagtactgcaagctcacagacacgcaggtgcgtggtcgggggagggggagagcgggggtggagcgtggggggtagtgtgagggaatccatgtgatgagaacagcagactggacagaatgtttcctgnnnnnnnnnngaatcttgcaacatcgttttctgccgtctttcttcgttcttcattcctcatctctcccccccccccccaaaccaagcagttggccnnnnnnnnnnagggggcagtgtgagggaatcaatgtgataagaacagcagactggacagaatgtttcctgaagaaaggcagcaaggcctcggctggcccgcacaggggtctcactgctgttgattgggcataccttgcgacatcgttttttgccgtctttctacgtccttcattcctcatcttcctccccccccccccactaaccaagcagttggccacggtgcgcagcgcggtgaagctggagcaggagcagcagttcctgatcgccaagaagctgcaggagctgacggggagcaagaacatcaagctgaagcccgtggtcgacgagtctctgatcggagggtttatcgtggagtacggctcctcccagatggaccattcaggtggggggaggaagggaaggagtggcatgcatctgccagctggccccctttgattctccaggtggagtttgatggtgcagggggcaagctggcggctcaaattgcccaacccagggcctgtttgcacccttctgtccccctgtggtccatccccatccaatccttgctcatccaacctccaacaccactactttacagtgaggggccagctggaccagatcacctctggcatgaagtctgccgcagagaagctctgatgcggcgttgcagaccccctcgtgcctggcgcgcccaagcctcgcatttgcttctgcctttggctcgcactgtgcaatggcagcttcgcccaacagtgagagaaaaacatgctgtatgggtgtaagaacgtcccattagaggatcagggcatgctattaggatcagggcatgagacaggaattgttgagtcattgaatagccactgagcgatgnnnnnnnnnnaaacgtcccattagaggatcagggcatgctgttagggtcagggcatgagacaggaatggttgagtcattgaatagccactgagcgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagatctgtgggcaaggacaaggtgaaagtcgggggcggggggtaatgagtggaagccccggctcaacccgacgggtccgacgcgggcctgagccttccannnnnnnnnncgattgaggatgaggtgtggcctcccttcatcaggatttctggtcgcgatggagacgcagcgcttggnnnnnnnnnnaccagatctgtgggcgaggacaaggtgacggtcgggggcggggggtaatgagtgggagccccggctcaacctgacgggtccgacgcgggcctgagccttccannnnnnnnnnaggaagaaaattcaaaggtgccgggaaaacttgatcacggatgctgcgacctgagcgacgacgggctcacctacaagtgtcagtggcctcccccgtgtgattgaggatgaggtgtggcctcctttcatcaggacttctggtcgcgatggagacgcagcgcttgggccaggcgagccaccgcctcctcaatgttctctggcgtctcaaaggagaaggcgaggcgcacgcacgggactgccgtgcctggaagnnnnnnnnnnnnnnnnnnnnnnnnnnnnnnnnnnnnnnnnnnnnnnnnnnnnnnnnnnnnnnnnnnnnagcactgctgtggatcgaggcagcgcctgcactgggtgctccatcacttctcgttgcagccgacccacctggcgtggaagatgcggcccggcgccaccacgacctttgcctccaccagcgccgccgtcagctgcgaggcgtcgtccacccccagaatggtcatccactgagcagggatgggtggacgggtgttcttaagggggggggggggaggagggcagcaattcagaggtcccaggtgcagaaacacaccggccatgatctgacgtggccttgctgtcacacaggctgtgacgccccgcgctttgaccggcgaattgatagctccggggactgccagccgtccaccaagagtactacctaccaggccaacccctgcctcctcccnnnnnnnnnnaaccggcgaattgatagctccagggactgccggccgtccaccaagagtattacctaccaggccaacccctgcctcctccctaatgtgcatcctttcttgcccatgcagaggagccatggcccccagtctcgacacatggcacgcgatccacggcaccccccttcactttgcctgcgcctcccatccccagaccatttcaatccacgctttcccccccaactgccattcctcaccaggaacatgccggcgcggggcagggaccagcgcgccaggccctccaggtggcgctgcgccgcagcgtgcatggcctgcgcgcgctcggcgtagatccgctgcacgtggctcaggtggtcgtgcaggcccgcctcgccccaggaggaaagcagggcggcggccatggcctgggccacgccgcacgcgcccagggtctgcgtctgcaccgcgcaggcggccacctcggcgaggcgcgggtggcaggtcagccaggcgaggcgcagaccgggggccaggaacttggaggcgctgtccaggcgcagcacgcggccgtcgacgtccaggctgaggtagctggcggcgcggggcaggccgcgcaggcccgggacgtcgccagagccgtgcgggaactggaggtagtaataggggtcgtcttccaggatcaagaggtcgtaagccctgccagggagggaggggtgggatgggatggtgggtgggcgctgctggccggagcagagctcaggagctacatgctgaacggtgagcaagcaagctgccagggatcatggactaggcgtggaagcaagtcgtgactgaccaaagtgtagaagcggcaaggcaatgggactgggcagagatcatgagctgcaggcccactcggtgtgatcttccccacgacaggccacctgtcaagcaaccaattgtgttgcctccgcatgccccacctgcacacttcgtatatctccttcctcctctccaagcctgtgttcgtgccagttgggttctgcgccgtctgggcgggcaggaagggggaaggcggggtggcggagtggtgcagtgctgagcttcaggacacctccttcagttccaatgcaaaaaatgccacaagcacccacacaaaaccagacttcgtgccgccagtctctgcaccacaaatgctgatcctgcccctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaacatgatgactcacagtccatcaagcagcacagtctctacgtttccgttccaggaacgtcatcacacaggtcctggcaaaggacggaannnnnnnnnncccttcagttccaatgtaaacacgccataagcacccacacaaaaccacacttcgtgccgccagtccctgcaccacaaatgctgatcctgcccctcggctcactggcacagtgtagaggagcttggggaatggctgggtgccgctcttcctgatgccctccaggccctgtggatggggacagggtcgacaagatgatgactcacagtccatcaaagtctctacgtttccgttccaggaacatcatcacacaggtcctggcaaaggacggaaccagagtcctcgctgcatcgcgctcctcaccttggtcaatgccagtggacacattcccccatcgttcgtggcgatggggaccaggttgatgcgatcgggcgctgccaggcactccgagacctgggggtaggacagctcctcgaccaccatgctgtcgccggggtcgaagagcatggagaagagggcgctgaggccctggctggcccctcccacgatgatggtggtggtgggtcggggtgctccgtgcaggtctgcgacatgtcgtgtggcccagtcacgcagggaaggcaggcccgacgggtggataccgtactgcagctgcccttgcaccagctgagcaagggtggggtggggaaggcacagcgtggcggcttggcgggctggtcagcactggctgagcatggtgacatgccccagaccatcgatgggaagcccctctccaggcccaaatcggcgatcgcatgcatgacgcacatcgttctctccgaccgtgactgtgctaccgtcacgcagcttgatgtccagcgacagcatggggaaggcgtccggtgggggaaggcccccatgcaacccaattacaccaggcacgctctgaaatttggccaccaggccacgcagctnnnnnnnnnnaggggggaaggccaccatgcaacccaattacgccaggcacgttctgaaatttggccaccaggccacgcagctggccataattcagtgcggcccccttttccgtgatgaactttccgggatcaacgtcagtggcaggatgcaccattgcaggcccgccgcgtctccgggacagcacgacaccaggcgatggaaagctgatgccgcaattgagtcgcgccgatgcccactcgaatctctagagtgcgcattagtagacaaggtgcatcaatgcactgtgtatcttgccccccaattccgacagttctgaaccctgcgttggacacgtggagcgatgggccgtgtactgactggacaactcaattacctgtgtgttttttcttgtatgtatattgaagaatccttttccatcaatgaacccaataatccattgtgcatgtaaattcatgatattaaatgtatatatttaattgcacaaggcagctgccattagggatctgttttgcttaggcaattagatcnnnnnnnnnntgggatcaacgtcagtggcaggatcggtagacaccattgcaggggagcagggcccgacgcgtctccgagacggcacgacaccaggcgatggaaagctgatgccacaattgagtcacttgaatctgtagagtgcgcatcagtaaccacatcaacgcactgtgtatcttgcctcccaattccgacagttctgaaccctgcgcgttggacacgtggaaccttgtactgcctggacaactcaataacacaagataccaaggcttaaccagctggcttgagccaaaccaacaattaacataaatgcaagtaaatacctcatgtttactgcttttggtttgttgagtgtaagaaaatttttaaatattcaatttatccgtagggaacacctgggtctacaaacgtcccaagcacctttgctgaggaggatgccatgtttggatagcgctttcctcagagcgatagttacaatcaatattgccatgtggtaaaaaagcgaccagatgagatgcacatgcactcccttggagacccagcctgctggtgcaaggggagcctgatgctgtttggaaaatgaagaactctcaggtttgcagttgaggtcttcaacaaagtacagccagagcacttatcataggcattaccctttcagcatatccgaatcaaaacactatcatgtacacagaccctttctgcaggttatgtctgagagtcttgatctgtacgaatttgtacagctgacccctcccgacttagttaccaccctcgagcgactgacgcaacacgtttccggacgacaagcaagtgctcacccatttagccctattagtctgggatatttataaagaacatatgtgcttactacgttccctggtcgtcgattccgtgtcggcataatcacaagaggagaatgggctggtgtccaccactcaccgtaccttgatatagtactaaagtgggagcagcgggactgttagcgttaccgcaatcctatgaagacgtggtggagatggttcgaggatgattggctatcttttcggcacccccccgtagaggctagctaccagtcatggctgcgccaaatatggactgacaacgattggtacagcggcatcatccnnnnnnnnnnagtagggatctatttgcctaagcagatcccaagtgctcacccattcagccctatcagtctgggatatttctaaagaacatatgtgcttactacgtttcctggtcgccggttccgtgtcggcataaccacaagaggagaatgggctggtgtccacccttcaccgtacctcgatatagtactaaagtgggagcagcggggctgttagcgtcaccgcaatcctatgaagacgtggtggagatggttcgaggatgattggctgtcttttcggcacccccccgttgaggctagctaccagtcttggctgcgccaaatatgggctgacaacgattggtacagcggcatcatcctgacggtaggtgcacctgcatgattaggagattacccgtgcccatgcattggtacgaaagcccctcccatgccggcaccgcgcagggctacgagactgtgtgcatgctcaaatcatgcagaagcgtcctccagatgccatgcccatcgcagtccatggtgagctgcttcgccttctcgggacttgttggacagaattccgcatacgttgagctgcctcacacaggctggcccagctgtcaaccgtccattccttccctttgcacagttacactggtggcatgccttgcagnnnnnnnnnntaaccctccactccttcccttcgcacagttacactggtggcatgccttgcagcgctctcactccttcccatctacaagcctgctgcttgggtggcacaccgaaacctgctggccatgctagcgatgttgaacgtgaccgtcgtcggtgctttctgtgtgtgagtgcgccaagcttcccggctcagggtgtggggtgccaggcctcgctgatgatctggcatggccccgatgcatgggtccagctcctgaaactccatccagttccgttcagagcatcccatccccaccccattctctccatagaaacctgccgtccataagcgtagctgtcctgggcacatcgcacctggcacagctggttgataggtgcgactgggtgcctggagtatggctctcggaaggggtgtgctgcatgcggacaaggttttcacgacatgaagcctggattgacgggtgtatcttgcaagacacggagcaagcattccatgcgcaacccgattgttcttgagcttttcaccctgtgggcgccagagctgcgcagctccatgctcagcacccagcccgcatccacgctcccctctcacagcggagcttgcatcccttccatcgcctcgaatttctacatacaccttccactgaagcggaagtgccttgcccttctattgtgtgagtcaggggacgcggggtctcgagcaagcctgtgcggctgcaatgttgttggccacagctgccaagtgtaacggggcacatgctccgattacatcaggcattgctgcggggaggcacgtcaaggcgtctccctgctccaccggcaaaccaccatgcgaccccatcccctcgttctccctcgcccggacaggtttctctgcaacactgtgtcgcctgtggtactttggcaggcagnnnnnnnnnngagtgtgacggggcgcatgctccgattacatcaggcattgccgcggggaggcacgccaaggcgtctccctgctcaaccggcacaccaccatgggaccccatcccctcgtcctccctcgcccggacaggtttctctgcaacgctgtgtcgcctgtggtactttggcaggcaggaggtgagttgggggttgatgctgcgtcccccggaggcttcacatggcccgacgcctcatgcactcggctgtggcccctgatcgccctgcccctcacccaacctgcgccggcttccaggactccatcgtgcgcgtgctgtctgttgtgtgcggtgtcctgatcccgctggtgctgagctggcgcctggagtacaggtcgaggtaccgcttcctgctccaggtacggtccgcggtcgatggcccccacgccgcagcttgcagatccctcatccagtgcattcacccggggccggcggagcggcaccctttcgcctccggcgctttgggccgtgcagcaggaggcgaccaggccccttccattgcccatgcagatgcggcggggcgggaggggcagggacggctgggtccccaaggacgccctcttccgggactggctnnnnnnnnnnccggcggggtgggaggggccgggacggctggggccccaaggacgccctcttccgggactggctggccatttccctgctctgcgcgcactgggccatggacaccgccaccgtcatgctgttggccagctacctgatcatggcctgcggggcaggcaggccgctggcgctggcggcgcagctccccgccctcgccgccgtcctggtcatcaacttccgacagtacctgttttgaacgggctggcgggcgccgctggggacttgtagagcgcggcgcgcacccaccgcatgcagtggggtgcactattatttctgctgtactgctgaattgttttgtgggggaacgagccatttccagatgccccccccttcctctatgcatatcttacccaggctctgctcgggcagatgccttggccgactttcgccgggctttttgaagacgccatgctgctgcccgttcagggctttaccctgtgccggcaggcagccttgcgtcctcctgcgttgctcatggtctgtttcggggcccaggactcgggcaggtgcgtcatgagatgtactccttatatgctgggttattgagaggaataataccagatagtcatgcagccagtcccccggacctcctgaaaaatcaacgggaagaagactctcagacttcatcccggagtagagaagatctcacggcagtactacnnnnnnnnnnttatgctgggttattgagaggaataatacctgatagtcatgcagccagttcaccggacctcctgatcaatctacgagaagaagactctcagacttcatccaggagtagagaagatctcacggcagtactacagcaggttccggcaagcagcacgccgtgctcctcatgaaaaccctctcgccttggcgggcgtccctagtccccgaggcggtctggttcctccgaattgggcgaagtgggatcccttgggatgaaaccggcgcaagggatcagctcttcccggacgacacctgccgacctttcccggggggaatcgaggtgcccacacgctacaggaaaatggccagactatcttgaagcgacttatannnnnnnnnngtttcccggggggaatcgaggtccccacacgctgcaggggaatggccagactatcttgaagcgacttataatgactggaagacgtgaaattcggtgcagaccgaggccaacataggcgttatcctggcggtgagagtcggggccgccgtgatcgcagcggtcaaggtcccctccattccacgtgcatcaccccttcccattctccgttgtgacaggctttacacatggcccttgcctggaatatatccaggcagaggcacactaaatccttacgaacaggcctccatggtacgcaaaggggcccagcgggtgtgccctccaggatgcaagcccaggctgcactcccggccccgcctgctgccctgcttagactcctcccaacgaggggttcaccccatcacaccctcaaccccacgcgcatcccctttgctccctcccagttgcctcggttgtggccctggcggccaccctgcgcctccccttcctgcacagcccgctgtgggttcggcatcgcagcgccaggnnnnnnnnnnccccggccccgcctgctgccctgcgtagacccctcccaacgaggggttccccccaccacaccctcctccccacacgcatcccctctgctccctcccagttgcctcggtggcggccctggcgaccgccctgctcctccccttcctgcacagtccgctgtgggttcggcatcgcagcgccagggggtttctggtcatgctcttcaacaccatcatctacgccttcttcctgtgaggaatggcagannnnnnnnnnggtctagccatgctcttcaacaccatcagctacgccttcttcctgtgaggaatggcagagcagggcagaggcgcgcttccgcagcatgcgccagggctgtggggtgctttctagtcttgtcgtggctccgggtgctgcagatcgtgctcgacacctgctggtccctggcacgcaggattcgatccgagcgcctggaagcgatccacggcgacagcctgccggcgcagcnnnnnnnnnnaagcatgcgccagggctgtggggtgccttcaagccttgccgtggctccaggtgctgcagatcgtgctcgacatctgctggtccctggcacgcaggattcgatctgagcgcctggaaacgatccacggcgacagcctgccggcgcagctgattgccaggtgggcaccgcacgcgctgggcagggggggtgcagggcagtggccgcgtgccgtggcccccgatcacccccttgctatggctggcgctactcctggctcacccacacagcttggcggccccgacacacccctgcagtggcactggcatcatcaccatctcctcccaactggccatgggcattcccctgggcctcaaactcccagctcnnnnnnnnnngtgccaggtgggcatcgcacgcgccgggcatggggggtcgcagggcagtgaccgtgtgccgtgctccccgatcacacccttgcagtggctggcgctactcctggctctcccacacagcttggcggccccaacacacccctgcagtggcgctggcatcatcaccatctcctccaacctggccatgagcattcccctgggcctcaaactcccagctctcattgcctgtgaggatgacagtgatgtggggaagtgtgcgcgggggaaggaggatgagggcatccccccgtgcatggcagcttgcaggctggaggggcgggacaccttggcacacgtacatagcatctggtcttatggcacgggctgcacccgccccagctgcacctcccttccctcccgtgcaggcattgctgtcctcggagccaaccagctgcactctggagtgtggaagnnnnnnnnnntccagtgatactggggagtgtgcatggggaaaggagaatgagggcatcccccgtgcatggcagcttgaaggctcgaggggcgggacacctttggacacgtacatagcatctggtctcatggcacgggttgcacccgccccagctgcacctcccctccctcccgtgcaggcattgctgtcctcggggccaaccagctgcactctggagtgtggaaggtgcagtggcccagccaggggccgtggcgggcggggcaagtgcgtcgccctttccagcgcggcgccggcaggcattcccacggcgcagccagccctccccccccctcactccccaggactcggctttcgccagcgtggcgattctgacgggcttggtcgtggccctgctgctgagctggcggttcgactaccgctcgcgctacaagttcctgcgccagcgtgccagcggccgtcagggagccccgcccgccttgacgcgccggcagcgcctgggctggttgtggctcctccccttcnnnnnnnnnngtggcaggcattcccacggcgcagacagccctcccccccccatcactccccaggactcggctttcgccagcgtggcgattgtgacgggcgtgcgtggccctcctgctgagctggcggctcgaccaccgctcgcgctacacgttcctgcgccagcgggccagcgggcgtcaggggggcccgcccgccttggcgcgccgacaccgcctgggctggttgtggctcctccccttctggaccctggagggggtcacattatccctgctgatggcatacaacctgcatgcgacgggcttctcttccatctcgctggttgccgcccaggcgctggcatgcctgggcgccatttcttacaatcacagtgtgtttgtcgccgagtgatgctccctnnnnnnnnnnggcccacaatttgtgcgccagaaccccaggactttttcatgcctggattcctgttgccagacccgatgcatgtaattttcaacaagcgcacgcatcgggggattgaggcgtacagcgcacgagccagaaataatgacgttatcatagtggtactatgtccagcagtactgatggaggagagggtgggagcccatatggaacgtatccgcttacgacctcgagtccccacgttcctgcatctactccacaaatcgagagtagcgcaggtgcacccaccgaccgctctcgtcactcgaccttnnnnnnnnnnccatccccttgatctcccacccctctttgccatgacagcctgaccttcccactctcttttgcatcgccctgaggccgctttgccaccctctccacacttcccttagtccacgacttgtgcgtcagaccccaggactttttcatgcctggctttctgttgccagacccgatgcatgcaatttcaaacaagcgcacgcatcgggggattgatgcgtacagcgcacgagccagaaataatgacnnnnnnnnnncatcatggcagcagtattgctgggggagagggtgggagcccatatggaaccaatccgcttacgacttcgagtccccacattcctgcatctactccacaaactgagagcagcgcaggtgtacccaccgaccgctctcgtcactcgaccttgcggtacagctcctcgacgccggcagctgcgctgcgcgacgtgcacgctgaatcccatctcgggaatgcacggtcatgcaggcatgcnnnnnnnnnngagctgcgttgcgcgacctgcacgctgaatcccttctcgggaatgcacggtcatgcaggcatgccaagactccaagggcatgtttgtggtggattctagcccgcttgtgcgggacgagatggacccaaagggagtggcggtggacaacctgcagggctggacgcaagagtttcgcacccccgacctggaggaggagtacgcggactgggtggccaggagcgtgctgtggcgcgacagaatgcacggcgtgatttcagcggtgagctcgtgcatgcatggtcgtgtgttcgcattgcagcttgctcttgggaaaagggcctgagcatctccctcaagccctggcctccaggcctgggannnnnnnnnntcaagcgcatgtttgtggtgaattctagaccgcttttgcgggacgagatggacccgaagggagtggcggnnnnnnnnnnacgtgtgttcgcattgcagcttgctcttggaacaagggcccgaccaattccctcaagccctggcctccaggcctgggatgctctggcggtctggagcatccgtggccactccgtcccagaacgtcacagcctcgcactgaccggtaagctggtgaatcggggaaagggtggggcatgcgtgacacctctgcccagcgctgctcaacgctgggcccccctttcttccacagtgcccttcacagcgctggcctgcaccgccatgctcctcccctgcctctggcccaagctctggatccggcaccgccacaatctcgttgccctgtgcatggnnnnnnnnnnacccccacgcaacccatgccaggccagcaccgctcagcaccccgcacccactctccttcctcccctttctgcacccgctgcaggagctactactccattgtcaccgcagtcctgggcaacaccttcatggccagggtcgtgtcgaggtnnnnnnnnnnctcccacaccatcgtattcgcggtgttcatgtgcgtggtttggccgagggcttggtcgtgtttcctgcgggtgggatgtgtccgcccccacgcaacccatgccaggccagcgccgctcagccaccccgcacccactctccctccccccctttctgcacccgctgcaggagctaccactccattgtcaccgcagtcctgggccacaccttcatggccagggtcgtgtcgaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtccctccctgcagtggcgtgggaggccctgcaatgctctccgtcaattacgagtgcgtgcccctccccaagaagctggccaccnnnnnnnnnngaccgacctgggctgcccagcacgtacaggccccggccccaagccccgcgcctcnnnnnnnnnncatgaggttgcttgcatgcggggcccatgtgggggctggcaaggcttccatgcccactcgccaccacccgttgtccctacctgcagtggcgttggaggccctgcaatgctctccgtcaactacgaatgcgtgcccctccccaagaagctggccaccctggcggcatgtgagtgagggtttgatgtgccctgcctggacctgcaccggcttggggggcggcagggnnnnnnnnnnnnnnnnnnnnnnnnnnnnnnngccaccacgcgcaatgccccctcgtgcaggcaccagcatcaatctcgccgtcgtgcaccagcagctgggcgccgaggtgggctcctgtgggtgggggaggggctcggtgctgagccgctctgggcgtggaagggccctggcgctcttgactccggccccctcctctctggtctgctgccacgcgcccctgcccggcaagctgccgggtggactggacctctgagaccccctccccgcacacgccgcgtcggtgcagggcctcccggtgnnnnnnnnnnaccaccacgcgcaatgcctcctcctgcaggcaccagcatcaatctggccgtcgtgcaccaacagttgggcgccgaggtgggctcctgtggggggggcaggggctcggtgctgagtcgctttcggcgtggaagggccctggcgctctcgactccggcccctccctctctggtctgctgccatgcgcccctgcccggcaggcagccgggtggactggactgctgagaccccctccccgtccacgccgcgtcggtgcagggcctcccggtgatgctagccgtcctcctgtttggcgtctgctacccgatggtcctgagctggcgagcagagtacaggatgcggttcaagttcctgcgcaaggtgggtcaggacctgatcggtggcggaggcgggcttcgtcgtgcgcatgtgtgtgtctatggggacgagtgttacgggcgtgcattgttcccagatgcctggctgaggcgcagagtgcctccctccgtgggacctctcgtgtttccctggcatcggcgccgcgtgagggtcggtgctgtcgccgcagctcagcacccagccccgtaccggccctgagcctcttcagactgctctcggcgattgacccgtgcgccccttgccgaccccacatac

SEQ ID NO: 24367 - DNA, 61 bp, Chlorella protothecoides
ctcagcacacttggcatttgccctgaggcatcggtacatgatctccaggacgtccagctgg

SEQ ID NO: 24368 - DNA, 61 bp, Chlorella protothecoides
ccgccgctgggaccccgacatggcgtgaaactccttggaggagcaggatgtaacattggca

SEQ ID NO: 24369 - DNA, 61 bp, Chlorella protothecoides
acagcgcattgcatgcaggatccagctacaattccttgcttcaggccttgtgctcgaacgc

SEQ ID NO: 24370 - DNA, 76 bp, Chlorella protothecoides
gctcagcggagagacctgtggattcaggggggaggaaaagtggcggtgaagtgatggagcagcggcagaatctggc

SEQ ID NO: 24371 - DNA, 152 bp, Chlorella protothecoides
tttggattggaactaggggtggtccaggctggtgcacagcgcacctggatccaaaaccgcagcaccaccttacccagcctcctccttccaccacccccaggcacatgcctaaggagccggcaggggcctggtgggacgagcgggtggagcgc

SEQ ID NO: 24372 - DNA, 98 bp, Chlorella protothecoides
cgcaaccaggtccggtcgcggggagggacatcaacctggcacgcgcatagcaggggcattgccggcagacaggcatgccgccagagggcacagacatg

SEQ ID NO: 24373 - DNA, 71 bp, Chlorella protothecoides
cctgctgagtaggtatatgagcacagggaatttgatacattttctcgtcccatgtgatgaactcgcaaggc

SEQ ID NO: 24374 - DNA, 67 bp, Chlorella protothecoides
ccggcaccacgcggggtgctcaatgcggccggtgcacagagcatgtacaagcatggtgaatcgaggt

SEQ ID NO: 24375 - DNA, 61 bp, Chlorella protothecoides
cgttgcttgaacagttcgacattccagtcccccaaaacctctgcagcgcccctcacccaga

SEQ ID NO: 24376 - DNA, 78 bp, Chlorella protothecoides
aaaaacatcgactatcgggtggacactctctttaaaagccagatcctcctcagtatcacacttttcgattgtagggac

SEQ ID NO: 24377 - DNA, 132 bp, Chlorella protothecoides
tgtccaccttgggtggatggactgcctgtgcgcagccctgctcatgcacgagtccttgtccagcacctctctcaaccccctctcgcctctccacttctaccgttcccaggctacatcaagctggagctgccc

SEQ ID NO: 24378 - DNA, 61 bp, Chlorella protothecoides
gctggaggactgcgggcgctgggacgaggggctggaccacatgcgcggcatggggcggcgg

SEQ ID NO: 24379 - DNA, 71 bp, Chlorella protothecoides
ccaaaggcgaagcgtgggcaaaagcgcgggcgagatggtgtgacgcaggaccagggccgccggattacgaa

SEQ ID NO: 24380 - DNA, 174 bp, Chlorella protothecoides
gggggggatccaggcggcaaacagcggagtatcagaccaggtacagcccgcccactcgcctcggggccgcgccgaggactcagggcacgagcgcaggccattcagaggcccccccctttctcatactgcacaacccagcccacgcacgatgtcggagggggagcgggggcagga

SEQ ID NO: 24381 - DNA, 293 bp, Chlorella protothecoides
caggaaggttccgtcgaacccgacgaggaactgtcgtcgacgtgtggaagtgagaatagagtctcgcgagtggatgtatttttcatcctatatgcgcggcttcgaaatattattccttatcgcgcgaccaaaaatctatatctctgacgtctcagtcgtgttgctcatcccgacgtggaatatgatgtggagacgaatccttcgtcgagattccgtccacatcggtgggccctccacgtcgcaacccgtcgcctcctccgaccaggtgactcgataccagtggaagtgggcga

SEQ ID NO: 24382 - DNA, 66 bp, Chlorella protothecoides
gtcccgatggccaccagtgaggcggaccccgacacagctttaggcgacaccaggtgctacgcgcct

SEQ ID NO: 24383 - DNA, 64 bp, Chlorella protothecoides
catgcaacagccagtgactcgcatgcagcctttgtccatccagcgatggtgcccctgtgctgca

SEQ ID NO: 24384 - DNA, 155 bp, Chlorella protothecoides
ggcttcgcgtcaaccccggcgaggtgcgcgtcatccaacggcacatgcgccggccgaatcacctccgtgcgtacctccgtgctcaaactcactcgtaactctcctgtgcccgagcagtgcgattgaatgcggtggcagcagcgtctgaccaggcc

SEQ ID NO: 24385 - DNA, 78 bp, Chlorella protothecoides
gcctccttctccttgcgcagcagcacgtacacctccagccgcatttcgggcaccagcgccaccagctcggccgtcttt

SEQ ID NO: 24386 - DNA, 384 bp, Chlorella protothecoides
  modified_base (129)..(287): a, c, t, g, unknown or other
cgcctgccagtctcagaccgggacatgcacgaacgccatgcaggtgatgggggccctggagagttgccaaagatttcgatgttgctgagtttaggcagcatcagcacttcactctggtctgactgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggttgtggctgtgggtttagattggtgatcaggtgtccaagcgataattattctcatttcaagaatctgaacaagggttcaaagggaccttgtc

SEQ ID NO: 24387 - DNA, 62 bp, Chlorella protothecoides
atcgaactgggcaccatgcagggacatgtgccggaggtgagaagcacataacggacgggctt

SEQ ID NO: 24388 - DNA, 61 bp, Chlorella protothecoides
ggaaggcttggtctgcgatgcaggagcgggtgttcaatgagacgctcagggctggaggaaa

SEQ ID NO: 24389 - DNA, 118 bp, Chlorella protothecoides
ctcctccctgccaggtccatcaatggccatccagcacttcacgcttccctctccgcacagccacccacctggggcaggtggtaggccaggcagttgtatgccaggtcggagaaggggt

SEQ ID NO: 24390 - DNA, 73 bp, Chlorella protothecoides
tgagattgtaacctgtgtgcattgatgtcgggttaaaccgctgatatatggaatcgctaggggcggcagggca

SEQ ID NO: 24391 - DNA, 73 bp, Chlorella protothecoides
aggggggtggggtggggtgagttgtgttgttggagcgaggcaagtgtgggtggttggtgggggaataagtggg

SEQ ID NO: 24392 - DNA, 138 bp, Chlorella protothecoides
gggacgacagaggccaagccagctctctgcttgagggtcgaggtggagagcaagtcggaaaccggagggctctcgctcttgcacaacgctgtcgtgcctataggggcacggcatgacgatccccacttccatcatagt

SEQ ID NO: 24393 - DNA, 75 bp, Chlorella protothecoides
cgggctcgccaagccatggatggcggtgccgaggggggccctgactgcactgactgcacgtgcaaagctgcaaac

SEQ ID NO: 24394 - DNA, 77 bp, Chlorella protothecoides
gagaggggacgctggtgtgggggctggcgctgccgggtcctcgacatcgcgtggctgcacccggtgaatcaggcgca

SEQ ID NO: 24395 - DNA, 61 bp, Chlorella protothecoides
gcaccctgtccttctgggtcgaggcactcagcttgcatgcccgtgcacgagcctgccgccc

SEQ ID NO: 24396 - DNA, 122 bp, Chlorella protothecoides
ggacccaagggcatggtgggtgatgggagagggggaaggcggagtgacagcgcttgagccggcgactggtaaacatcatagccttaccttttgcccacgcttacctttagccatctggatca

SEQ ID NO: 24397 - DNA, 69 bp, Chlorella protothecoides
ggccgatatgccagacagccaatcacagagcagatatcatttgtgtacacatcacaggacttggtaata

SEQ ID NO: 24398 - DNA, 268 bp, Chlorella protothecoides
gagatgttgggaggagggaggaggggtttgtgtggggggatgggttgctcggaccactgcatacgtagctgcttggcgagttgagggtctgtgcctcgacacgaatgcctcggtgaaatgtgctggcccgcttcacatccgccccagatgtgcggcagggtcccctcccctggctcatacattccaagtcgctcattacccaccccgtcaacctcgcacacacgatcctgccctccatgtacacaacacacagtacttgtggtatgag

SEQ ID NO: 24399 - DNA, 69 bp, Chlorella protothecoides
agaggccgggcggtgtggctgacgactcttccaagacaaggacccaagcagttccgggtcgtctgccgg

SEQ ID NO: 24400 - DNA, 132 bp, Chlorella protothecoides
caggagaatacagtcgggcatgcacatcctccctttgtccccccacccaccgctctccgaaacccaatcaaaccacctgtcatggccaggcaaatgacgaagacggcggtggcggcgatgcccaggatggtg

SEQ ID NO: 24401 - DNA, 80 bp, Chlorella protothecoides
gtagatgctgcagcgtggggcacaactcgcacctgctgcccagatctgcttctctccgccctgcatctcaaggatgtgag

SEQ ID NO: 24402 - DNA, 25983 bp, Chlorella protothecoides
  modified_base (820)..(829): a, c, t, g, unknown or other
  modified_base (1236)..(1245): a, c, t, g, unknown or other
  modified_base (1735)..(1744): a, c, t, g, unknown or other
  modified_base (3983)..(3992): a, c, t, g, unknown or other
  modified_base (4573)..(4582): a, c, t, g, unknown or other
  modified_base (4997)..(5006): a, c, t, g, unknown or other
  modified_base (5936)..(5945): a, c, t, g, unknown or other
  modified_base (6503)..(6512): a, c, t, g, unknown or other
  modified_base (7189)..(7198): a, c, t, g, unknown or other
  modified_base (7860)..(7869): a, c, t, g, unknown or other
  modified_base (8329)..(8338): a, c, t, g, unknown or other
  modified_base (8453)..(8462): a, c, t, g, unknown or other
  modified_base (8592)..(8601): a, c, t, g, unknown or other
  modified_base (9313)..(9322): a, c, t, g, unknown or other
  modified_base (9948)..(9957): a, c, t, g, unknown or other
  modified_base (10201)..(10210): a, c, t, g, unknown or other
  modified_base (10589)..(10598): a, c, t, g, unknown or other
  modified_base (10851)..(10860): a, c, t, g, unknown or other
  modified_base (11140)..(11149): a, c, t, g, unknown or other
  modified_base (11255)..(11264): a, c, t, g, unknown or other
  modified_base (11422)..(11431): a, c, t, g, unknown or other
  modified_base (12020)..(12029): a, c, t, g, unknown or other
  modified_base (12096)..(12105): a, c, t, g, unknown or other
  modified_base (12572)..(12581): a, c, t, g, unknown or other
  modified_base (12667)..(12741): a, c, t, g, unknown or other
  modified_base (12892)..(12901): a, c, t, g, unknown or other
  modified_base (13120)..(13129): a, c, t, g, unknown or other
  modified_base (13525)..(13534): a, c, t, g, unknown or other
  modified_base (13733)..(13742): a, c, t, g, unknown or other
  modified_base (13977)..(13986): a, c, t, g, unknown or other
  modified_base (14505)..(14514): a, c, t, g, unknown or other
  modified_base (14907)..(14916): a, c, t, g, unknown or other
  modified_base (15268)..(15277): a, c, t, g, unknown or other
  modified_base (15594)..(15603): a, c, t, g, unknown or other
  modified_base (15934)..(15943): a, c, t, g, unknown or other
  modified_base (16316)..(16325): a, c, t, g, unknown or other
  modified_base (17165)..(17174): a, c, t, g, unknown or other
  modified_base (17927)..(17936): a, c, t, g, unknown or other
  modified_base (18407)..(18416): a, c, t, g, unknown or other
  modified_base (19194)..(19203): a, c, t, g, unknown or other
  modified_base (19427)..(19436): a, c, t, g, unknown or other
  modified_base (19669)..(19678): a, c, t, g, unknown or other
  modified_base (19836)..(19845): a, c, t, g, unknown or other
  modified_base (19950)..(19959): a, c, t, g, unknown or other
  modified_base (20113)..(20122): a, c, t, g, unknown or other
  modified_base (20712)..(20721): a, c, t, g, unknown or other
  modified_base (22021)..(22030): a, c, t, g, unknown or other
  modified_base (23187)..(23196): a, c, t, g, unknown or other
  modified_base (23593)..(23602): a, c, t, g, unknown or other
  modified_base (24212)..(24221): a, c, t, g, unknown or other
  modified_base (24359)..(24368): a, c, t, g, unknown or other
  modified_base (25847)..(25856): a, c, t, g, unknown or other
cctcaagtcgccccctccgcctcctccctctcacaagtcgccccctccgcctcccccctcccacaagttcccgcccccgttgtccaaaacccatccaccacctcaatctcccaccccaaaaccgtcccctcctccacgccctaggtctccacctacacaaccacggcctccctcacccaagccaaagtcccctcctccacagtcgaggtcccctccccctgcgccaaaacactccccaccacccagcagacgcccgccgccacccaagacgcattctccaccccctcgccggagtctgcctcctccacgtgcgaaacccacgagcccacccccacctccacgcaaaagtccttccccatcccctaaacggagtgcgcctcctccaacacaccttcaaaaaccaccccccgctcattagcttgcatcacctccgccgcaaggtagacatcctttgccatggcagggaaggcacctgtgactgctcaaacgagctcttcggtatgcgagcgctcttgccacatgctggcaacccctgtcccaacaattcggagagccgttggcctccgtcagtacttcttgagagtaaatcaaaacatgtgcacgtgcttgttgctgccgcacacttccgttgtaagcttgactgcctgctgggatctaaagtctcgactctgtacgacattgtcagtggtggcttgtcactctcacaacgtgtgtgtccctagaatcctcctttccaaagtacaatgtaaacagccgaggggtttaacgagatcacatctgtgtgcttggatgctagcctcaatgagaggtgtgggtttannnnnnnnnntgtcagtacttcttgagagtagatcaaaacatatgcacgcgctttatgctgccgcacacttctcttgttggcttgactgcctgctgggatctaagatctcgactctgtacgacattattagtggtggcttgttaccctcacaacgtgtgtgtccatagaatcttcttttcgaaagtacaatgtaaacagtccagggttttaacgagatcacatctgtgtgcttgtatgctagcctcaatgagaggtgtaggtttaggttcaagaatttcctacttggctatgagctatcggatacggcgcctgtccaaggacttaggaaagcagatcgcaagtcatgcatggagttgcaagtcttaccgtaaccagtcgaatgcgccgcttttgattgatttcgaatcgtagcgtcnnnnnnnnnnccttagaaaagcagatcgcaggtcatgcatggagttgcaaggcttaccgtaaacagtcgaatgcagcgcttttgattgatttcgaatcgtagcgtcagatgaatctcgtcacgtgtccgacgtgatctcgaaagaggcctgcgtttgctcttccacctagatacttgacttcctcaaggactggtgagcttggcaacctctaaaaatagttattgtgcttgacatactcgttgtagcctatcgccattgagttcagtcttaatccgtcgagataagcctccagtcgaaacaaccctattgaaccctccgggcacacgcgcacgcgcagagcacgcgcactcgtcctaccccattccatgccgtcgacatatcttcatgtcgatgtaactgcaggattttagacgacaaacgtctcccatctcccatcacattccataatggccacccccggggtagtcgcagagccacatgtggtgagccagccaggccnnnnnnnnnngaactgcgcgatttcagacgacaaacgtctcccagctcccatcacattccgtaatggccacccccggggtagtcacagagccacatgtggtgagccagccaggccggcctgggggcgcctaccacttggcggcaccatatctgcgctccaccctcaagctcgttacaggagcaggactgctgttcctggtatatatgtggtgccagtacttctggtatgagggattcgagaagatctatggggccagcatggccaggctgggcttggtgtacacctatggcgctggcctggacccccccgtcaagtccctcgacatgtacgactccttctacatcctcttcctctgggtgcccctgggtggtggcgctctcttcatgattctggcacagcggcttcctaaccaggccaagcctggctggatgcggaggacccaggccttggtgaggaggaaggggccccaagcaacgaaaacagatgagggctgcacaccgcattagcaatacatggctttggtcatgcagcatctgtgaaacagctctgccatcccagaggccgagtaggcctgaatagcgattctgctgctctgggaagccctgcagccagaaggattgacctagggtcccttcgttcgcgatgtccaacctgcccgctcccccactccccaccccagggccggagggtgatgcagtaccagctgccgccccatggcttctggatcaagcagactgggggaatgagcgtgctggatatactcatgctcgtcatcgtgctgctgctgaacctgatgtggttctgcgtggggatgaagaacttcaacgatgaacatgctgcaagtgagtgctgtttactgacggggcatgaggtcttcatgagaggcagaaggtgccctcggcgccgccattcgcagtggggacccccttgccacaccgacactcacgcccaactgccccatgctctctgtgccagtgaggctggccggtatcaggacggtggaggaggtctggcagctcaggctcgagtggtgagcgccttgtgcagtccatgagcctgttgtgcgagggcgtggaatggcctgccgcagctttgagtctctctgttgtcacccgcctccctcacttaccccaatgccaacccctctctcccacagggcgggcctatactttggcgtactcctcttcatcgacgtctggctgctgctgcttcccattccccagagcagcttcctccaggacctgagtggcatggactaccaccagatgatccgctggcacaggtgggttgagggacagcacccagcaagtccctttcctcagggttgatacacatcaattcgtttgacctgtggccttcaaggaacctagtcaatctaccctgagcctttgtccttgccctcacaggtggatgggccacatcaccatgattgtcaccaccatgcatggcctcctgtacttcattttctggggcatcacccaccagtgagtgcctgggaggcctgcccggtgtcagtggcgttcttgtgcgcgccggcatgaacgggagggggtgacgcttggcgcattcacgagctccttttgatccagccgtgccacctgctcttccctctaccgagctgcgggggcagcggtgactcccaagccccattgtcccaggttctggacgatgttcaccgactggtcggaggactcctccatcaactacctggccggctccatttcctggttctttggccttgcgctctggctgacctccatggagtggtgccggcgcggattttgggaggtgagctccagctgcctgcctgtgctgttgacgagtgaccagggctggattcctcacatcgcatggcgcttaaagagcaattcgctcccacgctttttcatacccaagcactggcgcattcccctccctgcctttccatgccccaggtgtactaccgattccacatcgtttgtttctttggtttcatgttctttgcctacatccactactctggctcctggatctatttctcaccaggtatgggaaggtgccccggtctctggatgttattgcgggcagttgcagcacttgtacatgcatctgccaagtggtgcctgtccgatgttgtctgggtgaggggtcagggggagccctggacattgatctagaccttatcggcaccctgagctggcatacaactcccttcactttcctaagaaaaccctgtccaacccacccaggtctgctcctgtggttcatnnnnnnnnnngggcatacagctcccttcactttcctaagaaaaccctgtctaacccacccaggtctgctcctgtggttcatcgacctcgtgctcagggcagggtcctacccaaacacgaccaccgtggccaactgcggagtcagtgcatccgaggaggtggtgaccctgcagatccaggcctccaaggtgtgtaagctcgtggctgggtattccaggtgcaaggctgggccccgctcccctcatttctcctctaatgtctcacctccctcctacacaaatattattgcagagggcacgtggctgccccctccacgacatctacctcctattccccaccatctcccgctggcagtggcaccccttcaccatctcgcaccagtcgcctgacggcgtgcttaccgtgcgcatcaagagatttgggggctggaccgaggtgggtgccgaggcgcgttgtttgtgcgcactggacagggaatatgtttggcgatgggggggcgtcgctggcgcgggcccccagactcctcagggtccccagctgcgcttgtcggtatgtgcgagacgtatacacgagcccacttctgctccattcnnnnnnnnnngggcgcattgcttgtgcgcaccggacagggaatatgtttggcgctggggggcgtcgctggcgcgggcccagactcctcaggggtcccagctgcgctggtcggtgtgtgcgaggcgtatacacgagcccacttctgctccattccttccctcactccagagtctgctgaacaagctgaagaacagggagcccctgcccatccgagccagctgcccccagtacaacgcaccccatcgctggaggcaggacgaagtcgccgtggtcctggcaggtggcattgcggtgagtgatcgcatgctggccccaaggagaggacgcggagtgttgcaatgggggcatgcagatcggtgcccgccctcgactcctggaaacacctgctgctccaaagggaggatgcggtgcattcgccggccaannnnnnnnnncgcggtgagtggtcgcatgctggccccaaggagaggacgcggggtgttgcaatgggggcatgcaggtcggtgcccgttctcgactcctggaaacacctgctgccccgaagggaggatgcggtgcattcgccggccaaggcttgatttcttgaatcgtgtgccctgtctgcctgtattcccagtcccgctcatcaccgccgacaccagaccaccaaccccacgctcccgccccttcatttcctcctcccacagagtactgcggtcctcagcgtgctctcagacctggtggcccgccgggcccaggggaaagccaccggccctcaccgcgttttcttcgtgtgggcggcgcgccacgccgtcgagttctgcgtcctggacctctccgttgcagccgcctccatgtgagtggcagccgggggtcgggagtggcggccacggtgttggatgggccgtgtgccactgtggggtggatatcacggatgtcatggaccaaaggccgacacgccaccaccaatcttgctgctcattgcatgcatgcagctcttcacgaccccaaaattcctctcatcacttttcgccctgtttctccctgcaggagctccgatggttggctgtccaccagcctcttctacaccggcaaggagcccctcctggctgccaatcagcacgagaagctggactcgctggagaaggtgtcttcccgtggcagcgagtccggcagcgagccgcgggcgggaggggccgccaaggccaagcccctcacctttccccgggcctcccccttctggtggaaccgcgcaaggtaaggggattgcttggagcttctggacatttgggttggaggtgggggttggatgaggctgcgtgcatgcatgtgcccgccagctcagcccttgatcgccatggtcgaggccatgcttcagacgggcnnnnnnnnnntgggttgggacggggctgcgtgcatgcatgcgctcgccagctcagcccttgattgccatggtcgaggccatgcttcagacgggcgctccttgccacaaactcatttgcgagcacagagtcacccttggcggcgagcagcctgttgccagtcccatgccactcgcgtctacagtccttctcccctcgctccccgcaggcgcatgcaaccccagaccaccggcccctggcacctcgccatcgtgactggcctggtcttcttcgggggctttgtgggccaggccctgtcctacacgtggtatggggagtggcagacacactaccagagcctgggggaggcgctgccctacaaccccttcttctggaagcaggcggcggtcaactgcatcgtcttctgcgtcattggcctgggcttccccttcctcgtggcggtcttcctacccaacctgtacaggcaagtacggcgaggcggctgcaggggtcggtggatggcctggtacccactccccgccagacccagcgacccatcgtgcgtgcccccaccacaaactcacaggtacnnnnnnnnnnccccaacctgtacaggcaagtgcggcgaggcggccgcaggggtcggaggcagggcctggtacccactcaccgccagatccagtgacccatcatgcgtgcccccaccacaaactcacaggtactggcgcgacacacgcgccggcagcacgggggaggagcagatggccgcctttgacggcgtgtgggacccgagctccatgggctgcgagctccagggccaggaggtggtgatcccggggtcagaggcgggcatccccatcgcctcgggccggcctgacattgtcaccgtgctgcagggcgccgcgaaggagacgggggcgcgccacatcggcgtgtacgtggccgggcccgagcccatgagccgcgatgcgcagatcgccacctgccagctgaacagcaccaagggcggcgccttcttcgacttccacaagatggcgggcatgctgtagcgaggctggagctggttgaggaccctgctcagtgctggttgcctgcacggcgctcaaaaccctgattacagccccccatcctggggatgctgtgcatgctccaatgtcaggggggttgggtggatcggtgcgtagggacgcccacgcaggtcttccctatccctgagtttttctccggacgatacgaagatccttctcggtccattctttttgcaccctgacatgaannnnnnnnnntctgcacggcgctcgaaaccctggttgcagccccccatcctggggatgctgtgcatgctccaatgtcagggggggtgggggaggatcggtgcgtagggacgcccacacaggtcttcttccctatccctgagtttttctctggacgatacgaagatccttcacggtccattctttttgcaccctgacatgaagatggctattactaccggtgcgatggtccgccaagtgtgtgctcccgacaatgtcagtgccagcaacataacacatgggctcgccgccgaatgctgtctgcaagagcaccatgcgccatgttgctacataccctgccatgagcatctgtcatctggctggagccactttaaaatcgtatgttgcttcacagatcgaccccgtgcccatggcggcggagttgcaaggggcgaccaccgacaaggatacaagatttacaacatgggtcacggctcaccctgcgaaccttcctctcgcaaagcgatccttggcagacttcctcctgcgcccttcagagcgttatactaactcctcatcgcccaatcttcctaatgattattcggcacgacctccaccacggggcagcgtcccaaaatacagagtccaagctcgcgacagatatgctattgcgaaagggtcacacggatcgcaannnnnnnnnnccgcccaatcttcctaatgaatattccgcacgacctccaccacggggcagcgtccccaaatacagagtccaagctcgcgacagatacgctattgcgaaagggtcacacggatcgcaagccaagccctttgccgtatcgatcgacagaattacccactaatttgcattgcattgtagcttacaaggccttgtggtcgtgttcggggtcttacgagctaatctatcctcgggagcagttgtgagatgttcctgacaagatattggctcgaggacatgagagcacatttgaagacacattgtatttcatctagtatcttgagtttctcttaagatttatgcgggtgggagtttgagggcttcctgacatttgatctccgcattagtcaggctgcgacgtgactcgacgtctcctcggacttggctcctggcttactgcgcgacatcctcgacaggcctcgacnnnnnnnnnntcaatttgcatcgcattgtagcttgcaaggccttatggtcgtgtgcgcggtcttacgagctaatctatcctcgggggcagttgggagatgttcctgacaagatattggctcgagnnnnnnnnnngctcgacgtctcctcggccttagctcctggcgtactgcgcgacatcctcgacaggcctcgactcctccaaaactcacaaactatgatcgagtgtcttggaatgcatgcttgattgagataggaggtcgtnnnnnnnnnncctcacaaaatatgatcgagtgttttgtaatgcatgcttgattgagataggaggtcgtgcaaggcatacggtccacacactctcctcgacagcttatccccagcgtaacaaccctacgaggagactgggcacgcacgcgcacacgcgatgcgcgtgcatgcgctgcagctcaaggagcacgccgcagtgtaccatcttattcgttattcaatccttgctgaagcacaatccatcctgcaatcatggcgaccgccgtcatggacccagggctcgcaccagaggtctcggcccgccagccgcctagtctcccagccaagtgctcaccctatgcccgaaccttcatcaagctgctcgtcggcagcagcctgctcttcaccgtatacatctggtgtcagcgcatgttttacgaaggatttgagcgcatatttggcgaaggcatgaaatccatggggatcgtgtacccctacggtgcagcctacgacatcaagaaccccgaccagtacgacgccttttacgtcctcttcctgtggatgccgctgggtggaggcgcactcctcaccatcctggcgcagaggctccccaatcacaccaagccgctgtggatgaagaggacgcaggctctggtgggccagtgggggggtgcctggccggatggatgggcatgtgtagattttgccagtgcgagctggccagctctcctcacgacctggtnnnnnnnnnncgagggggagcctggccggatggacgggcatgtgtagattttgccagtacgagctggccagctctcctcacgacctggtctctggttaccagtttgtctccccccctcaccattcccgcctgcaggggcgtcgagtcatgcagtaccagctgccaccccatggcttctggatcaagcagaccgggggaatgagcgtgctggatgtcctgttcctcgctaccgtggtcatgctcaacaccatctggttcgtcgtcggcatgaccaacttcaacaagcgctatgcagcaggtcagaggggggcttctgtgctgagcagggtagagcaggtgagtgattgagtgctgtactgcatggcagcaagtgaagacaccagtcgcaaatgggcggcctgctccacgtcgcagtggcctccagcggcatcaagaccgcacaccctgtgagccagctacgcctcgaatagtgagtcctggggggtgagggtggaaagagcgctgcagccagcccgctgggtggagaggcttgggcgatccatgggtaaatggcgtttggttcgagcacggccgggagtacacgcgccgtgcagccacccggtcccctgaccccccccccccccccccccccccccnnnnnnnnnnagctggatggagaggcttgggcgatcgatgggtgcatggcgtttggtttgagcacagccaggagtacacgcatgatgcaaccacccggtcccctgaccccctcccatgccctgcagcgccggcctctactttggcgtgctgctcttcatcgacatctggctgctcctcatccccgtgccccagagcagctacctccacgagctgacggggcttgactaccaccagatgatccgctggcacaggnnnnnnnnnncgtcacttccttgcacggcatcctctactacatattctggggcatcacacacgagtgcgaggggcttgggggggtggaaggttgcatcaggggggggccagtgatgtcctgtgggatcaccacctccttgaagaccctagcaagggcccaagcattgcagtgaggatgtcagcgcacacatggtggtgttccagccctgtcgaggttgtcagctacaatgacaactcggtgcgactctttacatggcactgtgcatctgggaagtgaggcctcggcctgtgcactgcgcctggctcattcatatccttcaacaactttctcccagcttctggcatgagttcagcgattggtccaccctgcactacatcaacaacctggnnnnnnnnnntgagtgcgaggggcttggggtggtggaaggttgcatcaggggtggtacagtgatgtcttgtgggatctccacctccttgaagaccgtagtaagggcccaagcattgcagtgaggatgtcagcgtacacatagtggtgttccagccctgtcgaggttgtcaattacaatgacaactcggtgcgactctttgcatggcactatgcatctgggaagtgagacctgggcctgtgcactgcgcctggctcattcatannnnnnnnnngttctggaaggtgggcgttgcggggcggccatcgcagggccagggagtctcgcacctccttgggttggctggcctgggcaggaccgtcccacacggcaaagccactgaagcacatgcgacggtgcacaggccgtcgcttgcaggtcagatggcagcaaatgagcacagtacgtgaggagccttctcaccctccacacacaaccactcctgggacagatctactaccacttccacatggtgggctttgttggcttcatgctctttgcctacatccactacnnnnnnnnnnttgaagcacatgcgctggtgcacgggcctttgcttgcaggtcagatggcagctcctgagcacagtacgtgaggatccttctcaccctccacacacaaccactcctnnnnnnnnnngatcgggcatcagatgctttcgtggccctctgcctggagtgctggtgccccggctgtgttgcacctcacatgccctcgcacaccacacgcatttgtaacctggaattctgggcccaatccgttccctctcaggcctcatgctctggtgtgtggacctnnnnnnnnnnaagcgggcatcacatactttcggggccctctgcctgggttgctggtgccccggctgcgatgcacgtcacatgccctcccacaccacactcgtctgcaccctggaactctgggcccaatccgttcccactcaggcctcatgctctggtgtgtggacctggtgatgcgctcaggggcttttgccaacacgaccaccgtggccaactgcggcgtgaatgcaaccgaggacgtggtgaccctgcagatccagggctcccaggtgaggggctgggaggggtgagtctgcctgccaacgtttgcctgggatgcaccccggcatatggggggccatgctgctggaaatggaagaatctcagcccaggcccgtcccttggcctgcggagctgacaggacccaaccccccaccccgcatcacacctgcagaggatgcgcggctgccccctccacgacatctacgtcctgctccccagcatctcccgctggcagtggcaccccttcaccatctcccagcagtcggcggatggcatgctgaccgtgcgcatcaagaagtatggcaactggagctcggtgagcgttgccaggggtgggggnnnnnnnnnntctccccacccccaactcctcctccagaggctgcttaacaaactgaaaaacagggagtccatggccnnnnnnnnnncgcttcccatcactcatgggttgcatcattgatgctccacatgaccctcccatctccccaccacctctccccacccccactcatcctccagagtctgctgaacaaactgaaaaacagggagtccatggccatccgcgccagctgcccgccctatggcggcccgcaccagtggcgacaggatgaggtggttgtcgtgctggctggcggcatcgcggtgggtgacggcacggcgctgcaaaactgggaagggttctttgcgaggataacaacatctaccccggtgccgaatccatgttcccacagcatctgcaaacctgccgatctagggcggcattcacggcgagttccgcatggacatgcggcttgacacccctgcctgtcccgccgtgctcccaaacaccactcctgcaccgccagctacatccccaaaccccagaccacgaacccacgctcccactccttccttnnnnnnnnnnttgccgtgctcccaaacaccactcctgcaccaccagctacatccccagaccccaaaccacgaacccacgctcccactccttccttnnnnnnnnnnnnnnnnnnnnnnnnnnnnnnnnnnnnnnnnnnnnnnnnnnnnnnnnnnnnnnnnnnnnnnnnnnnccacgggtcccctatgaatgagccgcctgggccccatgctcctgcctctcctgctggttgtaggggagctgaggctctcgctggggtgcagggaggctgcgcagaagccctccccttccccagcacaccaacattctccccccactcttcnnnnnnnnnnacacggggtctctgaaagggagccgtctggcccccatgctcctgccgctctgctgggtgtaggggagccgaggctctcgctggggtgcagggaggatgcgcagaagccctccccttcctcagcacaccaacattctccccccactcttcctgaccacctggcacaggaacagcgatggttggctgtcgaccagcctcttctacaccggcaaggagcccnnnnnnnnnngaccaccaatgttgctgctcgctacatgcatgcagctcttcacgaccccaacgttcctctcaccacttttcgccctgtctctccctgcaggagctccgatggttggctgtccaccagcctcttctacaccggcaaggagcccctccgggcctccgacctgcacgagaagctggactccctagagaaggtgtcctcacgtggcagcgagtctggcagcgagccacgggctggagcggatgccggggccaagcccctcaccttcccccgggcctcccccttctggtggaaccgcgcaaggtaagggttgggaaggggagcgtggacatgagcttgaggggcgggcgggaacagaggtgcaagcatatttaactgctcgcctgtgctccaaaccatcannnnnnnnnngcacgagctggaggggcgggcgggaacagaggtgcgggcatccttaactgctcgcctgtgctccaaaccatcacactcctggtctgccctgggcagctgccgtgagtcgggcaccgagtcctgatgctggccggacgagcgcaagcgtgcgcccaaaccctgactgtgcaggaagctgcagccgcaggccacgggcccnnnnnnnnnnggtcgggcaccaggtcctgatgctggctggacgagcgcaagcgtgcgccaaaaccctgaatgcacaggaagctgcagccgcaggccacgggccccctccacctggccatcatcaccgccctcaccttctttggcgggtttgtcgggcagtttgtgacgtacagctggtatgccgagatggcgacgcactacaccagcattggcagctcctacccctacctggagtactactggannnnnnnnnnctacagctggtatgccgagatggcgacacactatgccagcatcggcggctcctacccctacctggagtactactggagggtgaggccgggggtctgggaggagccttggctgctgccagcagcatggagcgaggctcgcctgcacggcaggcctggggtgtcgtgcttcgggatcatggcccctagccgagggcagcccgcgcaggccacggccagggctcggacccctcacgtcagtcaagtccccgctgtgcccttgcagcaaggagccctcagcgcgtttggagtcatggtcggcgccctgggcctccctttcctcacggcggtttttctgccgggactgtacaggtgggggtagggggcaacactcccgggacattgccagtccaccaggggcatgtcgagatctgcccagccccctttggagggacccagtcgtatgatgcccgaactcccaggcgctgccacgaccacacagtcaccctagtacctgcctgcaggtactggcgcgacacccgnnnnnnnnnngtttctgccgggactgtacaggtgcacggagggggcaacactcccggggcattgccagtccaccaggggcatgtcgagatctgccccaacccccctcgggcggacctagtcgtatgatgcatgaccgcccaggcgctgccacgaccacacaatcacctcaaacctgcctgcaggtactggcgcgacacccgagtgggaagctccaatgatgagcagatggctgccttcgatggcgtgtgggacccgagctccatgggctgcgagctggtgagtgcctgcgcggcggcgcagcgcctcgtccagggtgtctgggggaggggacccctcacagcacctggccctctgctgctcataggagcctctgacattctgctgctctgaaggtcgcgctcnnnnnnnnnnatccaggggtgtctgggggaggggacccccctcacggcacctggctctctgctgctcatgggagcctttgacattctgctgctctgaaggtcgcgctcaccttctgccccatctccacaggccggcgaccagctcatgattccgggcaccgacctgggcattcccatcgcctccggccgccccgactttgccgccgtcctgcaggccgcagccaaggaaacgggcgccaagcacgtgggggtgtacgtggcagggccagacaccctctctaactctgcccactccagcgtctgccagctgaacagggtcttggggggtgggacctacttcgacttccacaagatggcaggannnnnnnnnngtccaactccgcccattccagtgtctgccagctgaacaaggtcttgggagggggcacctacttcgacttccacaagatggcaggattcttgtgagcttggcgggccacatgccatccagcaagcacaagcagtcgggcaatcctggtgccgaccacgcatggatcattatgacgggaggtggcggtgcggggatttctcctcaaatacttcgttgttggcctttggctcaagttcattctatcgttgccctgcatctctgaaccgggcatgaaaagctgcaaacattcatttgaagtttcatgcagtgcttaccagnnnnnnnnnngtcctggtgccgaccacgcatggatcatcatgacgggaggtagcggtgcgggaatttctcttcaaatactcctttgttggcctttggctcaagtttactccatcgttgccctgcgtctctgaattgggcatgaaaagctgcaaacaatcatttgaagtttcatgcagtgcttaccagaaaactcttaatattaataccttgtcatgcatcaccagtgggtccaagcaaggacggcagccagggacaacgcggtatgccaatgattcatcgaggaatgtgtaccgaattccaggagcttactttcggcatcgaccagagatttaatctcggnnnnnnnnnngagcaaggacggcggccagggacaacgcggtatgccaatgatgtattcaggaatgtgtcccggattccaggagcttattttcggcatcgaccagagatttaatctcggcatttgatgcatgtagggttcaagtggttgagacaaaggtgttgcgggcgtcatggggttgagtaatctgaaggtcaggggagcaaccccaagtaccacggttgtaccagcgatggggacgttcgtccggggggctgcacactcgagatcgacgaggcatgggtcctgatgaatcaaaaatcttgcagatgcatgaaaacttaggaattgaaaggagtgccctgatcagccaacgtcccagattggtcgccgaggggcaagaacnnnnnnnnnnattgatgcatgtaagcttcaagtggttgagacaaaggtgatgtgggcgtcttggggttgaggaatctaaagatcaggggagcaaccccaaacccctcggttgtaccagcgagggggacgttcgtccgggggccgcactctcgagatcgacgaggcatgggtcctgatgaatcgaaaatcttgcagatgcatgaaaacttaggcattggcaggagtgccctgatcagccaatgtcccagattggtcgccgaggggcaagaaccttcacaagcccagcgtttgcgtccgcgcgattgcggcgggacggatcccacagagcaaaccgcactcgggggggtttaaatagattatcgaacaatatactatcgcgtcaatggaacgagtgtgcttcactcggatgatccacacagcgcgaggacaactccatctgtcccccggccgattgtggaccggagctcgcagaatgggggcagaggcaggtccacacgcccaaactgcttggaattgaataaggcttgtcagcagaatcctagttggagttcccgcaacgtcagggcagcatgtctgttgccatggcgccaagccctcgtgcccggagaacccttcaagggcttttagtcatgcaggcgtgcgctctaagccggtacacccggaaacagcgccgccagcgcagtatttcatccacaacgccacgcaataagtttgttgtttatattttgtcccattcttaaagctgctcgcggcgccatggcggacagcacgcttcccaagggcaacctccctgaccttgtaccagcgccccggacgtcagcgttgagacgcacattgccctacatacgcnnnnnnnnnntacacgcccaaactgcagggaatattgacaaagacatttcagaagaatccacattgcagttcccgcaacgtcagggcagcatgtctattgccatggcgccaagccccggtgcccggagaacccttcaggggcctttagtcatgcaggcgtgcgctctcagccggtacacccggaaacagcgctgccaacgcagtaattcatccacaaccccacgcaataagtttgttgtttatattttgtcccattcttaaagctgctcgcggcgccatggcggacagcacgcttccccagggcaacctccccgaccttgtaccagcgccccggccgtcggcgttgagacgcacattgccctacatacgcacctcacttaaactacttgtgggatgcggtctgcttttcacggtctacatgtggatccagttcatgtggcgcgcctccttcaaccggatctacggcccgggcatcaaggatctgcccctggtgtacccatatggggccgagtatggcatttcgaacccctctggcagggagcccttctatgtgctattcacctggatacctttgggtgggggtgctctgctgaccatactggcacagaggctccccaacgataccaagccgacctggatgaggaaagcgcaggcgctggtatgatggcagaagggacggctcgctccgacgagctggcctgctgagggttcggccattcacctggatttgtggccattccttgaggtatacgactctggaagnnnnnnnnnntgacgagctggcctcctgagggtttggccattcacctgaatttgtagccattccttgaggtatacgactctggaagtgtactcctgccaatggcaactctattcccgaatccaatgtcacagggacgcagggccatgcagtaccagctgccgccccgtggattctggatcaggcagactgggggaatgagcgtgctggacgccgccatgctctgcatggtgctactcctcaacctcatgtggttctgcacaggcatgcagagggaggagacacggtacagcgcacgtgaggccgggatcctgggacgttagggtggcatggaggccatgtagtttgggccgccacagcttggcaacctattcagcatccctccccaccgttgccttcctgctctcccgaatgcgcagtggaggcggcggggctgaagccaggtgtggagctctggcagcgccgactggaatcgtgagtgcnnnnnnnnnngccctaggatgttagggtggcatggtgtctgcggaggccatgcagtttgggcacgccacagcttggcaaccttctcagcactcctccccaccgttgccttcctactctcccgcatgcgcagtggaggcggcgggagtgaagctgagtgtggagatctggcagcgccgactggaatcgtgagtgcaaagagttcaccttggacaccagggcttgagaatgtcggcctgggcttggtccagtctcaaaatatccctccccccctcccatcccctacagcgcggcactctactttggcgtgctcctgtacattgacgtctggctgctgctgctccccatcccccagagcagcttcctgcaggaactcagtgggctggactaccatcagatgatccgctggcacaggtgcatgctgtgcgtgtttagtcatcctgtctctgcggggggtccaaagttcccgaagatgctatgcaaggctactcacccacacgccatcccccacccacccaccctggcacctggcactcccgcacaggtggatgggccacatcaccatgattgttacctccgtgcacggcctcttgtactatttctactggggcgtcacccaccagtgagtcctcgagcctgacattcccttgctcggtgttcatggcccttggagggtgccagatacattatgctccagcctcaggtgtctgaaaactatggattggacccgcctgccttgcacaagtccacaatctgtcgccttgcataaactttgccccagattctgggnnnnnnnnnntctgcccttcccttgctcggtgtgcgtggcccttggagggtgccaagtacatcacgctccggccacaggtgtcttaaacctatggattggacccgcctgccttgcccaagtccacaatctgtccccttgcataaactttgccccagattctgggcgatgtttagcgactggtccaccgtctcttcaatgaactacctggccggctccatctcctggttcttcgnnnnnnnnnngacactctcccttgtatgtagagattctgtgccatagtgtgagacctcacatcttaggaccaacatcgctgatacccaggagaagtattttcccaccgcttgccctgcatatctccacaccccccttctctccaccgtatcctgcgctacaggttctgggcgatgtttagcgactggtccactgtgcattccatgaatgccttggctggctccatctcctggttcttcggccnnnnnnnnnnaacgcctttctgcacttgcttgctcctactcccatggcgtcctggtggacagcggtgggaccccacctgaacccgcacccaactgctgccccaggtttactaccgctgccacatcgttggcttcctgggcttcatgctctttgcctacatccactacnnnnnnnnnngacgcctttctgcacttgcttgctcctacccccatggcgtcctggtggacagtggtgggaccccacctgaacctgcacccaactgctgccccaggtttactaccnnnnnnnnnnaggtgtgctggcagttgggactgctgccgcgagatgtagcccctgctggtgatggcctggcgcttatagcccgaaaacacacacccaagtcgtgcacctgcccaaccgtatccccccctcatgccactcccaggcctgctgctgtggtgcatcnnnnnnnnnntggtgtgaggacagttgggactgctgccgcgaggcgtagcccctgctggtgatggcctggcgcttttaccccgaaaacacacactcaagccctgcacctgcccaaccgtatccccctttcctaccactcccaggcctgctgctgtggtgcatcgacctggcactgcgttctggggcactggccaacaccaccacagtggcccatagcgcggtggatgccagcgaggacgtgattacgctgcagctgcagggctccaaggtggggtggggtgggggtgaaaggcgtgcagcggcagtagaagggtgctggcttggcagagccaggagactcagacctcttcccttctggcgctgtgctgatctggcagtggggcactcacaaaagaggaatgtggcgaagctccccattctgtgcttccctgcaaaggcccatgggccactgcatggcaatgtcagaggcagcccgatagcctccctgaacaccgccacaccgtctctcatcgcaacagagggtgggcggctgccccattcaggacatctttctgttgcttccaagcatttcccgctggcagtggcaccccttcaccatcnnnnnnnnnnaaaggagaaacagtagtgatcggacggtgctgagctcacactgcttgaaggccgaagtctcctttctatccagcgttccattgggctgacagtgaagcctctgcggggaaagaggagtggcgtccctccccggcccctggccccctgccaagcggatgggttgcttcttaacatgtacatgagaaacccttgcttctctgcaccaaaaccccacaccaccctcccatcgcgacagagggtgcgaggctgccccatccatgacattgcacttttggtccccagcatctcccgatggcagtggcaccccttcactatctcccaccagtcggcagacggcatgctgaccatgcgcatcaagaagcagggcgcctggtccagggtgagccatgcctcttgagggtgttctacccgctgcgacggcatgcgggatcgccctccctctctagaacatcgggacagtctcatagccgggcccacctgaccccacccaccccaacaaccgtgcaggagctcctggcacggttgaagaggagggagagcctcccggtgcgtgcaagcctgcctccctacggcgcgccccaccagtggaggcaggatgaagtcgtcgttgtaatggccggtgggactgcggtaagcatccttgagtgtcgcattttatgtattgagttggagtgtgggcttgccgcatggcaaatccccggcaaactgatcgatcaaagagagccgccgtgtcccatgccgcacactcaccgagtgagggggacatccaccaagaatggggccccatatcctgcccacattaccccatggcccatgtctgcctgtagagcacagcggtcctacgggtgctctccgacctggtggcccgtcgcgcccaggggaaagccactggcccccgccgggtacattttgtgtgggtggcgcgccacgccatcgagttctgcgggctggactgtgctgtggccgacgctgccatgtgagccatgtcttcaccagcatgcggacaatgatggggggaaggggagcaatctgacgtgcagtgccatgggatgaggccacagctcctctaatgcagagctgcaccttcctcgtcgcaggaatgccgatggatggctggcggccagcctatattataccggccgggagccgctgccagcctcaaaggagccgagggcgactggtgcgctggaaaagccatcctcccatgacagtgacactcgcagtgaggagcttcccacgattaagggtgctgactccaccatccccgcgagcttcccactggcttcgcccttctggtggnnnnnnnnnntgcggagtcctgtagggcccctatcaggctggaagcgacgttccaggggacgggcacttgcggcaggggccgcacagaatgggatgccatggatgcagttgggctctatgccctccaagggactgaggagggtgtacacgtctgctaggcgaggtctcaagcaaccaaaccgggctagaacatagaagcagtgcatccacccttccctcccttcctacaggaagctgcagccccaggccacaggccccctccaccttgccatcgtcaccgcactgacattcttcggcggctttgtcggccacttcgtgacctacagctggaccgcagagtgggagacacactatgccagcctcggcgaggagcctgacatgcgccccatcgagtggcgggtgcgtaggtgatcctgcagcgagcttgcagcaggccaggcggatactgggtgtgccgcacatttctccagatgcaatcgggtgagggactgctccagttgcacagacgaccgcaggccgacaccgcctccacaacccctctgcccatttaaacctcccaaccatccttgcgccgctctctgcagaatgctgccctggccagctttggcgtcattgtgggtgggctgggtctctccttctttcttgccatcttcatccccggcctggtccggtgagtgcacgagggacttggaggtggcaggaatgccccagggcgtcgcagcctgcacagggatgcaggtggaccagcatgcccccccttacttgtcgaggtgggcgccggtgcgccacctgcccctcaccgccagccgcaacctccttgccgacccctccaggtactggcgtgacacccggacaggcagcgccaccgacgagcagatgggggtggacagcagcgtccacgaccccgttgtcgtgggctgcagtctggtgtgtgggggggcgcaccgtaacttgtgggtggcctggcctggccgcgctgcaggcatgtggcgcgaaattggtgcacacctgaaccaccagctcagccacccgttgctcgagggaaagattgtatactgaagcatcttcctcctccaaacacaatgcccccacaggtgggtgaccagctcatgatccctggcaccgacctgggcatgcccatcgcctccggccgccccgactttgccnnnnnnnnnncagtccctctgcctcctctccagcttccggtccgcccctcccaggtacttgcgtgacacccggactggcagcgccaccgacgagcagatggaggtgaacagcagtgtccatgacacggtcgccatggactgcaagctggtgtgtgggggggaccatctctgcctgcagaggcctgggcgcactgcagactcttggcttgggcttggagggcccctgagtcccgagctcaggccctccagcccggcaaccctgaattgcatccaagccgcaccccccaccacatgcaaatcacccacacaggtgggcgaccagctggtggtccctggcaccgatctaagcattcccatcgcctccggtcgccccgattttgccgccgtcctgcaggctgcagccaagnnnnnnnnnnccccgccagcccggcaaccctgaattgcatccaaaccgcaccccccaccacatgcaaatcatccatacaggtgggcgaccagctcgtggtccctggcaccgatctgagcattcccatcgcctctggtcgccccgattttgctgccgtcctgcaggctgcagctaaggagacgggcgccaagcatgtgggagtgtacgtggcagggccagagcccctggcccaggccgcccacctcgccatctgcgagctgaacggcagtggaaaggggtgcgcccactttgacttccacaacatggccgggttcctgtgaggggaggtcgtgcctgatgaatctccgaccagaccatgggcggtgccagggcggccactgccagccccttgctcatacggtcttgcactgctcacgattaaatactgcactgctgttctgtaccagacgcccagcgcggcggtgaccccagcgccttgcttctttccccctcttgtggtccaactcatccacgaacgagagcttggggagggccaagggcacgcatccaccacgcaccatcccgaccctgtcccagctcccagcctaagcacaggcaaactgtctgctgcaccccccccnnnnnnnnnncttccccctcttgcggtccaactcatccacgaacgagcgcttggggggggccaagggcacgcatcccccatgcaccaccccgaccctgtccctgctcccagccacagcacaggcaaactgtctgctgctccccccccnnnnnnnnnnacacaacatggccgggttcctgtgagctggctggccacaaacccctccagccagccaaacaaacagtcgaggactcctgctgcagacggcagcaggaccacaatgtgtgtgtgtgtgggggggggtgtgacctgatagccttctccaaatccaggctgatcttctgctcaagttcaatctctcttggtcctccatctcaacattgtccttgaatttctcaaaaatgtccgtatgctcttgcatgcagtgctctccagagagcttcaactgttatactcgaggaggatctcagcagctccttccaatcagtgaatgcagccagaaagaatggtgcgcgcccctggtatgtctattgattggcctctgggtccaggcgctgatccagtgacgtatgttagactgtacaaactcggcgcacgccacctagacgggtgtcgaattgagactctgccggggtgggtgtcacgggaaggaatacctcatttgcacctgcgagggcagcgtccccctaagacggacactcgacgtcgatgaggcatttccaaaaattgaatcagcacccctgcgagaatattccttctccgctgtctaaatcgcccgaagacatgcctgtgcgctccatcggccgccgaggggcgcgaacgtccggagccatagcggtcatgtgtccgcgcgcttgcggatagacggatgtcgcaccagcagatagattagcaaggtatcaagttatattgaagggtccaagctgtgttagtgggacgatttacagttcactgggaccaattccatcatgccccgcccgactctggaccggagctcgcttggccgtgcagccagccaagctacacgcaaacacacccccaaaacataaaacaataagtcttaaaaatattctggttataatggtttgaaaatcagagaaaaatatttcgggcgagtggggccaaaccctcgcagaatgccgtttagggtattagtcatgcgaggggatgccccccccggattccggaatacagcatccccagcgcaagcattcaacccatcacggcacggaaataaatgtatactcctcttcctctccgtatccattactaccgctcgccatggctgacgggagccttcccgagggcaatctcccggaccgtagaccgacgccgtcggcggttcgacgcatatcgccgtacattcgcaccgccctaaagctaattgtgggatgtggtctcttgtttatggtctacatgtggatccaactcatgtggcgcgcctcttttgaccggatctacggcccggggatcaagaatctggccttagtgtatctttatggggctgagtacggcatcacgaatcccaccggcccggacatgttctacgtccttttcacctgggtgccattgggtgggggtgctttgctaaccatcctggcgcagaggctcccaaatgaaaccaaaccgacctggatgaggaaagcgcaggcgctgnnnnnnnnnnttacggcccgggcatcaagcatctggccctggtatacccttacggggccgagtatgacatctcgaaccccaccggcagggaggccttctacgtccttttcacctggatacctttgggtgggggtgct

SEQ ID NO: 24403 - DNA, 61 bp, Chlorella protothecoides
tccactcactgtgccacctggcttgcaaggtgtgacgccgacggccccaaaacccccgccc

SEQ ID NO: 24404 - DNA, 71 bp, Chlorella protothecoides
tcctcaccgacggtgcgtgatgaggagttggagtgtttgttgtacgcccaagcatcagccggggcaggaac

SEQ ID NO: 24405 - DNA, 73 bp, Chlorella protothecoides
gtgtgcccttgtggtcatcgctgatgcagcgcgcggcgtgctacatggaccctccctcggtccctgctgcacg

SEQ ID NO: 24406 - DNA, 61 bp, Chlorella protothecoides
cctgtgaacatacaacataatctgtcaatattaaactccaagggtgttagatcaggctggg

SEQ ID NO: 24407 - DNA, 73 bp, Chlorella protothecoides
taaactccaagggtgttagatcaggctgggctcctgctgcagaatctcagggggcaatgtcacaggaaccgca

SEQ ID NO: 24408 - DNA, 91 bp, Chlorella protothecoides
atgctgggattgcgaaaggccgggttgatgtccagcagagactccacgaggtcaatggcccaccgggacaggcgctgacactggaaagtgg

SEQ ID NO: 24409 - DNA, 75 bp, Chlorella protothecoides
atggtggtggtccagatcaacgatagggttggactcgtgctgggatgatgtggggtgtctcgcactcagaattgc

SEQ ID NO: 24410 - DNA, 121 bp, Chlorella protothecoides
gtaccgttcccttggcattcttcattcttcagagccttcgccatacaatctgcatctccaaggtgcttcgaccgcatgattcaggcctacacccctgagaccctctgccatctggactgga

SEQ ID NO: 24411 - DNA, 67 bp, Chlorella protothecoides
cgatgccaaacaatggtcgctcgcaccttgtgccagggccggcatgccacacccgcgcatgctctcc

SEQ ID NO: 24412 - DNA, 75 bp, Chlorella protothecoides
gtgtgggtgtgttgggggagcagggcgtgcagcgcatcatgcacggctgtccccaggcctggggtctgccccaca

SEQ ID NO: 24413 - DNA, 61 bp, Chlorella protothecoides
ctcactgcagtgatgggagaaatagaagtctgtgagcagagagccgtacgtgaggatcact

SEQ ID NO: 24414 - DNA, 65 bp, Chlorella protothecoides
gcgtcaggctgtgactggccctccagatttggtgctcttgacataccatcaaggagctgatcacg

SEQ ID NO: 24415 - DNA, 76 bp, Chlorella protothecoides
caaaaccgcgatgcgcagtacagctcatggcccccgtcatggatggtgcccaggatgcatctgaaaccgcgtcgca

SEQ ID NO: 24416 - DNA, 61 bp, Chlorella protothecoides
tggaagaggcgctggaatcataccggcaggacatcgttcaggtgctgcccagcaacaccgt

SEQ ID NO: 24417 - DNA, 245 bp, Chlorella protothecoides
acttctttgcaattgtaggtttataggcttacaagcatgtatacagccccatgtccatccctgaacgtggttgtgcctcccgcagaggatcgtcgttctttcccacgctttctaaaaccccccttggattggtgagctcataagatagagtcttgaggcaaacaccgcaattaactagcccgtatcctttcctatcaagaaaatcaacctcctgaaaccatgtctggacgcggcaagggcggaaa

SEQ ID NO: 24418 - DNA, 113 bp, Chlorella protothecoides
agcatttgctgcgcccctcgcatgattgtaaaaggcttaagagtgtcaaggcgcaggatttaccctgggccggaatttgtgcttgggcatgctgagcccttccggtgccccaa

SEQ ID NO: 24419 - DNA, 107 bp, Chlorella protothecoides
cgctgcattcgttcccttcttgagagaggggatggcaagaggcgacggacttattgagggactacaatgctcatcatcacctttacatgctgcagaatttgcgttct

SEQ ID NO: 24420 - DNA, 61 bp, Chlorella protothecoides
cattttttttcgtttcgcggcagcttcaaatcgattgggattctgtgcgacagtgtccgaa

SEQ ID NO: 24421 - DNA, 79 bp, Chlorella protothecoides
tggtacccccctgacccgtggtaccctcctgaccccgtggtaccctcccgacccgaccacatgctgattcacacccccg

SEQ ID NO: 24422 - DNA, 61 bp, Chlorella protothecoides
gggcctcgtactgcaggaccagctgcttgtaccccgccaggatgctgtccacatccgcctg

SEQ ID NO: 24423 - DNA, 79 bp, Chlorella protothecoides
ttaaaaacaatgataagcaaggcaggaccagatgtgagggtcaggttcaagagggcaagggtgttgtctgaacttctac

SEQ ID NO: 24424 - DNA, 455 bp, Chlorella protothecoides
  modified_base (182)..(390): a, c, t, g, unknown or other
gccacgtcgccatgggggacctgctcaggtgctgggcgggggccgggtttccacaagaagcagggggcgggtctgctgcaccccgcaccttgggttgttgcgtgctgccagcgggctgcccctccattcaccggcgtatacaggtacaagacgaccatgcgcaccgctggcgaggtggactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacctatgaggacctccaccccgctatgcacacggcggtcctcatcgctgtgggaggcggtgt

SEQ ID NO: 24425 - DNA, 94 bp, Chlorella protothecoides
ccgccctacgacccctccacattctagagttgctgcggcatccccccgcatgcgccctgttggtcctctcttttaccctccttaccaaatgcat

SEQ ID NO: 24426 - DNA, 232 bp, Chlorella protothecoides
tgatctggattcatggtctgtaagaagtgatgctcggctctcgctatgaggacatggcgacagggtacatgggctgccgggtgcatggcagattgctggtcaaaatacggttgcagcagggagggtgccagcacaggtggcaagcgtgcgacccatggcgtgaggtgtgcggcaccccagggacagggtgctcaggttatatgatgaaaaatggctggcccattccgcggtg

SEQ ID NO: 24427 - DNA, 125 bp, Chlorella protothecoides
tcagccaatagtccccaccgccagagggggaagaggggaacatggtccaatacaatagacattggtcctgtatgccagacgtgtcgttcaccttctgctacttccctacccctcagcagcaatct

SEQ ID NO: 24428 - DNA, 115 bp, Chlorella protothecoides
gggccgtgggagactcagagttcgtgcatcatggccgtaaggcgtacggaaatccctatacacgagatggcaattctctttgccaaggtgcgggaggatgcccagcacgtatgat

SEQ ID NO: 24429 - DNA, 61 bp, Chlorella protothecoides
ggacttgggcttgctcccggccatggctactacggccacctctgcgggaggccttgtgaca

SEQ ID NO: 24430 - DNA, 1608 bp, Chlorella protothecoides
ccccgacaccccccccccacacacacacacacttccctgctctgcgcccactgctgtcacgtctccttcccccatatccccttgctccacacccagtactacgacgatgcggcgggcatcctgcgcatggtcatcctgtcggcggtggccccgcaccgcctgctggcgccccccaacccgcccatgtcgctgtccgacccggccaacccggaggacgccattggcaaccacgcctgcctgggctccatgagcgacatccatgagggggaggaggacgacgaggaggtggcggccaaggctgccctgtttgcgcagctggcgggcacccaggaggatgacctgacgtgagcctgtgtggtggtggacgggcaggggggatggaggggtcgtggagtgggccttgtatgggcccaggtggggtggtgcttgcctcttggcatggcgctcgggagcgtcgttagtcggtcaggcacgcacaggagcgtcgtgcgctacaccttgcgaccaaatggaagacgggctcgcaggcagggcatgcaggaaggtgccccactgcatgtccacagatgccctgtcacatgctcattgcacttagccaccctccacacacacatttcccctttctatcacaggcttcgtcccgacgaggaactgcggtgcgtgctggccatcatccggcacggcgaccgcacccccaagcagaagatgaagatgaaggtcacccaggtgaggggcagcaagtgacgcctgagggctggagcgtcggcttcgcggtccggcgtcgacaccatcccggccgcgctccccaccaatgagcctgcacatcgcatggctcgccacatgacaggccctcctgccctcccccctgagctgcacaggcccccctcctggcgctgtgcaacaagtacctggactccaagggcaagcaggccaagctcaaggtgtgccgcgtggctggggcacactggtgccagtgaagctattgctgggaagggtgcctgtgaggatgtgcttccttggggtggacgatggtccctacacacatctggtgctgttcagtccctggatgcctccacgatcttcgcggtgccttgacatgtacggagcatcccaccctgtccatggataacgcccacagagcccctccgagctgcaagacctgctggacgtggtgcggcagctgctggaggaactggagatgcctcgggcaaaacccgcggaggccagcctccccgaggaccaagccgccacagcagcggacgacaccttgcaggacgaggagttccgcgagaagttccgcatcgtcaaggtgggtcgggagggcgccttgtagtgggcctgggcgctgggatgaggcctgggtggctgcaggagggggctgaagcgctgggagcgaggctgggcgggctcgtggtgggtcctaggcacgcagcctgctgggacacagggccccaaaggcactggatgccggcttgcccccccagctgaccgggtgggttcagcctttggcacgcgccggccatgctgaaaggacccatcccacaccagtcagcgttctgggccaccaccccgcacgcgctagtctccctcagatatatgggagctgaa

SEQ ID NO: 24431 - DNA, 248 bp, Chlorella protothecoides
aatccatagcagccttgcattctcttcttcgttgtgagctattctttagacaatggaagtgtgagtgcggcctggacactatcataagagagtttgactgcttgctgagctggtcttcaaatcaagcttagccgtattgatgaacagttggcgaccgggagctccctcaaggtcattacactttatcaaggattggacgggtatctgaggcccccccgctcgcgacctgcaatccaagcaatcgcatg

SEQ ID NO: 24432 - DNA, 152 bp, Chlorella protothecoides
tccgtcaaggcggaggtggagagccgagcgaatgccttcaaggccttgtttggagacgatcgtagatttgtgacagagtcggaggtatgcaaagggaagctgcatgaaccccttggcaggaagtcagggttggtgtgtatgtctgccttccc

SEQ ID NO: 24433 - DNA, 21815 bp, Chlorella protothecoides
  modified_base (1012)..(1021): a, c, t, g, unknown or other
  modified_base (1755)..(1764): a, c, t, g, unknown or other
  modified_base (2686)..(2695): a, c, t, g, unknown or other
  modified_base (3064)..(3073): a, c, t, g, unknown or other
  modified_base (3128)..(3137): a, c, t, g, unknown or other
  modified_base (4930)..(4939): a, c, t, g, unknown or other
  modified_base (5405)..(5497): a, c, t, g, unknown or other
  modified_base (5635)..(5644): a, c, t, g, unknown or other
  modified_base (5865)..(5874): a, c, t, g, unknown or other
  modified_base (6584)..(6593): a, c, t, g, unknown or other
  modified_base (6686)..(6695): a, c, t, g, unknown or other
  modified_base (8223)..(8232): a, c, t, g, unknown or other
  modified_base (9189)..(9198): a, c, t, g, unknown or other
  modified_base (11220)..(11229): a, c, t, g, unknown or other
  modified_base (11837)..(11846): a, c, t, g, unknown or other
  modified_base (12342)..(12351): a, c, t, g, unknown or other
  modified_base (12468)..(12477): a, c, t, g, unknown or other
  modified_base (13536)..(13545): a, c, t, g, unknown or other
  modified_base (14250)..(14259): a, c, t, g, unknown or other
  modified_base (14543)..(14552): a, c, t, g, unknown or other
  modified_base (17129)..(17138): a, c, t, g, unknown or other
  modified_base (17384)..(17393): a, c, t, g, unknown or other
  modified_base (18772)..(18781): a, c, t, g, unknown or other
  modified_base (19084)..(19093): a, c, t, g, unknown or other
  modified_base (20509)..(20518): a, c, t, g, unknown or other
  modified_base (21040)..(21049): a, c, t, g, unknown or other
ctcggagtataaagccgaaggacattgaccaaccatcacaaaatcctcccgatcccgaagtcttcaatctccccacacaccaaaaactctgcaatcatgtctggacgcggaaagggaaagacctccggcagcaaggccgtgagcaagtcctccaaggcgggcctgcagttccccgtcgggcgtatcgcccgctacctgaagaacggccgctacgctggtgagtgcatgtgtcgatggttcattctgtccgagatacagacttccaagttggacgttattgaccctcctaaccctccgctccaatcacagagcgcatcggtgccggtgcccccgtgtacctggcagctgtcctggagtacctggcggccgaggtgctcgagctggccggcaacgccgctcgcgacaacaagaagacccgcatcgtgccccgccacatccagctggcggtccgcaacgacgaggagctgtccaagctgctcgccggcgtgaccatcgccgagggcggggtgctccccaacatccagtcggtgctcctgcccaagaagaccggcaagaaggacgagtaaatcgtctcctccaccacacaatccacctggtgttattcaacaccacctctcttggaaagaaggcaaaccttgtgctgtgctctacaaggaagaattcttgggtctgggaatctagatgcaaagaatgttcaatggtatgcctgcacatcaggaaggctgcaaggcctggtccggaactgtgtcattcgacttttcagaatagccatgcaaagtggctcctgtgctctcggccgggactgggattccccctaagtccaaggtgtggaaggaagccaccaccagttgctgcctgaaatctgcagttgtagagggacgggggcaggacagatgacggaagggctccggatgggcgccctgtcaacgagcctccaaccacgatgagctgtgatcacatcccaacataccttgaagcagcagcatgaagagggcagacgtctctagcttgnnnnnnnnnnccacaccccaacgcaccttgaagcaggagcatgaagagggcagacgtctctagcttgaactcatcccaggggtctcggcgagagaaggcgcggaccatggcggcggcggccagggtctccatgttctgtgtggtggggcatgcttggtagagttgggggagtggtcggtcccgaggcagttccctgtcagcatgtatcccgccagcgccatgtgcgaacatcttccccctttccaccttcaggaagtcggcccacaggctgtctatgcacgccagggccgcagccctcagggcgagcagcgaggcctcctccgcctcctcccggctggcgcccaggaaccgcgcgagggcgcgctggcacagcgcacggtgcgcatgctgcgccatgattagctgcgtcagcagccaggcgtgcagccggtcggcgtccgactcaggcggggcggtgggcagctgcgccgcttgggcggcctgcacaagggaggcaccagttcgactgtggatgggcgcctcgtgatctgagcgtacctcgacagtgagcaggggtggaaccctcttgcctgtgcttgagcatatcctccgtgaagcagccagccaaccacgcactgcacccaggcactgacgcgccgacaccccatgccccatcccccgacacacaccctcctacccgctggcgaatggagcgcgtcaggggcacgcccgcgtccagagggaacggcagctcctggttgcccnnnnnnnnnntttgagcatctcctctgtgaagcagccagccaaccacggactgcacccaagcactgacgcgccgacaccccatgccccatcccccaacacacaccctcctacccgctggcggatggagcgcgtcaggggcacgcctgcatccagagggaacggcagctcctggttgccctgcagggccagtttcagggattccacctggtcgtgcgggaacaggttgagggccacgcggtacaagcccgtgcgggggtccagccgcccctcgttctccgcatctttgggtgcgtgggaggggagaggtggagtttagggacttgaaggccccgtgcacggcgttgggtggcaatgcagcggcccaggccggcgcagtcccttgccaggtgacgctcccctgtttccccacccttcacaacaggccccagcatcctctcctcaatacaggcctcaccgtggaatctggcctgctggtcggccaggctggggctggggtcgccgttgacggcgccctggatggcagccaggaggccctccaggtcccactcgccgccgcccggagagccgcgcgcctcgatgccaaaggcgcgcatggcgtccctgacaaagtcggcgcagtaccccctcgtgaagacgcccaggccctccgcgtcggcctccagcagcgcccgccggatgctgtacacgtggcgccggtaggggtccaccactgcgtcacgctttctttcctgctgcagccctgcacggtgggaaggggcaaggaagggggcatgggcatgggccagagggcattgaagcgcctcactcccacccgtcacatgcagtgcgtcggtgccgcacatcccggccattcaccaaactcccccgccaccatggactccccgtcagggcccccccccttttcccctcatcctccccctccccactcacnnnnnnnnnnattgccgcacatcccggccattcaccaaacttccgcgccaccatggactccccctcaggccccccccctttcccctcatcctccccctccccactcacgcatgcgcacgtcgtggtcgtaccgctgctgtacgccccccaccagcatccgccctgtgggctgctgctcgtacagcaacgactcgtcgcccagcctggtgacggccgaggaaagcgtggagcccaggtacatctccagcatgcggtcgcccaggtgcgagaggtagaaggagtcgcccgggtcaccctgcctgtagttaggggtgaggggggtgaagggagggggggggtgttaaagaggggaatcgaggctccacagggtcgggtcccnnnnnnnnnncacaatcgcgcgaggctcgactctaacgcaatccagcaagcaccctggcctcccnnnnnnnnnnaggaggggggatataaagagagggaatcgaggctccacagggtcgggtccctcgtgacgcttcccgcagcgcatgtgtggggctgcacagagacacagcccaagccatgaacccggtgaggaggccgtgcagtcgcgcaaggcccaactccaacgcaatccagcaagcaccctggcctccccactgcagccgcccccatccactccccagcctcctcacctgcccgctcgaccccgcagctgggcctcgctccgggtgggcgccacggaggcgatgaggacgcgcaggccgcccgccgccctgacgcgcaggttctgctccctgcaccggccgtcaaaccagagccagaggaggagggcggcggcgcgcagcgcggggcgcgccgccgccggcgcgtcgggggcctcgttgggtgcgacctcaggggtccaatccgcctcgccagccagcagccgcaaggcggcggccagcacctccccctcagccgccccgtccccgctgtttggactcgagccgcccgtctgcgccagcaggaggtgggagcgcaggacctccacctcctccagcagcccggacagccagtccgtggcggccgcgggcgcgaggccgccagaccccggggcggcccccacctctcgcagcgcggtctccagcgcgacatacacgggggcgggcaggccggcgcgcatggcctgcatgctgtggaacacaggagacaggccctccaggggtggcctggggatccaggcggccaggccctcggtgcctgcggcggttgggagggtgggggtttaagcgagggggtgcgggggttggggatgggaaagtaaggacagggggccatggggaaatggggcaagagtgagctccagtgcgagtgagggtcggcgtctggcgatccagtacatcacccccccgcctcaccccccccccgcaagcaattccctcacctcgggcgaggtgcgggaggaagtagcgctccagcgtctgctgcgtcagccccttggcgttgccccccagcaggatgtcggttcccctccccgccatgttggtggcgatggtgatctgcgttttgagggggggcggcgtggagtgagacgctggggttcatcggggcacagggcagagacacacacgccggcagctcgcgccgccgcctccctttccaccaaaaatctcccacccgccgaccctccccccgccagctcaccgtgccgggcagtccggcctgggcgatgatctgggcctcccttcggacgctctcagggcgggcgttcaagaggttcagggtgggacccttggaccccagcccgccaaactccgactccagcaggcgggagaggcggccgtacagcgcctccgactgctccacggtggccgtgcccaccagcacgggccgcccggcatccagggcctccaccagcagctgctccaggcgagccaggtagccctggggtgcgggggcagaggtgaacggttgggggccggcctgaccatctgcactggagcatcggaagggaggagaacgcagcgcagggcacgacagagacccaggagtaccagctcctgcctccgcaccgaccccgtcacacctccgtgcccatgtagacctcgggggggtgatcctccctctgccgtggccgatggggcggcagggccaccaccttgaggtcataggcgtccaggaagtcggcttgcagcgggagggccgtgccctgcgttggaagagggcgatagttactgggttccttacggtcggtgtgttgttgtgtcatgttggaggggggaggggnnnnnnnnnnatgggagagggcgatacttactgggttccttacggtcggtgtattgttgtgtcatgttggaggggggaggaagggggggccggcgcgcatgggaggccatgcttgtgcgagcggcgacggccaacttggccgaccagtaaccccctttctccacacccatccaggggcccccaccgtcatgccggccaggcgccggtacatcttgaacagagaggtgaaggtgatggaggcctggttgtagtcgcgcgccgagatggccaccctttctttggcctccaccgcctgatgcagcccgtcagaccaccgcgtcttctcccgctcccgcccggtgctctggtcgatcaggattacctgtcgtgtgcgtgtggaggggacagaaagggcgcgatggatgtgataatcggaggggggaacagtggcctccacacgcttgctgccccatcgaacctgtccacatcgccagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacggtggtagaggtgcagggccttgaggcaggtctggatgtacttgccgaacgcctggcaggggagcgcgtttgtgggggtgtgagagtctgaacaggcgtcgagcggggtgctgcatgactgaagagcttgtcnnnnnnnnnntgcctggcaggggagcgcctttgtgggggtgtgagagtctgaactggcgtcgggcggggtgctgcatgactgaagagcttgtcagagcggctccccccccccggcacaccagccgacttagggtccctggtgggcaagtgccatgatcgttgccgccacctttcatctcaacacccccccttctccccaggcccacctcctcgctaccccacatgagcacnnnnnnnnnnggcacaccagccccctgagggtccctggtgggcaagtgccatgatcattgccgccacccttcatctcaacgcccccccttctccccaagcccacctcctcgctaccccacatgagcaccggggcggtgcgcgccgcgaccccttcgtccccggcgtccacgtccaccagccccgcgcgccgcagcgcgtcaggcacgctggccaccgagcgcagggtcaggggcggggccggctggaagctgactggaagctggcccggccggtgctccggcacgggcgtcaccagggccgtccagcgcgggccgggcgcggtgccggacgcgggggccgggccctcctcctccgggctcgtgagctggacgacatgcagggcgccgcccgcgtccctgcccacgcccgcgacgccagcctccactgcggtggtttggggggcagtgtcagggctggaccgatgctccccacggcctcgaagggcggtctcgcacccggcggcgcggcctgcccagccccccaactccaagacccccacccgggcccccctccccccgtctcaccgagcagggacactgcagtgcgcagcccccgccccgtcagcgtggcctggcggctgtgcggcaggatgacggcgtcggcggcgccatccgcccacttctgcagcctggcgtcctccgcctcagccgaggagagcgtggcggggcgcaggcggcgcnnnnnnnnnnaggcgggcgcgtcagcacctgccatgtccgagggagggggagcttgagtgggggagggccggcggaccgtgaccaccgtctgcacgtggcacnnnnnnnnnngtccgcccactcctgcagcctggcgtcctccgcctcggcggaggagagcgtggcggggcgcaggcggcgcgccacggcggccgccgccacccagtggcccgcgtccaccacgtcggcctgagccgacatgaccaggggggtggcacactcgtccaccagcaccgcatccacctcatccaccagcgcaaaggcgggcgggcgcgtcagcacctgccatgtttgagggagggggagcttgagtgggggggggccggacggaccgtgaccaccgtctgcacgtggcaccctctgccagggtgccccagatgcagcatgcccaggttcctgggcacccaggcgtccctcccgaccaggcccctgccgggtcgtgcttgagcagcgcagagcaagagccaccctctcccctctgtcttcgcgatcccccctgtttcccatgcaaacagtgtcccaccagcgaggccgggtcgccggtcatgttgtcccgcaggtaggtgaaccccagctgctgggcggtgacgtaggtgatgtcggcggcaaaggccgcctgggctgtgggcgtgtcgtcggtggcgaccaccacgcccacgctggagccgagggccgtgaagaccttgcccaccctggaggggcgggtggcggcggtggctcgtgctgatttgcatggggcggcgggcggggtggggtcctgcaccggcgccgccgtagggacaggaccctggcaccggtcccaaaccctgatccctcctttcctcaccactccgcatcgcgcttggccaggtagtcgttcaccgtcacgatgtgcgcgcccaggcctgcaagaggaggggggcgaggcattgggaatgtgggcaagagtggggccccacctgtcacgccactgcgaccccgggccgcggaatgtaggcacctaccagtgagtgccttgccacccacctctacccaaaccataccttccagggaggcgaggtacgctggcagggtcgccacgagggtcttgccctcgcccgtgcccatctcagccacacagccctcgaacaggacgatgcctcccagctgcaccaagggtggggtgagagtcatgaggacaaaacccctccagcagggcttgttcaagtggccaggctgtcaagcccgagctgcagaggccctgcagccaacaggtgccctgccatattggccatgaaaacctgctatggcacagcaaggagcaggaatgcccattctgacagtcccagcagcttccccccttccccgcaccccccctccccctttccaccaggaacatgctcaccatctgcacatcatagtgcctcatgcccaggacacggcgcgccgcctccctcacggcagcgtaggcttcgggcaggagcgccttcaaggtctccccgccggcaaggcggacgcgcagcctggacgttgtccccgccagctcctcgtccgtgagctcacgcagcgccggctcgagggctgcaatggcctccaggatgggtgtgtggtgccccacgacgcggcgctccccgcgggacannnnnnnnnngatggcctctagggtgggtgtgtggcgccccacgacgcggcgctccccgcgggacaggccctggaggctcaccctggggctctctggcgccgactgcgtgaggggaggcgacggctcgcgatgggtagtcatgagctcggcatggacatgaacactggcagggaggcccacctgggtccagcccctcctccatccccccgcactcacgctgacgatcgaggtctgggtcgccatgcagtgtggtgcccggaggggcctttggggagttcgcgggatggagggtggcgacggaccatgtatgcacacgcctatgtgcactctgcgccccatttgtgctttgagcggctgcgcacatgcttgccgcaggcgcatgggcgttccaacgcccgcacggtgtagctccatcccccgcctctaggcgactggagggatgagtctcagatcattgacccagagcttcgtaatgtagtagcatgcaatgatgcattgccccgcaagccaggtgcacagattcagagattggtcagggccaatgagtctcggcgatacgtcctcgcgcccaggcagatcacctcccgacacgcttcgctctgttgcacaataatccatgccggatccaggcgatctctggggtttcatgacatcatattgctcccaccataccgcagcacctccatgccgggatgaatagaggctgacgcccacctgcgaggtgctgcggagtggcctggagtccccggcccattgatgcgcgccatctcccagaccctctgtcgcctacaacggggttcgagaggtgctccggcccaaggctgcatacaccgtgcgagagctggcactgccagccttagcatgacccaggaccccatcaagctcgtcttggtgggtgatgttcatggtgactgggacgaggacaggtgcgcacaaggagctcatgcatggcgggaccgattgtcnnnnnnnnnncccagccttagcatgacccagaaccccatcaagcttgtcttggtgggtgatgttcatggcgactgggacgaggacaggtgcgcacaggagctcatgcatggcgggaccgattgtcactggctgttgctgttcatctgtgcatgcatgcagcagatgaagcacatcggtacctacatgtatgaccaatcccccctccccccaccgtcagtgcgacggccgcgcgccacctggaaccggatgccgtcctcttcctcggcgactttgggaacgaggatgtggcgctggtgaggtccctggcggcgctggaccttccaaaggccttcatcctcggcaatcacgatgccatgtgcgggggaggaggggaaaggaggggagaaggggagctgagttttggagtgatgtgtcagctggcttcgcggggaggatccccgcgtgatacagccaacgctgcctggtatgagttgcaacgctatgagcttgctgcagcatgcaggtcagcgcgccccaaagcaagtccccaagccctcgagcgcaggttctcgctcagcgggaggggcaaagagtactacgtcaagaggattttgcagaagagcacgctggggccgttctgcagtgaccccgggtccggcgcctcgcctaacgtggccctccagctggaggctctggggtccatgcacttggggtacgcatccgccaccatggccgatggcaggttgagcgtcgtgggtgagtgcagcggcaggggagggtctgtctggggtcaacacctcagcagagctttgggtggcattcgaatctggctgtggcgcaggtgctcatgctgagtcgccactcacccgcacctttgcacgcacagtgctgccctgaccttcaccattgtgagtgttccctgccttccacttgccccataggtgcccgccccttcagtcagggcggcgccatggatgaccatgtgacggacttctaccagcgccactacgacgtggactccatgtccatgtctgcccagcgaatcgttgagaccgctgaacggcagcatgaagctgcaccgcacctgcccctggtccgtggagtttttgccgacgtttttggcgtcaggatcccacaagatggtacagccgcccggtgtcacaacaaggatcgacatctcacggacccactcctccaaaaccccacccaccttcgcgcaggtgctcatcgcgcacaacggcccctccggcctgggtgggcggccggaggacccctgcggcgtcgactggaggccgggtgggggcgaccacggcgacgccgacctggaggtggggattccggtgctgcgccggcaccctaagactgtgcttccctgtcccgctccaaccgcccccccccaaaccccacccatcaccccgccaggcggcgctgcgggagctctgcgcccggggccgaccccccacgctggtggcctacggccacatgcacgaggagctgcaccgctcggtgcgcagggagcggcccggggtcaaacgcgagcgcgtggcggtcgcgcacggcgcggtgttcctgaacgccgcggtggtgccgcgcatcgtgcgcctgccgggggcgggggcgcggacgcaccactttgtcgaggtgcggctggcgccgcccggcggcgtgctctccgctgcagacgtgctggtggaggtggcgcgggggggaggcgtgctgggcgtgcagcgccagcccctgctgaccaccaccgcagttgatgcggagggcggtgcccggcgcacccgcatcctgcacaccagcaccggggagtgggaggacctgggctgagcgagctggggatgctggagcccttccggagcctgggaaggatacttgcgcttgtttgctgctgcaaagtgagcctgctgtggtgcggtctctgcgccacaggcagcgtccagtgagaacagccattcgaaaattacatcgccaggcttgtggccggcagggtgccagctgtgtgccgcaattcccgctttctaatcatgtttgtattgcgagtcagtgtgnnnnnnnnnntagggtgccagctgtgtgccgcaactcccccttcctaatcatgtttgtattgcgagtcagtgtgctcaagggcatgagtaatctggacaagggtgtggcaggaacaaggattaccacaggacgctggcgagtcattgacccttcagctgcctgcccgacgattggaggtaaaaaaaatactggaagcatggcccatcatgggcctgccctagcggaagtaggccatgtgccggctgggcatcatgggtgccggctgcttggcggccgtggtcagtgcgtcctgcttgcagccgcctgccgccatggccgccctccgctctttcttctccttcagcagccactgctcgaccgtggcgagcagcctctgcccgccctccagctcgtggatgccggcccagaggccccccttgaccaccttgccgccctccatgtaggccaggtgggtgggccaaccctccagcccatcaaaaatgtgggtggcatacacgatgctggcacccctctcctcgcactcctgcggggggggacgggggcctgccttatggctgacagggtctgagaacttgcaaactgggccccggtgtgagggttcttgaccgggggagtcnnnnnnnnnnaaacgggggcctgccttgtggctgacagggttggagaacttgcaaactgggcaccggtgtgagggttcttgaccgggggagtcctcgcccttttggtgacgctcgaggctgaggatgggatctggggtccttgacaggtgcgaacaacccatcgatagctgtgggcctcagcttgaataggttggacctgccgcagctcccatccacagtctgcgagccttcccagtctacacagaccccatcacaaggaacatggcagtgaccccagccccgctgcccaccgacctgcttgaagaagtgcaggaggtccagccgaccgaggacgtccatgtccacggtgatctcatccagcagcagcacctttgatggttggcatgttggggtgtgaggaggactaagaaacaacaaagagatgaggcagggcacagctggggaaaaggagtgacgctggtcagcttggaaaaatacagatggcacactccaccatgtgtctccnnnnnnnnnnagtcggacctgccgcagctcgcatccacagtctgccagccttcccgttccacacagaccccatcccaaggagcatggcagtgacctcagccccgctgcccaccgacctgcttgaagnnnnnnnnnnagtaaggagtaatgctggtcagtttggaaacgtacagatggcacactccaccatgtgtctcccagcatagatgcacgccaacccacccacccctcatttacacccagctcagcaccttgtagggcagcagcaggcccatggcgatctgcacccggcggcgctgcccgtcagaggcgctcagcatggtccactcaaggtcgatgtcaagcaggcggagcaggcggtcccgccgcgcggggtccgccccctgcaccccgtagatcagtgtgcgggcgcttaagtttcccttcaggggctggccgccgccgggcgtccccgccccgctgcgccactgggtgcccaggtagccgaggtcccccgtggtcaccagagagaggtcgtggaaggcggggcggcccagaatctggaccgcagatggcgggaccatgtgcttgcccgccagcacctgcagcagggtggtcttacctaggggagggatgttgtaggagaagggtgagagcatagaaatacaggagcacgcggtaacttgtccaaagcaatcccaggtcgccaccagtccctcgcgtccgagccatgaaggcgcattccctgagagatttgaggcccttggcgcactcaccggccccattggcgccgcacaggaggcagcggctgccgggcggcaggtcgagatttatattctctaatagtactggaccgaagccggctttgtaagtcaagtcagtcacgagaaccgagggcaggtcggttggggggtggtgggagctcgtcatcaccgcggagtacacctcagtggcccctggcttctcttccagcttcttagaaaaactcttcaagccctgattatcccgaagtcatgactggctttaactgcgcgccagcacttttcgggaatgtatggccaggagaagtgatccaaggcttgccatgccgggcatgctgcggtaggagcgcacccctgggcgaccaatgtgagtgtcacggacgagacgatgtgcgcatgcagaaaagggcagggtacccaaggttgactacatcaaatacctcgttcattgattnnnnnnnnnncgcaaaaaagggcaggataccctagggtgactacatcaaatacctcgttcattgatttcctagtcttcggcttcggatctgcatactgggagcgttgctcaggccgggagcagcatggctggcttgcggcgtatgttggctcagcaatcaggacccctccgtctggctcttgagcagacgtacaaccagcgcgatgctgcccggatagcctgtacatgcggcttaagcgcctacatgcagtgcttggaggctcagaagggcatgcacacctcagcgtacaccgggctgttcgcgtcgttgcgcacatccacggcagccacacaagcgcgagccactggccgagacatgacaagtacgtttgtttacggctttggaaaagttgcagcattgtgccggtccgaggtgcctctccctcccattctcctgagagggttcgtcctgctgagattcagctcttggctcccctcctttcccataggttcgagacggtcgcttttcatccaggtagagaagacgcccaaccccaccagcatgatgttcttgcctggcaagcccgtgttggaggtgaggtcctgggaagagtcatagtgctcgctggcagggaacatctggcagggcatcgctcatgcccttggttacgcacaggtactggcgattccgtgatatcatctattaccgtgccccgtctgactccttcacagagtnnnnnnnnnnctgctcgctggcagggagcatctggctgggcatcgctcatgcccttggtgacgcacaggtactggcgattccgtgataccatcgggcaccgtgccccgtctgactccttcacagagtggcacgcaaggcttcctgacggcgcgcgagagcatggcctccccgctcgcaaaagccctcttccagatcgatggggtgcagcaggtgtggggggttgctccactggctgcatgtgacggggcccagacatggagggtctggtggtcgacgtacccgtcgccaggctnnnnnnnnnntgatggggtgcagcaggtgtgggggttgctccactggctgcatgtgacagggcccagacatggaggatctggtggtcgacgtacccgtcgccaggcttgcataccaaagttgggcgctgtcaggacctgcctgctgccgacaccccaccctccccaccacccctccaggttttcttcggcaccaactttgtcacggtgaccaagaccgacacctacccctgggcggtgctgaagcccgacatctttgctgccatcaccgacttctactcctctggcaagccagtgctgctcgagggcggcgctgtggagaacctggacaacgtcatcaacgacgacgatgacgaggtgctggtcgggatgcatgcacagagggtgggaggagacccctgacactcacagcgcccactgcccactccatcgctggacacccaccccacccctccccttcacctctcaaaaaaggttgtggccatgatcaaggagctcttggagacccgcatccgcccggcggtgcaggaggatgggggggatgtctcctacaagggtttcgaccccgactctggcatcgtgaccctgaagatgctgggcgcgtgcagcggctgcccctcctccgccatcacgctgaagaacgggattgagaacatgatgtcgcactacgtcccggaggtgaagggggtggtggaggcgccggcagacgagtcggagcaagctgggcttgccgcattcaacgagctggagaagcacttgtccaattgatgagcatggtgcaatagggcctgtacaggttgggaaccttgcaagacgcacatcgtgtaatatgcaataatattgtgctttcaatggcgacgactgccattgacggggggtgcaggtggtgggggcccttccggctcctcgggaacgaaagggcttcccagcggacgacgccttgggcactggaacctcggcggcccgacaccgccgtacctgcaagcctataaaacacgtggcatatactgttttgttctggtgaagcccatctaaaacctctcacccccaccccatgatggatttgctcttccggaacatatgggaggggtcggaccaccgggatttcctcccgtcagcccatactgcaaccttaacccagtccctcgtctcaacgcacccctctaacattctaattggaaacattgcaatagacaagactgaatatgtacagtatggtattctaatcctatcatttcgtctctcagtgcagcaatggggcttgttggggggtttcgtggccatgcggtgataatcgcactcctcatgtcgtcgaccgtacgaattgacgccaggtattgtgcccggggaactgttgctacgtttaagatcgctgtaggtcgcatatcatcccattttgccgtcagtcctgacaatgcatggagccgtcgcccttgggccggctcggtgtcaaagtggccatgcgggaggctgctcttagaccttctcgactacgcgccatgtaggcacctcagcggcgaggtcagcctctccggggactccgatggacaagtttctgggaaggcctccgcgcagacagactctggatacagcgcagatgggtccgtggaggcggtggcgtcgggccagggtgctaacgctgacgccggcatgtttgcatccacttcaaggtccagtggccttgtggcgggaggaggacatgccaaggtaagggctggtgagatgtggaggacctcagcctactcattctcctgctaacttctgctaataggccctaattctgattcaaaagctgtcctggaggtttgatggtttaccagcatcgctcattctgcccccaaacacagtacaagggcagcggaagcgagatggtgtgggggagcttcaccggtgaaatcaacggcaaaggccagacggctgaatactcgggagaggcagaggctgcgagcgctggaggggggtttgtgcgcgcatcctccggtggggcagtcaccgcacagcaagggcaagtcacggtgagtctgcgagcgcggaggcagtgatctgggaagcattgtcggtagaacccatttgtgtgtctctggatcctctgcctggcgggatgtggtctcatgctcgaccgcatacagtacgccgctcccatacacaactgtaggcaggaggacactgcgaatcccagaatttagcacggaacgaaactgcatcccctttccaaaaggatgcgacgaccgcaagtgctggatgcttcactgtggttggggcggaggtgcctcccaagccctagtccaatagaatctcttttccagcactgtgtgtccatcccagcactccatccggacttgcctgccagttgtatagcaccctttgtggtagcctttacaggcgataattgacagcaattggcggttctcttgacacatgttggattgtacaggtactatcatcactctctatggttttcatctgattatgttgttccaggacttgattgacatgcaggatgaactgtcagtgcaggcacagcacctctcgcagcggttgtaattgaagcttgggtaggccgaggtggcgtacgaggctctctgcccnnnnnnnnnntcgatgtgggcttttgccttgatcccttcacaggccatttaggctcgaccctccagtgaatatagacaatacccttcctctatgaaattctgtcaaattttacatagctccaacagccacctggctctctgctcaataatgtacaattcacaagtgatcgtgaagtcgctcacaactcggcaccatctccctgcttggccaggtactcgaaaacactcttgtccccgacgtcatcagacacgggcnnnnnnnnnncaaggtgttacagcagagcactggaggcatggatatactcccagccagggcagaagcccacggcccccaggggcgccgtgcatgagacgcaacgtcccgttgcagcggtcgtccatggtcgaccgcattctggggcgccgtgcacgaaactgcgggagcgtcgtgcacgaaactgcgggaggtcaatcaaaagccatgcagccattcagatgcaccatggggctagattttgatcttctcaatacttcagtgttcaaggatgagctgcacgggacaagttgcgacccatcggggcggttgcatggggtggggcccccgaagtgcatggcggccctcacgggtgccatgcgctccccacctcgcatgccgtgccgccggtggcgtgaggggaccatttcaggggcgattcggtgtctaccagcttgatgaccgggacattcaagaggtgatgggctaccggacggggttgagcctcctcgcggcaggtgagcctcatgctggcctgtactggcctgagatgtgccataccgcactgattctgcgaagggcttgtcccgagaggatgctcgtgcgcactagagggccatgcaggtgcctgccacactcgtcctgcagctccacaatgtgctgggagttctactcatgtgccagcatgtacctcctccatccctccccttcctgccctgacagcatgtgcctcgcaggcattagcacacactgcagcagatgccccatgggctggagtcctgcaggcaggcagcgatgtcgctgcagtgagcgccattgggggacttgccatgtccctctccctgatccacatctatgtggcgcccatcaagcgagccctgcaggccttggccgcagtgggggcagtgggggcagcctgggtgggtttgacccagggcggacccctgctacagaccctggagttgcacccgatctacctgctggcggtgggtccggccgcggccgcgctcactggcgtctgcttcaaggaggcgctctgctatggcaaggccgaggcagcggtgctgatgctgggcatccccgtcctctgcctcggacacctgaccggcttgctggcaggggggcttgagctggcggccgccgacatcgtggcaatcttcctggtgctctttgcggcgaggaagtggacccagcccgtgtctgatgacgtcggggacaagagcgttttcgagtacctggccaagcaggggaatggtgccgagttgtgagtgacttcacgatcacttgtaaattgtatgttattgagtcgccagactgctggctgttggaggtatgtaaagtttgccaccctcaagttcacaaaatttcatagaggaagggcattgtctatattcactggagggtcgagcctnnnnnnnnnncgtcacaaacactcaacgcatgcaattaccataataacgacttgtatatctgtgagcactggatttgactgaaaagcgcgtgtgcgggcttcaaaagagcgaccatcacccacaagcggaacaagcttggatcccccgatctactcgtgcttacagacacctcccctagatctgtaaaaatggcggagcaatggcatctgcgcgcgccagtacctagcaaccccatcgtgttcttcggtgaggagaggtgaggtcgctgtgcagcccaacaaacaccactgtgccccagccaagcccaccttnnnnnnnnnnccgcgcgccagtacctagtaaccccatcgtgttcttcggtgaggaggggtgaggtcgctgtgcagtccaacacacaccactgtgccccagccaagcccaccttgtcaccactcatgctcacgcagatgttagcattggtggccagcctgccggtaggataaagatggagctttttgcggacattgtgcctcgcacagccgagaacttccggcaattctgcactggagagttcaggtggggccagagctcatggggggtgaatcaagctaggtccctcaggctgcgccgacatccacgcgtgccaacgactctctcgctcccaaattggacaggaaacaagggctccccgtcggatacaaggacagcatctttcacagggtaccggatggcgaatgctttgcggctgcatcaatgggttgctccatgcattcgcctgtgcagccgacccttactacgccaaacccctccaaccccttcggcatgcacccagatcatcaagggcttcatgctccagggcggcgacttcctcaagggcgacggcaccggttccctcagcatctacggcagccgcttcgaggacgagaacttcacggggcgacacatgggtcctggcctgctctccatggccaactctgggccagggaccaatggcagccagttcttcatcaccgtcgccaagacaggtggggggcctggcagggcaggggaggctcggctggcaatcagaccagatcagccaccattgcctgcggcggcgtgcgccctgactgtccggcaccccgctctctcaaaccaagccgactccttgcagagtggctggacgacaagcacgtcgtatttgggcgggtgctggcggagagcatgctgactgtgcgcaagctggaggcggtgcagaccgcggggcagaacaacaagcccaagttggcgtgcgtgatcacagagtgtggtgagatgtagggcaggacaagatgcagggccaggggcaggggtgccggtctcggtgagaggcatctgagaggtcacgtcgccggacaggaccgggcaggagatgctttgagccaagcgcagcccagggctcgaggacgcagagactggcctcagcatgaccactccaaggcagcagtgcgcgagagccccttgcgcaggcacccatgtctgcacggcgtgcggcttggggccttgggtgggcggcaggcaggcgcactttcacggtacgctcaccgaaaccagctcacaccgccatgtccatggcgatcttcttgtgtggctcgtagtctgccagctcaaagtcggccatggtgaaggcatcgatgtcggtcacctcggggtttatcttcagcgtctgcagcgatgagcgggttcagagggtgaaacaatgggcccatggggtctggaagacgcaggagggcgtcgcgnnnnnnnnnncatcctcagcgtctgcagcggtgagcgggttcagagggtgacacgatgggcccggggggtctggaagacgcaggagggcgtcgcgcagtgagtgtcaccagcaacggctcacatcgctcctgacagccccatcgcctccacatgggcacacatcagtccccagccacgcccaccgggaagtgcttggggctgcgcagcagctgctcccgcagcgggtccacgtggttgcagtacacgtgcgcgtcacccagcacgtgcacaaagtcgcctcgctgcagcccacacacctacgtggatgggggggtgttggacgatggcaggcaagtgcagcgcttgggccggacagggaatcctgggcggggccggaaccatgcatggtgaggggaccgtgcgagggctctcccctgatttcaacccctgcatccctttcccttgcttcgctccctcatccaaaggcgggagagtccacctgcgccagcatgcaggtgaggagggcgtaggatgcgatgttgaagggcaccnnnnnnnnnnagagggctctcccctggcttcaacccctgcatcccttgcccttgcttcgccccctcgtccaaaggcgggagactccacctgcgccagcatgcaggtgagcagggcgtaggatgcgatgttgaagggcacccccaggccgaggtcggcggagcgctggtacatctggcacgacagctcgccgtctgccacgaagaactgcgtggagggggggaaggggggggggagttggcgctgggcagcggcgaggctgggagaaagcgtggcgcacgcctggccatactgtgctgcaagattgccgggcaccccgcaggacctgtgcccgctctcgctgggcgagggtacgcgctcctccgccccggctctgcggctcccctccgacgccgagagccttcccccacgccccctcccctcacgtcaagcccccccccccgggccttatcacctggcagaacatgtggcagggcggcagggccatgtcggccagggccgcggggttccaggccgtcagcaccaggcgccggtcggtggggtccgtcttgatgcgttgcacgaggtccgccagctggtccacgccctggcctgggcagggcggggaggggtccttgagggcgccggggtgggcatggaggcgcgagcctgggcgcacgggggtggagcggggcgagcccggcgggcccggcgctgcacacggccggcccgcagggagcggtggccctggactcggcggggcggcacgccggcctccaccctcgcacgccccccgccg

SEQ ID NO: 24434 - DNA, 78 bp, Chlorella protothecoides
ccacccaaatatattctgagcgcccgaatttagagattcaccctcaaaacacgaccggttgcacgcatgcaagaccag

SEQ ID NO: 24435 - DNA, 61 bp, Chlorella protothecoides
tgtccgccggcctgagcatttcgagggatgaaggattggagtgcgggtagccaacggatgg

SEQ ID NO: 24436 - DNA, 61 bp, Chlorella protothecoides
gatgagaagctggatggcttgcagctcctcatgtgcaaagtcaaggacctacgtgccctcc

SEQ ID NO: 24437 - DNA, 87 bp, Chlorella protothecoides
tgtagtagcaagcgactgtcaagccatggttcagtggaatggggtggtttgggcatctgcatccaagcaggtctgtgatgctgacat

SEQ ID NO: 24438 - DNA, 61 bp, Chlorella protothecoides
catccctgttatcacacattcatttaccgtggttaagtatccatcagcttcccgacaggtg

SEQ ID NO: 24439 - DNA, 61 bp, Chlorella protothecoides
tgttcctgcgacgatgagggtgagggggggtggacagtgagtcggggtgcaaacacgcaca

SEQ ID NO: 24440 - DNA, 74 bp, Chlorella protothecoides
caaagtgaaattcaaactcgtgcgtaagattaagatcttcgttcccagagaagtgctatcatgccgatgccttg

SEQ ID NO: 24441 - DNA, 72 bp, Chlorella protothecoides
ccaatgcatgcagattatgtcagctatgggaaaatgtacgtttaagcgacagcacaatggcgtgcctagcca

SEQ ID NO: 24442 - DNA, 72 bp, Chlorella protothecoides
gtggccatgcgttgtggtgtgagttgaagggcactgacgagtgccgagggcctggctcgcaatgggtgagtg

SEQ ID NO: 24443 - DNA, 61 bp, Chlorella protothecoides
gccctcctcccgcgctgccctcagccactgtgcctgtggaggtgggggagggcaggaggaa

SEQ ID NO: 24444 - DNA, 61 bp, Chlorella protothecoides
gtccgctcacacagcacaacatgttctttaacacctctcttagtatacaattgcttccgct

SEQ ID NO: 24445 - DNA, 61 bp, Chlorella protothecoides
atcaagcccgtctttgtgtttgatggtgccacccccgccatcaagaggatgactgtcattg

SEQ ID NO: 24446 - DNA, 77 bp, Chlorella protothecoides
ttgtagagaagctgaatgaaatggtggtgaatgtcgttgtaccccttcatgccttcatggaggcctcaaaattcatc

SEQ ID NO: 24447 - DNA, 205 bp, Chlorella protothecoides
ccgatgctgacctcgcatccaggtgggctggagggacacaaattcatggatggagcctggagcttgtgatgatgtccctggcgtctcagtgattcttacccctgttctcaattacaggctggaggagctgcagtctgtcaggacggagcgatcggatggagctgccaggagggccgaggtgaagcaagaggtaggccagaagcgc

SEQ ID NO: 24448 - DNA, 480 bp, Chlorella protothecoides
  modified_base (111)..(356): a, c, t, g, unknown or other
cggggcccggcgcggcgccgggggccccgccccctgcgccggggagccccacgccgggcggcgcgggggacaggctgccattctggggcgcggggctgggcgccgaggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagggaatgcacaacctctggtgagcatacgtcagggcgcagccccaaacagatccatgctgaggccgcctcgacatccgacactcgccccccttcccccctccctctcccccccccctctct

SEQ ID NO: 24449 - DNA, 78 bp, Chlorella protothecoides
tgccttgcgcatatatacaaacaccccgcataacacatcctctagcacccgcacacagacggccaacgtggtgtggaa

SEQ ID NO: 24450 - DNA, 61 bp, Chlorella protothecoides
gggtcgaagggctgcgaacagagcccgcacaccccagccatgtgcgagatggccttgttcg

SEQ ID NO: 24451 - DNA, 64 bp, Chlorella protothecoides
ggttccagggtatcagcctgcagaagccaagttcctgtgtcatatcctgggcacggaggccgcc

SEQ ID NO: 24452 - DNA, 61 bp, Chlorella protothecoides
tatgaggcactctggagatcatctggagtcgagcttgtcaagcctgtctcaagcagttcag

SEQ ID NO: 24453 - DNA, 90 bp, Chlorella protothecoides
cctgccagcctgcagggagtgtagctgtgccgcatcatgttgtgagtgcagcccttggcagcagtcaatctggaggagtcgggggggggg

SEQ ID NO: 24454 - DNA, 498 bp, Chlorella protothecoides
tgggtaagtttgtagctttgtagcatctgttcgaccagccactgtttcagcgttggacctttctaattctcatcgtgtcctcctgaacctcattctaccatgatctcgcaggatgtggtccatctggattttcactgtgccttccttgcgggcacggcaatgcagcagtaaggagaaggaggcactcaactacctcttcctggccatccccctcgtcaacattgccatcccttttgttgtcagatccttcccactcgtcttcacttgtgacctcctgctcctcgccgggatgtatgcctggaaaggagtgaaaccactgtcacagcttccttcaagcaagtaggctggtccctttcctgactttgaaaagatcctgtgaaccagatgctcgctgacaatggagaaggggttcttgtaggccgggagctaggcaatgtcagagccccgagtctctggcctccacactttcattgacaattactataaggctgagtcaat

SEQ ID NO: 24455 - DNA, 144 bp, Chlorella protothecoides
ttgacggtgttggaatgggttgttgatcaaaatgagtacatgggggattgacggtgttgcatcacctcgtgagagacaaggagacgctccgtttcggccggcctgctggtggtcgagcgcctgagtcgatggacacctgtgctt

SEQ ID NO: 24456 - DNA, 108 bp, Chlorella protothecoides
ggacatcgagatccaggtgcgctgccgtggcgttgagattttcttttgtgctttggtgtgtggaaggaggaagagagctcggctctgggttagagctgggtggtctag

SEQ ID NO: 24457 - DNA, 67 bp, Chlorella protothecoides
ccaggccgatgcacccgcctcgttgtagcttcggattgctttggaactgggcggcttgtgaaatttc

SEQ ID NO: 24458 - DNA, 142 bp, Chlorella protothecoides
tctggttcggtagagtggcaactcaaatgcattccttggaggatagagggatggtgtggtaagtggtgcacctccacgtcaatgaccatggattgcccagccggcctcctcgtccctcgaccggccagaccttgtcaaggca

SEQ ID NO: 24459 - DNA, 161 bp, Chlorella protothecoides
cgacctgcagggacaataggggagggagggtagggtgacgggctactcgagcagcagtcaataacactccaaatgattctgttggaggcaatcggcgtctccagctctggcccaggtgcatgggctcccggcagtgccaccgccgctcaggcatcccaggg

SEQ ID NO: 24460 - DNA, 63 bp, Chlorella protothecoides
gcgccgacgcctctctgacaaccccccctcgctccctccgggggcgggccgggggaaggctga

SEQ ID NO: 24461 - DNA, 61 bp, Chlorella protothecoides
cttctgtccatactcttcttgtcatcacgatccaaccacacctggttggtggttgggcctg

SEQ ID NO: 24462 - DNA, 127 bp, Chlorella protothecoides
ggggttgggatcgattgggtggaggacagaagtcctctgtgacctgctccaagtgcgagaatccaatgacacagagctgtgcacccccatgtagatatggtgcctcccacgagccaggcactacatc

SEQ ID NO: 24463 - DNA, 61 bp, Chlorella protothecoides
aaacaagtgaataagcatcgtacgtgggggtggggattgtgtgagccatgatgcgggggac

SEQ ID NO: 24464 - DNA, 130 bp, Chlorella protothecoides
tgagggcgctgtgtgtgaattgcatcgaccttcctagctcgtggtaggggaagctggttgacccggtcgcttgggcccagcactgatcccgttggcgctaaactcctttgaacacttgggaaatttgctg

SEQ ID NO: 24465 - DNA, 67 bp, Chlorella protothecoides
ttgatgcagaagtttggttcacaagcctcttatgcactgcttggcgggaagctgctccggcattcaa

SEQ ID NO: 24466 - DNA, 76 bp, Chlorella protothecoides
ccggttcggggcatctcggacatctctgccagcgctgagccgatcgcccagaggtccagtgccggcggggcgggtg

SEQ ID NO: 24467 - DNA, 63 bp, Chlorella protothecoides
ggggtccttggccaagtggtccaggaccacctggcgtgccctcttggacacccagggacagcc

SEQ ID NO: 24468 - DNA, 132 bp, Chlorella protothecoides
cgggatgaacctgctggtgaggctcctctgaaacaccagtgcctgcgacaccaaggcattggtgcccctgccagggggagggaagggtagggagtgtatgggaggctgggtccatcactgatttagatgcgc

SEQ ID NO: 24469 - DNA, 69 bp, Chlorella protothecoides
tgtatacatgtgtgctgtacgtacctcgagcacttgtacccgccgtgaaagcgtgaagcgcgacacttc

SEQ ID NO: 24470 - DNA, 106 bp, Chlorella protothecoides
ccgccgtgaaagcgtgaagcgcgacacttcacagatctgacatccatcactgcttcatgatcatggtccctacagcttgacagcacatgcagccgcacggtcatgc

SEQ ID NO: 24471 - DNA, 68 bp, Chlorella protothecoides
agtgcacgaatcatagacagccatcaaaatgcactcatcaggtgctgcagccagctcatggtgctcat

SEQ ID NO: 24472 - DNA, 61 bp, Chlorella protothecoides
ctcagcctggcatcgccgtggtaccctcccaggccggctggacgttcggcgtctcccaccg

SEQ ID NO: 24473 - DNA, 61 bp, Chlorella protothecoides
gtcgctggcgttctccgggggctcgcgcacatgctggggcacggcacgtttcaccctcatc

SEQ ID NO: 24474 - DNA, 77 bp, Chlorella protothecoides
gccgtcactgtcacacttcaaggaagggggtgggtgggcgggacgggtggggtgggtggatgttgtgggggcgggct

SEQ ID NO: 24475 - DNA, 69 bp, Chlorella protothecoides
ggaacttaacatgccaaagaaccatcaatacatcagaacggggcgcttttgcacctctacttacattca

SEQ ID NO: 24476 - DNA, 74 bp, Chlorella protothecoides
ttttggctcgataatattccacgagttttacacttctcacacagtgtttgagacaccaagttgctcaccagttc

SEQ ID NO: 24477 - DNA, 61 bp, Chlorella protothecoides
gaccccatacggcaacaggtacaggtccagacccgccgtcaggaaggcttttttgagtagg

SEQ ID NO: 24478 - DNA, 61 bp, Chlorella protothecoides
ctggctcttcctcatcttctacggcatgccacgccacctgccctccttccgcacccccacc

SEQ ID NO: 24479 - DNA, 86 bp, Chlorella protothecoides
ttccatcagagagttggaccttgtgttcagggacctgcagtctcctttcactctactcaagttcgacttggagagggtgctgtctg

SEQ ID NO: 24480 - DNA, 853 bp, Chlorella protothecoides
aacgataatcaccagcgtgtcctgcgcgaccatgcgcatggctgcctgtgtggatcggcagcacacatggcaccaatgatgtgaatatgaggaagtggttggatgggtagccttgcagtgtatggcctggtctctggatgccactgtgtcagaggagaggctgccctcacagcaggcccttgcccctcccctccggtacagctcaaagccttcctcctgatcgcgatggactcggggaatcgagtccattgcgggtctgtggcgctgctgcggcatgagggagtggagggcatccagaagtggctgagagtgatcattgacaggatgggccaagactggatgccttcctgtgtattcatcgatgcaagtgcggcagagtacagcgccatcaggtgggagcacgctttgattgtgcggacagcagcatatttgatgtgaccaatggcccctgaggacaccacacaatacatcctcatgcacaggtcgcctttccgtactggatgcccgtacacatctgcagcctgcaccagaccaaggctggggcatccaatgccagccgcctcgagaagggccatagacaacactttgtagcggccttcaaggagctgcaaagcatgtccttggactttggaaggactctagccaggctgccaaggatgcagctttggagacagcaaagacccgcgtggaggcgatgctgacagacgcctccgtgccgccggggctggctgaccactttcgtgggcagtgggtggacaagttcccgttatgtgagtatcagtacagtgggaaagggtgcgtggtgcgtgtgtgtgtataagtgggggggtaattcttaagacagaaggcagag

SEQ ID NO: 24481 - DNA, 69 bp, Chlorella protothecoides
cattgcatgccagcggagctggccgtcatcgcagggttacagcgtgccgcggcagccgagaggcgcacc

SEQ ID NO: 24482 - DNA, 61 bp, Chlorella protothecoides
agaagaggggtggatgcaggagggtctgggtcgggctacccatgcaccttgtcagccagca

SEQ ID NO: 24483 - DNA, 96 bp, Chlorella protothecoides
gcagtggggctacttggaattgtgcgtcacccagaaattgaaaatccacaggtgacattgtgttacgaaaccagcaagctcggcgcacccgatgta

SEQ ID NO: 24484 - DNA, 96 bp, Chlorella protothecoides
aaggtgcccgggtacagctcctgcgtcggggtgcgtggatgagtgcatgttggcagtgcatgggcgtagaccgggaagagggcagcatggcagggg

SEQ ID NO: 24485 - DNA, 77 bp, Chlorella protothecoides
ggtttccagataatcctgaagcagtgtttgggtgagtgggggagggaaacaaaggtccttgagagtgttgctgcagg

SEQ ID NO: 24486 - DNA, 61 bp, Chlorella protothecoides
tccaagaaacccgtgctgaagccccttctgacaacgcctcaccgcagtagacatggtcgca

SEQ ID NO: 24487 - DNA, 185 bp, Chlorella protothecoides
ggcgcggctgtcaggcgcaaggggggtttttgaagccgtagccgcgactctcgaccatgcacactatttccaacccctcacacatccctaccttcctgccaggatgtgatgcgcctggacgactccgccaggatgaacactccgggcaaggcggcggggaactgggcgtggcgggtgggcggcag

SEQ ID NO: 24488 - DNA, 64 bp, Chlorella protothecoides
acggccaggatcggcctcaccgatgccatcagaacatccctctgtgcaatcgcgggtgtgcatg

SEQ ID NO: 24489 - DNA, 76 bp, Chlorella protothecoides
caagataggcctggagaccagcctcaggcgggtggctgggggtgttactgcgtggtggggggagaggaggtgggga

SEQ ID NO: 24490 - DNA, 509 bp, Chlorella protothecoides
  modified_base (108)..(351): a, c, t, g, unknown or other
cagcttccacgccagggtctctgcgggcggacggggggatgggtgtggagggggtcggggctcggtcgtacgtctcgagaccatggcgcacgtcatccccgccacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgactgtgccacccggatgagctgcggcgtgggtggaaacggtgtacttcccggggggggcaggcagcctccagcctggcaggcttccagccccccacctgaagaagatagggcgccaccatgggccagatggatcgagggtaacttgtggcgggg

SEQ ID NO: 24491 - DNA, 74 bp, Chlorella protothecoides
gccctcctcgtggtgttgccctggtccctttgtttcccccacggacatttcctcatccccctctaaacttctct

SEQ ID NO: 24492 - DNA, 61 bp, Chlorella protothecoides
atgttatgtgctggatcagctacatgctgcaccatccactggctgtggtgaaagcccctgg

SEQ ID NO: 24493 - DNA, 78 bp, Chlorella protothecoides
tagagtagctacacaacaagatgatacaagtgtaaaaggttttattgacaacgttcgcattatcgttgtaggagagaa

SEQ ID NO: 24494 - DNA, 183 bp, Chlorella protothecoides
aaaatgtatggtccatgcgcttttgcatgctccctgaccatgttaagttctggcttcagcatgaagacgggctgcgcgggcgggccaagggccatgatcgtggctgtcctggcagcagggcgatatgaaggcgaggcagatcagtgctgcaccatgttcagctccgtcacgcggattcatgaa

SEQ ID NO: 24495 - DNA, 76 bp, Chlorella protothecoides
cgcccttcacttcacctcctggctgaagcctcacccccatcacccaccccaccgtccaatcacatctcccccacca

SEQ ID NO: 24496 - DNA, 61 bp, Chlorella protothecoides
gcgtggcgtgagtgattgcggcaggggaggatggggggccgcatgccgagcgatgagcagg

SEQ ID NO: 24497 - DNA, 151 bp, Chlorella protothecoides
tgtaacaaagatcttgtcccgtgcctgcagttttttaaccccacgcaacatttataggcacccatgccatttgccgacacagagacggcctccttcttgtctcctcctagatgcagacacaccccctttgccccagtcacccaatccaggc

SEQ ID NO: 24498 - DNA, 77 bp, Chlorella protothecoides
catgcctacgtactgcagactgctgtgaagctcatgcactggtgttcgctgtgttatggtgaggcttggcacaggga

SEQ ID NO: 24499 - DNA, 61 bp, Chlorella protothecoides
attggtgtttaagcgcgtatgataggcgggtggtaaggggtacgtcccgctccacgccggg

SEQ ID NO: 24500 - DNA, 61 bp, Chlorella protothecoides
gagccctgtccccattcctgtcgtggcgggaattttggaacatcagtcatttttctccccc

SEQ ID NO: 24501 - DNA, 75 bp, Chlorella protothecoides
gcaggatcatagcatgtgtacaaggatgttggtaatcagcagcgctgcctctcctgcctccctccccatccagat

SEQ ID NO: 24502 - DNA, 61 bp, Chlorella protothecoides
tggcagccatgctgattcagtctccgagacacccgcctgtgagagacagccctgcgcaaag

SEQ ID NO: 24503 - DNA, 145 bp, Chlorella protothecoides
agggagtgctttcgggtgactcagtggatgtggagcagggacacgatgagttccatgccagcctcaaccccaggaccgcataggcacgaggaccccccaacccgacccatacattcaacacgcacttgaagtcgggcttgaggcc

SEQ ID NO: 24504 - DNA, 906 bp, Chlorella protothecoides
aagtgcatggcagtggtaaactcttgccttaagctcgccctagaatgtcgaattcaaccctccatgcagatgaggtactcagcgtatcaaggcgctcgagaccccatccacaggcgttgtctcagatgctcaacaaggtcatgcagtagctatagagttcaagtgagcgtatcgcacttgacactgtgacgattacatcacccgacgtcccgcagaattgagtagtttcccatggcacctcatatttcagagaaccagtagatctgcagcggcattgcaggggaggtattgcatcgctactacgttgtccacatcaatttgctttcggaatgggttgaaatatctgcatgtaagagagatttcctgggaccatgtgaggaccgcatcgaggattgtcttgaacaatcactttctatccctttcacagggaggccacttcggtggtttgtccatgctctgcggcaagacagtggatagaattagacaggccgagaaactcttgcatgcatgactgcccggagtgctgtccctaaacaaaactacttcagcaatctttctaatgacaaccaggccttttcttgaaggttgagtgccttatcagttcaaaagacacgagcaggtttgcttctagtgtacagaataggcgcatgttgccatacagcttgcttagcttttggtacaagttggggctcggtatagcacatattgaagtcgtgcctgccctcacgcagggcctatcaggagcacctcgtctgcattcagactgacactgaatagcctggtcgtctggcttctatgggttttaagtgatgctaatgagagaatcgaattatcccccatcccgggtctcacctctcatggcaataccgccctagtttttttcgttacttgagcctgcaccctctc

SEQ ID NO: 24505 - DNA, 76 bp, Chlorella protothecoides
ctcctggaaggagcccttgcccacctcgccagtctcgcaggaccccgacagcagcacaaggggccaggtgttgacc

SEQ ID NO: 24506 - DNA, 115 bp, Chlorella protothecoides
actcaaagatgggcctgccagcagtggcaataagttgacaacatctctggtctgacagctggtcggagaggctctgtggcggttcctcccgccagccgcaccacagggtcacact

SEQ ID NO: 24507 - DNA, 179 bp, Chlorella protothecoides
tcgtaggcggatgctgccctcccggaagcctaacacgctgacgccagacagggcacagcacagctcggttgcggcggcagccctgcgtggatgggtggttggcaggctttttggtgctttgtagggaagagaaggttgggtgtacatgctcggaggggcgggggcggcaatccgggcca

SEQ ID NO: 24508 - DNA, 61 bp, Chlorella protothecoides
tcagctcaaatggagtgtagtctgcattgattattgggtgtttggagggagctggcgttat

SEQ ID NO: 24509 - DNA, 61 bp, Chlorella protothecoides
ccaaagctgggagttccaacatcggcggggtgcattagacgacggagtctcaacataatat

SEQ ID NO: 24510 - DNA, 61 bp, Chlorella protothecoides
ggggcgggccaccacctggcaggccgtcagatttggaagaaaggacggcaggcgctcaaag

SEQ ID NO: 24511 - DNA, 80 bp, Chlorella protothecoides
tccaaggcaaatcaccttgaggagcgcacagaaggtctcaataaacataaggatgctgaatagctcaagtatgcctgccc

SEQ ID NO: 24512 - DNA, 121 bp, Chlorella protothecoides
aagggctgctgccacgtacacttgccatctggacttcagtacacgtttcaacaccagtctgtatagccttggagtgattctactggctcgcagttgtaatttgattgtcatgcgttgctag

SEQ ID NO: 24513 - DNA, 78 bp, Chlorella protothecoides
tccgcccagcccagaccgtgtgccgtcccggatgaagctgttcttaggaggcactgcgccagtcatcatcatgcattt

SEQ ID NO: 24514 - DNA, 71 bp, Chlorella protothecoides
tgggtcatgcccacggcctgcgccttacagagttgctaacaggggtgctcaagggccacgccatggccagg

SEQ ID NO: 24515 - DNA, 124 bp, Chlorella protothecoides
gtgctcgaccattaagcagggcacatggcaaacccttgcgaatgtagctttaactatagcaacgtataagaagctgtcctcaatcgtgcgggcctccggacccttgcgttccaagaccatgtcg

SEQ ID NO: 24516 - DNA, 70 bp, Chlorella protothecoides
gcctggcaggggccagggtggcacgatgaggtcaacaaattgttggaggatcagaaacaatttggcatgc

SEQ ID NO: 24517 - DNA, 70 bp, Chlorella protothecoides
aggatgtcacagcgtgcacccagtagcccaggtaccctccacccgcaccaggtgtgttgggcgacgacac

SEQ ID NO: 24518 - DNA, 68 bp, Chlorella protothecoides
ggctcggaagcgagtggccccagctcccactgaggccgcggatgacgcgtcctcgcgctcccaagtga

SEQ ID NO: 24519 - DNA, 81 bp, Chlorella protothecoides
tgggtatggcagagtgtgggctgttttttttgtcagagtatgtgctgggtttggtggggtgtggctggggcattcagggcg

SEQ ID NO: 24520 - DNA, 105 bp, Chlorella protothecoides
cggtcttcgcggagagatccagcatcggaggatttacgagggcgggaaacccttcctgacagtgtgttgcccgtcttgccgtgttgcaataggtttaacaagtat

SEQ ID NO: 24521 - DNA, 61 bp, Chlorella protothecoides
gtacgagccgcctggatatcgcagcacaatcatgctgattctcggtttccatccctagggt

SEQ ID NO: 24522 - DNA, 138 bp, Chlorella protothecoides
ctgaatgggtgtgtgggtttgggtccaggatgagaaacgaacggcagctcaagtggttcagggaatgttcgcgccaacccaggtgttaggcttcccgccaggccagtctcgcgaacagtcgagagctgtcgcagagct

SEQ ID NO: 24523 - DNA, 919 bp, Chlorella protothecoides
ggtgggggggaaggggggggaaagggagggaaggggggggagagatatgtcggtgagatgttggttggggtggtggagggcgggcaatggacctcattcaggagccaagcgggtgaagaccaaaaggtcctgtggcacgtggcgccggcatcgcgagcgccggcacttctcgataccatgcgagtctccccacccccctcccacaccttccatgacacccaccccaccccaggtctggcccccgacgacgacctcttcttcgacgcggcggaggatgagctccgtaccgtgcgcagcggtgagctgagcgtgcgccgctcggcctcgctggccagcgacgcccccgcccgcgagctggcagagttcaccttcaccatcgcgcggccggggacggcggggtacgcgggcgtggacacgtgcctggacgtcacgctgggcacgctgcgcttctactgcaatcgccccaccctggcggcgctcatgagcgccggcgccgacttcgccgccgcggcggcggggggcggggatggggccggcggggaccaggaggagcccgaggtggcggacgccaaggagctgggcgcgccgtcgggcgtggagctggcgcaggccgtggaccagtccctggccgagaagctggagggaagcccggtgaggagagggggatggaagtcgtggaggatgtcttggccttggaatgtcttctggggagggggggcccaatggagaagcaaggcatgcactgccaggccccacacagcaatctgagtgggggggagggcaatacaggcgggtgttggacaccaggttgcgttgcatggattgtgagacccacaccccatgcccccctctcccctgtcacctcccgcccccatccacaccaatctcccctcaaccttttacctcccccctcccccac

SEQ ID NO: 24524 - DNA, 61 bp, Chlorella protothecoides
gccgacgtgctccctgctgggtctgggaggtgcggacctgtacctcagtgcgtatgccgcc

SEQ ID NO: 24525 - DNA, 64 bp, Chlorella protothecoides
acccagtcagacgggctgggcctcgctgcagccacccactgccaggaaggcgttgaccatgttg

SEQ ID NO: 24526 - DNA, 98 bp, Chlorella protothecoides
aaacactcttgcagattgggatcccatgtcgagttcctgaccgatgatagtgccactgcatactgcaagtacgagcaacagcagagctcaggcaggac

SEQ ID NO: 24527 - DNA, 104 bp, Chlorella protothecoides
gacctgcacctgcacagcacagcatgcgcgtcagggtttggcatggccacgtacagctccaccatgcagaggaccagggttatcgaaattgcgggtttcgagga

SEQ ID NO: 24528 - DNA, 133 bp, Chlorella protothecoides
tccagttgcttcatctgtcgggtacccatcgttccatcttcatcgcccacagcctgaccaacaggacgcagctagaaactctccgactcctcttgccgggccaccgacccccgagtctgagaccctcgtccag

SEQ ID NO: 24529 - DNA, 85 bp, Chlorella protothecoides
actgctcgagctcgtgccgccgctgctgctggaggaagtgccgcttccgctgctggagctggttccgctgctggagctggttcca

SEQ ID NO: 24530 - DNA, 232 bp, Chlorella protothecoides
caagaaagcaatccgcaaccggaccgggacactgtagcatttattgccgtattttgtgggcgagtgagtggatatgcgcatgaattgtatattatccgtaaagcatagctctggacacagcaaagattgaatatcgcttggactttctgcaaactataccaacttccgtgtcaccccccggacgtgctcatattccttgctagaaggggccgcgcgcgcatctcgatcgcgg

SEQ ID NO: 24531 - DNA, 240 bp, Chlorella protothecoides
cttgacctctcacagagatggtgagacagtcgcgttttcacccgaccaggaccaacctgaccacacccggggcccgtgcaaaatgtacagccactcttgtgcccatcaaagtggcggccaactaccctcaaccactcaccactccccccaggcccaaacccatgctatcccagtctcaccctggttctgactaccgcgggccttgtttgatggcgctctgggcacactcctctccacggc

SEQ ID NO: 24532 - DNA, 61 bp, Chlorella protothecoides
tcgggcccttgcacagactgcacgatcctaccatggcatggagctgccaagcaccatactc

SEQ ID NO: 24533 - DNA, 115 bp, Chlorella protothecoides
ctcgggatacttttccttgagtcgatgtagttcctcccgcttcttgttgtgctgtggtgagatgtaaatggaggagctggtttacatgtcggaggagaaggctcgccaaggcggc

SEQ ID NO: 24534 - DNA, 61 bp, Chlorella protothecoides
gcggttcatgccgggtggggagtacgagcaatttgacgaggacatccggccctatatggtg

SEQ ID NO: 24535 - DNA, 131 bp, Chlorella protothecoides
tggcgtgtgccgtcttggagtgctcatagctgcctctgccctccgctggcgtaacacaacttgctattctcgcatgtatccggactcgctgctgctcccccgcacacctgcaaaccaacctcaccccggct

SEQ ID NO: 24536 - DNA, 75 bp, Chlorella protothecoides
tcgcaatggcacgggcctggcagcaccggccctaggttaagacataaacttacgcgcgacaagctgtcgtgctac

SEQ ID NO: 24537 - DNA, 80 bp, Chlorella protothecoides
gtgggtgaggctgaaccccgcagcctttgcccggtcctcgaagacctggcggtgttggtgtgagggtatggggggagggg

SEQ ID NO: 24538 - DNA, 61 bp, Chlorella protothecoides
ccagcagggactcccgtccgcgactgtcataccctcctctccccatcgcaaccatgtcccc

SEQ ID NO: 24539 - DNA, 169 bp, Chlorella protothecoides
acgacgacaattttgatgaggaaggtacgagccaaatgtcatcaggagggtgcagcatgcaggggaaaaccatctcatggtaaaatgggattgccctgcattggtctgaggagggtcttgcgtgcacccaacctcctcatcatcacccaacaggcccagcctctcctcg

SEQ ID NO: 24540 - DNA, 67 bp, Chlorella protothecoides
ccgggtgccgggctggcgggacctgtgggggggccgccgcggccagcttgggaggggtctgcctcgg

SEQ ID NO: 24541 - DNA, 73 bp, Chlorella protothecoides
tccctctcctcctcgagtaccccaaggtgtctctcatgggggtttggcatccctgcatggccatccttgctcg

SEQ ID NO: 24542 - DNA, 75 bp, Chlorella protothecoides
gcaggcaccgatgctttcagatctcattcagtacaagtgcactctgaagctcagctcgtgtgcaggaatgctggg

SEQ ID NO: 24543 - DNA, 131 bp, Chlorella protothecoides
acccggttgccctcgggcagcaccacccacacaccttgtctctctctcccaccacctccctccgattgtgtcgctggcagtgaccgctgtgtcccatcatatttgtccctcttttggccctgcggtcgctc

SEQ ID NO: 24544 - DNA, 115 bp, Chlorella protothecoides
gcacacgccctccctgccggattgctaagctggtcgcttacagacatggatctcatattaggtgcaaggccatcctggccgtcatttgcttgctgaagcagtctgccgcctcttg

SEQ ID NO: 24545 - DNA, 128 bp, Chlorella protothecoides
tccctttggctgggtgcaccacgtgccgctttgaggcccttcggattcgcagggaggcgagcctcagttttcatggcgcctagtgtgcacccctcggggaatgcaatgcgagccagcgaggggggggg

SEQ ID NO: 24546 - DNA, 117 bp, Chlorella protothecoides
tctgcctcgatttcagccctttcctgtcaggaacacagggggctgaggggttcagagagatcgctctgatcatgactgtacctctggaagtatgccctcatctcgtcagcccctata

SEQ ID NO: 24547 - DNA, 61 bp, Chlorella protothecoides
gcctgctggctggattgaatagggccaaactggtcctggagcaggggtcagacaaagaggt

SEQ ID NO: 24548 - DNA, 128 bp, Chlorella protothecoides
acaatggcgcctcgtgcgaggcagcaagtctcacaagctacactcaaaataaggcacatattgtatgtttatgatagtcatgtatgcatgtcgagcgtggcctgtttgtcgtgtaaagttgctgtact

SEQ ID NO: 24549 - DNA, 69 bp, Chlorella protothecoides
gacttggctggacttcagcctacttgaagccatctctgatgcagcatacaacggcagagcttcatcgca

SEQ ID NO: 24550 - DNA, 101 bp, Chlorella protothecoides
ggccgtctacttcccggctgccgccttcctggccctgaccctgcacggcgccagactgtcgcggcaggccatcaccacgctggcccagctgctgcttggcc

SEQ ID NO: 24551 - DNA, 79 bp, Chlorella protothecoides
ggggcgggtgttccccttcatcctcctccgccccttccggcccacgatattcatccgggtgagccctgctgcactggcc

SEQ ID NO: 24552 - DNA, 112 bp, Chlorella protothecoides
cgacgagcacatcatcacatctcgtcacctttcccagcatccaaaaagtcccacaccaaccctcccaccatgcgtgagaccctacattgatgacatccgacaggagagcatt

SEQ ID NO: 24553 - DNA, 81 bp, Chlorella protothecoides
ggagggccgggggatggatctgggcttgtcagccaatataagtggaggtgaggagcaaagcttcaggaggaacctggcaaa

SEQ ID NO: 24554 - DNA, 78 bp, Chlorella protothecoides
gggccgtgtcgcgacggcggcctgaggcattcacattcttgggttgaggggaggccagagggccccaggcagctcgag

SEQ ID NO: 24555 - DNA, 61 bp, Chlorella protothecoides
gatcctgtggcaaggaggagcggcagcgaggggttcaagtataaattttgcaaaaatcaag

SEQ ID NO: 24556 - DNA, 61 bp, Chlorella protothecoides
ccggcaacccctcccactgcctgctgcatgacgaaacccctgcacccactttccagcactt

SEQ ID NO: 24557 - DNA, 79 bp, Chlorella protothecoides
ccaactacttccaagtcagagaccacactttcaactcggcttgccccatgctcaccagattggaatcgatgacatcggc

SEQ ID NO: 24558 - DNA, 61 bp, Chlorella protothecoides
gcgctgcccctctgggcggcctgccagcacaaggcgcaggcggcccgccacgcagcgccgc

SEQ ID NO: 24559 - DNA, 61 bp, Chlorella protothecoides
gcagcctcttccaactccctgcgtgccagcacctgccgcactaccaggtaggctcccacca

SEQ ID NO: 24560 - DNA, 77 bp, Chlorella protothecoides
tcacaatcaagcagctgaggcaagactccaggaagagcattgtcttttaccctgacattgggcatttgggccacagt

SEQ ID NO: 24561 - DNA, 61 bp, Chlorella protothecoides
gaagaggaaggctgccagggtttgggggaggtttggaaggtgtgcgcaccagaatgctctg

SEQ ID NO: 24562 - DNA, 61 bp, Chlorella protothecoides
cgccaagggtctgaacgacatgatggggaatccagacgctatgcaaggcatgctcaagcag

SEQ ID NO: 24563 - DNA, 184 bp, Chlorella protothecoides
gtgagaggaggacgaggtgatggaggagggggtgcttggaaatgtgccctgagatcatcctggggtcaaaagtagaacaagttagcgagggaaggtggctgattgctgccccttggtcaggcgagggatgctttccgaggctcgtcctactcgttgctgctcatgggcaaacctccaagacatc

SEQ ID NO: 24564 - DNA, 124 bp, Chlorella protothecoides
cagagatcctccgggacatgctgaggcaagcctaggaaacagggtcagactgggggacaggcagcagctcataacagtctggggattgggggggaggggggtacgtatcgtgccgcccaccctg

SEQ ID NO: 24565 - DNA, 112 bp, Chlorella protothecoides
gtgaagggtatagctggggggccatgttggagtggggttgacagcagcgcactgcatgcacgactcacataccggccccatactcttgtcagcccagcacctcaccgtgctg

SEQ ID NO: 24566 - DNA, 3502 bp, Chlorella protothecoides
  modified_base (278)..(407): a, c, t, g, unknown or other
  modified_base (1409)..(1418): a, c, t, g, unknown or other
  modified_base (1552)..(1561): a, c, t, g, unknown or other
  modified_base (1763)..(1772): a, c, t, g, unknown or other
  modified_base (1990)..(1999): a, c, t, g, unknown or other
  modified_base (2333)..(2342): a, c, t, g, unknown or other
aggcagcgggccgcacccttgcctccagcgtccaccggaccctcagccctgccccacatcctcgccatactccagggccacgagccgcgtgcccatgagcagctccagcgtggagttctggcgggggatgcggatccggcggtcgcccggcgtgaccagcaccagcgaatgcggccggctgagcgccacaatgcccgtcagcccggcggcgtcggggcgcgcggcgcaggccttcaccctgaccagagcaccgtggagctcggcgcccaggagccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcgcaaggtggggatcggggggcttggggcaggggttgagggcgttgggaaattgggggggcgctgcgccagaaacaagcaggcacgtgcactaattccagaggaagcgcttgtcatggaccagcactccaccgttgctgtcgggggcgcacagcatctgttgacagcgctgaatcccccgaccaacttgtccacccccaggcatgcccctcgtgacaaacccttctggtgcagcgtggcaccagactctttgactcacgtgacggtggccagggcggctgcgcttagagtcccatcctggcgcccagcgcgcttggctgtctgccgagcgcctccacctggattggcaagagggacaataggcgttctcgtcggcagagacaattgcaattagccgaacactcctgttcaaagtgcagcaatgcccacctccatgtacctgtcccacagcctcgggctcctgcatcactcaccctttgacttggccttcatggggttctccagcaggacgctcttgtcttgcattcggagggagtatggcgcactggagcgtgcgccgttccccgacaccaagcctccgaccagcgcctccacagcagcttgtggatcgcgtgcgggagggggaacctgtgcaatgagataccaatgtttttagggttggcgttctaagatgaaaggcctctcagacgatggtgacccaggagacgggagtgcagaggctatactccgcccaacaaataatcttcttgtcaaaaaccttgcacacactcatttcacccaccttgaggacctctgcggccagcaagcctcgtggcagggcatcgtacaccgggtgtggtggcgcgacagctgcagctgagaccagagatggcgatgctatgcttttcacttcaattgtgttggtcgatgtcttgggattggacccctcgagcttggccagacgtcgtttctttgcagccgaagtgcttccatccaccttgctcatattcaagactttcnnnnnnnnnnagctagacgtcgtttcttcgcagccgaagtgctgccatccaccttgctcatattcaagactttccttcctggtcaaatgcctccttgattgtacatggtcccattctgtactgcttgcggtgcgcccacacgtnnnnnnnnnnaatgcctccttgattgtagatagtcccattctgtactgtttgcggtgcgcccacatgtcaaggtggcctgctcgttgccgtacccccaccaccaacacaacaacaacatctacatctacagggtttcgcgccgacacgtgagaaagccagggtcgaagctgcagtgcctggtgagatcagacgccgcctcaccatacctcgnnnnnnnnnngtgccgtcccccccccaccaaaacaacaacaacatcaacatctacagggttccgcgccgacacgtgaggaagcccgggtcgaagctgcagtgcctgatgagatcagacgccgcctcaccatacctcgcctagagcctgcatgaggccgccagaaccactgcgacggagcaaattctgggtaaatttctagagcaaggaatactaggcggactgtatcnnnnnnnnnncagcaaattttgggtaaaattatagagcaaggaatactaggcggactgtatccaaggagccccccgtagccgacctcatttgcgatcgcgagtggcatacaccaagtccctgtgagcgctctccactccgttgtggaggaaaaataaaaggattcaggactgcatataaaattaaaggtgattgtgggtgtcgcggaggtgtgatcacgggtgcgacccggggatgtatacttcgcctctatccaccttgcaatcgttttgtctcgacatttccaccatctttcggtcgtgtgtatctcactcttacttttgagggcggttggggtcgctggcnnnnnnnnnnttcgccaccgttttgtctccacatttccaccatcttttggtcgtgtgtatctcactattacttttgagggcggttggggtcgctggcaagcctgcaatgcctggatcacgatcccggatggggtgtccccggagggggaggggctacccctctccgagccttgccctgcccatgggctggcacaaactttgcgacaccaacccggaccctcccgcacgcacccacaatcggtcacacccattcgcttctcaactgaatcttttttacagatcattctggtggtttacggtgccctgatctttgccagtctgccgctctcacctggtaagacgggaccttccccctcccccgcactgccaccattgtgcctgcgcatctcccctcgccagccaattgttctccaatgccactcggatgctgaatgtggctcgccccatccccccggcctagcctccctgacctagtattccaggctcgagatgtcgcggccctcacccagccatccctcaccgacccatccctgcccttgcaggcatgcacataggacaaccatgactttggtccagatcacagcttccttcgataccctggacaccctgcgggcgacacctcttccgggggaagagttcccctacgctaccactggctattgtggggtgaagtgctgctccaagtgcggcgcaaccaagacaccacagtggcgtgagggcccttgtggtgagtgggatcatgcatcggtggggtggtcaggagggccgagactctttgggggggtgaggggtggggttcagggtgatgtccttggcggatgtggctgcatccatctggggcccagcatgcgtatcacttctgccacgctcgctgcgcaatttcccctggcacatccacctttcacatccctcccccgtcggaccgcctcgccccctcctcccccagggcccaagacgctgtgcaatgcgtgcggcgtgaagcgcacccgcaccctgcgcgccctgcaggagggcagcaagcgccggcgcccctcccccgccgcgctgcgcgcccaggccgacccgtccggcgcggggtgcgactcgccggacgtttcgtcggccggcctgtccgcgccgcccccgctcttcgtgggcaccggcttcggccccgccgcgccgcggcgcccc

SEQ ID NO: 24567 - DNA, 76 bp, Chlorella protothecoides
tcattccatccgtttccaccctctatccccgcagacttgtcctagaggaccaacacagatactcaaagaatttctc

SEQ ID NO: 24568 - DNA, 61 bp, Chlorella protothecoides
ccgagcgtcaggcgcggtgtctttggacaaaatgaacacacggaggggcgggcaggcccag

SEQ ID NO: 24569 - DNA, 70 bp, Chlorella protothecoides
ggggaagggggcgtcgtcgctggtcccccttgctgcacgctgcaatctcaagccaggcaccctggactgc

SEQ ID NO: 24570 - DNA, 13658 bp, Chlorella protothecoides
  modified_base (453)..(501): a, c, t, g, unknown or other
  modified_base (577)..(586): a, c, t, g, unknown or other
  modified_base (912)..(921): a, c, t, g, unknown or other
  modified_base (3652)..(3661): a, c, t, g, unknown or other
  modified_base (4697)..(4706): a, c, t, g, unknown or other
  modified_base (4865)..(4874): a, c, t, g, unknown or other
  modified_base (4947)..(4956): a, c, t, g, unknown or other
  modified_base (6127)..(6136): a, c, t, g, unknown or other
  modified_base (6328)..(6337): a, c, t, g, unknown or other
  modified_base (6986)..(6995): a, c, t, g, unknown or other
  modified_base (7294)..(7303): a, c, t, g, unknown or other
  modified_base (7750)..(7759): a, c, t, g, unknown or other
  modified_base (8294)..(8303): a, c, t, g, unknown or other
  modified_base (9448)..(9457): a, c, t, g, unknown or other
  modified_base (10751)..(10760): a, c, t, g, unknown or other
  modified_base (11339)..(11348): a, c, t, g, unknown or other
  modified_base (12836)..(12845): a, c, t, g, unknown or other
  modified_base (13509)..(13518): a, c, t, g, unknown or other
aggaggtgggaggcttggcggctctgggggtggtggactaggcggggaaggaggtggggggcttgggggagatgaaaatggtggtggactcggtggggaaggggctggagggcttggggcagatggggccggcggagtaggcggggaagggggtggtggattgcggggaggaggggggagcgatcttggaggtggtggcaacgcccggggtgagggactgatgggcgggggtgtgtgtagagcaggcggtgacggcgatggtggcggtaggggtgcaactttgatggggacagatggcgatgccaccgtctgttttgtacttgggtcgagggcggctgcggtcactgtgccttaagctttggtcgaggccaaggtggttgtgttcacggtggtgaggctcgtgggtgttaaggtcagagtcctactcggtccagacgcaaagtcaaatgtcannnnnnnnnnnnnnnnnnnnnnnnnnnnnnnnnnnnnnnnnnnnnnnnnggggagggatggaccttgtcttcgggggtgggggcgaaatcttcttctttggcggcggagacctggctatgggcgnnnnnnnnnngagatgagggcgtcagggtgtcgcacaccatgtagttgacgatgattctgaatgcaatgggtagtgggggcggcgaggcggcctcaggggccggaggtgacctggcctttgagggagggatggaccttgtcttggggggtgggggcgaattcttcatctttggcggcggagacctggctatgggcggaggggacgacctcttcctgggtggtggaggggaccgcttcttgaggggcggggggggagaacgctttttggatggtggaggagtagaagaaagatttatagtgtccccggtgaccagatcagctggggtgcagggtcgnnnnnnnnnnagtggaagaaagatttatggtgtccctggtgaccagatcagctggggtgcagggtcgcgaggcgccagccaggccattgcagatgttggcattgcccttgttattagtgccaatgttgaggcttccttgattcttgttgcctgcaaggaatgagggggattgccttagattggctgacttagtagcaacgtctgggatcacaccccagaggtgtgaacatgacacccccaggttgggagtgtgcggccctggctcctccaagagccccttcccagctctcaaaacaggatgcggcagggcataccccatatcagagcaccctcaagtgccagccatttgcatggctgcagcagcgcaccacggacctatgtttttgtctccactgtttgcggtcccaaagttgtgccacccgatgttgccattgccagtgtttcccagccgatcaggcgtgcaggccggctggcctttaggcaggcattccacagccatcagcgcttggcaggcaggggatgcgcatgtcttccctctgacaaggctgactgctgagacgttgatgtttgtagacttgagacttgctgtacgcacagctccgactttggcaaagcctcgcttcctaagaagaggagttggagaaatcagaaactaaaatgacgtacgcctgtagtcgcaacatgaacatagcaaggacggctacgggaaattcacccgcatccgctccagaccctacttgcaaaagctgtcggcgctatcatccgtcagtaggaagactttgtttccggatctgaacattgcaggacaataggtatttctggtccgaggtgttaaacatcccggcagcactacccggccgcggtgacctatgggctccggtgatcatagtaacgccagcatcggatgcaggggagctgcatgctgacatatctcccagtacccctcactcacctcgcagatggaagagcgaagaaggtagatttacaagccacctgcgacgtgaggggaaagaagtattacgccgacctgccctggagcttcgcaacgtatctgaactggcacatacacgatctcaccgccgtctccagcagtgtggcgaaacccagtaggaggagcagcgacaaacccatctttggtcgtgcactgcctgccatcctcagagagagatgctattttccccgtcgaattccagttctctttgtccgactcttcggagtggttcgagctgaagactgcttcgtacgatgatgtcacgggtacccgagagctccgacaagtgttaaatacttgggtgttggtggcgagcggagcctagtggtgcccacatggaggtgtaagtgtggtttcccccccggacagatccgacaaggctccggaccccggcagcaaaccagacgtacgggtccctgccgcaccccagcaattcttttcagcttctcccttgcaagctatggggaccattcattgccgatgaccttaaaaagccacccgaatgggcctgcagcgatctgcccctctctcctgcagtcccgacatcgtcagttccacggatgctggaatcagcatcgtgatattgagatcttccttcacacatggccggagcattctgggttgaaggctggagtgggagagttctgagtaacttcaagagctctgatgtggtgatctcctcccgccacattctgtgaaccagaccaagcacaaaggcttgagatggtggccagccaacggggctaccttgccgaagcaggctcccgccattggccatcagcgcaagtcgcaatggctacaccacaccaccatgccaatgggccgccaaggtcaagtccagagggccatggggtgttttcactgggttgcatgtgagggaagagggcggtggcttgatggtgctggggcctgccgctgctgctctcataggggcacagcaatggaagctggccttggtgcacccatcatcctgccacacctacgacatggcctccacatctgcgaagcctgacactcaaggaccggagagtgccaccagtccacaccctgtggacagtggcagcgaggctccaccactgctgagcatcccggacaccccggcgccttcacgcgagagcgattcagggctcaaggaagcactccaggggccggcgatcagggtcaacctggttgcggagaagggggtgcgtgcggagcatgatactctttacaagcaccttatggaagatgatccacctgtgctgcccgcttggccagctgataccatcccctacgagcgccacatcaaagccaaaactcaccgcatccgctcccatcttgaaagggatggtggcaagaggcggcagactgtttcgacgggcaaattaaggctaaggtgaccttatacctgctgtaattcccatgtctgtaagcgaccagcttagtaatccggcagggagagcgtgtgcggggcggcagtgcctccggacgggcaagggagaggaggggaccgcccctcacctggcaccccctcccccttgggccgcgtgaggcctcgacgggcggaggccccggggacgtccaacaggtgcaggcactgcttcatcgccgttgcaatcgatactgtaccgttcccatgatattataacacaacaatctgcctcgcggggcgcgttcgtaccccgacgggacatggcaatgccctgcaaagcacgaaaatctatcgaccgaacgaggggatctcgcaccgcgaacaagcacttggagttcnnnnnnnnnncattttgtcgttttgaacgactgtatactttggcaggcacccatggattgaagatgtacatcaggtagctgcgaacgtttggtctggagagcagcatcgatgctgacctgaaggggtcggccacatgctgccatgatcctcttcgttcccctccaccagagtctcaacccctactgcaacagcagttcctagggaaatgccggcgatgggaccggctgcatctatgcttccatggccgtcagccatctgtggatcactgatatgcactattcaccccaccagtggggctaggaagtggcgggagattccctgcatcatagagaaagggaaggtgttaagtttgctgctgaggcattggcgcatctgtgcgatgggaagcttataaaggagtcctgcatagcggataatcacgcccgcatgacacaccgcccatccccttggccagaatcacaccatggaccaccaccggcctcctcgccaatcaccaccccgtaatatgctgggcaacttaccctgtcactgccgttgaatggcagcgtgtcgccccctggtctccactgtcgaagatagctcccgcacgtggcaaagcacgccgcatccgctcccatgttgagaggggaggcggcaagaggcggcagactgcttcagcaagcaaatgacggccaggatggccttgcacctaatatgagatccatgtctgtaagcgaccagcttagcaatccggcagggagggcgtgtgcggggcagcagtgcctccggacgggcaagggagaggacggggccgcccctcctccggcaccccctcccccttgggccgcgtgaggcctcgacgggcggaggccccggggacgtccaacaggtgcaggaagtgcttcatcgctgttgcactcgatactgtatcgttcccatgatattaaaacacaacaatctgcctcgcggggcgcgttcgtaccccgacgggacattgcaatgccctgcaaagctcgaaaacctatcgaccgaacaagggggtctcgcaccgcgaacaagcacttgnnnnnnnnnntgcaccccgacgggaccaggcaatgccctgcaaagttcgaaaatctatcgaccgaacgagggggtctcgcaccgcgaacaagcacttggagttttacaaaggcttgtttattaatattggaggggtaaatgtcattagaagtgcgagttgtgacttgtnnnnnnnnnncctattaattaatatttgaggggtaaatgtcattagaagtgtgagttgtgacttgtcccaggggggcgataannnnnnnnnncccgggggggcgataatgttgtgagagaagggtactccccccctccctggcttcggcttcgactctgtacttacaccggccaccaacgcacagtttatccgtcaacccacctcccgaatacaatttagaaatggatggtagcgtcagtcgaggcctcctggccctgctggtgatggtgatggtgctcgagcctgcaggggtaaggggttccatccctgacaacaccaatctcacggccgctctccaggccgtcacacggagctatgctaaaacttctatgaacaccatgaagatgctggaagaggcaagggtgttcgcagcggcagtggacgggaacattgcgggggagccagcatccagccccgaagcctcagatactgcgggcccctcgctgggcatggcgtcaatgtgcgtgagagttcctgtacttacttgatgtgcccaacatctgcattcctgccagcagagcacgccaggccgttggcagacgggaactgtcccctgctgggtgtcgctcccgggcggaccggaagctggcccccgagacccggcaccatgctctcttgatgcagggcggaccaccgacacactggggtctcagtcccgcgccaagcctctcctctcacgtacaggctacctctctccaccccctggcaggtcgtactcctctgttccaagcaagttcctggccacgaccaagttcccggcctaccccgcggcccgcctgggggacccgagcgtgccctcgggcactctgtcccccctgtacccgtaccagcgcgcgacgagcaccggctgcccccagcagtacagcgtgaccctgcgcggggccaggggcaccggcgccgtggacgacagccccgccatcgccaggacggcggccgcgtcggcgcaggtgtacttcccgctgcgcagcggcgccaccagcagcgtgtacctggtcggcagctccatcaccgtcgcccgccccatcatcgtcccctgcggcgtcaggctgcaggttgccgcggggaagaccctcaccatcaccgcgcagccgcgcgtgacctgcatgaaccaggtggggcgatggggtgctgaggaaggggtcggccagcgggacacggcgaccgttccctgcccatgctgcggcatgggttccctagatcgagtgtgaggccaccgcaggccnnnnnnnnnngccctgcacgtgctgtggcatgggtttcctagatcgagtgtgaggccaccgcaggcctgtgagtatggaagcaacgtacgtcacttggcttgcgccgcgcacctgctgagcagcttcccccccaacacttgaacacccccccacacccacaccattctcgcaggccatattctccggctccggcgccgtgannnnnnnnnnacagcttccccccccacactcgaacaccccccccacactcacaccattctcgtaggccatattctccggctccggcgccgtgaagctgagcggggcggtgcgcgacattcaccccagctggtttggcacgcccgccaccgacgccacggccgccgtgcagcgggcggcagacgcctgcgcatccggcgcctgcaccgtctggctgtcgcgcgccacgggcctcacccgcaccatcaccctgcgtggcaacgcgggcgtgcatgccagcgccggggcgactgtattccctgtggggggctcctccaccaacgtcaagcccttctcggccttcacaatggcgccggggacatatcccaacccgatcagcctgtccagcatcacctccttcaagtatgccgtcacagtcaacgtgcgtggggccgggcagtcgcccccttgtgtgtgtactggggggggcagggggtgctaggtgtgcatgtcttgggggggcttgggaaccctgtgatcccaacagcagcctgaatgaatgccgattgcacctgccgcgcccagccccagcccctgccagatcctccatggatctgctcgaccacgttgctccgcggacgagatgttcaccgtcgccctaggcctgtcttgacagtcacgnnnnnnnnnncttgcatctgccgcgccctgccccagcccctgccagatcttccatggatctgctcgaccacggtgctccgcggacgagatgttcagcgtcgccctaggcctgtcttgacagtcacggcaatcccccgctcgatcctcccctactctctgaccccccccaacacacaataatcacccccgcacatctgcagggtggagtcaagtcggccagtgtcgggatcgggagtgccacttatggcacctcggcgctgctcctcaacccaggctccggctcctccatctccggactctccctcttcnnnnnnnnnnacagacctcccccccaacacacaattatcacccccgcacatctgcagggtggagtcaagtcggccagggtccggatcgggagtgccacctatggcacctcggcgctggtcctcaacccaggctctggctcctccatctccggactctccctcttcctcactgcctgtgcatactacaccaactgcttggagattgtgggctcggcgtcgggggccagcctggtaaactcggtgctcaggatcaactttgcaaccaccatctacaacgcggccgtgctgttcaccgggtcccggccgcccagcttcacgcggagcggcgtcgtcttccaggtgaggcgtttcaggtgcatgctgtgggtgattggggcacgccattgccatcagggtggtcctgatgccaatgggggtcccagcctcgcacaggcctccacacaccctcccacgcccnnnnnnnnnnaaggcgttccaggcggatgctgtgggtgattggaggacgccattgccagcagggtgatcttgatgccaatgggggtcccagccttgcacaggcctccacacaccctcccacgcccacctcacacccggcaggctgtcgacccgacgcccatcagtccccccttctcgaccctcaagaacgctgcaacgtccccggccagcggcttcaccctgggcgtggacacgtggctgggagggttccccgtgggctccagcaccctcggggggctgtccacagggcagctggtgaagggcagcttctcaaacctcctgtccagctttgcgcttgccaatgccgactccatgaagagcaacaacatgtggagtgagcgagggtggagcggcgggagcctcgggcgcgcgccatggaggagttgccgccgcatgctgcggccagacccagcatgcgcatactctgcccacccacttgtggttctggatgtatgcatggccctgcctcaccggggcaggtaccccctccccttgcacctgcctgnnnnnnnnnngcccacctgtggttctggatgtatgcatgggcccgcctcaccggagcaggtaccccctccccttgcacctgcctgttcctgacccaacaaccccgacccccggcccctcctcccacacccaggcatgtctggctcctccaacatcgcaagcgtgccctacctgggcagcgcaggcgccatctacggaatgtccatgaccgcctcctccgtcatgtccaatgtcccggtgttctacaccagtgtgcaaatctcttcctcctggaaagctggaacctcccaatccttcctaatctacacccccctggccagatgggctcccacctccagctttacattcgtgcctttcaggtaggtgcaggctggcatggggcctggcgcaggctggcaaggggagggtggacgtgggtctcgtgctgaggggtaaaggcttagaggaaggcaaggggagtgtgaaagcatcaggcgcggcggcccaacagggcattctgggtcagggtttgccatctgttgatcaaggtggaatataccagaatttacgttggcatgtgcctagatagggggagcggtgcagcctcagcacggtccatggcggcattgtgctggggactcttgcgctctgccggggcacggaggagatgatgactcgcatcccccttcccccccaaccacgctcgatgcaggcagtacaacatctggctggtgtgcaccaagattgagaacaggaactccatcaccaggaatcagctgagggtcaccctcaagaacgtgtccaaatctaccatcccctatcccatgctcatgagatttgggctgcaagtgggcttctgaggcgtattgctactcacattcccatgtaccgattccccaatgcatgctacctgggctccatactgatgagcgctacaggtcttctggtatcgtcgctcaccccttcccactcacaaacatcaccggtttggacgaggctcgtgcatatacattgcaacaacccctgtccttgttcatgaccctcccaaccacctcggcgcttgttttggcgacaagactgtcgcttcccacccttgttaacgttagtggagtgtgccagaccgcacctcgcctgctgatgaatatctcacaactcgtcatgcctgccagggatcgtnnnnnnnnnntgaggctcatgcatatacatcgcaacaacccctatccttgttcatgaccctcccaaccacctctgcgcttgttttggcgacaagactctcgcttcccacccttgttaacattagtggagtgtgccagaccacacctcgcctgctgatgagggtttcacaactcgtcatgcctgccagggatcgtgcccccttccgcctgataaagtcggtgcacaaagcccaccattgcatgtgctgtacgttctcctgtaagctgggacactgtggggtggaagggaagatgacattgttgctaggaccccagaacggcacaacagcattgcatgtgttggggcagcgcgcggcagccgctccatccggcatcaagggtgggtgggaaggattcaccactgcacgctgccttgctgccacctatgcgtacctaggttgctgcgagatacataatatatggtggggaactccttgtactcgatcagcgccgagggcagctcattggccgtgccatcaaagcgtcctatgaccaagtcggggaggtcctgcggcatgcaaggagcggggcttgagagcagcatttctcatgtcgagggttgtggtgcagaccttgcgaatctgggcgacgacagacttcttatggttctccgtatgttagtacgcctcgagctaggggtgcaggcagtgggcgacatgcacgacccataccttcaacgcctgggccgcctcctcaaaagccggcgagacagcctgcagcaggtatcgggtttgggtagcgtttgcagtcggcgctccaagcgtgcaagatcatcacgcgagatagaggctcactagcgcaggcagacctccagagactctcatgcgcgagccccagcggcctcctccccttgatcaacatgtaccttgctgtgctgacaaaactttgcatgtatgaagaggaaggctgacgtgtttggggagagcactgcgtccacaatcgtggttcccacccaaacctgtggaagggcatgggatggtgatgatcataagatatcaatctccccttgcttgagcagaccggcaatcactcttcacctgtgctgctactcatcaagcttgaggaaactgaccaccagtgccctggcatgccaaccccgttccgtccttgcctgaatgggtccgtcgttggctgctggctctggctctgactttatgtggcgtggaatgaggtcggcctgcacatgcgtccatcaggtgtggacatgggcataagggtcacctcaacttttggagcagctccgtcatacgaagatgaagacccaannnnnnnnnnagtggacttgggcgtaagggtcacctcgactattggaacagctccgtcatacgaagatgaagacccaagactctcaaggtgtgagaagagggtgctgctcgtcaagctcactgcccgcaagcagatggatgtcctcgggcaccggactcactcctatgggcaaaagcatgagacacggatcacatgtccagcggggcatggacggcgtgctcacctgatatcgcttgatgaagggctgcatctcctgcacatcggcctttctttccaagtacttggcctggctccagtgctcaatggccatcagggctggcagctcctctgctttgacgcccaccatgtccagcagttgctgtgggaatcgtgtgctgggcaggtcagacagccatgtgtggtgcctggcgaagcatcgcgctgtgcatccatgtcgcagaagtgagtgattggtccttcctcaagtggcggtcgaggggcagtgcagcaggtcagccccaagtccacccgagaacattgggcgacatactcgagcacgggtctgcagttcctgttctccaggatcgtacctctccatcgggacctggnnnnnnnnnntgcagccccaagtccacccgagaacatcggacgacatactcgtgcacgggtctgcagtccctgttccccaggatcgtacctctccatcgggacctggcagtcccatcacgaacttcagttttgggaaggcatgcgcagccgcaacagcagcttcccaccagttctcatcgtcctggattcagcatgcacagcatagtgattgaggtgttgcacgggatggcaagtgaccccaagcagtatccaagccccaggcaggaagaggttgtgggcagggctggtggaataagagaaatgcatccttggtgcagctgcacggccaccagccttgcactcacccccggcagcatgatgaggatcttgtcagcaatggtgttccaggccacctggaactccttcatgaactccctgcatccgcagtgggaaggtattcaccgcagtcagggctttggcgagcccctgtaacccgttcacatagcagtggatggctgcgagaacatgacttgtcttgacgtgcgggatgccgtgccgctggttcccctcctcccaacctggtgaacgggatgacaggtgggttcaacttctccatagcccaggctaccagctctttgggagaagaaggcatgcgctccagcgtgggctgtggagggagaaggtgctttggactctgcacaattgctgtaccaatcgacaccgtgtaagtgatgtctccagcaatttgtgcagccacagttcgcgcagtacggatctctcttttgacttgactcacagtgactggcatcccatgccgctgtaagatgacagtgcaaggtttcctcgctgctgtagccccaccagatgcgcagggaggtagcagggcttcctcgagcacatacccgactgacaccgctgtgcaggtaggaatggggaaagttgtcagggtacatccagacctcacaaaccattcacagagcatgtctgctattgggctctgggtatcccctacaggcggtgcacacatatccgttgcatgcaagcctcatcgcttctaggcaccttgtggcaggcacacggcctcaaatctccccctctcagtaacacgagaagcttacacttggagagcgtggtagccgcctcggcgtacactcgaaattctgcagtgtcgttggatgtaaggaaggccacaagggtgctcggatgggtcgccagccaagtttcaactgtaggctttgaaatgtacagcgtcggggtgccggagctctgctgagcatccggtgagcacgagacaaatcccagcatcatcagcatgattgccgaagacatcaaggtctgtgacatcttccatgccatcgtgcgatctagggcgccgttcatcatagcctcgagctatcgcacagccgagtctcggttacaaaggttggcctacccacgccatcatcgaagtttggattcgagtcctggaccttcgaatgattaaagtagctcactcacgatgtactttgcctttgcttnnnnnnnnnnaccatcatcgaagttttggattcgagtccttgaccttcgaatgattgaagtggctcactcacgatgtactttgcctttgcttgggtgccagcaacaagctagatgaattggtgtcggaaatgtctcctgcgcgccctggtgaaggtgcaccacactgcacacatgatcaagttcgaggagtcagcggtcagcttgtcgttgcttcacccatactttatgtcgtaaaggtgctaccattgtgtcgctggattggtcctcccctagatcgcgggcacaagcgtccgctcacccccaggcggacgagccggcagccctcgccgacagtcctgatcgttgctcaaggtctgctgcatctcagagacacatccgcctggcgccatggtgaagcagcggctcacgagtgcagatatcgctgcagaggtgtcctgtctgcgctcaagaatcattggcctcagggtggccaatgtgtatgacatcaatgccaaggcaggaagattgggagggcagggggaatcaggactgcctgacgcagttccacacgtcagcgtcgccacagcgcacccacccgtgtactcgctgcgcctgcaccacagacgtatgtgctgaagctggccaggagcggcgaggacggcaagaaggtgttcctgctgatcgagagcggggnnnnnnnnnnagcgctgcgcctgcaccacagacatatgtgctgaagctggccaggagtggagaggacggcgagaaggtgttcctgctgatcgagagcggggcacgcctgcacaccatcgaggtgcgggctggggcggatggtgcggcttg

SEQ ID NO: 24571 - DNA, 90 bp, Chlorella protothecoides
gacctggccctgcatgcgtccaccctgtccctgtctgcctggaccctggccttgccagcctttgccctctccgtgtcggcctccgcaaac

SEQ ID NO: 24572 - DNA, 62 bp, Chlorella protothecoides
ctctcgaaaatcttgtggctgtgggacagcttccagcgaggttccgcgatcttttctgggtg

SEQ ID NO: 24573 - DNA, 65 bp, Chlorella protothecoides
ccagcgaggttccgcgatcttttctgggtgggtgaagatgcacggatgcaagcctcgccttgtgc

SEQ ID NO: 24574 - DNA, 63 bp, Chlorella protothecoides
ctgcgccgttcgtgccctcccgcatgccgccccgctcagtcgctcagtcccagccctgccgcc

SEQ ID NO: 24575 - DNA, 64 bp, Chlorella protothecoides
taagaaacacaagaaggacaagcgatgacaaggagtgctgaaaggagagccacctacgctgctg

SEQ ID NO: 24576 - DNA, 61 bp, Chlorella protothecoides
cacattgcatgttatcggatacttcagagggcgttattcgccacattgctttcgcgtgcat

SEQ ID NO: 24577 - DNA, 110 bp, Chlorella protothecoides
tggagagcgccatccagaggtgagtgggagggggtgcctgtcgtgtgtgggggttttgaaatgaggtcatcacagacgcggacgaggtcagtgagctctgcaaggcctgg

SEQ ID NO: 24578 - DNA, 61 bp, Chlorella protothecoides
gtgagattgccccgtccaacacaccagggagggcctacttacagcaagttggaccctgcat

SEQ ID NO: 24579 - DNA, 7935 bp, Chlorella protothecoides
  modified_base (1422)..(1431): a, c, t, g, unknown or other
  modified_base (1778)..(1787): a, c, t, g, unknown or other
  modified_base (2309)..(2318): a, c, t, g, unknown or other
  modified_base (3152)..(3161): a, c, t, g, unknown or other
  modified_base (3368)..(3377): a, c, t, g, unknown or other
  modified_base (3452)..(3461): a, c, t, g, unknown or other
  modified_base (4189)..(4198): a, c, t, g, unknown or other
  modified_base (4741)..(4855): a, c, t, g, unknown or other
cagaggcatgaacagggcaggctgcagaggcgactactctcacagtcctcatcggaggaaggtcgaggtcacatcagcggagtgccttccaggcttggacttgcgagtctctcaggcgcagacgtcactcctcagcttgcagttgtcttgagctcatccctgagtggtcctgcgcagcaccagggcaccacaccagagagcttagaacatgccgaagtggtactaggggtttatcgactgcctcgtacaggggcaagctagctttcgttcactaagccccagggagactgcaacacacccctggcatctcggagagccccacacctgttgcaggggcggagtgggcttgctggcggcgtcatcgcgcaatcggtccctcagtgcgcacagcatgcgccagaccacctcctccagcgaggctcctgtgctggagccagggctgtcgaggggaatcacgatgtctgcctgctcatacagggcctgtcttgccttcatgaggccctccagcttggcaaccgcggcctgcagagcgtcaccctgctcatcagcaccctgtgttcgggaagccacgccagatggatcaggatgagggcactgagtgtggatgcggccgttggcaaagtattgcatcagacatcacaggggagatatgctgacatacaaatggctcccaatgtgcatgttcttagccacagaaatccctgcatagaaacacacggccagctctgctccactgcccccaaaactctcacatccctaccatgcccacctgttcccctgccagcagcggcctggactgagtcccgtctccaaccactcgctgtgcaagaagctctggtgtgcccctcagccacaccaccaccccggtctgcatgtcagcccagttctgggcccgcagaaccgccccaccgccagttgataccacacagtttcggtagggggccagttcctacaggaccaaagtgatgattgcgaggtgcccatgggacatggcaagggtgattgctctcagccgctcgaatcatctgtgcttgaattgcaccgacgcacatagggacgtgtgggcgggcgggagctcacctacgccccaaggcctatctccaccacctaagcacctccgcaacccctggcaatgctgcctcctcacctgtatcacggccgtttcggtggtgcgaaatgcctcctccccttcctccctgaagatgtcggcgatgctcttgccagacagggccacaatcatgtcatcggtgtcgaaaaagcagtagctcagggcagtgctcagtttctggcccgcagcagacttcccactgtcatgggcaagattcaggcagtgcttggcgatgctgggcgtttgatatggaggggccctgggcatgcgcagcagggcaaacccgggatagtctgacaccatggcgtcgtggnnnnnnnnnnccatgggcgagattcaggcagtgcttggcaatgctgggcgtttgttatggaggggtcctgggcatgcgcagcagggcaataccgggatagtctgacaccatggcgtcgtgggagatccagatgcaacaccaggcgcagcgcaccttcccatcatgccaacgaggtagacgctgctgcccttgaggagaccggcgacttgagcgccaagattcttccgggaaaatggtggggggagggagggagcaggggggcgtgtgtccatgggaggttctgtaagaagtgcaacaatcaattgacgacaaataacttcataaattcaggatcccactagtcctcacattcaagtnnnnnnnnnntgggggagggagggagcaggggtgtgtgtgtccatgggaggttccctaagaagtgcaacaatcaagtgacgacaaataacttcaaaaagtcaggatcccactagtcctcacattcaagtcttgatacgtcggactgtcggcgaaatcttgctgggcatggctttggacgatttgcaggccggtgctgcgaggatgcgagctccaactcctggtcctcatcgagagcatatcacgcgcaagcgcgtgatgcccatgcatgccatcggtatgcagtgcaaggcgagccgacctattcttgcgatagacgttgtcgcccttgaagcggtgctccaggcgtcttgaggtgggcccagtgcctgtaaacgccttcatgccctcaagcctgtttcgagtggacgcagatgagtccggtgctcggtaatcaaaaatgacacgcgtctcattggtgatactacgcacagtcacgggtatatcccaccagagttggtcggtgggcatgtcgcgccctgccaaacatgctgnnnnnnnnnnctcatgccctcaagcctgttttgagtggacgcagatgattccggtgctcggtaataaaagatgacacacgtctcattggtgatactacgcacagtcatgggtatatcccaccagagttggtcgatgggcatgtcgcgccctgccaaacatgctgacgttgccgacaccgacaccccgcgctccgcatcggtgcaagcctgatcatgttggcaacgtactggcatattcatctgacacccagtatatgtcagatttcgtgaatgatggattctcgccagctcgaccttctcctggcaggcctggccggggcgctggtcacctatggtgggacgcggcttttgcgcagggttgcaggcgagggagtcccaactcctccagcgagagacgccaaggacatgaatggaagcatcgctgcgctgcgctccaccactccacaccctcattggacacccccaaaccctttgcccgcccccttcagcgacaagtaccatgaggtggaccctgcaaccactccgtcagcagtgatctaccccctcgtcatctcggccattgtccccaggcccatcgccttcatctccacactgaatgcggcaggcagcgtgggtaatcttgcgccatactcttacttcaatgcggtggcacatgacccacctaccttggcgattggcttctgcgcgagttccattcgagaccaccgacgcaaagatagcttggtcaacattgtcgaaactgggtgagtaacttcgtcaagatcttgtacaatttggtcaggggtgttggagggaagggggcccgcatggtttacgagctaggccgtctggagggccaacttgnnnnnnnnnnctggtcaacattgtcgaaactgggtgagtaatttcgtcaagatcttgtacaatatggtcaggggtgttggagggaaggggacccgcatgggtcacgagctaggccgtctggagggccaacttggacagctgttcctttatgcaaacactcccatgcctgtgagtagcttgcagtggcagcgaggattgcaatccagctatgagacannnnnnnnnnccactgctgcggaaattttgactacgggcagaacgagttcgagctgtcaggcctcacacccatgccgtccgtcannnnnnnnnngaacactcccatggctgtgagttgcttgcagtgccagcgaggattgcaatccagctatgagacacagaccttcatgtcaaggctgacagcctcacaactcacatgcacagggagctggttgtgaacatcatcagcgaatggtttgtggaggctgccaatcactgctgcggaaactttgattacgggcagaatgagttcgagttgtcaggcctcacacccatgccgtccgtcaaggtaaggagggaagcatgtaatacattccaatggattcaggattgaccttggagcatctcctgtccctggtcaagatgctgtagcctgcatggttcggctcggtacctatatctatggatgtcagggagtgaatattgagatcgttcatgttcccagcctgggcgtgcgtgcattcctgcaatcacatggcttcttcactctcaactcaatctcggcccaggtcaaagcccctcgggtccgggagtcggcggtgcagatggagtgtaaggtggtgcacagctatgaagtgaggaatgcggctggcgctgtgtccaccaccgtcatactggcccaggtggtcttgatgcacgtggccgatggcgtcgcaggtaatttagggtctgccaggggtgggtgcattgtcgagtggagaggaaaacgggagacagctcctgcgtggtaaatgaaaggtgtcgtttgctacgcatgtgtatctgaccttcaagtgtggaagnnnnnnnnnnatggtaagtgaaaggtgtcctttgctatgcatgtgtatctgaccttcaagtgtggaaggggaccattcaaggcatgcagacgctctttcttcgtcgtgctagccaactcactaccctgcactcaggccacccttctcccaacccactctcacacatgtcctcaggtgcatcgccatcagggaagctggttgtggacctggcaaagtatgcacccatctctcgtctggggggcaacacgtatggcagggtgaaggagacgtttgatctgccccgcccagacaggacccccgcccagaaacacatccaatacaccagtcagccagagtgacgcggcgtggctcggcggacttgttggggagagagactcctcccctcctagctgccccctgatcggctcgactgatgtggattcccatcttctgctattgtactgagaactgaggagctgtgccaggcacccccacctgcctcttcaggtaccattctcgtgccaactcccttcctcatgcccttgtgttgtacattcaagtagcagagccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacatgacaaatgccggtgcatctgaaccaagcttggtcgtgcagggcgttcatccttgcgacccgagacaaccacaggccttgaacaccggcaaatcaccgcttgagcatcctgcgcccgcctgtgcgcctcaagctggccaggcacccgggtgcctgaactttgccgcaagcagcagcgtgtccagcgccggcggcggcggcgtggagtgggccgagcacaggcggtgcagggccgcaactagggcagggtttccctcctgcgccgccctttccagaaacgctgaggggcgcggcgtcgccacgcggtgcctgcgagccaggtgcagcgcggcctccacctccccgccgcgcaggagcagcgccaccgcagccgcgtggtccccgaccagcgagaagacgtgcagcggggggccgatgtcgctctgcggcccctgtgtcagcagcagcgtgtttgccagggcggagctggccaggggcgggtgtgcgtccagcagccgccgcagacggtgcacctccccctgggggaggacagaagcgtacgggagtgggtggcatggtattgagtgctaggtggttggagtttgtgcacctgctccttcaaaaggggagtctcgggcgggctgccaccagcgctgcctccagtagcgaggactgtcggcgtgcagccggcccgggcccgaagccacagcgtcagggagcaggtcccgagacacacacacacgcgccccgccttcggcgcaccgtgacagtgagcaggtcgaggaccagcaggcccaggccgaggtcgatctccgcccctgccgcctggcaggcagacacaaactccagggtgcaggcaaggaggcgctggggaggggcggtggcgagcaggggacgcagcacctcgctgcaaacatcctgcggcagaggcagtgggcaaagaggcagccattcagcggtttgatgtcaagtatcatcgctgggcgggacaggatccggagtggcaggtcgcggagagagggtcctgctacccacctctggcacctggcgcccatgcactcctgctggagcctcatcccgcccaccaccacgcgatgccactccaccctctcactactcgccctggaggagacgtgtggccccgggagcgtgggcccgaccaggcgcccccccgcgatcccggtgggcccggggacgtgccgccgcagcgccgcatcgaacccccggcgcacctggagcaggggctcgccgtccctcaccgcatcctgtgcaggggggggggagtgatggcgagggtcaaggggcggcccggctgcgccgcactgtcggggcgtcggcctgggcagtcacgcattcggacctcacggcggcaggaccctaggacgccgtcatccccgcgcgccccgtcccacccgcatgatggcgagcgtgatgcgccgcgcgtcgcgcgcgccggccccgccgctgtgcctgcgctggaggaaggcgaggagcgcgggcaggtcccaggccgagcccatggccgccatggccgccaggtccagcgtcaggcggtacactgccccacgctccacgtccagcgcccagtcggggaggtagagttgcagcgcgctcagcgcggggccgggcgcaccgccccgggggggtgattgccccggggtgcctggctccgacccgtcccaggaggcagcgggggagggggtgccatcgtgctcgtgcgggacggccaggccctcagcggagtccggcgcgtacccctcgccgcactcctgcgccgcatccgccagggccgtcccgccctgcacgccgccagagtgcgtgcccggcaccagcgccctcccgcccaggccacggtcggcggcttggggcccaacctcctggcgcggggcgccgccgtcgccgtcgtccacgccgccaccccctccggcgccgccatcaccacccgccaccccgccgccgggcgcgaggcgggccccgccgatgggcagcggcgcgcacagcggctccgcccccggtgccgccacgtcgtagagcagggtcacgtgggcggcgaggaggtggacagccagcaggttgtccaccacgctgagcgcgacgggcccccccccgcccggcaggcggtactcggccgccagggagctggcgtcgcggtacattcggaacaggcgcaggctgcgctgcggggggtcgtggtgcgcgcagtgcacctggccgtacagcgtgaccagccagacatgggcggcgcaggcgccggcgcgcggcatggggtcctcccccgacccgcgcacaggggaggagacccagggcgggcccaggtccagcatgggcaggcgggcggggccggcgggcaggaactggaggggctgcaggcgcgcgccgcccgggccgaagcccagcagcgcaatgcgtgactcggggtcgaagcggtaccagcgggtgtcgggggcggccaggtgggacagcaggcgcaggccctggcgtgcgggctgcaggaagagggaggggaaagaaaggcgatgggatagggaggggggcatggtggtcggatagcattccaaaggagggacgcagcacatgcaggcgtgaggcgccgcatcgcaggcagggtcccctcgcgccttatacgcggacactgcctgcgtgcggtagagtcgtggggcccggcggtgccttccgacacgccaatttcaagcgatccaggtcgcacaccctggcttgcaccgctctagcacaaccccttccctcgtgctggccccactcaaaagccagcccaagtccccaccactgcggtccatcccatgtgcttgcctggaggccgtagatctccagccccgggggggtgaccatcaccagctggggggagtggtccgtggtctccacccagaagaagcccagcaggtccacatcccgccgcctgcaagcaggaggggactggggtaaagaaggagttctggcgaccaaactcaaaccctttgaacgcggtttaggcccatgcgaagaataaggccccagcaaatcctcggccctcatttatgaccccagtccctgcagccagccagccacccaccctttcctccccccaccccccacccccca

SEQ ID NO: 24580 - DNA, 745 bp, Chlorella protothecoides
ccccccccccccccccccccccccttcccctcctttccatgctcaggcctggccgcctccgagctgtacgtggtctcggccggcgagttcgaggtgctgcagcgccggcgcggcgccaacctgcgcgtgaacatgaagcgccgcggcgacacctttggcgaggtgagcctgatgtacaactcgccgcgcggcgccacggtggcggccacccaggactcggtggtctgggtgctggagcgcgatgtgttccgcgcccacgcccgcgtgggccaggagacggccacgcagcaggtggagctcttcctcaactccgtgcccatcctatcggcgctgaccaaggaggagaagctggtgctggtggacgccgcggaggaggcggtgttccccccggggaccaccgtggtgcgccagggcgacgcgggcgacgcctttttcatcatcaaggacggcgaggcggtggtgtaccaggaggagcggggcgggggcggcgacggggcgggcggcgcggcctcgcgccgccgcgtcaaccagctcttccgctccgacttcttcggcgagcaggcgctgctgggcaacgtgccgcgcgccgccaccgtggagtcggtcacccgcctcgtctgcctggtgctgggcagggagaccttcaccgcggtgctggggccgctggaggcgctgctcaagcgcgagaagagcccgcaggtggtcaaccagcgcctgctcaagctgcaggtgcgtgtggagggtg

SEQ ID NO: 24581 - DNA, 74 bp, Chlorella protothecoides
gttcaatgcaggatgccaatggccagagtctacccctaaaaaaaggctaagaaccatacgaagacagcacccac

SEQ ID NO: 24582 - DNA, 71 bp, Chlorella protothecoides
tacaacgtggactgctgtatatgacctaagataggaatgtcacagacaagaccccgaatacggtgaggggc

SEQ ID NO: 24583 - DNA, 66 bp, Chlorella protothecoides
cccccccccccccccccaaaaaaaaaagtcaaaacatcaatcctacctgaggctggccaggctgtc

SEQ ID NO: 24584 - DNA, 68 bp, Chlorella protothecoides
cagactgatggtgccttgttaaaagcggggttactaactatttgccctggttcctgcaccaagcgtgt

SEQ ID NO: 24585 - DNA, 80 bp, Chlorella protothecoides
gttgctgtgatgtgcaagccctgcaggagcatttctatactacttctcacacaccccagcacacctggtgtctttcgaca

SEQ ID NO: 24586 - DNA, 70 bp, Chlorella protothecoides
aggaaaaggaaggtagaaggaacttggcaaggggagagagcagggaatctgagggtggaggcagatgaca

SEQ ID NO: 24587 - DNA, 207 bp, Chlorella protothecoides
ggttgaaaggaagggtgagcagacagcaagctagcctgactacttttagaggcaccagatccgggtgatcctgatctcctatttgctatgtgtaagcgggtcaagcacagagagggagaggaagggcctacaaaaaagttcagcagacatccctgagaaatggcagtatgtccaaggcactgcaggtgacaaagtctacagtggcca

SEQ ID NO: 24588 - DNA, 466 bp, Chlorella protothecoides
  modified_base (163)..(347): a, c, t, g, unknown or other
cccctttctagacgagcactacatacccaccctcctggctgtccatggactggacaatgagacggactgttcggggagtatcactggtgagaagctgttgggcagccattccccatgaagcctggccctgtaccatggacttctgtgcggggtgatacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagcgaatgtgtcattctgtgctgtgccgacggatcgaggctgggatatctgcctggtcgtcatcaccggatcttgcaattcttcccggtactcggcacctgttgctcttcccggtgc

SEQ ID NO: 24589 - DNA, 61 bp, Chlorella protothecoides
cagtgtgcccgcagcaggccggcagggcgctgcgtcagggagttcagctgaagatgcgcac

SEQ ID NO: 24590 - DNA, 77 bp, Chlorella protothecoides
gctacgtgagctcgcctgttgagtgatgagcttgtcgctggtgccttggataagctcctgaacaaacatgagcaagt

SEQ ID NO: 24591 - DNA, 69 bp, Chlorella protothecoides
ctcaaacgtacacgactgcagctcgtggttgtgcaagaagcgatttccgcgagagttgcctcacaatga

SEQ ID NO: 24592 - DNA, 61 bp, Chlorella protothecoides
ctggccgcggctgtgcctgcgccacctcctcttcatctgggagagccttggaggcagctgg

SEQ ID NO: 24593 - DNA, 61 bp, Chlorella protothecoides
aggcagagcccgtgagacatagtagacctgatgcagatggcaagcagctggacataccggt

SEQ ID NO: 24594 - DNA, 136 bp, Chlorella protothecoides
cctgccagtggtcccccaccatacacaccacacagcaccttaccccttcctctgcgctgcctctgcctttgttagcacctccatcacgcgccgcttgatcctggatgcctccatctccgccctgcacgccggggtc

SEQ ID NO: 24595 - DNA, 61 bp, Chlorella protothecoides
gcgcctagatcgggatggtaaattgcggggtgatcaccaggagcatgctccttgtggccgc

SEQ ID NO: 24596 - DNA, 138 bp, Chlorella protothecoides
gcattcagcacggcgatgtcgaggcccccgttgcgacggatgtggtcagagaatgcagcctcctgggacgccgacgaggccacatcgcagtacactggggttgcatttgggcctgccaggtcggcggtggcacgagcc

SEQ ID NO: 24597 - DNA, 69 bp, Chlorella protothecoides
ccttggctcgagaagctgacaccacagtgtgcaccaggccactggagctcctttgcggtgcatcatggg

SEQ ID NO: 24598 - DNA, 69 bp, Chlorella protothecoides
agcccctcccaggtgactgcaaaacttgatcttcattgacagcaatccatatggcacagccgggagtga

SEQ ID NO: 24599 - DNA, 61 bp, Chlorella protothecoides
cgccgccagcactacatggcataatatgggtggagggggggggcatgtacaaatgtcagca

SEQ ID NO: 24600 - DNA, 93 bp, Chlorella protothecoides
ctgtgtgaaggggggtcgaatgatgggttgagggggggattgcagctacgggcattgaggccaggggggattgcagctacgggcattgaggcc

SEQ ID NO: 24601 - DNA, 119 bp, Chlorella protothecoides
cagaccgtcacggcctttccctgggtattggcagacgatcagggtgggctcgtaatcattcgtattaagctgtacatggggcttccaggcagctccccttccggagaattctcacgcgg

SEQ ID NO: 24602 - DNA, 68 bp, Chlorella protothecoides
tgaccgcgacacggctcgctcaagctccggcggcggggaccccggtggccaccaggatctggtctgcc

SEQ ID NO: 24603 - DNA, 61 bp, Chlorella protothecoides
gcgctctcaagcgaccctgcatcctggcacggagtgaggcaggcgcactggaagggatgag

SEQ ID NO: 24604 - DNA, 61 bp, Chlorella protothecoides
agaacacgcccttcacgttgttgcacacgatgtttatgcactctggcaacggcatggccat

SEQ ID NO: 24605 - DNA, 61 bp, Chlorella protothecoides
cgtggaatgggtatgcggtgacggcggaggtggcgcaggtcttcagggagtctcccttggc

SEQ ID NO: 24606 - DNA, 110 bp, Chlorella protothecoides
tgttttcccagcgtgaatcaccctggcgttcggccccttggaccccagtgactccccgcagcgcattgtctcacgagtccctccgccccacaacagcaatcactgcgcat

SEQ ID NO: 24607 - DNA, 132 bp, Chlorella protothecoides
attagtactgaaaccaggagaatggctgccgggatgtagtggatcatgaaagggtggcacagaggggctacgccccgagccggacctacttgatggtgggcaaggcaaagaacttgtttcgagggtcacagt

SEQ ID NO: 24608 - DNA, 67 bp, Chlorella protothecoides
ggtgacagaagctgggcgcgaatgacgtttgcaaacacacccgctccccgccatttctcaatccatg

SEQ ID NO: 24609 - DNA, 79 bp, Chlorella protothecoides
gctgcgtgtcgtcatatcttggcgccatgcccgagttccgaattcactgctgacaggtgtcctgccatcccagaagggg

SEQ ID NO: 24610 - DNA, 89 bp, Chlorella protothecoides
ggaaaaatgatttcgcactcttttgcccctggatcagggttagggttagggtccgggtcaggtttaggtttaggtttaggtttagggtt

SEQ ID NO: 24611 - DNA, 172 bp, Chlorella protothecoides
cctaagagcggcagcatgttgaatggcaacacgggatctgcactgagggccaaacatagtgagctggattgtcttggtacgaggaccctcaggtgtccactgacacagagcctatcttggacccgacccttgcacccttccccccctcttttcccagtgcaagatgtgcagc

SEQ ID NO: 24612 - DNA, 62 bp, Chlorella protothecoides
gcaaagggtttgccggcgacgctgcaacacctgtcccctccgtctgcccgcttccgcacctg

SEQ ID NO: 24613 - DNA, 76 bp, Chlorella protothecoides
agggggagtccacggttgatggggagggggcgtccacgggggacggtgacggggatttcttcggcgaggaagaggg

SEQ ID NO: 24614 - DNA, 61 bp, Chlorella protothecoides
ggccagcagcgcgtggtgcgcttcgcgcgcgagctcagcgtcacgctgggcgcgctgcgcg

SEQ ID NO: 24615 - DNA, 63 bp, Chlorella protothecoides
ccccccccccccccccccccccctccccctccaattaggccgacgaggcggtggggtccctct

SEQ ID NO: 24616 - DNA, 147 bp, Chlorella protothecoides
gtggttggaccatggtagatgagcagctctgagtcaaaatcacctcgctcaccccggacacgcaacagatactggagcagggaatgtctgcagcctcaagaactggcgatgacgacggcatggtgggcaagggtgttgtcttgatgc

SEQ ID NO: 24617 - DNA, 123 bp, Chlorella protothecoides
ggtccaaagcgtccagcccggcgcccagcccggcgcccagcccccacgcctcacccagcaaggctggggggaagggggcgtgcaggctctgcaccggcgatgccagtcgcacctggtgggcgt

SEQ ID NO: 24618 - DNA, 101 bp, Chlorella protothecoides
atggggaatggtgggtgacggccctcgaggctggggatctggcgccgttcatgccccaggcagatgaaggtttgtgaaaagtcctgccgggccccgcaggc

SEQ ID NO: 24619 - DNA, 61 bp, Chlorella protothecoides
cagagaggggccggggctcaggctgtcccgcagctgctgaaagtaggcgcctcggtctctc

SEQ ID NO: 24620 - DNA, 158 bp, Chlorella protothecoides
ttctcggcactgggcgccaagcaatgggtggaacctgggtctaagcatcactatcgatattgcaggctgtcgccgggaatgcattctcatctccacacctcttcgctgggcagcccagtcgccctcaggagctccacatgtagcaggccatccatgca

SEQ ID NO: 24621 - DNA, 64 bp, Chlorella protothecoides
acatctgcctttgtttccatccacgcctggggtcccactgctctggagcatgggcgatggcgcg

SEQ ID NO: 24622 - DNA, 76 bp, Chlorella protothecoides
ccactgctctggagcatgggcgatggcgcggcgtaccgccctgctacctcccgacggagggcgagcccccctcttc

SEQ ID NO: 24623 - DNA, 61 bp, Chlorella protothecoides
cactcccacctgcgacgtcactacccctaatacacttcacatggcttctgtaccctgatgt

SEQ ID NO: 24624 - DNA, 77 bp, Chlorella protothecoides
tggggcgcgggaggggtcgagcacaaagatcaggattaggatgaggtgctgctcacaggcgccaggcatgcgtcgtc

SEQ ID NO: 24625 - DNA, 63 bp, Chlorella protothecoides
gtttgtgcccttgttgttgagaccccagttgaggtatcccgtgttagagttccctgcgcatca

SEQ ID NO: 24626 - DNA, 61 bp, Chlorella protothecoides
ctcccacccgctggggggaggtaaggagggtggctcggcctacatccaggcggtgtacgcg

SEQ ID NO: 24627 - DNA, 248 bp, Chlorella protothecoides
cgaagtgggtgccgagtatgtccaggtagggagggatggagagcagcatgtgcgtaagggagggatattgtggctggcgtcattgtatgggtcttcttgtggagatggtggatgctcagatcactcacaaggagacttgctccttgagttcagatttccgagaagcgatctgctcaggattgatactataccctgattctgaagcaacttatcaagataccctgcctttctgtacagcctcctggagg

SEQ ID NO: 24628 - DNA, 75 bp, Chlorella protothecoides
tgcctatcgaaccaccgccgtcctataaaacccatcccaagaatgtggactgtgcatgccgaggtgaggaatcct

SEQ ID NO: 24629 - DNA, 141 bp, Chlorella protothecoides
gatggcggaggacctgcaggccaggctgtctcgcatgcggagtggggagacatgagtcatacatgattaagaggacctcttctggacctgctggggccatgtgcaagtgataaagggcgccatgtctcacgctgccccccg

SEQ ID NO: 24630 - DNA, 79 bp, Chlorella protothecoides
caaggatgaatcaccatcagccaagcacggattctcatgagtacaggatcgtacctccctcactctatgcacgcccacc

SEQ ID NO: 24631 - DNA, 262 bp, Chlorella protothecoides
ggcaggacacctggcacggcagaggcggggtatggggggccatggctgatgtgactgaacgtggaggtgctgacagtcgcaaaatcaagggtaaactgcgctcaggagggcaaatgccagcgtgaacgggaaagaattcgcgaaggcagcgtggctgcgcggcaagtgcacccaacgaaacccccaacccctgaagggcaacgggcactatccgtcccagcagcagtgccaccacgcacccactccagggggtccccctgga

SEQ ID NO: 24632 - DNA, 76 bp, Chlorella protothecoides
ccagtcaacactggcgcacaaccaagatgaaggtgtcctccgatgctgacgatgtggaaagatccctcgacatcag

SEQ ID NO: 24633 - DNA, 1089 bp, Chlorella protothecoides
  modified_base (200)..(209): a, c, t, g, unknown or other
  modified_base (871)..(880): a, c, t, g, unknown or other
aggcggggccgcccctggccgcggcctggtggggggcgggcctcggggaggcggtcgcagcagcggccggccgcaaggccctggcgccagacctgcggcgccgcctccacgcctggctggagcgtgcggccccgtgcgccacgcaggtgggtgcgtcctgagacgtgcaggaggggaagccgtcctggctgctcgtcgcnnnnnnnnnngcgccggtgggtgcgtcctgagacgtacgggaggggaagccgtcctggctgctcgtcgccacaccgcactccctgtcggcgcccagccaccacccacctaccctggagtcagaccttggagccccggtgtccccaccttgcccctgtttcttggtgaaactactctgtgctacatggagttttacaccctgctcgtatggcatgcacacatgggagtttggcttgcgcatgcttgagatgttaaatcaagaatgaatcggaaatgggatcactgggggtacagtggaagctgcctagaactagggctgaccaaccccgtcaagctcaacgggtcaggcctgaaagtcaatgatacgctgcctacatcagtgatgagatcaagctcattgccttctaagagtgcggggcgtgtatggcgagggcgacaccccggtggggggaggaggggaagccctggtgggtgggataggggagctgggtgaaaaggccgggctgtagggggtgggcggtggggacaggttggttggggacaccctggggctaggcgatgggctgtaaggggtcggcgggggaggaagactagacggtggcgtcttgggcgacgggctggggctagccttgggagatgggaaaggagatgggccgtagggggtggggggagnnnnnnnnnncgtacggcgagggcgacaccctggtggggggaggagggggagctctggtgggtgggataggagagctgggtgaagaagccgggctgtagggggtgggcggtggggacaggttggatggggacaccctgggactaggcggtgggctgtagggggtcggcgggggaggaacactagacggtggcgtcttggggctggggctggggctggcc

SEQ ID NO: 24634 - DNA, 61 bp, Chlorella protothecoides
gagcaggaagtagaagaacttccaggccacggggtcgaagcccaccatccagtaggagatg

SEQ ID NO: 24635 - DNA, 61 bp, Chlorella protothecoides
tttctatccctgcagccaccggcatgacaatctcgtgctgcattgccttgtctgtgtactc

SEQ ID NO: 24636 - DNA, 62 bp, Chlorella protothecoides
ctcgtgctgcattgccttgtctgtgtactcgatcagctcaaatggagtgtagtctgcattga

SEQ ID NO: 24637 - DNA, 80 bp, Chlorella protothecoides
catcgaggaaagcggggtcacagcgacggctctgcgcgccgccgccgcctcagacctcgcggtggttgtgcaggagctct

SEQ ID NO: 24638 - DNA, 61 bp, Chlorella protothecoides
cagctttccctcccctctcaacaggcacaccccgccccgccacccattaaaccccccacgc

SEQ ID NO: 24639 - DNA, 2233 bp, Chlorella protothecoides
  modified_base (723)..(732): a, c, t, g, unknown or other
cttggcgcagtggccggagcgggtgcaacggcccaggcaggcgccggcgccgcgtgtcgcggagctgggcaggccggccaagcccagcgcgctacccaggcgtgcattggtacccgggccggcggtggcgccgccgccggcgacgcgagggtaggcggttgcggcgcgcagctcgggcgtgttggccgcgaccaccaggccgccgtcgggtgcggcgcagatgccgacggtgtcacccacgcccaggcccagggtgcgcaggtactcgcccgcggcctccagcacgaacacgcggcggtgctccgagccgttggcccaggacttgaccacaaaggcgtgctgcgcgccggtgcgcgcgcagcgcacgcgcagcgcgtagtggcggtgcggcgtgacgaaggccaggtgcgtctccaccgccacgcgcggcaggatgatgcgcccggatcccgcgtccgagttggtcagcgtcttggcgaccagcacgcgaagggcgggcggggcgggcgggtccgcgctggagcaggggctctggcccagctccgccccgtcctcgccctggatttgggcaatgggatgggagaaggaggggtggggggggctgggggaggggacggcggctggacacaccagggaggagctgatgtgagaggggagggctttaaaggcatgggtcaaggccctcctgcaatccccctccttccccctcagcgacgtcagggnnnnnnnnnncgggtccacgtcctcctgcaacccccctccttccccctcagcgacgtcagggaggcatgcaaggcgtccatggtgctggtatgggcacatgcaagccacactgcagctccctgctcacgcatgcatgtgcgagcttgcaccgcgagggtttgcatgcgccgaggcccatccgcggagccaccccaccttgggcgtggcgtagctgatgacgtccgtgccctccggaacgcccggcgccaggaccacggagtcatgactggcgcgaatgggggccaggcccgctcccggggagaggcgggacccaccctggaatttgagttgagcgggatccgcgtagctggcgagcccggccagcaccccgcacgccagctcctcgcccatgtgatcctcttctactcgcactgtagacctgtcgctggcagtcttggcgcccgccatgctgccggggccaggggcggggtccgcgaggttgagatcaacagctggagggttacggacttcgccaggctccccggcgagatcaatgtgtgtcatgattctttatcaacaatatgaaatgttctgcgcggggcgagaggggtgttccggctctgcacacaatgctggcaaagtcaaattatatgcgtaatgcttcatgcccatgctccaatgcggaatgtgctatcaaagcaacagtcagaccggggccaaggccctccatcgggtgcccgggatgccgcatatgcattcaccatcaactcacactctggtgccttgaaatgggccggggaggggctggaacgagggggctcgcagtgggtactgtacgggaccggtagggccaggactcgcgagcaggtcggtgtcgtgcgccccgatctcgaggtgctgaaatcgctggatcactcgtggcaatgtgtggggaatgtgggggagggcatgcgttatctcccctcccatccccctttaccctggggcgctgtggcgaaactgctgggtctcggattccgcccatgccgtggatcagcccgggatggatggatgcggcacgcacaccgttcacaggatgaatgaaacagcaagctcggtgggcatctacagggcgcacgcactcagggcaactcatcgcatatcttctccccctcgtcgttcagtcactctgccactcccgccgggtcaggcggaggcggccgcggcgggctcacgctccgcgcccgcgccgtcccccgcctcgccctcggccccctccgaggcctcgggcgtgttggcctccgagggcggcaccagctgccagaagcggggcagggccgcctcccagtcgcccagcagctcctgcccggcggccgacccggtcagctccacgtgccgctccagcagccccttcagctgcgcagcccccgtccccgtcagcacccgctgcaccgtcacgatctccgcgttcacgcggtccgggaacgtgcctgtggggatgggcggggaggttcggtgggcgtccggggaggggtgcgagctcgcggggggg

SEQ ID NO: 24640 - DNA, 153 bp, Chlorella protothecoides
aacctggcatgcagtgctgggtctcgagcagttccaggcgaccgaaagcacggacacgtgtccccaatcgcactatgatctgagcctcacttctctcactcacttactgacatgcccccgggcaaaccaggacagctcctcaatgccccttat

SEQ ID NO: 24641 - DNA, 73 bp, Chlorella protothecoides
cggcccgcagtgcactgcagggacccttgtcaagcccaccaaacctcccgtactgcgccggccatggaggtca

SEQ ID NO: 24642 - DNA, 61 bp, Chlorella protothecoides
atacgatggtggcctgtggtggcgcaagggtgggcacggtgatgatgtgtggtggggatca

SEQ ID NO: 24643 - DNA, 5392 bp, Chlorella protothecoides
  modified_base (95)..(141): a, c, t, g, unknown or other
gggtcccgcccggcagccgctcgcggcggcgcactcgccggcccccgcgcagcactctctgcacccggcggcggcggcggcgcggccggcgggcnnnnnnnnnnnnnnnnnnnnnnnnnnnnnnnnnnnnnnnnnnnnnnntgcgatccgcgaccaagcccgcgccgcgccagtcccagcacgagagcgtggtgcagcatgtgtcgcacttctggagggacgcgctggccgtgccaacggggaagcgggcgaggcatgccgcgctggaaagggtggcgtcggcgcgcgcccaggtgggcttttttgggggggggggggtcgtgtgtgttgcgggtggagtgggtggtggtggtgggctgcttcggaagccgtgtgctcgatatgcccagggaaagaacgggcacctgcttgcaccgcgatgaatccccagccagacagccgtgtgcggcgcatccttggacctccctctccatccaccagcacatgcgcacacatgcatgcagaggcaggaggctctggagcggtacgccgagagggctggcctcctggcccagctcttcgacggcaggcccgccacggcccagcccctcctcgccagggaggccgagggcctggcgcaactggcggccggccggcctgtgaaagcgagccctgatttgggagccgtcgcgggtgatgcagccgaagtggaggcgacggctgcggcctggggtgaagcacgagaggcggcgggcgactcgcggggggatggcacggcccctgtgtcggccacggtcgcgccctccgcgtccactgggcacgcgccagcagcgcagacccccggccagttctggttggggggggcggtggagggcctcgggggcgtggaggccctgcgctcgctcgccgccgccgccggcggcgacgaaaaggccgagtcctcgtctgtgggagactggcccccggccgtggtccactgggacgcgtcgcgagggtcgcctcgcctctcgggcctctcggccgacctgagcctgacggccgagcccctgccggtgagcctggaggcctctggctggggcgggccggaggatgttgtgccggacaggcaggctgtcctgctctgagcgccttgggccgtcaagtcgggagcatgccccggggtctgactgccgggagcatgccccctcgggggcctgtctacaggttccacaacgtgtcgctgcgaatgcgctggccgacgccgtcgcgacctcaagaattggcgctccgcatccctcactgggaggctcacaccccccacacgttttcaagcacgctcttccctcttgcacacctctcatggcctagcaacccctgcccgcaccgaagagcggcgtcgaggggtgcagacatgcccctggactggagttggtgccttcccccctttcacgacttggtcatttatgcactacatccctcgcactgtgaaagtctgtaccggttcaagcacacgcttttgaagactcgggcctgatatgacggacaccatggggccactcggggggccctggacatgctgccactcggcatctagaaggacgcgagcgcagtgaactcgtcgtcctccatcacgcgaatgtcctgcgttgggaaggggggggaaggcacatcagaggggtggtaggaggagagtttactctgctgctggccgcaaccaggccccacatgttctacggtatcagggaccgggcgattgtcaagaatgaccgtcccctctccgtccagtccacagctggaggattgggattgtctgggacccatcgacgcctccaccctagggtctcgagccacagtgcgacccctcggtaccttgacgcctgggatgaattcccgcaccgcctccagaatcttcacccccgcttcccgctgttccctctgcagcggcacgtagggcagccggaacaccggcttcaccaggccgcacattgccagcgccgtgtttctgttttcaaggggacagggcgggtggaggggtgtgtggactgttagagtggagccgaggcgggtggtccaccacagacgcgatccagcagccccctgcaacacgcagtgttacccctcgtgaaccccctcaacatcccaaaggaacaacagccacctctccctttccaagcacactcacaggccaatggggttgggctccgcgaagagccaggcgatgagatccgccagcttggccgccagctcatcgtcgcggcgcgccatcagcgcggcaaacgcccccggcaccaggttgctggtgacggagaccacgccctgcgctccgtgctcgtgccgtgcggcgtgcgcctcgtcgtcgttcccgctccagcaggtcacgccgcggccgacgtagcccgcgatgcgcgcgttccccgtgcactccttgacccccagcaggttggggtgggagcgcagggccaggatgacgtcgtcggggatgtcctggcctgggggagggaggaaagggaggtgcagaggggagtgacaagggaggaggagggtctacgacgcgtggacacgcggtgtgcttggtgtgcatctgcagggtctccagcgcccgcaggatgcgacggcggctggcagtgcaccgcagcctgtgacgcccaggggactgcatggtccactgtgacagcggctcccgtcccacacgccatccctcatccaatccgggcatgcgatttctacgcaccccaaagacaccgccagggcgacgccctgccggtcctaggggaagctcgcatcattccgcaccagcacattccaattcccaacacggtgcaaccccctccaccacccccaacccaaccccccagccaagtggtaatcaacccatcctcgcacctgttcggcccgggacattgtagagcatggcgggcccctcggccaggaccgcctggaagtgggtggccagtcccacggccgaggtcttgccgtagtaggggttgatgtgcagcgcagcatccatgcccactgcaaacccctgctcgctggcgtgcaccgcctcgcgcgtggagttggaccccgtgttcccgatcacgcgcacgcggtcgccaaaggagttgacggtgtgcgcaatgagcatgatgtgctcgtcccaggacatgagctggccctcccccgtggtgccgccgatgatgaggccatccacgccggcctcgatctgggcgtccaccaggcggtcgtaggtgaccaggtcaaacttgccggaggccaggtagggggtcttgatggctgggatggggttgaaggcgtgcagagggggaggtctataagtcgccccggagaattgaaggaggcgtgctgggccgccccctccctcataatgcccggcccggggtcccatgacaggggcgcatgaagcattaccatccgatcaatatcctcaaatgctcatctggggcgccggtaatgcggcccaaaccctcgttccccatcctgcgtgacccacccgtgacgaggcgcatctgctgcagggactcggtgtgagacttggcggccttgacgctgcgggacggcgccagaaccgcactcgttgagcatgctgatcgccttgcggatgtcctggtaggctgtgcctggaatgcgggggatcggcacaggctggcgccctgcatagctggtgctgtcggtactggtcccggcgaggatgagaagaaggcggtggtcaatccgtccaagctcactttggataaagaaatatacttgtatgtctttagcgggtacgggagtgcccagccatgcatgagacacacgtcgtgacatttgcgcgcgcggtgccaaatgttggattttagtatgacaaccggcctccctccggtgtgcagagggaaggtggcatgcgtatgcaccagccgagcagccttcctttgcatcacatcccttcactccacattattccatgagaggctgtgagaggattctgaagccgccacctggtgtttgacaaggctaaattggataattttgtcatgaaaatggcaactgcaacggcccccccctggtagtcatccagagagcttccaagtacatatgacactgatccaaaataatggaaatactaggctaggctagtctcaggtacggggtgtttgcaaaggggagtgcatctatgactagtcccggtgcaaagaaggcggtttactggagtgtcactggggtcacaatgttcaaatcacccgacccgtgctcttctacagtggaatgtgagcgttgcacccttcctacacaactcctgtccatcccctagtgagcgaaactccatagcaatgtggacttatcagatgccgtgaaggaaggcccagccacaaagttgtgggacaaagtcggacgagttcctagcatgatgttcatggagcgctgccgtgagcagagctgtcaggcaacaatgatgcatggggtacccttgaatcctcaagtatacccagcagggttctgagatgcatcgacaaggttgaatcctatgcgttccaagcggcagccgatcaaggtgcgtcacatacgtatacattcatcgctggctatcgtcggcgtgttccatgtggcttccagccgtggctcacaggcgtccttgggtggcaggacctcatagtgcaggcgcaggcagcaggtgggatcctcgctctccagcaggaggtccctggatgaggggacgggtggcggagggatggcgcgtgggggctggcaagcgcgtacggcccactgcacatggtcgcgcaggggtctgcaagccccgagcccagccaggaagcgggcgtgactggtcccagtgtgtccttgtgcatcgagtgccgcatgtcatgcggcaatgctacggatcctgccactccctggggagcggggggggtccggaggaagccccccccctggagcaaccacccatcccctgcccaggcacctcaccgtatcgtcacagcgccgggatcggcggccgcgtctcgcgccccgcgcttgccggcgaccgtgaccctcgcctgcccggggcgagcccccggccgggccgccagggcctgggccacgacctgggaggccagggtgagcgagacgggaggcatggcgagcgggggcctgcccagcgcacgagtgtgtcgtgccgcacggcacccggtcgaactgccagggccagccgccgagccatgctcgccacgccgggcacatgctgggcaggacagatcgcacccccacagaaagtaaaaagcccagccccctcctgctggcccacctcctgcacatctgccagggtcgcggtgggggggcaggtcagggcctgctggggcagcgcctgccccccgccgccgcccgggtccgcctggccccaggggcccacggcacggcagcgctcgggggggcgcggcgccaccagcaccgtcgcgcgccgggcctcgccgcgcagcgc

SEQ ID NO: 24644 - DNA, 110 bp, Chlorella protothecoides
gttgatcggccagtctgtacgatgtgcatgacgcccgattgtctctgcagtttgagactacgccacctcccgaacacccaatacctccagtcggccgcctgcgcaccttg

SEQ ID NO: 24645 - DNA, 113 bp, Chlorella protothecoides
tgacagagtgtgttgagggctcggccatgggaacgagtggagatatcgtgcacccccaagctgacaagggttccgtatgggaaggcatgggaaccaaagcaggcaacagagat

SEQ ID NO: 24646 - DNA, 65 bp, Chlorella protothecoides
aggggcacggctggcgtgccgtgtggcctccggccggtccagtctcatgctggcgtggagggcaa

SEQ ID NO: 24647 - DNA, 93 bp, Chlorella protothecoides
tggggagaaggtccaggggattgtgggtggaggagcgtcgctgccatccaggcagcgtgtcatcggatggcgttcactcagtcagtcagggac

SEQ ID NO: 24648 - DNA, 61 bp, Chlorella protothecoides
gtgcatggcttgcacagacgagcgtcaaggaggtggggctgccgatgattatgtgaagagg

SEQ ID NO: 24649 - DNA, 67 bp, Chlorella protothecoides
gggggggggtctgcagagtgtgacatatgcctgttcctgaaccctggacagcgctgcattgcatgat

SEQ ID NO: 24650 - DNA, 113 bp, Chlorella protothecoides
atgcggaggagagggcctgggacgatgacagggccgtcttgtgctccattcatcctctcagaagaaccatctcgatatgctcagcatcctggacaggacctgcgccgtcttcc

SEQ ID NO: 24651 - DNA, 61 bp, Chlorella protothecoides
agctatcgacgttctgtcccccggacggcgacctgccggctacgcacaccgtgttgaagcg

SEQ ID NO: 24652 - DNA, 71 bp, Chlorella protothecoides
accacgtgtcgaccttgagcatttctcacagacccctcagtgtaggtagggcatcagaaaatgtctagcgc

SEQ ID NO: 24653 - DNA, 61 bp, Chlorella protothecoides
gtaggtagggcatcagaaaatgtctagcgcacctgccagcagctggcgcccgggaatggag

SEQ ID NO: 24654 - DNA, 78 bp, Chlorella protothecoides
aagcatacggtttcctggggttggaggggggtcaagagggacatgagattgggaatgggagctcagcatggcaccact

SEQ ID NO: 24655 - DNA, 76 bp, Chlorella protothecoides
ccagccgccagtggggcagactcctgctcacaggctcgcttcaaaacccaacaccacaactccatgggtggccccc

SEQ ID NO: 24656 - DNA, 79 bp, Chlorella protothecoides
acttcccacctcggcctggtgccctggcacggtgtgacgcaacaaaaccctggcacaggacagcctctgctgtgtggac

SEQ ID NO: 24657 - DNA, 69 bp, Chlorella protothecoides
ggctcacaaccagtcatccgcgtgctgtgctgcccaccactccccttttgcaacgccagggggcgccac

SEQ ID NO: 24658 - DNA, 78 bp, Chlorella protothecoides
ggcgtcttgaaagtgcaaagtagcacttgcagtgagaccttccgtcatgctgccggtgaccacgcatggcgagacatc

SEQ ID NO: 24659 - DNA, 120 bp, Chlorella protothecoides
gcaagcgtgcttgctgcatacatggtgctcgtggtattacagcaacgcgtcccaggtgtgctcagagactgcagcaaggagcagaagcaggcgagcaggttgttgggctcaggtcagggt

SEQ ID NO: 24660 - DNA, 129 bp, Chlorella protothecoides
cgagccgggcttcctgcagggagagaacgccgaggatgtgggtggacgcggaggatatagggggttggggggaagggatggtgtgatgggacgtagcggaggttggagtggagatgatgaggggggggg

SEQ ID NO: 24661 - DNA, 77 bp, Chlorella protothecoides
gggctggaggtggggagcaaggaacaggggcgatcctcgatcacggggccaggcgccttcgtcgctttgtctcccgc

SEQ ID NO: 24662 - DNA, 62 bp, Chlorella protothecoides
atctcagggggcaatgtcacaggaaccgcagggagatgagcagggcacctttgaaagtgccc

SEQ ID NO: 24663 - DNA, 124 bp, Chlorella protothecoides
agcagtggcgcgagctccagaacaaggtagagggctgtgtggtctcgacagcgcagcgggattgggaccttccttgggagagttgggggggggaagggctggggagcgtgccatgtactttgca

SEQ ID NO: 24664 - DNA, 74 bp, Chlorella protothecoides
tggctggtgcatgaatgttgaggagatgattgcacacctcttgatgcgatgcctctgaatcgcccactcttctg

SEQ ID NO: 24665 - DNA, 79 bp, Chlorella protothecoides
ctcacacaccacaccgcaggtgaggttattttttggggggggggggtgcttgggtgcctgcagatgccagagcggcagg

SEQ ID NO: 24666 - DNA, 61 bp, Chlorella protothecoides
gagttgtgcctcccatgcacagctgcagtgcacacctaagctagccatgtgacctttatat

SEQ ID NO: 24667 - DNA, 61 bp, Chlorella protothecoides
cgttgccgatgggaggacatggtacggaggacatgggtgacactccatgtttgaaaaatac

SEQ ID NO: 24668 - DNA, 80 bp, Chlorella protothecoides
tgtcgaaagacaccaggtgtgctggggtgtttgagaagtagtatagaaacgctcctgcagggcttgcacatcacagcaac

SEQ ID NO: 24669 - DNA, 61 bp, Chlorella protothecoides
acagccatctgagtcgcgaagatttctacgcagcggagatgggtgggccatacgccaggat

SEQ ID NO: 24670 - DNA, 80 bp, Chlorella protothecoides
aggcgggggagggggggatgatgaagggcgtggaagtgtgtgtgtgtgtggggggggtgatgctatgtagagaggttgga

SEQ ID NO: 24671 - DNA, 61 bp, Chlorella protothecoides
tattgcaagcttaccaggctcatcggatagtgctatcccctagaatccttgtcgacacagc

SEQ ID NO: 24672 - DNA, 183 bp, Chlorella protothecoides
tttgaagttgtcgtggcatcgttcgaggggatggcctcgagcatgttgtggccacgcctggacggctgtacgagggttcacatgccggcatcgctgctggagcaataaggaggttgtcctcagcaccatgcgcatacccttttcactggaatttaccaagtgagtgcactgtatgccgatgtc

SEQ ID NO: 24673 - DNA, 64 bp, Chlorella protothecoides
ccaggattcacacccctccctcgggctggcaaacagccttccctgctttgtttggcgtctgtat

SEQ ID NO: 24674 - DNA, 103 bp, Chlorella protothecoides
gccattacgacacgaatcctcagtttgcctgaccgtccaagtagacaatcgccaagtgctcactgcgatcacagtcctcggtgaaaacgtgcataccgagtgg

SEQ ID NO: 24675 - DNA, 72 bp, Chlorella protothecoides
agaggtgggttgactcaatggaccatgcagtgccactaccagacatctggtggtgtgatgccaggttgggaa

SEQ ID NO: 24676 - DNA, 79 bp, Chlorella protothecoides
cattccgtgactgcaatcgctgaacctcttcatccccaacacccttgacattaggcgctgtggatctggaggccatgga

SEQ ID NO: 24677 - DNA, 61 bp, Chlorella protothecoides
gaagtctggggcagagaagtatggctgcagggattggagtgccgggaggagggggatggag

SEQ ID NO: 24678 - DNA, 72 bp, Chlorella protothecoides
tctccaccgccaatcaaccctccccgcacttaaccccctcaatctctgctcaagcacgccggcctccgacgt

SEQ ID NO: 24679 - DNA, 61 bp, Chlorella protothecoides
aaggtggatacaagcagaggggcgtgtccgacaaggtacatgccttcatctctcaaagtga

SEQ ID NO: 24680 - DNA, 79 bp, Chlorella protothecoides
cggatcgcaggtcctgcaggacgaggagagtgaagtgtacgacttggaacgtcccatggaggatgcagggaagttcatc

SEQ ID NO: 24681 - DNA, 3606 bp, Chlorella protothecoides
  modified_base (792)..(801): a, c, t, g, unknown or other
  modified_base (1572)..(1581): a, c, t, g, unknown or other
  modified_base (1730)..(1739): a, c, t, g, unknown or other
  modified_base (1898)..(1933): a, c, t, g, unknown or other
  modified_base (2110)..(2119): a, c, t, g, unknown or other
  modified_base (2734)..(2743): a, c, t, g, unknown or other
  modified_base (3139)..(3148): a, c, t, g, unknown or other
cacccccctaaacacccccacccggttcccccaccgatgacgtagaggtagatgctgggcaacaggacgccaaaggacaggaagacccagttgatgaccacggagcaggcgtagacggcgtcggcctggccctccgccggccagcgccccaagcccaggcccgccacgcgcgcccccaccgcgtacacgtccagcagcgcccggcggctcgccggggtcaagtcccccgcgcggcagtagtcggcgttgctggacagcgcggatgcgagccagaacgggagcaggggcaggcggtgacgcagcagcatgggccggcccagcagctggaagcaggcgacgcaggcgcgcgacatgatgaagaggcgggagaggaccaccaccgcgcgcacgccacggcgcgtgtggtcgcccgcgatgttctgggcgcggtggtagccaaaggcggggtacagcgcggcggtgaccagctgcatggcctggtgcaggcgcttgcggtgggcggtgtagacgtgggcgggcagcgtggccacgaggacgccggggatggcctgaacaggggatggggagggagtgggggcccgtcgtgatctggccatgcaaggagggggaggcgcagagctggcgggtgtcgccacagagcgtgggcatgcatgcactctggctgtacgccgaggacccacagagccaggatcccggtgtgggggcacagaccagcatttcaggagctgcccatgcaggtgcccacctcggcaaaggcatatgccaagagcagcttgtgctcctcggccgatnnnnnnnnnnctacgccgaggacccacggagccaggatcccggtgttggggcacagaccagcatttcaggagctggccaggcaggtgcccacctcggcaaaggcatacgccaagagcagcttgtgctcctcggccgatgcaaaccactccagattcgtcttccaggagggagggggaggatgtggtggtgtgggcgacgtggtgacaggttctctccggagaatggattgttgaaaggagctcatgcatcattctcccagctcattgtgtcccacggctgacgacccctccctcccttctccctgagagctcctatcctcgtaccagatttaatgtcgccaccaggtagatggctaaaacgaggattgcaaccgcaagagcgccagtggcgtccagggagcggtgtctggaggcatgctgcccttcaaaggccctctccagctcagggtcgtcgaacaccagggtagcggaccagggcttgcgggccatggcatctgggaagtaagattatggcccgtgcgagaaccctataaatacaatgggcaatgcttcgtacccagggttgggggagctgaatgccattccgaaccccgccaaccggaaactcccgacgcgcgtgtatgacagcaggtcggtcctagggtagagtttgggaggcattgcagctggatacaccttcatagcttgacaaatcaagcatttgaagaccccgcattgcgaattctgccgtagagagccacagctagcgcattacacctccagatactgggcccatgcatannnnnnnnnnctgagatatctgccgtagagagccacaggtagcgccttacacctccagatactgggcccatgcataactctctgtaagcactaccccgagatcatgcggagactccgccgatactgagagcattccggtcacaatttacctcacaaatnnnnnnnnnngcaccccaagatcatgcggagacaccgccgatactgacagcattccggtcacaatttacctcacaaatacatttcccaggtcgaaccagcccacgtactccggtcagcgggacggcctctcacagggaccgcaccacctcgctgctaacaccctgggannnnnnnnnnnnnnnnnnnnnnnnnnnnnnnnnnnncaaacctcagtgcagctgtagcactctcggagaggtcactggggggatatgggggttgcagctcaggagcagggtaggtccagggtcccgcactcagcgccgatccaccggggaagtcacagggggctgtgggtcccctccgtcctgctccatcctcgtgccacccagcccccttgnnnnnnnnnnggcgccgatccaccggggaagccacagggggctgtggatcccctccgtcccgctccatcctcgtgccacccagcccccttggtcatccctgggtgagtgcgtcggagtcgcccgatccccagccgggccgcagcgggcgcctgcgtctcacggcccgccgccctcgaaggccgcttgtatctgctccaggctcctgcccttggtctcggggacgaaggcgtgcgcccaggcccagcccagcgccgccaccccggcgtacgcggcccaggtccccgccggccccagcgcgtgcagcagggagaggaaggtctgcgccaccgccgcattggccagccagttggtgagccccgccaggcccaccgccgtgccgcgcacgtcggccgggtacagctcggcgttcaccgcccagggtacgggccccagccccggggagaaggccgccaggtacagcatcaggcctgggcaggccaagggggtgggagagatgggtcacaacgatggcgatgacgacagggtgcggggcgtcgtgggaaagggtgagcccacccctccacaccgacacaagatcacacctacccatgagaacgaggggggccctggagctggggcagcccnnnnnnnnnnctgggtcacaacgatggcgatgacgacaggatgcggggcgtcgtgggaaggggtgagcccacccctccactccgacacaagatcacacctacccatgagcacgaggggggccctggagctggggcagccctgggagaagggcacgcccgcgcccgggcaggcctgggccggcagcgccgccccgccgggcacgccgacctggcactggccgggcgcggtgaggtcatcgaccgagccgcagaacgtgcacctggcggggttttgggtagagcattggcgtgtggtctgctgaggcatcgcggcgcgtgaggggagcagcgcacagaagtcaggggaccgacatggcatgtgggcgcatgccctggcccatgccccatcagaagcatggggcagccnnnnnnnnnnggggaccgacgtggcatgtgagcgcatgccctgccccatgccccatcagaagcatggggcagccatctgcaatcccagtacacaacatccgcaagattgcctcaccctcggcggaggcaggcagtgcaggaaggtgcggggcaggtgctggtcgccaggtcgacggcgggcgaatggctagcggccgaggcaaaggctgcagccagcagcagcagggcacccgccacacatgccgtgctggtcagcagcagccgccgcctgccatacctggcgtggcgaattggttgtgtgtcggtggatgggtcgcaacatgtgcaggcaggccggttcaggccgtgctggcgcacaatgcgcgcaggatgcacgccacatcgtgggcatggcccggcctagaggcggccacttttcgcccgtgcactccctacgccccccccacccccaacccaccccccaaccct

SEQ ID NO: 24682 - DNA, 71 bp, Chlorella protothecoides
caggcgcccttggacgccaatgtgcccgccacctggaacaccatctccctcgcgaacaacaagctgacggg

SEQ ID NO: 24683 - DNA, 79 bp, Chlorella protothecoides
tgtggcagagatcagtgcagcgaacataagaaaagcgctagatgatgccctattgagcgttgataatatcgtcttattc

SEQ ID NO: 24684 - DNA, 61 bp, Chlorella protothecoides
gaccagcaaagtcttcctgcgccctgcctacccgggcccgcaccggcgttgggcttccgtg

SEQ ID NO: 24685 - DNA, 61 bp, Chlorella protothecoides
catcgatgtatgcacgtgtttgccacaggcgcgtggcaagaaagaaacaaatgctcgaggg

SEQ ID NO: 24686 - DNA, 79 bp, Chlorella protothecoides
gcagagtctgtggatgggcaccctgtgtgagctgtgtcatgtcgagctgcccgactggcgatgggggctcaccattgac

SEQ ID NO: 24687 - DNA, 61 bp, Chlorella protothecoides
gcggcggcacaggctgggcgtgaataagcttggatacaagtttgcacctcaagaccatccc

SEQ ID NO: 24688 - DNA, 78 bp, Chlorella protothecoides
ggatacaagtttgcacctcaagaccatccctctcccccccctccaccgcaccttcacaaagggctccgggctgccgtc

SEQ ID NO: 24689 - DNA, 155 bp, Chlorella protothecoides
gcattaggctcctggatcctcaaaaccaaatcaagaccaaaagcacagcaggccccctggccaccgcctctgttcccagaactcctctctcggctaccctcctctcaaaatctcaacccccaaaattcaccagcgcctcaccgcgcggtgcgccc

SEQ ID NO: 24690 - DNA, 65 bp, Chlorella protothecoides
acaatgccagaagcttctgggcaagcaggggcgcgaagactcttcccaggctgttcaccggtctc

SEQ ID NO: 24691 - DNA, 89 bp, Chlorella protothecoides
agtggatgaatggactgagggggtatcatgctgctggtgtcgtaaagcgctggccgcaggcctgtgcgcctctgcgaaggtatgcgccg

SEQ ID NO: 24692 - DNA, 62 bp, Chlorella protothecoides
tgtttaccagcagcgaagtgcgttaccgtacacaactacccactcacccgccaaccacccac

SEQ ID NO: 24693 - DNA, 61 bp, Chlorella protothecoides
actcaggcaggccccaccccacccgctcactccccggacctctgccggagctgccaggggt

SEQ ID NO: 24694 - DNA, 61 bp, Chlorella protothecoides
ttctctcgccttgtcagcgctctgctgactccctggctccctcacaatctttcggattgtt

SEQ ID NO: 24695 - DNA, 61 bp, Chlorella protothecoides
gttgttgatgacatacacggccccgactgtaaatgaaggtcggatgaccatgccgccggag

SEQ ID NO: 24696 - DNA, 119 bp, Chlorella protothecoides
acgggtggcgcacacagcctgcacatgagaggggcaataactgggtttgcacttggccgcccctagagacccgggccaaaagcttgctttccggcttcagctctgtttcttggcgccct

SEQ ID NO: 24697 - DNA, 755 bp, Chlorella protothecoides
  modified_base (504)..(513): a, c, t, g, unknown or other
cgcctccggcgccgcggcggccgcggcggccagcgcggcggcgcccgcacgcttggcgccccagctcgcgcccgccagcgcggcaccggcctcccggcagatctccgcggccagcaggcgcacgccgctacccaccgaggcggtgctctcctcccacacccgctcccagactgccgccgcctcggcttcgccggagaactgcgcgcaggagttatgttttgatgtggtgggaggggtcttggcgcgacagctacccgcccacggtgcggctcaggaggggccagatcctgccagacctcagcgcgccctactcgtggctccagagacacaggagcggtggccgcggcatgccagcggccctagcccgggcagaattcccccctttccacccctccagtacagaccacccatcccaaatcccgaccttgagcaggtaggccaggggggcaacgtcggccatgaccccggccaccttctcctgggcctccgacgcgaagcgcaggnnnnnnnnnnctcccccctttccacccctccagtacacgccacccatgccaaaatcccgaccttgagcaggtaggccaggggggcgacgtccgccatgaccccggccactttctcctgggcctccgacgcgaagcgcaggagcacctggcccgccgccagcacgcgcccgtcctcgccgcgcgcggcgtccagcagcaccgccagcgcgcgctgcgtgcgctggggtccggcgccgtgccgcgccagcgcgg

SEQ ID NO: 24698 - DNA, 91 bp, Chlorella protothecoides
cacccgctcccagactgccgccgcctcggcatcgccggagaactgcacgcaggagtcacactttgatgtggtgggaggggtcttggcgcga

SEQ ID NO: 24699 - DNA, 73 bp, Chlorella protothecoides
gccaccacgcaggacctccgcggacacacagccctggcccaatcacccacccacccgcaggtccacccaggcc

SEQ ID NO: 24700 - DNA, 67 bp, Chlorella protothecoides
agaggtcgcagggctggatgccggggatggcgaggcagcagggctggctgccggggatggggaggac

SEQ ID NO: 24701 - DNA, 580 bp, Chlorella protothecoides
  modified_base (279)..(288): a, c, t, g, unknown or other
tgggcgggtgcccgccgccgccgccgccgccgccgcgccaggtgcggggctgccaggcgcgcggcacgcccaggctggcgccgcgctccagcatctggagcggggcgtcgccgtctgcggggcgtggagcgagggaatgggatcatgggcagtggtggtgggagggacggcggggctgactgtgacagaactgtgagcgatctgggcgattcctgctccccgcgctccagcgccccaggaaaccagccccctgaggggagaagtcccgcaggttctggnnnnnnnnnngactgcgagcgatctgggcgattcctgctccccgggctccagcgccccaggaaagcaactccctgaggggagaagtcccgcaggttctggggctcgaaccccgagcagcaaccccgaccagtttggtgggcggcctgcagagcctgcaccgcatgatcaaactcccatgcacaacccaagcaagtacgttggaggctgcactcgggcgcctgtgctgccgattcccctctcccccaaacacgcacacaaccgacccacgacgcacctccccgcaggcccgggggcaggccca

SEQ ID NO: 24702 - DNA, 454 bp, Chlorella protothecoides
  modified_base (153)..(370): a, c, t, g, unknown or other
tctggagtcggaaccttgtccgtcaggcatcggatggaagtccgtgtagcgatcaggttgttcgtgctgagctctcgccgattcgccaaaacctctgcctgacatgtaactgagcgtttcgggatgtcatgcaccgagagctttacatgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatactttcagaaagtgaaaactgtcattaccacggcctgtccctgtgccaataccagcgacccactacccacctgcagccggc

SEQ ID NO: 24703 - DNA, 68 bp, Chlorella protothecoides
tcgggaccaagtgcgcacatgtagaggacctggttatagactctgcagggccttgctgaccatgaaac

SEQ ID NO: 24704 - DNA, 61 bp, Chlorella protothecoides
cccccccccctttctctgcactcttccctccctcaggcccgagacctgcggaagggggagt

SEQ ID NO: 24705 - DNA, 61 bp, Chlorella protothecoides
gggccatgtagtccgctgtgggaggggtggcgggctcgtggctcgaggcacgggcggcaga

SEQ ID NO: 24706 - DNA, 78 bp, Chlorella protothecoides
atagtccttgctcaccccacttctctcaccactgcaggctagtcccacagtattgctcctcactgaacactggcaaga

SEQ ID NO: 24707 - DNA, 71 bp, Chlorella protothecoides
tttgtcccttgcaaccccagcttccccttcccccccttccgtatggcaggaggaagggatacacaggagca

SEQ ID NO: 24708 - DNA, 97 bp, Chlorella protothecoides
gccaagcagcaggtcaggacttgtcgtgcgctggaatcagtaaattgagcatgcttgatgtgagtgatgactatgcttcctgtcttgtataagatcg

SEQ ID NO: 24709 - DNA, 71 bp, Chlorella protothecoides
gcatgatcgaggaggtgcaaagaacgtttggatatccgagcaaatacttgtcagaaagatcattggccaca

SEQ ID NO: 24710 - DNA, 64 bp, Chlorella protothecoides
cgtggaatccatgcggtatgcggcatgcggttgaaatttgtttgccgcatgctttggtcgcaag

SEQ ID NO: 24711 - DNA, 75 bp, Chlorella protothecoides
ggccgctcctcaccacactgctccgagggcggacttggtgcccaggagatgctgcgaataaaacatgccgccctt

SEQ ID NO: 24712 - DNA, 254 bp, Chlorella protothecoides
cacctgcacggcaccgtcgaaaaagaaaaacgcgccccagggtacgtcattcatgagcacaggtagcaaccccagaggcccccctcgtcgaccctcttcaatgcatgcgacatccttaacacgaagctattgaacatggtggttcagactgttctattgcccgtacagggtccatctgaaaattgaaagggaccgtgttgctggagtcaagccattattgaagtatggtcaagagcgatccacaggggggagac

SEQ ID NO: 24713 - DNA, 312 bp, Chlorella protothecoides
agtccactccaaccctatgtcttggatatcttgcttgccttcccacagcaccattctccatgtgatgtgacctgctcgcgtgccaagcttggaccgaaggacgcctgctcccctggcgataaatacccaccgacctgcgttgtaacggccttactctcgacagtctgtaggttgcgttgcatattgacagagtgaagacgtttgtacgttgagaccggagggcagagtgcccctgtgatcgctacctctcccggccccagggcgacccctggtacaccgacgccccgcgtctacaccctttcagtgcctcgc

SEQ ID NO: 24714 - DNA, 74 bp, Chlorella protothecoides
cctaggagtcaaatgggccggccacccctgccgaatggagtaagaaggggtgtggatggtcttcaacgagagaa

SEQ ID NO: 24715 - DNA, 70 bp, Chlorella protothecoides
ttcctgggtgctgtcgcgccctgtgtcacattgcatgttcacacatggcagcgaagagcatgtgctgagc

SEQ ID NO: 24716 - DNA, 85 bp, Chlorella protothecoides
cgacaccaatcgggaggatcttggcctcttcggcactgctagtgaagaagtgctcggcgtcaagtccaaacccctgtacaccatc

SEQ ID NO: 24717 - DNA, 73 bp, Chlorella protothecoides
taaagatatatattgtaggagcttgctcgtgaaaggaggtttgtatgtgtggtggtggtggtggtggtggtgg

SEQ ID NO: 24718 - DNA, 66 bp, Chlorella protothecoides
gtgccggcggccactttcacccgtccccaacacaaacccctcacgaacagacacacacctggtagt

SEQ ID NO: 24719 - DNA, 61 bp, Chlorella protothecoides
aagctctctctctgttccattgctggcgcactgcacaccgtccctccttccgtattcgtgc

SEQ ID NO: 24720 - DNA, 61 bp, Chlorella protothecoides
gtagtcgaggccatgcttgagccgtacacttgtgagtacagtgcgcaaacgctctgaatct

SEQ ID NO: 24721 - DNA, 61 bp, Chlorella protothecoides
catgcatgaacccggcttgcgagaagaccgcccccctcgaggcaacggagaccgggaggca

SEQ ID NO: 24722 - DNA, 61 bp, Chlorella protothecoides
aaataaaaaaaaaaaaaataaaagaacctaggattccagaatcaacctccgaagaaaactc

SEQ ID NO: 24723 - DNA, 223 bp, Chlorella protothecoides
ctgatgcagcttgagcaggagagggcggtccatatggccggccgccgcgcgctcggcgagcgccgggtcgagagcaccatcgtcaccggttcctaccgtggcaaccccgctgagggcggactgccagcgctcacccactgcctcggtaagccaggcttcagagacggcgcaacccaggatcttggccgcctgaagccccagggtggaggggccggcgcggagc

SEQ ID NO: 24724 - DNA, 72 bp, Chlorella protothecoides
cgagagcggcgtgggagggacagtcgatcacgctccccaacaccccggagtcgtagcaggtgaggatgctga

SEQ ID NO: 24725 - DNA, 809 bp, Chlorella protothecoides
gtctcatagccctaccaattcaaggtgagagcatttgaagtgccgccagcgaatttgaacgcgacaacttgggcgtaggacgcaagagcggtctcacttgactccagagtggtggtccaactcattggtgtgctgtatacttctctggaagcccgaatcaggccaccagctgcagtgaaaaaagcccatctaacacggtctggtgtaacgtctacaatgttcaccgaaaatgagaagtcattgacattcttggtaacagtcccgctgatggacccaaatgctggtggtggtggatagggttccggaggggggggtgaaggattaagcagagtcagcggtagaacttcctcgagttcattgttagcaccatagactcttgcagagccaaaggagtaatttgctgcaatcccttgatctcggaatctgttacgaagagtggtgacagcagagtgaggtgtatcagatgtgccgtcaatttcatctaaacctgatgagaacatggtgcaagaaatggaggagggtatagaacccactgtggtgactacaaaagtgatgtcaaccaaaccgtttttaggagcactgaactcgactgtggctgacgcttgtggcggtggtgttggtggggaggggctcggtggaggcaatggagggggtgaaggtggtgagggcgggggagtgggaggaggagggctctggattgagggcggtggcggcgacctgtcggcgggcgggggtggggccttcttggcgggtggcggaggtgacttcttggcggggggtggaggagattgcttggcagtcggcggagg

SEQ ID NO: 24726 - DNA, 61 bp, Chlorella protothecoides
actcacccgccaaccacccacacgtgccgcactcccacaacatgactcaccccccccacca

SEQ ID NO: 24727 - DNA, 67 bp, Chlorella protothecoides
cactttgcgatggtcttctcccgccgcttgaaccccaacatggagtggaactcctttgatgaacagg

SEQ ID NO: 24728 - DNA, 61 bp, Chlorella protothecoides
atcggagtgtggcgaaacagcatggcagggggagattcaccagccacgggcagtcctcaca

SEQ ID NO: 24729 - DNA, 61 bp, Chlorella protothecoides
ggagaagaaggaggagtctgaggaggaggatgcggtgagtggctgcagggccggtgcagca

SEQ ID NO: 24730 - DNA, 76 bp, Chlorella protothecoides
cacgcccacgatgatgcccctgctgtcataacccccccatcccatacccctctccaaagtacccaccttctccgcg

SEQ ID NO: 24731 - DNA, 66 bp, Chlorella protothecoides
cttccccttgttcccggtaccgatgttgccattcttgtctcctgtgcacgccttctgtccggcctt

SEQ ID NO: 24732 - DNA, 144 bp, Chlorella protothecoides
agcaggaggtgatgggaaggaggagaaggagcaggaggcgatggggaggaggagaagatggtgtgggctgcggaagctagggaggtggtggtcccttcactatgggtaatggtgaggtctccactgtaggcggctgtctaggag

SEQ ID NO: 24733 - DNA, 61 bp, Chlorella protothecoides
gagtgaggtaggggcctgtgggaaatgttgtgtcgaccttgtagtcattcagcccgacact

SEQ ID NO: 24734 - DNA, 61 bp, Chlorella protothecoides
ccaccgagttccttcccctccccagaacaacgcagcgagaggtacctggtgtgaacttgaa

SEQ ID NO: 24735 - DNA, 73 bp, Chlorella protothecoides
cacacacctgtctgggcctccaccaggtaggggaaatggtttgcaatgaactggatgccaatctcacggcagg

SEQ ID NO: 24736 - DNA, 73 bp, Chlorella protothecoides
tgtgcgcgactgcagcatccctcagggcaaaaagcgtcgccatcagctgctcaaatcctcctgctggtcggtg

SEQ ID NO: 24737 - DNA, 79 bp, Chlorella protothecoides
ctttgtggtgcagagagggaggagcaggggttgggggttttcaagggggggcgacgctgcagtgggtggactgggcggg

SEQ ID NO: 24738 - DNA, 149 bp, Chlorella protothecoides
cgcggtggcgagggcgccgccacgcccgcgacgggcctctccagcctgctgggcgccgcagggccgggtccaaccccaggccgggcacggcaggggcctgccccccccgaagtcccctccggcctggcgccgcaccagcccgtctccct

SEQ ID NO: 24739 - DNA, 61 bp, Chlorella protothecoides
gtgggaagggagtgggggagggggggttgatcaagagggttggtacagttggagcgatgcg

SEQ ID NO: 24740 - DNA, 74 bp, Chlorella protothecoides
gccctccgcccctgctgctggcttcctgtcctccctcgtcccctggagagcaatgcaggacactgcccctcccc

SEQ ID NO: 24741 - DNA, 134 bp, Chlorella protothecoides
caattcactacttcaccgtgcaaagcctgaaaattgtggtttaacaaaagcacactctggattgggtcataatgaaattagccagatgattgccaagcgcagtcacgagtcacgcagaggagcaggaaaagagg

SEQ ID NO: 24742 - DNA, 67 bp, Chlorella protothecoides
ttggccactcggctggtcttgctggggttcgtgcttctgcatggatcctacttagcgcgtcccggac

SEQ ID NO: 24743 - DNA, 61 bp, Chlorella protothecoides
gggcatggcagcaggctccagacattggggtaaccggctcttcatccattgtctggagcag

SEQ ID NO: 24744 - DNA, 133 bp, Chlorella protothecoides
tggagaagaaagcgagggggaatggccagagacgctcgtcatagcgaagggcagcggcgggaatgggaatgaatgtcgtgtcatggttcagtggcacacggggaaagacactctacatggcggcggcaggcgg

SEQ ID NO: 24745 - DNA, 153 bp, Chlorella protothecoides
gagtttcaggctgccttttgcaatgccgtgcttctcgctccatctctccgtcgagcgcaggcgtgtcaggcacccggttgctcttcctctgcacatttgcatgaggctggtcactcagcaagtcgattccacaccctcaggagcggcagatcc

SEQ ID NO: 24746 - DNA, 67 bp, Chlorella protothecoides
aacctcaggtgggacatgcatgctgacattacctgctgaatgacgttgggcactgattcttcttcca

SEQ ID NO: 24747 - DNA, 86 bp, Chlorella protothecoides
gcaaggagggtggaggaggtgggtgcaagcagttgaaaacccgcccaccctcctcctcaggcttaccagctccagtgccttgaact

SEQ ID NO: 24748 - DNA, 61 bp, Chlorella protothecoides
caagagggtgagaggattgcagtagacacattctaaacccacgtgcaaagggacttggcat

SEQ ID NO: 24749 - DNA, 74 bp, Chlorella protothecoides
ctgatacctgaacaggcacagcccagcccgtagaaagggctctgtcaagcaagaaactccatggcggtgggcaa

SEQ ID NO: 24750 - DNA, 4021 bp, Chlorella protothecoides
  modified_base (864)..(873): a, c, t, g, unknown or other
  modified_base (1287)..(1296): a, c, t, g, unknown or other
  modified_base (2077)..(2086): a, c, t, g, unknown or other
  modified_base (2664)..(2673): a, c, t, g, unknown or other
  modified_base (3533)..(3542): a, c, t, g, unknown or other
cggcggcgtggaccgccagctggtggtcgcgcccggcgcggccggcgcgctgacgcgctcgccgcgcgccgcgttggccccccccccggaccgcgacctggcgctgcagctggagtacctggaggtgtccatcaccgacgcggtgccgcaggagctggcgctggtgtcgctgcagcgcctggcggtgaacctggcggcgggcagcacgccggccggcacgtaccgggccgccacccttgccctcgcccgcatccaggtggacgaccagctccccggcagccgctaccccgtcgtgctggcgccggccaaggggcagggcggggacctgccggcgctgcaggccgcggtgacgcagcacacgggcggcgcgcgcgggcacgcattcttccccatcctggcggtgcgcacgccgctggtcatgcagctggcggtggacgagccgctgatctggcgcgcgcaggagctgctggcgaggctgcaggccgccgcggcgggcgacggcgcggggggtgggagcaaggggacgccaggtgccacccggcagccgtcggacgccccgcaccatccggacaccgcggccgcagacaccatgctgcgcgtgcgcctgctgtccatctccgacctggccgcccaggtcagctttggcagcaaccctcttgcgcgcccgcgccaggtttccgggggcgccgtctccgtcatcctggacctggccagcttccaggcggccgcaatcagcctgcacggcttcgagctgcgcgaagaggccatgctacacagcgccttccgcgcccacgtggcccaggtggtccagggccaggtcttcggcgtgggcgtctccctcgtccgcaactttggcgtcatcgnnnnnnnnnnaccatgctgcacagcgccttccgcgcccacgtggcccaagtggtccagggccaggtcttcggcgtgggcctctccctcgtccgcaactttggcgtcatcggcggcgcgggcaaggtcctgggcatgctctccgcgggcgtggccaagctgtcccagtccaggtgtggatggggtggagtggggagcagggggggaggagcagcagggtctggcgggcccctctgcaggtacactccttgcaagggctcacacacgtcagaatgacgactgccctgtcgccgagcctgtggctggcgaccaccaaacgtgcctcgacttgtattgaccctgcgtatgtcgcagcgctgggaaacccctcccatctcgtgagctccatcattccccccacctcccgctgacaatcacctcctcccnnnnnnnnnncggcaggcccccctgcaggtacgctccttgcaggggctcacacacctcgtcagaatgacgactgcgctgtcgtcgagcctgcagctggcgaccaccaaacgtgcctcgacttgtactgacccggcgtatgtcgcagcgctgggaaatccctcccatcccgtgagctccatcattcctcccacctcccgctgacaatcacctcctcccacaggagcgacctggagcaggccgcggccgcgcccgtgcccgagaccaagcccatatccaattttggcgacggatttgcagagggggcgggcgcctttgggtccagcatcctccgcgggctgcgcggcgtggtggagaagccgcgggagggcgcacgccagcgcggcttccagggtgggtttgcggtggggtgtgagcggaggtgggagaagatatgaggggaggggtggaggaggcttgcgtctggagcgggtgggtcgcaccagggcacctgcaattgaagtctaatagtgcgacattgtgaggtagcatgttcatcctttctctccttcctggcaggcgcactgtcgggtgtggccaagggtctcgtgggcgccgtggccgaccccatctcgggcgcgctggacgccatgtcggccaccgcccagggcatggacgccttcatgtcaaagtccaaggccgagctgctggtgggtggttgtgtggttgtgttgagtgagtggatatatcagagggaggggggtacaggctgtgttgtgatttggtgcccatggcacgaggcccaccctttccnnnnnnnnnngagggggggggggtacaggctgtgttgtgattcggtgcccatggcacgaggcccaccctttcccatgcgctgcaacctcctgtgccttctccatctgcctctgcgctcttcagctccccatccacactccctcacacccaacatactcacaggagctgggacggcggcgcctgccccgcgtgatgagcgtggacggcgcggtgacgcccacgctgcgggacggcagcttccgcgaggcgcgcatggaggagctgggtcaggccctgctgcagaacacgctgctggcagcccgcgagaagctgacgcgcacgggcacggtggcagaacgatatgagcagcacttcctgctgccagacaaccgtgtggtggtgctcaccgaccgcggcatcctgctcctccacgcccccggctttgaccgcctgggcgccgccgcagacctaggtcaggattgtttgtcctttctgtgtggggaaggggggggggggttcccaaggagaggggtagtgaaggggggcgggttgtgaatggctcaaggtataaacagggatagcaggggtgctgatgctagtcgtaggcannnnnnnnnnacaggtgtagtgaagagggacgggttgtgaatggctcaaggcataaatagggctagcaggggtgctgatgctagtcgtaggcaagctttaatccatcacaagcctctccgcaacctgcgtcgccagcatgatgttcccccgctacgagttccatatctcacttccccaccctccaacaatactcccaggctacattgcggtgagtgatgtgcctcctggcgaggtgtcatggcgggtgagctgggaggacctgctggcgctggagctgaggctgagccgggagagccccgatgcggagcccgatcgcttgatcgtgcaccgtaaaggagtgccaggtaggcagctgatgcttggatggaggttttggggtgtggccgccttgggaattgtggacggactcgattccaaagagggttgggccgcgaatgggtaggaacgcagctgtgtcggggccggagtcattttctgccacgctcccttcccagcgtcaatcccaccccagcatgtcccccatccatcaccacagggcgccagcaggaggagtcgttggcgcaccagatcaaggggtaccccaacacgccccaggcctcccagatcaagatggtcgcccaggccgtgagttggagtgcaggggaggtgatgcgaaccttgcgatgttctgtggctgtccccgggacaaagagggaaccatcttcgtacatatctccactcctgtctccctgtcctgcggacaccaggtggccttgctctcctccaaaggacactccactgtccacacccaccagcaacccgcactcaaccaaccacccccaccccccgtcgccaggtttacaagcggcggtacctggaaccgctgcgcnnnnnnnnnnagccgtgagttggagggcaggggaggtgatgcgaaccgtgcgatgttctgtggctgttctcgggacaaagagggaaccatctccgtacatatctccactcctctctccctgtcctgcggacatcaggtggccttgctctccaaaggacactccactgtccacacccaccagcgacccgcactcaaccaaccccccgccccccccctggccaggtgtacaagcggcggtacctggaaccgctgcgcagcagcgcgctgtggtctgcccggcatgcggcggccctgggcgccgcgccgcccaccgccatccccgccgacatgccgcacgcctcggcgctgccgctgtgcctgccctgcctggagttcgcgcccgcctggcacaccaaccccgcgcgcgcgccgtgcgtgtccttctggcggccgctggcccccgcggggtaccgccccgccgccgacgtggtctgcgcggggctggagccg

SEQ ID NO: 24751 - DNA, 72 bp, Chlorella protothecoides
gtgccaccgctaatcgaccccctctgagactgtttactgcggcagacatgatggccgccgaggccacagtcc

SEQ ID NO: 24752 - DNA, 61 bp, Chlorella protothecoides
gctatcattcgccaaatcactgccagcatcaccttcctgcccctgctcagcgacgcctgtg

SEQ ID NO: 24753 - DNA, 110 bp, Chlorella protothecoides
acagggcgtcaggcagcgatcgctgcttcgtatccttggaagagggggacaccagggaatctttggcttggcgaaggctatccaggatgcggcggccgatgccaagcccg

SEQ ID NO: 24754 - DNA, 61 bp, Chlorella protothecoides
gagtttgggttttggtgggttgagttttggcccatgtgcatgccatgtcaccaagagagcc

SEQ ID NO: 24755 - DNA, 82 bp, Chlorella protothecoides
tgtgcaacagcacgacacccttcggggacgatgggtggagaggggagtgtcatggtgttgtggggtttccccttgaccgggc

SEQ ID NO: 24756 - DNA, 79 bp, Chlorella protothecoides
gaccgtatctcaaggcgtcattacaagggtccagtgggggttgcatgtttgagtaccatacatgcccacctggtcatga

SEQ ID NO: 24757 - DNA, 79 bp, Chlorella protothecoides
gcatcgcggtgacagagctcttgcagggggtgggcagggagcaggatgccatagagcgagcaaggatggccatgcaggg

SEQ ID NO: 24758 - DNA, 62 bp, Chlorella protothecoides
atgacaagagtcacctcatcccagatggccttccccttctccacacagtatacaattgtatc

SEQ ID NO: 24759 - DNA, 61 bp, Chlorella protothecoides
tgcatgtggaaagatgcccgggctgcaacaccagaaaagcccccatctgtaatatagctca

SEQ ID NO: 24760 - DNA, 63 bp, Chlorella protothecoides
cctgaatgtcaacgcgacccagtccacccaccccttaacccaactgcacgataagagtatcac

SEQ ID NO: 24761 - DNA, 72 bp, Chlorella protothecoides
tcgtggctgcggaacgcgatgtgagcgggacgtcacgggtgagggacgacacacggggtgcttataccggga

SEQ ID NO: 24762 - DNA, 4303 bp, Chlorella protothecoides
  modified_base (1233)..(1320): a, c, t, g, unknown or other
  modified_base (1895)..(2047): a, c, t, g, unknown or other
  modified_base (3372)..(3532): a, c, t, g, unknown or other
aaaccagctgaaacatacgctgtgttgaaatataccatagcacacatctgtcagcggaagaattaaacagtgaactggaggcaatttgactggagacaggatccctcacttcgcaacagcgtggctttgctgtcctgctcttggagattgtgttcttgagcgccgtgattctaaagagagaatgggtgagggaaagcttgtggcgacttccttgtcacgaattcaacgggttacaaaaggagtgtcttcccttctgtctttgtggacgaatctcctgatgcttgaatctgttttgcacatgtgcccaaatattcacaacttctgccctagaaattcaggcgcagcactgcactcactctcataggcgatgacgttgcaatatctcccagccggatatgagttctgcttactcgcgaggaaaatgtgattgtgaaacagcagctttctcagatagaacatgcgaagaacaactatctggaggttgcaaacctgcatactcaccgaatagattgatagcattgccgcccgcactcctcacagcatactgtaacttaattatggagtcaaatgtaccttcaatcgttatctcaggcctcatgaggacgcatctttcatcccatagatgtaattgatgagggtataccttaagggtatctccagagttgcctcgagtcctcagccatgtgagccaggtcttggataagctgaacagagagattctgcactgcccttcgatatacatcccaattttctctctgccaacttggaaagcacatcgccctcagcggaactgggaaaaggagcgatttatgtgagccatttactactggaagtacttacaaaagctctaaataatgaatctcagactcgtaaaccgtctaccttgtcatgaacatcagctcgcaaaactctcatggtgcctggcaggaacttattgtagcattgctcggggtctaccctgaatctaccccaagatgcacacttttggatcgacagattgtatttgcacatcggatccgtgttttgcttggttactgaagcatcccatgtaagcggatgctgttttcccatttacaattgatcacatacacgcccgtttgtaagctgcattgcacgttgatagcacggcaacgcacaatttccagactcagtgaagacatactacaggagatgcactaaagaaggtataccagcttatattcaacccagactcctgatccagcaagctcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttgccatcactcaagcgtcttgcgcgcttgtgcctgaacctcgacagcccttagccatgatcaagacggctgtagctgctcagaatggtcctcatgggcacagactaaatactacaatgcaaattcatcacactgcttgatttgactccgttggttgtgtcagacaagatgcaatccctaacttgatatcagacttacggcaagagaatggcgtgatgcatgaccccctgtcttgccggattttaacatcacagatcaggatccattgcaatctgagcagcattctgcttgttgtttcagttaatgatttgtagtcttctcctttcagtaaggagttgtgcatgtcaagtatctccgtgggtgctgtggtatgtcaggcatgtgaaactccctcgactttatttgtgctgttgggtatggacatctttaagatctgctctgtggcatctcgtgcgcctgagatgagatagccaagcagtcctgctgttgtatcgaggtttttctttggccaggactactgccaaggaatagatttggtttgttgttgctggtgggatcggaggcgccagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcctgccttacaaacgtacagcagccttgaccgtcaagtacttcgtggaccctacgacatcagcatcagaagtgctagtctcatctcgaggtatctcatggaattatagagggactgattcgatctcctcaggcaagcatatctgatgcagggtgcgcttccggttcgtcgtcttttggctcgggtatgaccactctgcttgatcctcgagtctcgattctagtgcggtatctgcattgcatgaagtggaggcaattgtccaagatcaaaggcagtagaggccaggtacgcatgcggggactcttccatgaactgcaatgggttgcagcgagatactgggggctaatctcagatggaggtgtgacttcatatacagctgcaagccagtgaagttttctttggctgctcctcgcagtctcgtattgctgcgttcgcaatttctccatagtccctaacgtgcatttatctcactggactcatctcattttgccgagcgagcgctaaacataatagagatcatcacaattactaggattggggcaggtcttgccaccgtgccagagtatcccatcatcctaactaggcgagcaaggatatttccgtgttgtttcacctgtgagttctgtttttttccccaacctggttcatcaacctctcatggaatggagcacggcagctctgttggtgcaaattaaagatctctttgcttcgctttgcgtgaattacttgatcgacaacgagcgtggcgtttcagggcaagcaaaaccccccatgtctggttttcgaccagtacagatggaaaaggtactcctctactgtatcgtgtgagtgcgaactcccgctatcttatgtacattttacatccatctgagcgataccagcagagacgtaccggcgcaatgcagcaacgcaacaagacttcatcatcaagcatgagagctgttgacaataaaccgtaatcatgattggtatgcgacataaatatgagactgcctggttcacagtcagcagatgtgcacgatactgcagtaagttcaggctgatgcagtttgaagcgtcactcagtgaactgttcgccatcaatttataattttacgtacgtcgagtaggccaacagcagcatgtgttgccgcaactccattgttgcatagtcaaccaagagtaagaaggggttgcctaagtctgcagaagaatgtatatattgttctcatgtggctgcaggatggtggacgtacgtatttcatgctcctatgcaagagatacggtctcgacgagttggtcatggaccataacagttggatgttatcgcagaaccacatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggcaataacggactagatgctgtgtcgctcttggtccctctagaaattatctgaataagacataacacaacgctgcatgcatgtcatgcatcttgaacatagtatattggctgggccggacagtgaatttgctaggagttccagacccctacacgaacgcgtcgatactatgagattcagttggaccacttccgatggcatgctcactttgtgttcagaaagggtttctaaccttgtgacttgttggggggctggtgttattggcaaattttgttgaggcaaattttcacttctatctggtgtacttctcatcatcaattgtcgtggctctccttaagagccctgtcatacttcagcagtcctgcacattataacgtgcacaaatcaagagaagtgctcgcagacacactttgaattgatgtttgcaatggctttctaacagcaggcagacagtcagtgcagttgcagacaaataatctcaatgcttcctaaatcgcgagcctacctgaagacgcatggcagcttttacctcggatgtttatatcatctgccggagacttcctggctggcagttcgaacaataagtcctcgagtacagctttggaaggacttctccaagtcaagcttagacaagatcccatcagcaaatgtgaaggatcctggacaaccaccctttcgagaacttttgcttcgcagtggctcccttcagtcactcaccatttgtcgtaccaacaggagggcgagggctgcaagattggcctagccga

SEQ ID NO: 24763 - DNA, 61 bp, Chlorella protothecoides
atccacctggtgttattcaacaccacccttcttggaaaaccgctgaaggcttctgcctcag

SEQ ID NO: 24764 - DNA, 67 bp, Chlorella protothecoides
gtggtccaaaggccggtcggatttggcacgcgttggggacaggaggcaccagggcagccagacgtcg

SEQ ID NO: 24765 - DNA, 114 bp, Chlorella protothecoides
ctgggctcttgttcacacaattccccctaacccagccgccctgccctggcacacgaagctgcacagctggccgactcacacgtagtcgtccaggttgatcaccgtgatgacctt

SEQ ID NO: 24766 - DNA, 78 bp, Chlorella protothecoides
gacatctcgctcatgtccttgaagaggatgtccacggcatgcgccgcacatggcgtctatcggatgctgggatacctg

SEQ ID NO: 24767 - DNA, 96 bp, Chlorella protothecoides
tggggccctcctcaccgcctgtgcactaggttagacccatggaggatgctcatatccttcaaagtgacctccgaatgagtgcggggcgtccgtgag

SEQ ID NO: 24768 - DNA, 175 bp, Chlorella protothecoides
gagcaccaggttgtgctcgcgcgcccgcataccggacaccgagagctcaccaggctcctgggcgcgcagttttacccggtcttgcgcaacgcacgttgactgttttgcatccaccataccaacgcgttcattcagccgctgttttgtcgggatggcggatgcgggcagcagtcgc

SEQ ID NO: 24769 - DNA, 98 bp, Chlorella protothecoides
gcgcataatttgggcattccatcgttcgtcggtgtcccactctgacatgacaaagtgtgtccatcaagttaaagccaccgcaacatgcatgcagacct

SEQ ID NO: 24770 - DNA, 61 bp, Chlorella protothecoides
cgatcaatgctgaagccatgggggccgtcagtgaattagatgtgtccagaccaatacagcg

SEQ ID NO: 24771 - DNA, 73 bp, Chlorella protothecoides
tgcaatagccgagcctgtgtctaggccttccacctcaacgggactgcgaccgagcggggcctcccgcacaggg

SEQ ID NO: 24772 - DNA, 126 bp, Chlorella protothecoides
ccctgctactatagggattaccgcaataaacatcagcgaatcgatgatgagttccctctacagggtgttttgtcagtggaagttctacaatgagacaatcaaatccaattgatccttctgagattc

SEQ ID NO: 24773 - DNA, 70 bp, Chlorella protothecoides
ccctgagctctgctgccactgcccaccctgccaggcatggccctgagctctgctgccactgcccaccctg

SEQ ID NO: 24774 - DNA, 62 bp, Chlorella protothecoides
ttttcttcctgatcagtaaggcctacatagacgcgctctcaagcgaccctgcatcctggcac

SEQ ID NO: 24775 - DNA, 61 bp, Chlorella protothecoides
gcgctctcaagcgaccctgcatcctggcactgagtgaggcaggcgcactggaagggatgag

SEQ ID NO: 24776 - DNA, 126 bp, Chlorella protothecoides
gatcttgacctcctcctcattggcccccccgatgtaggcatacaggcgctgttcagcgttgggcaagtgacggcggtgggcaggaggtagggatgctgtgcatggctggttactcagcacgaaaat

SEQ ID NO: 24777 - DNA, 74 bp, Chlorella protothecoides
gtccacaaactcacatccgggtagtgggcgcagagcatgaccaggtcggtgctgaagtaacccagagagtagcc

SEQ ID NO: 24778 - DNA, 61 bp, Chlorella protothecoides
attgccgtcgagatccaggatggaggatgcgggggtgatcggcgttgatcaccccaggctg

SEQ ID NO: 24779 - DNA, 61 bp, Chlorella protothecoides
gaggaggcgccctgcgtagtggtccagttcacctgccagcagatcaactgcgcgcgcgaca

SEQ ID NO: 24780 - DNA, 370 bp, Chlorella protothecoides
  modified_base (93)..(286): a, c, t, g, unknown or other
acttccgcccatagaacccatcatcctccagtttaatagcagtcttcattggggtcgctggttgggtgggcacggttctggtggctttgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacattatactcctatgagaatcaagcaggggccctctgccacactccacaatcatccgacacgatcggaacccgacctggcc

SEQ ID NO: 24781 - DNA, 126 bp, Chlorella protothecoides
gtctgagcaacgctattctacacaaccgctagtcggcctcatctctgatatcgagccggcgatgaatgggtcggctctaagcatgcaacacatatcccccagcaactcaccaagccctccttccat

SEQ ID NO: 24782 - DNA, 61 bp, Chlorella protothecoides
gagctgcgtgcatcctgggtgcgtctcagcaccctcatggctaacgaagcagcacaggctg

SEQ ID NO: 24783 - DNA, 64 bp, Chlorella protothecoides
tcctcctcctcctcctcctcctcctcctccggcatgggcgatggggctggggcagtctcagggc

SEQ ID NO: 24784 - DNA, 61 bp, Chlorella protothecoides
tgcctcccggtctccgttgcctcgagggggccggtcttctcgcaagccgggttcatgcatg

SEQ ID NO: 24785 - DNA, 69 bp, Chlorella protothecoides
gtgccgacagccgggtgtatttctcgtcgacctttggatcgctctcaggtgaaggcgccgggttgtccg

SEQ ID NO: 24786 - DNA, 77 bp, Chlorella protothecoides
aaattttccgaatcggactgctcctagccccacaacatagaaacgatcctcttgtcgaacatgctacagccggagcc

SEQ ID NO: 24787 - DNA, 78 bp, Chlorella protothecoides
tgctttgttcccagggtagaccctcgcatctcgaactcgctcgcccgcgcagccagtctgatcacaaaatccgcaagc

SEQ ID NO: 24788 - DNA, 61 bp, Chlorella protothecoides
cggtttcccgccaccatatcacggacctccgggcccagggcgcaagagccatgcatggacg

SEQ ID NO: 24789 - DNA, 79 bp, Chlorella protothecoides
cggtgagttcaaagggtactccttgctctaatcaacaggggttgccaatatacaggtccacaagtattcgctggcatgt

SEQ ID NO: 24790 - DNA, 147 bp, Chlorella protothecoides
cctattatggttgcagggttggtagaaggtgcctgggacagaaggcaacctcatgatgtatgtgcctcggacttaagtatgcctgcaggagcagcctgaatttctcatggccgggcaataacaaactcttggatgtacttcttgaac

SEQ ID NO: 24791 - DNA, 77 bp, Chlorella protothecoides
ttgcaagttgtacttatacaatccaagtgtaaatctgtgctgtgaatatgtttgcgctgggcaattgagtgcattat

SEQ ID NO: 24792 - DNA, 61 bp, Chlorella protothecoides
ccccagctcctccgtagcctgtcgagcgctatcggtggtggagtgtctacccaccggaatc

SEQ ID NO: 24793 - DNA, 157 bp, Chlorella protothecoides
ccccccccctcgatctcgaccaagcttccctggtgcatgcacacctcttaatgtcaattaggtagcagattaggccgcagacggctcgagcatgtcccccggctcagagcatcgccacaagcgagcactgggtgatgtcgaggacctcgtgcggggg

SEQ ID NO: 24794 - DNA, 72 bp, Chlorella protothecoides
cggcgggtcaagattggcgagcacatcgcggggcccgtacaacctcagcatccagctctcatcggcgcgcaa

SEQ ID NO: 24795 - DNA, 271 bp, Chlorella protothecoides
gtctcatggcctacccacgctcctgctataaactgcggggtgtgtgccgggatgtccaggtcctcatcagcggatgtatccccaacaccccggacagtagttatgacttggatctttcgaccctttcctggacggcctctcataacaaggagagctgcaacgggctgacagggacaatcttggtcactgcattcaccccgttcaagatggctggaggtcagggtgttgtgagggctggcaagccaccacaacacagggacgaacagcttcg

SEQ ID NO: 24796 - DNA, 114 bp, Chlorella protothecoides
gatgtcaaagccaggggctagagtcttcccgatgccatccaggacagtaaaggagcggacctgtacaggcacagtgtatgccatggggggagggacgagggttgagctgaagcg

SEQ ID NO: 24797 - DNA, 76 bp, Chlorella protothecoides
catctccgcctgaaaggggggtcaggggggtacatggcttgagtcgcaatggtacatcctcatagggagcctggcc

SEQ ID NO: 24798 - DNA, 132 bp, Chlorella protothecoides
aagctttcgtgttccccctgcaggaaagggggatggatgagcttatggatacgttgcatttgaccggcaaagcatgccttcgacatgataatgagaatccctgcccacctctagtcgcctgagcttctgctg

SEQ ID NO: 24799 - DNA, 61 bp, Chlorella protothecoides
taggggttggcgtcctgcgcattgaggctgacagatcctcggtggcggcggcatacgcact

SEQ ID NO: 24800 - DNA, 72 bp, Chlorella protothecoides
cgatggaccaaagctcccacgatcccgagcacaaacgatccagggagacagcgttcacgatctccaagaatc

SEQ ID NO: 24801 - DNA, 135 bp, Chlorella protothecoides
ggcgaagccagccctcgtcgatattccctgccccgttgcttgaatggtgcacatgtgatacgtaccacctcacccctctctcttacacttctgaccaacaggcatgacctcctctgccaccttgacgctgaccct

SEQ ID NO: 24802 - DNA, 139 bp, Chlorella protothecoides
aggatcaggtggaaccaggcagtgttgatacctttcagccctcaaagagtacattcaagcagtcctccaagcagggaagcggcttggactatagatgcactctgcccttgctgtacgctgcatcctgagccccacccca

SEQ ID NO: 24803 - DNA, 80 bp, Chlorella protothecoides
tactgtgtcgagtttggcatggcaaggcaggggcgggggtggcgccctgcctgcacggaggggcttgctagtaggggggg

SEQ ID NO: 24804 - DNA, 95 bp, Chlorella protothecoides
aggccgccctcaaagtcaaagtcctcctgcgcatgcatgggtggggaggttgtgggcaagcggtgtatgggagcatgagcccatgcggtgccaag

SEQ ID NO: 24805 - DNA, 61 bp, Chlorella protothecoides
ggaggagattttcgacgatgcagagattgccttcatgcaagatgactttgacacagcacgt

SEQ ID NO: 24806 - DNA, 61 bp, Chlorella protothecoides
gactggagatggattatccagacctcttccaggactaccacatcacggccaaggacatcag

SEQ ID NO: 24807 - DNA, 66 bp, Chlorella protothecoides
ggggagggcgtgggctcaggggagggcgtgggctcgggggagggcgtgggctcaggggagggcgtg

SEQ ID NO: 24808 - DNA, 77 bp, Chlorella protothecoides
tataactcctccactctgcagaactgggatcacatttcctgcaggagcaccgacaccctcttccgtgagtttctgaa

SEQ ID NO: 24809 - DNA, 78 bp, Chlorella protothecoides
actccttcgcacctcctccctgctcttcttcgttgtgagctactggagagagagcttcctccgctgcctcctgagccg

SEQ ID NO: 24810 - DNA, 76 bp, Chlorella protothecoides
gagagagcgcccctcccatgcggaccgtcgccagcacggttcgtccttgtcacaaaggaccatcctctgtgatcga

SEQ ID NO: 24811 - DNA, 103 bp, Chlorella protothecoides
cacctcggggtgggggatctccaccgccccggccttcttggccaggccgcccaccgtcttcttcacctcctccgccacacccttggcctgggtgcctgtttgg

SEQ ID NO: 24812 - DNA, 61 bp, Chlorella protothecoides
gttgccatcgctgtctgctgagcacgccttttgtcctggcttcaggcactccacggcggtc

SEQ ID NO: 24813 - DNA, 78 bp, Chlorella protothecoides
atcgtcgacgataggctggacgtgagctggggaagagggggttgtatgtggaaggggtcctcagatgaggaggacggt

SEQ ID NO: 24814 - DNA, 78 bp, Chlorella protothecoides
acagtccctgacccttcgtcccacagccctagggggaagggggggggaggtagaggagcgggtgagggtgggtgatcg

SEQ ID NO: 24815 - DNA, 61 bp, Chlorella protothecoides
cattaatggcggatcgtggtgtgtctgtgcgccagccagtggtccgcgaatcgaaacccct

SEQ ID NO: 24816 - DNA, 192 bp, Chlorella protothecoides
ccagccctgcgatgatgctgcctgcaggggaagaaatccaggactttgaccatcccaacattctctactccactacatggtgctgctccagcatgctcggcacggtggagtgggttagtttgggtagacaccccgcgcacaaccaagatattctcaccgcagggggctgacacccatggtctgatggcggcc

SEQ ID NO: 24817 - DNA, 80 bp, Chlorella protothecoides
cgttgcggtccgtcacctggtttgttggtttttggatggggtgtggcatattatttgacaagaccagatgagaggctcag

SEQ ID NO: 24818 - DNA, 65 bp, Chlorella protothecoides
ggggaagcgctgaagggtgtggtgcaagcgtgcgggctcatgcccttggtggacgacaaggaggg

SEQ ID NO: 24819 - DNA, 61 bp, Chlorella protothecoides
gtagaggggtggcgccaccgagacttccagcgggagggtcaggagttgggacgcgtgctgt

SEQ ID NO: 24820 - DNA, 197 bp, Chlorella protothecoides
tcctgcccctttccaaatatcaccagaatggcgtagcttcttctcaagcttgggcttgatcgtctgcactcgaagctctccctgtgtcgcccagaaagctctccatggattgggggaagtgctcaaaacttcaacaggatgaacctccttccatcgtacattcagcaacatctggctcttcagtccagcgtctcgca

SEQ ID NO: 24821 - DNA, 108 bp, Chlorella protothecoides
gccattgcttttgacgtgttcatcaagcacgagaaataggacttaatgaagcatttgtgtcaatatgagggcacttgctttagtgcttcgttgtgagccgcgggcaga

SEQ ID NO: 24822 - DNA, 84 bp, Chlorella protothecoides
ctgtctttgcaggaacctcatcccactacgaccagatctactacggcttctccaacgcgctcaactacacgagccccaagctgc

SEQ ID NO: 24823 - DNA, 61 bp, Chlorella protothecoides
tgcaatgcatcccggttaggcagtgggtacaccctctatagaatagccacaatgctccatt

SEQ ID NO: 24824 - DNA, 75 bp, Chlorella protothecoides
ggtcgagccgtgcctgatgcacctgttccctgagagacattttatcgtgtgatcctacttgcacgctcgtttttg

SEQ ID NO: 24825 - DNA, 99 bp, Chlorella protothecoides
gtgacatgccccgcctagagacggcgcgatcaggtgacaaaggcccatgatgcatggaggagcatagcgctggggcgtgcatggtcgcattggccggaa

SEQ ID NO: 24826 - DNA, 66 bp, Chlorella protothecoides
tgctggtcaagctcgaaggagaaggtgagtatggcttcactacaactttcagcggatgctgaagga

SEQ ID NO: 24827 - DNA, 73 bp, Chlorella protothecoides
tccccagatgcattgctgctggcaccctgtatggtccccctgatctgcacctggagataggtgaaaaactctc

SEQ ID NO: 24828 - DNA, 61 bp, Chlorella protothecoides
gctgcagggcctgagtagagcatccgtgacagaactggaagaccgggtgctgtggactcta

SEQ ID NO: 24829 - DNA, 68 bp, Chlorella protothecoides
catgaaagggcttacatattccggacaacggagcctgcttatgtgcatggggtgatgggctctccccc

SEQ ID NO: 24830 - DNA, 72 bp, Chlorella protothecoides
agtatgccttgccatccccattctcatagcggtgcagggtctttgtccaccaagtcccaatcgccatatcat

SEQ ID NO: 24831 - DNA, 78 bp, Chlorella protothecoides
ctggatggacactacttggacataggacataaaggctaccatgtcattactcactgtatcagtccatgtgctcgggtt

SEQ ID NO: 24832 - DNA, 63 bp, Chlorella protothecoides
gactgcgggggggtgagcggtgagtgagtgagtgagttgggagtttggagaggtggagcaggc

SEQ ID NO: 24833 - DNA, 253 bp, Chlorella protothecoides
ttggagaagcaaggaccatttgttttcacacagaccagccatgcagaaaaggcatgaatggccatgtgatggattcctgaagctatccagctcgtgcgcacagcggcaagacggtggacgaaggggcggcactgtcatgctcctaggcacgtggcataggaccaggacggcatgctcccgagaccaaaatgactgtccatgcctttcggcccagcctacccggggatgaccaggccatcgtaggtgtcaagcc

SEQ ID NO: 24834 - DNA, 135 bp, Chlorella protothecoides
cgggtcgacgggcggtgggctggaggtgaggttttgactaggttctgtgggcccccctgtcgtcggcgccgggtggccatcacgtgcgccctccccagccagcaacgggctccagggctcgatgcgcaggctgac

SEQ ID NO: 24835 - DNA, 61 bp, Chlorella protothecoides
agggtttgaccccggctcgggcgcgcttaccgcgcaggcgggcgccgtgctggcgaccctg

SEQ ID NO: 24836 - DNA, 139 bp, Chlorella protothecoides
gtatggagcgtatggacttcatggcttggcaagggggtgcattcccggaagccctggtggggtgtgtgaaagggagggtccgcctggcgtccctgcacacttgtttgagagggagtccctctgtgcaaaccatctggtt

SEQ ID NO: 24837 - DNA, 173 bp, Chlorella protothecoides
gtatagtcgtacatggggtcctgcagtgttgtacgcgcatggtcgccagatgggacctacatttcagaaccaagatgtgcctggcggtcagcagggaaccccccatttcccaaaaccacaaccttaccccccccacacacacaacacaacccctgccccatgcagtggcgctg

SEQ ID NO: 24838 - DNA, 61 bp, Chlorella protothecoides
gcacaatgcggaagggatagatgaggtccctgtgtatgtagtgcacgaggaacatggccat

SEQ ID NO: 24839 - DNA, 74 bp, Chlorella protothecoides
gggctgagccgcctgattggcagcgagtcgtacctgcggacgcggaccctgggctgcgcagagtacatgtgagg

SEQ ID NO: 24840 - DNA, 114 bp, Chlorella protothecoides
gaagaggaaaggatggagggtctgtcggaggggcagtccctttggtttgcatgatgtctctaccggctttcagtacatcgtgtcccccattcacaggcatgagtagaggcatgc

SEQ ID NO: 24841 - DNA, 80 bp, Chlorella protothecoides
agaatggaaagagagggggtgggggacggcggtctccaggaagcgcagcgcgcttgtccggcgccgaccccaggatcgcc

SEQ ID NO: 24842 - DNA, 135 bp, Chlorella protothecoides
gacagactgcagagtgaaccccgcaagggggtgtaggtcacttttgttgggagatgaagagtccctcccctctggctcaccctcgggcctacctggaccttgacggggaacaagttttggtccgaccagtggtgc

SEQ ID NO: 24843 - DNA, 125 bp, Chlorella protothecoides
ggttgactgggtgggtgcatgttggggggtcatgtggggggtggttggcaccatgcaccctcgtgcatcagtcgcttgggagccccgcgactgcatgatgcggtgattgccggatgcagcgtggg

SEQ ID NO: 24844 - DNA, 61 bp, Chlorella protothecoides
ctttacttcatcttcattggcctttcgttgctgttctagcagcagaagtaacactgctgtc

SEQ ID NO: 24845 - DNA, 62 bp, Chlorella protothecoides
aacatgggattcgtacgcctcatgtgccgcaaagtttcgggccagggcatccagcgccttgc

SEQ ID NO: 24846 - DNA, 439 bp, Chlorella protothecoides
  modified_base (198)..(356): a, c, t, g, unknown or other
gggggcccatggcaggggcgccggcctgagcaggccctccccccatgccaggaagctcgagggtggcagcatgctcaatccccctccccacccgctcctccaccccttgccgtccatcaggtacctgggcctctgcaccctcgacgagtcgccctggtagaaggggcccccagtccttttacatagcccagatccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcctcgcagactcctgcagtgtaccaatgcccccctcccacccttatttttcccaacccctcctaaggtggctgtcccatc

SEQ ID NO: 24847 - DNA, 61 bp, Chlorella protothecoides
cgcggtgtggcggcatcaaccccctgaatctccccgccgcaccccgtcacagctgaagctg

SEQ ID NO: 24848 - DNA, 81 bp, Chlorella protothecoides
ccctaccatccccaccgccgccgtctcctccccctagctctccaccagcttccctaccatccccaccgccgccgtctcctc

SEQ ID NO: 24849 - DNA, 125 bp, Chlorella protothecoides
tcagattgggcaaccccgcaacttctcgatgctctccacctcccagggcatgaccgtggccgcacagacggccctcctcctccgccaacagctggcagaggcgctggccggcgcccgcgacctgc

SEQ ID NO: 24850 - DNA, 61 bp, Chlorella protothecoides
tctcggatacattgtggtgacgtggcgagatatgtcccatgaacttggcagcatgatgggt

SEQ ID NO: 24851 - DNA, 186 bp, Chlorella protothecoides
gaggagggagcaccaagggaggcgggtgcaggtggcaggaaggtggttgaggtgctgagaccgacacaatttgccaggcggtatacatctcagggagacaactcgtccaaggtgcacgcactccacctcaaacagtgctcggcaatcctcctcacaacccatcatcactaccctacccctggccaa

SEQ ID NO: 24852 - DNA, 4310 bp, Chlorella protothecoides
  modified_base (448)..(457): a, c, t, g, unknown or other
  modified_base (996)..(1005): a, c, t, g, unknown or other
  modified_base (2208)..(2217): a, c, t, g, unknown or other
  modified_base (2395)..(2404): a, c, t, g, unknown or other
  modified_base (2646)..(2655): a, c, t, g, unknown or other
  modified_base (3558)..(3567): a, c, t, g, unknown or other
  modified_base (3977)..(3986): a, c, t, g, unknown or other
  modified_base (4072)..(4081): a, c, t, g, unknown or other
aggctgcaccaccaaggcgggagtgaaaggcctaggcgatgcctgtgaagccgacctagtaaactaggctgatggcgacacgccaagaaaaatatatctaacaattgtcttgtccaatggacaagatactagctgttagactagtaagaacagatactacacttgatcttagccaaaaggccgagaaaggtatgatgagggaggcctccaaaaagaatatgagtgagagccaggcatcgcgatgatcccgacgattatgggtcaatctcacgtccttccgcaatctggcgtcacaagccgtagatacagatctccccacatcacgtactcatttgcgtttttccattaaagcagacatgttattactctacatcacgagcggcgtcagtgtgcaatgccggcttttcgccaacgtcatcaagagctcgaagtgtgcgtgcgaggcaannnnnnnnnntttggcgttacaagccgtagatacagatcttcctacatcacgtactcatttgcgtttctttcataaaagcagacatattattactctacatcacgagtggcgtcagtgtgcaatgccggcttttcgccgacgacgtcaagagctcgaagtgtgcgtgcgaggcaagcctgcacctctttccagaccaggttccgcacgctggaatgctcatcccgaagaatggcattcgcgtcccccgcctccctgcctcgcagcacctttgatgcgcatcgagccacaattccttcctggacggcctccgtcagtgaccagccatagctgacaagggaggccagctgcgtctccatggcccgtccaagcaactccctggcgacctgctcgggggtcaagggcagggcttctacccccgcttcgcccagcaccgtgtgcggagtcaaggaaggggcaggcaaggggcttgccgctgcagctccaggcagctcgtcgacggcctgccctgcatccccttcctcctcctcgggccttgcagcctcccagtnnnnnnnnnnctgcggagtcaaggaaggggcaggcaggggacttgccgctgcagctccaggtagctcgtcgacggcctgccctgcatcccctccctcctcctcgggccttgcagcctcccagtctaggtcagcctcctgcagccggcgtggcctcttcgtccctggcctgggcctgggcaggctgggctccctcacgggctcaagcgccggccgtgttgccagggcggggtcccagtcgagggcggtcagctgggcggccttgttctgatacacccccacccccatgcagcgccgaaagagctccgcctcctgatccatggcgaatgcaaaggcccgcgccctgcgccgaggcatgggatgcacgtgttgggtctcctgggttaagctcatcctgttcagaaggacaacagaggttgcagcatgcacatcatgacaccacaccactcgctggctgcacctgagcccctcgaggccagcggctgcggcaggctccagttggccttgccacatggcagccagggcgaggtgttgccctgccagcttggtcaccacggtttgccttttgagttgcgacggcatgggcggggaagtgagtcccagggtcagagtctcattgtcggacgcaaagcatggtcgactctgtatttcctcacctcgctgcgcgtgggagtttggagcgggggacataggtgaccaggggccgcaggcggggatccactgcctccaggaactctgccgcccgcgccaggcactcccactcctgctgtcggggatctgctgtgcatcgggtaggggaccatttgcagtacaatgggtgccatgcttgcgccaagagatggtgattgcagtggagcagatgcatggagctttgggaaacctggtggccagtgttcaacacacgaccaacaccaaggaaacaatacaccatcctaacgacctcggacccaccatcaagctgggggggcacgggtggctcctcttcctcatctacctccgcggctgcttgcagtatgatggccttggcattgacgccaaagcgtggggcagcggcgcatgcctgcaggagctcgtccgccggcatgggcccaggcggcagtcgcctacagcgtgggcgttagcgcccggcgcatgctgccggggagccgcatccagtctcgatggttctcattgccttgggagaagtctggacgggcatggacgatcgtgcagcgnnnnnnnnnnaagccgcatccagtctcgttggttttcattgccttgggagatgtctggacgggcatggacgatcgtgcagcgaggtccacgccccctcgcacgcgacgcacggcatgcagatctccaagcatcggagggttgttttcctcccatgcgccttggctcgagaagctgacaccacagtgtnnnnnnnnnncgcaccggagggttgtttttcctcccaggccccttggctcgagaagctgacaccacagtgtgcaccaggccactggagctcctttgcggtgcatcatgggaaggaagcactggtatgttctccgatagcaaggcacaaccgtgggcgtctgcctgaattcatcatgcagttcatcacacacatgtaactcctgcccgtgcccaccgcctcccgccccgctcaggcggcctgcgccagccgtnnnnnnnnnngaggaagcactggtatgttctccgaaagcaaggcacacccgtgggcgtctgcctgaattcatcacgcagttcatcacacacatgcgactcctgcccgtgcccaccgcctcacgccccgctcaggcggcctgcgccagccgtcgcagcagggccagggtggcctcgtaaaagggcgccaccgtggcgacctccaccctctcgtcgggactgtgggccccgcggatggtggggccataggacacgctctgcacgccgggcaacttctgcccgatgatgccacactccagccccgcgtggatggccttgacagcaggggccttgcccgtcaccccctggatggccgccgccgcggcatgcaccaccggcgcgtccggttcgggcacccagccggggtaggcggcgtcctgtttgtgcgtcggtgggtgggtggggtcccactctggtctgtcgccgagggcgaggaccctggttcttcccacgtccgagatccagaggccctggcgggcggaccctcccctcctgtgcatcatcctggaggcctccagggatcaagggacccccccctctgacacccctcttccccctagcacccccctcaccccacctggtgaacagtcgcccccgccgccctgcccagccgcgcgatgccctgccggacgtcctccagcgccctgtccaggctactgcgggtgcaggtcaccagctccacggtcagcgactcgggcgtgcgccgcttgatcgtggccgacgccaggttgctgctcgtctccaccaagcctggatgggtttgttggtgggtttattcaaggggagtgttttagggagtgggcttgagcgagctgagaagggtacatagcggaaggtgtcctgaccttcgtggtgcatatggggctgctctcagtnnnnnnnnnnttttgttggtgggtttattcaaggggagtgatgtagggagtgggcttgagcgagctgaaaagggtacatagcggaaggtgtcctgagcttcgtggtgcatatggggctgctctcagtcgcacaccaggccgtggacaagggccgactcctgtcgtgcattcgacgctccgggctctcagtctcccagagcccaccccaacccccggcccctccttgcctcccaccaacacctccctcccacccggcacggtgtggctgtgcttgatgacgccgtgcggcagcatgaggaggaggaggagcaggcggtcggcggcggccggggtcagccccgcacgcctcgcctcgacccccacctcctcctcagtcagggccagccccgtctccagcgcgccatactcgaggcggaaggnnnnnnnnnntccaggccatggaaaagggccgattcctgtcgtgcattcgacgctccgggctctaagtctcccagagcccaccccaacccccggcnnnnnnnnnntggggtcagccccgcacgccgtgcctcggaccccacctcctcctcggtcagggccagccccatctccagcgcgccatactcgaggcggaaggcgtcggccgcggcgcgcaccgcagccgtggcggcctccagcgccccggcgtccggcgcggccagctggaacccggcctcgcgcgggatggcgttgcgcttgtcgccgccggacagcgccagcaggcgcacgcccggc

SEQ ID NO: 24853 - DNA, 175 bp, Chlorella protothecoides
acctgtcagtgagtcgtgcagttgtgcctctctctgggatctggagagccgttgtgcatgtgggtacagcggaggcagcccagggcaccagtggagcatgggcgtctgcaggctgtcatgcgacacctggttgctcaccaagaacgccagatcccaagtacctcatttccccaat

SEQ ID NO: 24854 - DNA, 135 bp, Chlorella protothecoides
cagcctgcattcttctcgcccaactcacgttgctcaccgatactgtcatccccatcattcatcgtgccaaagttgttcctgcccttgttgtggtatccaacgctgccatccttgtctgccgagcaagccttctgt

SEQ ID NO: 24855 - DNA, 84 bp, Chlorella protothecoides
agacagggagcattgcagtgctctgactgcactctccccatgattttcctggggtgaccccaagcagccactcaggcacagtcg

SEQ ID NO: 24856 - DNA, 61 bp, Chlorella protothecoides
aggcgacgacaaagtcatctgtaaacttccacatggcgtcgttgatgccgcgcatgaaggt

SEQ ID NO: 24857 - DNA, 145 bp, Chlorella protothecoides
gagggggggagtgatggtggttggggccttgtgagctgataaaggccaaagatgtggctgtcttgacccagccaccgtccctacaaatatcccacacgctcccaccccacaccctaccccacctgtgagcagccagtcgccgaga

SEQ ID NO: 24858 - DNA, 75 bp, Chlorella protothecoides
atcgaccttcgagaaccgatggtgcgctatttgtgtgtgaaggcggtccgcttttgtgacataatgaggggcaaa

SEQ ID NO: 24859 - DNA, 67 bp, Chlorella protothecoides
ggcagccggagaatcgtgaccctgcacgaagtaaggtggcgctgaatagtcagtcctctcgccattc

SEQ ID NO: 24860 - DNA, 123 bp, Chlorella protothecoides
gttttgttgctacttgtcaggatgaatgagatgccattggctgcccaggaaaagtcgtgcaaaccatgtcgcatcgcattacaatccatcaagttccatgctgctgcatcgcatggcactggc

SEQ ID NO: 24861 - DNA, 66 bp, Chlorella protothecoides
agcctgcaccagggccattgggaggcacaggtctggctcatcaagcatgtatcatcatgggaaacc

SEQ ID NO: 24862 - DNA, 155 bp, Chlorella protothecoides
tgccacactgctgtgggcttggaaaggtgctgcccaggcagggggggtacctcagggaggcaacattcacactctactagacggcgagactgcaggcattcccaggcctgagtgcagcgccttgcgcatgccttccaaggaccccagcaagccac

SEQ ID NO: 24863 - DNA, 124 bp, Chlorella protothecoides
gctggagacatgatgccgcagctttctgatctccccagagatctttcgagccgccttattcgtcgcacatgccctcctgtccctcctgtcccaaccccccgctcccacccccctccaggcacct

SEQ ID NO: 24864 - DNA, 127 bp, Chlorella protothecoides
cgtgtcccactacgtgctgcgcctggcgtactgccggaccgaggagctgcgtcgttggttcctggcccaggagtgcgacctcttccgtgcacgcttccgggccctgctccccggcgagcaacgcgcc

SEQ ID NO: 24865 - DNA, 85 bp, Chlorella protothecoides
gaacagtctgaggggggtccggcgatctgtcgtcggcgttttgcacatttaaatcgcgcgcgatctgggactcctggagcgtgcc

SEQ ID NO: 24866 - DNA, 72 bp, Chlorella protothecoides
gatggctgcctcgctggcttcctctgcagctgggggggcagcagaccctgccttggccgctgtgggctcctc

SEQ ID NO: 24867 - DNA, 61 bp, Chlorella protothecoides
ggtggccagccccttcttcccagcgcgccctgtgcgcccgatgcggtgcacgtagtcgtct

SEQ ID NO: 24868 - DNA, 78 bp, Chlorella protothecoides
tcctccttgaagactgggatgcgcgattcctggcccggcatggcaaacccaggtgaattagctggcagggacaggtgg

SEQ ID NO: 24869 - DNA, 70 bp, Chlorella protothecoides
ggctgacagtgtgtgggagacagtgctgttccccaagaaaggaaagtacagcctccacgattccctgcct

SEQ ID NO: 24870 - DNA, 61 bp, Chlorella protothecoides
tgtagtaatacacgacaccggcaggggaggtgtgcgccgtccatgcagctgcagcttggcg

SEQ ID NO: 24871 - DNA, 103 bp, Chlorella protothecoides
gggggggggggggggggggggggggtgtggaggacgactttggcatacccgtatgccgctgttttccctctgaccttctgcgctacacgactcccctgccctc

SEQ ID NO: 24872 - DNA, 61 bp, Chlorella protothecoides
tggatgtcaatggcaccctgtattccgtggccgatgctgccgaacccgcattccgagagct

SEQ ID NO: 24873 - DNA, 61 bp, Chlorella protothecoides
tgggagggtcctggccagaggcttgattccaccttggggactaagatctgtcctgccagcc

SEQ ID NO: 24874 - DNA, 73 bp, Chlorella protothecoides
cttccgcaccttggccaggctgccatcggccttgatctcaccggggaacaggttctccagctcctgaatgagg

SEQ ID NO: 24875 - DNA, 111 bp, Chlorella protothecoides
ctctccaaggattgccctcacctgcggcaaccgagagttgagtgtgagcaagactcaggctgcctcaaccctccgctcaaatgctcggggcatcagaagatccaagaggtg

SEQ ID NO: 24876 - DNA, 72 bp, Chlorella protothecoides
catcttctgctacagcagttgacaaggcaagccttcccttgcaacaaatccctatgctgcatcgatctttgt

SEQ ID NO: 24877 - DNA, 61 bp, Chlorella protothecoides
gagttcgctgtacgtcgggagtcggatatcaccatcaatgtccgcgagtctctgcatcatt

SEQ ID NO: 24878 - DNA, 61 bp, Chlorella protothecoides
cggcttcaacgtcatcgtggtgtcctccggtgcggtggccgtgggctgccagcgcctgggc

SEQ ID NO: 24879 - DNA, 78 bp, Chlorella protothecoides
ggggtcgggaaggcgcgcgaacacgtcaaatgggatcgggcaggccgacgtcgtccggaaggcatcattcactgatat

SEQ ID NO: 24880 - DNA, 61 bp, Chlorella protothecoides
atgtgtgtccagcgtcaagggactggagggtatggttctgaggcctggctggattttgtga

SEQ ID NO: 24881 - DNA, 114 bp, Chlorella protothecoides
gcccagcttgatgcaagttcagtaccttacatggcagggagaagcgtgcatgcaggtgctcacctaagcttgccgatgaccgacccccccgccctcctggaacacacccgacag

SEQ ID NO: 24882 - DNA, 263 bp, Chlorella protothecoides
catcgtggcattcacccgctccctctccctccagctggctcccaagggtatccgcgtgaacgccgtcgcacctgggccggtgagagccacgctgcctggggtggtgtgcgccagggcgctggctgtgaaggcgggggaggtgaaggagcacatagtgtctggctcctggcacacctgctttccgaagaactcaccagcggaaatattcactattaactgcccccccatctcacgcatggcagatcatcacgccgctaaaccct

SEQ ID NO: 24883 - DNA, 243 bp, Chlorella protothecoides
agagggggagaccaccgcggcggcgctgctacagtacaggcccagcgctccgtcgccgctgggggtggccgtgatggtgtaccatgcctcctcattgtctgcgctgatgtcggtgaacagcacctcctcgccctactcagggtcggaggtttgcggatctgacaggctggagacagatcatgccttcacgccggcgatgcacccgcaggaacagctggggcactcaccaccgccacggtggaa

SEQ ID NO: 24884 - DNA, 93 bp, Chlorella protothecoides
gagcgcaggagcggctgtgctggtagtgtcattgtcctccattaatcctgcgcagcattcttaagcgacacccacctggcgcctgcaaacccg

SEQ ID NO: 24885 - DNA, 61 bp, Chlorella protothecoides
ccaggggcatgccaacagggcatgcccatgtactagctgcaaccaggcttgcaagtggtgc

SEQ ID NO: 24886 - DNA, 128 bp, Chlorella protothecoides
gatgttgagcatgaccaggttgaccccggggggacgggtgggggccgtagaggcggcggagtccatggcatctgtcagaacaggggccatctcctggcagacctgagaggggggcagggatggggtgg

SEQ ID NO: 24887 - DNA, 78 bp, Chlorella protothecoides
gaacggaatttgacatgtcgtgcgcacagctgcacacgttctcgacaacatcccagcttcatggccgccggaatcgaa

SEQ ID NO: 24888 - DNA, 137 bp, Chlorella protothecoides
acagcagggttgatacatggtcagagaggtggatagatctagttgattgaaaaactgtgaagaagacagttgacactctctgggaaatccgctccaggtcctgcccaccactccctgcccgccactcacctttgggg

SEQ ID NO: 24889 - DNA, 72 bp, Chlorella protothecoides
aagatgtcctgcggtggttgttggtgggggcagagaatcgttatgcgtctcagggccaagaccatccttgat

SEQ ID NO: 24890 - DNA, 79 bp, Chlorella protothecoides
atggtgttgatgcccgttcaagcctgtcattgcctcagggaggtgagtccctgccgctgctgcagcctgaatggcggca

SEQ ID NO: 24891 - DNA, 65 bp, Chlorella protothecoides
aatggaacatcctcatcctaccaagccgactcagccttggcacttgacctgcaacgtgggaccag

SEQ ID NO: 24892 - DNA, 63 bp, Chlorella protothecoides
ctctggaatgcatctcaggtgggagatcgttaggggaccatgccacagcctgtggggtgcaga

SEQ ID NO: 24893 - DNA, 262 bp, Chlorella protothecoides
agcgcccggtcaaggggaaaccccacaacaggtgcgctgctgcagccatgcaaatggctggcacttgagggtgctctgatatggggtatgccctgccgcatcctgttttgagagctgggaaggggctcttagaggagccagggccgcagactcccaacctgggggcgtcatgttcacacctctggggtgcgatcccagacgatgatactaagtcagccaatctaaggcaatacccctcattcctcgcaggcaacaagaatca

SEQ ID NO: 24894 - DNA, 136 bp, Chlorella protothecoides
gtggtggaggggaccgcttcttgaggggcggggggggagaacgcttcttggatggtggaggggtagaagtaagatttatggtgtccccggtgaccagatcagctgaggtgcagggtcgcgaggcgccagccaggcc

SEQ ID NO: 24895 - DNA, 95 bp, Chlorella protothecoides
atatcgaatgtacactgctcgatcaagtgtaagaccagtactaaccatggtgtacattctctcaccaccgcagtagggatggcaatatgactctt

SEQ ID NO: 24896 - DNA, 678 bp, Chlorella protothecoides
agagctcagactctgattccatgtcaggttctgagcctgattcagcggcgccgtctgaggaggggccccaggagctggtgagctcatccccaggcgctgtgtcagtatctgacgatgatatggcggtgcctcctgaggagggggggggtgagctgagaagctcatcctctgaatctctatcagcatccagggggttgagggcctcttggggaggggaggggctggagcagaccgctctggacatctcgtcctgggtctggcctcaacttagggacatggctggaggttccacctgactcgcaggtccaggaatgagcttccttggagccacacaaaagtagcacttgggtagtatttctaggaatcaaaagaagtgtcaggcgatgagattggcctatgtgggtggctgtcagattctgtacattatgcagcgcccaccatgccacacagcatcatgaagcagactgctttgtcctgtggaggtgcagcgagccgcacgccttcgcacacgcatctcgggccatcgatgtagagcacatgcctctttcagggattgaatacccccataagtgggagctcttcgcttcacatgactggctttccatatcgactgagaaaattgcaagccgtcctttccttgatattcacgattacctttttgtttccgtccgattttcc

SEQ ID NO: 24897 - DNA, 61 bp, Chlorella protothecoides
ggggacgtctggcagcgtggtgaacttgtcgtgcaggaagccggagtagccgctctgcgtg

SEQ ID NO: 24898 - DNA, 61 bp, Chlorella protothecoides
gcacagactatgcctggtcgttatatggcatggaggggagccagcgtgaagccgtgctcca

SEQ ID NO: 24899 - DNA, 80 bp, Chlorella protothecoides
tcggcgcagcaaagaccagattgagcaaaacttaagcatgcgtcaggctcgcgagcatggtcacaaaggagcggacagga

SEQ ID NO: 24900 - DNA, 175 bp, Chlorella protothecoides
gcatggtaatctcagagatcatacatagacggaccaactgattaatccggtgggggaggggggtgtttagcatgttgtcgaacccagctagcacaccaatacatgcaggggtaggggggtgcctgccacctgaggcgaatatctggggtccacgccagcaactgatcctggcaca

SEQ ID NO: 24901 - DNA, 126 bp, Chlorella protothecoides
ggggctccccggtgcctcgctgaggcggggtgagcccgaacaacaggcgcatgccctgctccccatcgttggtgcacttcatctccagcctcccaggctggcaccctgtccttgctgccccgcact

SEQ ID NO: 24902 - DNA, 162 bp, Chlorella protothecoides
tggcgtcctcgactggagagtggcaatggagagttggaatgggtgaggcgcggagggtgatgggagtgggggacggcgtgggggcaccattggcaggttgcccgggggagagccgacgcgtctccgcagtcccaacccaggccctgctcactcatcacggtg

SEQ ID NO: 24903 - DNA, 68 bp, Chlorella protothecoides
agcctgccaacatcagttccaaatgtcgcagcacatacctcgatacaaagctgcagcggcaggcaatt

SEQ ID NO: 24904 - DNA, 206 bp, Chlorella protothecoides
tctgtaagcgcgcggaggtggtaggacggtacatgcggctgctgctggagggtcccctcacaactcccctttcaacttctagtaaatcatcatacaattgcctcaagctgtataatacgcctcaccatcacactcacgcactttcaagaacgtgacattcatatctacaaatctctttgccttgcacccacaccttggttctcaaa

SEQ ID NO: 24905 - DNA, 363 bp, Chlorella protothecoides
acatcagcacagtgtccggtcaggaggggcgaggactcgcgtgcctcccgaatggaagagccttgtaccaacctgcttgttctatgatcgtgctgtccctcgagcttggtggacgtccatgggctgggggccaagtatccggtgaccaccgcgtcattcctgttatgggtgggaaacttgcctgtggcatcatggcctcccttcatttggtggcaccaatccattgagcggtcagctgcggcagtgcgagtgtggtgctctgcctgcggctgctgacttgcgcctgtccctgtgaaacgtcacctatggccctcaagttgttgacaaggccactcagatcgctgctgcagggtgcaatatctt

SEQ ID NO: 24906 - DNA, 61 bp, Chlorella protothecoides
gaggtgcaggatgcctgctgccccaatgccgatgccgaagaggatcagcaccaggccgcca

SEQ ID NO: 24907 - DNA, 69 bp, Chlorella protothecoides
agagccgccacgcatgaatgaatggacatgcatgtatgaatggacgtgcatgaatggacgtgcatgaag

SEQ ID NO: 24908 - DNA, 61 bp, Chlorella protothecoides
acgatccctgcgaacacaagatgtgggcgcaggtctgccatacaccgggatcttgaccgag

SEQ ID NO: 24909 - DNA, 72 bp, Chlorella protothecoides
atgtgccgactttacaagactcattggactagtgggtccctcgcatgcaggtggtacaagcaatttcagagg

SEQ ID NO: 24910 - DNA, 117 bp, Chlorella protothecoides
ctcaagggtacgtcgccggggggtgaggcccagtggtggccgagtttgctggaacccctctctggagggtggcctcacctgctcactgccgcgcacccctcacctcactctggagct

SEQ ID NO: 24911 - DNA, 136 bp, Chlorella protothecoides
cccacccccatcgcccgtccgagggtaatgctgccccgcacacgcgttgccctgactgcttgctgatccagtagattacaaacatgggattcacaaaaggtgcaaggtcatcttggccctcatttgcttgctgaag

SEQ ID NO: 24912 - DNA, 226 bp, Chlorella protothecoides
acgagttctctgcccctggctaggtgcatacacatgcaccgtgtgccgcattgtaacaacctgccctcgctattccagaacatgcttattgtctgaccaggttgaggcccagcatcgattctgagagggcaatcaggacagggagcctcgtctgccataacccgcgcttctatgacaccccgagcggccaccgactgcagacccgcgcgcccctgtcccttcgtgg

SEQ ID NO: 24913 - DNA, 61 bp, Chlorella protothecoides
gctggcctacaccccggaactgattgcttacgacgtttacaagcacctgccttccgggacc

SEQ ID NO: 24914 - DNA, 117 bp, Chlorella protothecoides
ggctggccagtgcgaccagctgacatgcatgattatgaatttccttcaatactatgtcctcatccaggcgtgggtcggatggtttttatctgggagctcaaccccctcctcaaagta

SEQ ID NO: 24915 - DNA, 128 bp, Chlorella protothecoides
cagcaggagggcgatgctggactgccggaggggggacagttcccttgttggagggtgcctcttgcgcccgcatgtcctactggctcagcaatgtacattggcgactgcaacaggccccacaagtcact

SEQ ID NO: 24916 - DNA, 75 bp, Chlorella protothecoides
caagctcgccagcgagggcaagaccgtgccggggagggcatcgtacgaggcctggatgacgtcatcgttcctctc

SEQ ID NO: 24917 - DNA, 669 bp, Chlorella protothecoides; identical to SEQ ID NO: 4358

SEQ ID NO: 24918 - DNA, 61 bp, Chlorella protothecoides
cacatctatgcgcagcactccacgacatcctttctgaggagtgctcccgggtcctcttctg

SEQ ID NO: 24919 - DNA, 83 bp, Chlorella protothecoides
cttgtcatgcgctcagctgcctgctcgtgtctctgtgcaatgaatgcagctttacagacattcaccgctcttctcctttgcag

SEQ ID NO: 24920 - DNA, 154 bp, Chlorella protothecoides
ggccgggtcatggagacccgtcgggggttgagcccaagtctgcagtctgcagtcatgccaccgccatgggctcccacctgagagggtgtacctgggggcgctgagccggtccgcgccatcggcatcgcccccttcccattcacctcccaggaca

SEQ ID NO: 24921 - DNA, 75 bp, Chlorella protothecoides
atctggatggggagggaggcaggagaggcaccgctgctgactattaacatccttgtacacatgctatgatcctgc

SEQ ID NO: 24922 - DNA, 61 bp, Chlorella protothecoides
ccaaccacacctgttctgagccgccaagtcacccgccgtgtggagcgcttgcagggaagcg

SEQ ID NO: 24923 - DNA, 74 bp, Chlorella protothecoides
caggtacggctggccacaagagatggtatcctatgtctcggaaggaggccaggccggggtgcaagacggtcctc

SEQ ID NO: 24924 - DNA, 61 bp, Chlorella protothecoides
tggtttggaatttgaattccgggcgcaaggtgcagttgacgtggcattcgcctcacgccat

SEQ ID NO: 24925 - DNA, 63 bp, Chlorella protothecoides
gccacacactcccccttcctcacgcagttacggtccccatgtctacatgctcgaggccagcag

SEQ ID NO: 24926 - DNA, 112 bp, Chlorella protothecoides
tccccacctcaccacattcatgccatgctggttgtagctgccaaagttgcagatcccctccacggcgattgcgcgtgctgccgcgtccggcagtgaataggccgacggcagc

SEQ ID NO: 24927 - DNA, 143 bp, Chlorella protothecoides
tgaggttggatagttttttcagacagcgtccgatgaggctcgacgtgaacacgcactttgttcgcgaagatgcctcctccacttgccgcctcccaaccccactccttttcccagtcccacccgactcacactccaacacccgg

SEQ ID NO: 24928 - DNA, 65 bp, Chlorella protothecoides
cggcgctgggcctcagatcgccctgcactacgctggtgtcctccttgtattatgtctggagaggg

SEQ ID NO: 24929 - DNA, 75 bp, Chlorella protothecoides
cccatctgcagttctcaaacgtacgatcccacgaggatttacacgcatacctacccatattttccggtgagaaag

SEQ ID NO: 24930 - DNA, 77 bp, Chlorella protothecoides
catacctacccatattttccggtgagaaagaaaattacggctaggatacaagccttggcaccccctagggccggccg

SEQ ID NO: 24931 - DNA, 61 bp, Chlorella protothecoides
ctcccattgcccacgtgcgacacggcgggggttcggcgcataaacacagggaacaagccac

SEQ ID NO: 24932 - DNA, 73 bp, Chlorella protothecoides
ctgcactgactttggacgttgcgatgacgcgcatccaaggtgccggtgccccagccagttgtgaagccgaggg

SEQ ID NO: 24933 - DNA, 119 bp, Chlorella protothecoides
ggtgggtggagactcgcatctgccagggagtacccacgcagcatgaggttgtgacctgagccaaggcaggaaaccagaaaggtggaaccacaggcaaattcacgctcttttctctccca

SEQ ID NO: 24934 - DNA, 61 bp, Chlorella protothecoides
cgtggaactcagcacgagattgcattttcaacagccagtccacagatgcaaagcccgcgtt

SEQ ID NO: 24935 - DNA, 109 bp, Chlorella protothecoides
agacttcttggcagatggtggtggggactttttggaaggaggcggcggtaagtcaaggacccgtgcgtatttacgaatttcgagcaggctacagtcgtttactatcttg

SEQ ID NO: 24936 - DNA, 66 bp, Chlorella protothecoides
gcggacagggaagggagctatggtactgcacgaactccactgccggctcagcaggcatccaaggga

SEQ ID NO: 24937 - DNA, 61 bp, Chlorella protothecoides
gcctgcactccgcatgcttcctaaagagccaccagcagccactcaattgaattcatgacct

SEQ ID NO: 24938 - DNA, 1449 bp, Chlorella protothecoides
  modified_base (205)..(347): a, c, t, g, unknown or other
  modified_base (519)..(528): a, c, t, g, unknown or other
  modified_base (822)..(897): a, c, t, g, unknown or other
ggcgcggcgccgggcacccccgccatggacttcaacatgtggatgctgtcctggggcgacctggacatccagaagcaggtgggggagggctccttcggccgcgtctacctggccaagtggcacgagacgctggtggcggtcaaggtgctcatggccacgggcgtggacatcgacgacgtggacgaggccgcgcgcgcgctgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagggggggcgtatgagggacgggtgagactcaaggccagacccccgcgcgcactcatggggcagccctccgtatcacccacccacccggtccacccctccaccccccaacctttcaccaccaccaccaccaccccaaaaccacttcccggcaggaggcgcacatgatgnnnnnnnnnngggggggagggggcgtctgagggacgggtgagattcaaggccaggacccccgcgcgcactcatggggcagccctccgtaccacccacccacccggtcctgccctccaccccccgacctttcaccaccgccaccaccaccccaccaccacttcccggcaggaggcgcacatgatggcgagcatgcgccaccccaacgtggtgggcttcctgggcctgtgcaccaacccgccctgcgtcgcgtccgagtactgcgcgcgcgggtcgctgacggacgtgctgcgcggcgcggcgcgnnnnnnnnnnnnnnnnnnnnnnnnnnnnnnnnnnnnnnnnnnnnnnnnnnnnnnnnnnnnnnnnnnnnnnnnnnnngcgccggctgaacatggcgctggacgcgtgcaagggcatgctgtacctgcactcccacgcgccgcccatcgtgcaccgcgacctcaagtcgcccaacctgctggtggaccgccactggcgcgtcaagatctccgacttcaacctgtccaagctgctggatggcagcccggtgatgagcagcctggccgccaccaacccgcgctggctggcgccggagatcctggcggggcacgccgccaccttcgcctccgacgtctacgcctttggcatcgtgctgtgggagatgctgacctgggagctgccctggcccacctccaacccctggcaggtggtcaccgtggtcaccgagggcgggcgcctggcagtgcccgaccgcgccgcgctgccgggccccgacacccaggactgggacgggctggacgcctacgtcgacctcatccgcgcctgctgggcccagaaccccaacgaccgccccaccttcagcgaggtcatccccgtgctcaggtgggggaggtgtcagtgtggggggtggggagggtgttcagggggagg

SEQ ID NO: 24939 - DNA, 744 bp, Chlorella protothecoides
gctctaggacggtgcaaaagtctctcctgaggaggagatctcctgaaagctgctcctggtctgtctttcaccccttagaatcaacggcgcagatgggacccactgcctctattcgacatgctcatttggaataagcattcaaaagatgatgggatttccacaggctcaggtgcaaagggcacgatcatgacgaccagcatgggcagcaggtttaatcacaagggacgggagttgcatccaaacgagccagcagacgtattatcctgcttctttgtaacattaaggaactccatctcagttggacagtgcagtccttgcacaggcctttgctgatttatcctctggagatgtctctctctttcagcactcgctctgatagcctcacagaccttgaacctgcgcgccgccaaccgatcgttatcaagcttctcatgacttgggtcatgacgatgtgctgtagaccatgcgctcaagacgtgtggactctgcgagacgctgtcctccatcactcggattctgaaagcattcgatcgccccatccaaccacactgattgccttggatttagcagcagatcttactatcacaagcacgtattgtcaagggatgcgcgatggtgatgcgggcgcagtcaggtgagttcccgttgcatcatggttgggtgatccttcaatcttcacggtgccctacttacataccttgggaggaggggttcccacttgatcaacaaccaggaatcggcagg

SEQ ID NO: 24940 - DNA, 61 bp, Chlorella protothecoides
tgtttcggcaaagcgatctcctgatcgctacaagccgtcgcatttgcaggtacgacatacc

SEQ ID NO: 24941 - DNA, 88 bp, Chlorella protothecoides
cggcagactgccagaaggcgtaggcgtcggcagcgtacgcggcctcccccgtggccctgaacagccaggcggcggcatacatgagctt

SEQ ID NO: 24942 - DNA, 79 bp, Chlorella protothecoides
gaggtggtaaatcacatccagagttgtgtcaatagatgaagaacccaacgtcatgagagcaagcatgccacaggacttg

SEQ ID NO: 24943 - DNA, 168 bp, Chlorella protothecoides
tctaatggcactcatgccgaggggtatgacatttacgtgcgatcctgtggaccttgctagtgtcaatatatagatctggtgtgtgcccttgactcattgtaccgcataacctgagaactgaagcagtctaataggaaattaggaaggataccttgaatctgactcgaa

SEQ ID NO: 24944 - DNA, 61 bp, Chlorella protothecoides
tacgtgaaaattacgcacatttggtgtacacccatgaaatccctgcatgcaacgacgccga

SEQ ID NO: 24945 - DNA, 66 bp, Chlorella protothecoides
ggggggggggggggggggggggggcattggacctgggaccctggctggcaggaagcgtggacaagt

SEQ ID NO: 24946 - DNA, 80 bp, Chlorella protothecoides
gcaacgcacgctagtctccgctcccatcttaagagggaaggcggcaagaagcggcagactgcttcagcaagcaaatgagg

SEQ ID NO: 24947 - DNA, 136 bp, Chlorella protothecoides
cgtggcatgtgctgttcgaggccatgcatatcgctcagtcatactctctcctgtgctgactactcacacccgccttactcctcaaatatcattacacaggatcccaagcatggatggcgagggccatgagcaatcg

SEQ ID NO: 24948 - DNA, 100 bp, Chlorella protothecoides
cttgcttgggtgcgctgaggctgggaggtgaggcacaactacgcgttgccatggcgcacaattatcgaccccccctctgcccagccccacttcacgacag

SEQ ID NO: 24949 - DNA, 75 bp, Chlorella protothecoides
gtctggtgtatatatgtgtggatgcgtgccgagatgggatgagggagcggacgaaagggcatgggacgggggcaa

SEQ ID NO: 24950 - DNA, 61 bp, Chlorella protothecoides
gcgatggagccctggctccatcattgccgttgtaccagccgcatgtgagaatgggttgggt

SEQ ID NO: 24951 - DNA, 77 bp, Chlorella protothecoides
tgttggcagtgtcacagcaggcctgccccccgtgctttgttattcttgtgcacagggcacatgcgcaagtcccagca

SEQ ID NO: 24952 - DNA, 122 bp, Chlorella protothecoides
gatgtagccaatacccgatcctcacagccgaaaaagcttgacaaggtaattagtatccaatatattgaatttccttaccttggtggaaatcgggggcaaattggtcatttcaagaagagtac

SEQ ID NO: 24953 - DNA, 99 bp, Chlorella protothecoides
gctatacctttggacgaggtgtgtttgtagccatcgtccagacctggctcgctaggggccgacggcgcagatcacggtgcttccaaaaccacaaacctc

SEQ ID NO: 24954 - DNA, 70 bp, Chlorella protothecoides
tctcccaggcactcactgccagtccccttccccaaatggcccccccctcacctcctccggcgcctccacc

SEQ ID NO: 24955 - DNA, 80 bp, Chlorella protothecoides
cgctgggcgcttatggacctgcaaatctcggcccctatgactattctaagatctcgcctcgatcaagctgctcgtgccgc

SEQ ID NO: 24956 - DNA, 61 bp, Chlorella protothecoides
gaaccacacggcctcctggaactgcacgccactgtacttctgcaggatctcagggaagacg

SEQ ID NO: 24957 - DNA, 62 bp, Chlorella protothecoides
ccgcgcgcgcgcccctccgcgccgccgcgctccgccatgatcttctccgccaccggcagcgc

SEQ ID NO: 24958 - DNA, 132 bp, Chlorella protothecoides
ttgggggggggagggggacaatcgtgaggatggaagccatgcaggggaatctggggaggaggaaggttagctgttcttatcaatttccaatgatcacatacgttgagagcctgtgggtagaatatcagccag

SEQ ID NO: 24959 - DNA, 73 bp, Chlorella protothecoides
gggacctgcctggttgggggactgatgtcgtgatcatgcaccatgcctgtgctgatgggcaagatatcggctg

SEQ ID NO: 24960 - DNA, 152 bp, Chlorella protothecoides
gcgccgacctgcgccgcgcctgcgccacgcccccgggaggcgctgcccggggcgaggcctcggcgccccgcccgggccccaccaggcgcgagaaccagccgaggccgggcgaggcccccgcccggctggatggaggcggtgcagcggcgggc

SEQ ID NO: 24961 - DNA, 61 bp, Chlorella protothecoides
gactgccccaatccgacagttatagcatacttcccagtccttcagcatccgctgaaagttg

SEQ ID NO: 24962 - DNA, 63 bp, Chlorella protothecoides
ggcttatgtactgcgcatccctccccatgcgttggaatccccttgggctgagccctggaggcc

SEQ ID NO: 24963 - DNA, 165 bp, Chlorella protothecoides
cgtgtggggtggggggcggttgggtgggtcggtggatggggacccccagctgaccattcgcaaagcctcaccatccctctcagctaccaggcacggtgtgccccaccagcagcccccaggacccccagcagaatatacagtccttccccttctaccccagagaat

SEQ ID NO: 24964 - DNA, 74 bp, Chlorella protothecoides
gatgcagcgcttggccacggccagctcctgcgaatgtgtgacgttggtgtgtgggggggggggggggggggggg

SEQ ID NO: 24965 - DNA, 123 bp, Chlorella protothecoides
tctgccgctcggcagattgcgtggaacatgcctgggatccacccgcccacccatctgataagccctccataggcccttcgacccccgctccccctccctcccaaccccatgcagctcgtcccc

SEQ ID NO: 24966 - DNA, 126 bp, Chlorella protothecoides
aggactgggtccaggacgccaccatcaggtaggatgcagcgtgcacagtgcgatgtgccgatcgtgagatcaggtgtgcatggccggctggtgacgcggatcccatgctcggagtttcatcctctt

SEQ ID NO: 24967 - DNA, 80 bp, Chlorella protothecoides
agtgagtgggccttgcgcgtggtctgcagtggcctgcgcttgccttgaactgcaggtcacacctggcagagtgatgattg

SEQ ID NO: 24968 - DNA, 849 bp, Chlorella protothecoides
  modified_base (237)..(394): a, c, t, g, unknown or other
  modified_base (525)..(774): a, c, t, g, unknown or other
ggggatgctgatactggcagccctttcaatctctgggaagtcctaggagcagtagtatacaccttgtaaccacccatcgtgctactgtatgatttgacgaaccctccaactcccaggcccccaaatatcccaccagtcagcttgatactcttacaccgcaacatggggtgggatattttaatggtgcacttgatccatctattgatcataggcaaaggctactgtcgacagagtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcacaagcggtatgggcattctcgctagagagcagtggatagtatcacgtgtgcttcggtggcagagtcaactttgaagggaatggggacattgttgccttcttgtgtggaggtgggaagttcttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtggggagaccttcttgggagagggaggagggaattttgtgggcaggggagggggggactttgtggggggggg

SEQ ID NO: 24969 - DNA, 219 bp, Chlorella protothecoides
cggagcgctaccatggtgcagagactcgtgcacgtcccagactctgagctctcctcccccccgtcaccaccatgccctcagatgggccgagccagcaaacaggccagtcgctggaatgcctgccccgccacacacacacaccactcttctctgcccgccatttgccccccagccagccctcacccgcgtaggagggccacccagttgatgtcggcgggg

SEQ ID NO: 24970 - DNA, 146 bp, Chlorella protothecoides
ggaggtcattgttcccatgcattggggggattttttgcccaatcgcaagtgtcattgagagcgctgagagagtgatacatgcatcagcgtgcccgtcgcaacttccaacgtctccgccgacagggcctggtgttctgcgtcttctt

SEQ ID NO: 24971 - DNA, 71 bp, Chlorella protothecoides
gtgctgcgagcgctccggctgctgaacagcccccgtgcgctgccgctgcgctgcggctccgcggaggacgg

SEQ ID NO: 24972 - DNA, 245 bp, Chlorella protothecoides
tgtggtgggaagttggaggggtccaaggatcggatagggcgaagtggggggacggtcatggttgagtccaagagggccggcccccgtcggctgtgttccccgagggcgaatcacccacgatcgcgttgcattctctccgcttcccaacgcactcctcaatccatgtcacctgcatccccatcccattcaacccccttcaccccacccccccccatcacacacacacacacaggctgaccctggac

SEQ ID NO: 24973 - DNA, 78 bp, Chlorella protothecoides
tggcaggccggattgtcaatgtgaaagtctcgtgcatacagtcttggacccccccgccctatttgccaggtcgctgaa

SEQ ID NO: 24974 - DNA, 75 bp, Chlorella protothecoides
atataatgatatccttgcactcgataatttactactttctatttttacatcggtatatgacacccaggatgccta

SEQ ID NO: 24975 - DNA, 111 bp, Chlorella protothecoides
tgagagcaggtgggagtggctgtgacggtcatgtgcaggaggcatggtgtggcatgtgaggggagattgtaggagcgtggtacagagagtagctaggggttccagacccat

SEQ ID NO: 24976 - DNA, 95 bp, Chlorella protothecoides
gtgcgagaaagcattcatggcagagagtcatgtaagcaaccatggcctacacagcttctgtcgcagccatcagcgctgtgccaggatctcgggga

SEQ ID NO: 24977 - DNA, 120 bp, Chlorella protothecoides
tgtgcagatggggatggggaagaagagaggaaaagggtgagcacgatcaacaggctcggctatggttcgccaagccagatggctcctcgcccagcagtgatgtctggattcccatgcaag

SEQ ID NO: 24978 - DNA, 61 bp, Chlorella protothecoides
caggcaggtgcgcaggtccatgccaaagaccgggaagtagtcctctggaaacgagtggggc

SEQ ID NO: 24979 - DNA, 61 bp, Chlorella protothecoides
tgaaccctgcggtgggtgtgttgttgtgaacccagggggcagagggagagagagctggatg

SEQ ID NO: 24980 - DNA, 61 bp, Chlorella protothecoides
tagtggtctggcatgcagggattccccagttttcagcacatggcctcatcaggagcaggtg

SEQ ID NO: 24981 - DNA, 21005 bp, Chlorella protothecoides
  modified_base (658)..(667): a, c, t, g, unknown or other
  modified_base (1207)..(1216): a, c, t, g, unknown or other
  modified_base (1782)..(1791): a, c, t, g, unknown or other
  modified_base (1955)..(1964): a, c, t, g, unknown or other
  modified_base (2033)..(2042): a, c, t, g, unknown or other
  modified_base (2812)..(2821): a, c, t, g, unknown or other
  modified_base (2987)..(2996): a, c, t, g, unknown or other
  modified_base (3360)..(3369): a, c, t, g, unknown or other
  modified_base (4101)..(4110): a, c, t, g, unknown or other
  modified_base (4526)..(4535): a, c, t, g, unknown or other
  modified_base (6062)..(6071): a, c, t, g, unknown or other
  modified_base (7212)..(7221): a, c, t, g, unknown or other
  modified_base (7940)..(7949): a, c, t, g, unknown or other
  modified_base (8465)..(8474): a, c, t, g, unknown or other
  modified_base (8833)..(8842): a, c, t, g, unknown or other
  modified_base (9896)..(9905): a, c, t, g, unknown or other
  modified_base (9995)..(10004): a, c, t, g, unknown or other
  modified_base (10125)..(10134): a, c, t, g, unknown or other
  modified_base (11325)..(11334): a, c, t, g, unknown or other
  modified_base (11647)..(11656): a, c, t, g, unknown or other
gccggcgcaaaggccgggggctccgcggccggcccccgcggcacgagggacgagcagggcgccgcgctggacgccctgctgcgcgcgctggaggcgcgctttcccgacggcagcgtgcgcgagcgcgccgccggcctgcgcagcctgagggactcggccgccgtcatgggcgcggcggccgtacccacggcgatgcaggacggcatcgtcgactggtacatccgctcggcgctggggcagcgctgagggcgggggcagtgcgcccctgtccgatctttctccccgggcgccccccccccatgatgcagccgccttgaatacatacccggtctggttttcggcccgtttccatctgaatcccggggcagagcgccctttgcatcacctttctggcaccttgccgcacagtcttcctcgtcgtaattgagagtcagtccgcacaccacccctcgcatttcgatattgcatggcaagcagcacttgtctcgctatcctcgtccatttgcaaccattccatgagtgtaaaaaccagattgtgtccaggtcactgggtacgacgagggccggggctgatgcagagaatggaagtgtgcagggaggggtcgatttcgcacaggctcagggtgtaagatggaggcgcgctaggcgccgggggctnnnnnnnnnnacggggaggtgtcgatttcgcacaggctcggggtgcaagatggaggcgcgctaggcgccgggggctgcgccatacttctggatctgccactgcacgcgacgggggttgggagggcgaggcttggtgggggggggatcgtgagctgccactacgtgccactacgggctgtagggtcaacagccagagccctcctggtaacagggccggcaacggtgagggcaggccgccaatggatccctctccccagcaccactcaccacatccatgatgccgggcggcacgctggcatccagcacggccgcaaccgctgccctgcccacgacctcgaccgggacggggggcacgaacgccgcgccgacgatggggaggtccgccagtgactgtgaaggcagggcactcagcaactgtagggatggagaggagggtgggcggggaaagagtttggggtttgtgtggggggaaggagtcgtggttggcgaagggtgggcggcgcatggtgacacggcgactcatcgtggcacgtggatgaatgtcgctcannnnnnnnnngagggatggagaggagggtgggcagggagagagtttgggggttgtgtggggggaaaaggagtcgtggttggcggagggtgggcggcgcatggtgacacggtgggtcatcgtggcacgtggatgaatgtcgctcaagtcaaaccctgggacaggtggctttgacgcaatcttcgctgccctctgcccattcatcgcgtctaccttggcccagggtgtgccgaccacgctgaggggcagcgacactgaacccacatcccgctcgccatggatgaagcccggccgcaaggccacgccgcctgtgggaaaggagacggccagctccgcctccgcatccctcttcccctggaagtagcccttgagaaggaagtcctgtgcatgccagccccctgcagccagacgaggtgagatgagatgtggcaacctaggagcagaagccacccatgaggagagaatccacagctggggaggggaggcatcggacgatagatgtactgacaagtgcgcactcgtcacccgcacagggcaccaactttcttccgggagacagcgctcctggaaacccctcnnnnnnnnnncaagatgagatgtggcaatctaggagcagaagccacccatgaggagaggatccagagctggggaggggaggcatcggacaatagatgtactgacaagtgcgcactcgtcacatgcacagggcaccaacattcctccgggagacagcgctcctggaaacccctcnnnnnnnnnncactgccaccaacgcctgaggttccgcccccactcccgacaccctgggtaccttgtacatctgttcagnnnnnnnnnntccaaagacatactcggcagcttgaactcgtgcaccgaaatgaacgcaaatcgcggcacgccggccgcagccgccgccttcatcagcaggatgttggcctccccacacgtctacagtagagcaggcaggacaggtcgaccatgctgtacattacgaatccaaaagtgcggcaggacgagcatgtctgcaccatggaaaccagcccccctttcactggatgtggatgactcagcagagggcaaaactgccaccaacacctcagattccggccccactcccaacaccctgggtaccttgtacatctgttcagtggtcccaaaggcgcccagggtggaaatcacgcctgtagcaccctccagcgccttgcgccagggctgggcagggtccagagcgtcgcccagcgtccattgcacggcgtcgccccacgttcctggccccaccttctttggccgccccttcctgctcacgctcgtcacatctgcaccgcgatccaggccagcctgcaggacccaggtccccacaaatccactgcctccaaagaccacaagtttcgggagcccaggaccggggggggctggtgtctgctccgcacagggggcgaaggaaggggatgagcggtgctgaagaggcggctctttagatgtacgtgaagctggaggcccgagacttcccacgcacctggacagaggctgggtgcagtcccggccccgctgccacggtgtatgaccggatgaacctgattttattcaaaggaaatgttatgtggtctnnnnnnnnnncgctgggtgcaatcccggccccgctgccacggtgtatggccggatggacctaattttattcaaaggaaatgttatgtggtctcctttcggtacgagggatgcatgtcagcagttgcacacatgcgaggcgccgtatgtccatgcattccaggtcgtgacccacctnnnnnnnnnnctgcatgtcagcagctgcacacttgcgaggcgccgtgtgtccatgcattccaggtcgtgacccacctcgctgatgctctgaataccgcagacgagactccctctttacagtaacgtgatgcatatgacgtccacgcggatccgctgagcttgaaggcgcccatcatcgcggtttctgggtctccttggaagtgatccgggtgcgggtgtggcacctttggtgtggcacctttgctctcgtaacacagcggtactatattcgatgcattcaagtggatataattatggatgcaaagcctttggggttcctgacccggtgtcaaatgtagcaccaccaccatggcgcgccactgtcggcccgcgannnnnnnnnncactatattccatgcattcaagtggatataatcatggttgcaaagcctttggggtttctgacccggtgtcgaatgtagtgccaccatggcgcgccactgtcggcccgcgaggatcttcgatcacccacgacggaatgccgccagaggccaccaatgccttttggtcaaaacgactccctccatcagtctcacagtgctacagtcagcagtcatacaaccttttgaggccctatggtttgagcttggcatgttgcgccgcccacgtacagagcttggatccgtgggcggtcacccatgctgcattcgtctcgatggtctctcgcgcccgctcgaggtagatcccctccgtgacgacgccctgaagaggtggaaatgggttgagagttggcgttggttgagatgtagggcatgggtctagtggctctgtgtggctgcccctcggcagtcttttccggcctatatggaggaaacccatccttgacgacagagtctagcagtgcaaaaccccggcacccttgcagatgaagctcgatccccacagtgctcccaccctgctggcagcgaagacggcctccacctccgggatcgcggtctggttggagaagagggacgccacgctttccagcagggaccccatgcggcgtgccccctcgttccctcctgcccaggaaaaagacgtgtggaagttggcgttcagcccatgtcgtatgcaacagtcccccatgcccagtnnnnnnnnnnaccggagaaagatgtgtggaagttggcgttcagcccgtgtcgtatgcaacagtcccccatgcccagtcgccaccagttctccgcctctcagacccccccgccccacctccaagcttctcagacactggcctccacttccggcccagccaggcccagaccaggcctggcgtgtcggggcgggtccgggcggcggtgacgatgacggtggccatgtcctgcgaggagaagcgcggcagaaggggagggggtgaagtccacgaggcagcgagggctggcgtgcatggtcgcagggccagggctcgcctccgatggcacatgtgcaccatccttggttctccagcgaggtgacacagaatgcaacgcctcgggtggaccgtccctcccgctcgccacatcccacctcgctcgttttcccnnnnnnnnnnccagaatgcaaagcctcgggtggaccgtccctcccactcgccacatcccacctcgctcgttttccacgtccctccccaaccccgctcccaaagaaaactcccgctcacctgtgcgcggacctccggccccaggctccagtccaggggatcggccgccgcccccggcgcggccgccagcgcgcgcagcgtgcgctcgcgctcatccgcggcgtcggcggccaggtacagccggtgcacgccctcccacacgtcgcggtgcccggcgcggaccgccgtggccaggagcgcggagcgcgcgtccgggtcgacgctgctggccgtcaggttgggcaccagctccagcgcctgggcctggaaatggaagcgagagggggaaaagggtgcatagtcctggatacatccgacgggcttggggcctgcatgcccgtgcgtgacgcatggcgggcaggtggcgtggcccccctttcctccactcgatcccatctcaccgtgatggccaggtggccgtaccgcccagccgccgcaaggatggcggggcgcagcagtcgctgaccgacccccgccccctccggcgccggggcatcgaaggagaaggccaggggcgggggggcagtgctggtattcgcctggccccccgcgtcctggcgcaggaaggtgttgaacagggtctgggccaggtagttctgccacagcgtgctgcagggggccagctgcgccacgcgctccaggtaaggcagcgccgccgcccagggctcgtagtcctccggcgagcgagcggccagcgagctggatgggcgtgtgggagggttgaaggggggcggggtggcggtcgggtcgtcaagaggggggacccccagggcctgaagaaccgaggaaaggctgtgcgcctcgccaaggaagcctccgcacgtgcccagtgcgccggtgggcagagggacggttgcagccctgggatgcgactcgtcagatttcccaacacaacccagccatccgcgatccccctcacggcagacccacccaccctcgcgcgccctcccctggaatggcgcgcacccgacgagattcagaaaggtgtcgatgcccagctcccctgcctcggccagcgcccagctgtcctccagcaaccccgccaggtcagtgggaggcagggtcggggcggccgccaccagccgggcccacagggcttcgtcgtactgcacccggaagaagccgtactgcccggcgttggccttgacccaggtgccggccgacgccgcgttctgcagcacgggcgccgccgactggcagccggagaactcggtccaagtgggtttgccagtcggggtgtcggctgtggccagggccacggggagccagaaggcggctgtcgagtcgcagggcgtgacccctgcgatcccgaatcgggactagaatcgtggggagggggcagcggatggcgtgagaggagcttgaccccagcgggacgtacatagtttccatgcttggggtttggatgaagaatcaacctccggtctttgtgcgctgtgnnnnnnnnnngtaatttccatgcttgaggtttggatggagaatcaacctccggtctttgtgcgctgtggaagctcatgccgtcccgaccccaacagggaccctgaccaccccctcgagccaccccaatgccaccaacgaccagacctgctggagccagacgcgccctccctcgtccagggagacgcgcaccaaggggtagccctgctggtacgtccaggcccgcatcctctgcgcacgagtggagagggaggggtgaggggtcggcacgggagtatcctggtgccaagagcccctgtcatggccggccagctcctaccccagggaggtggctgcatgaaacataggctgtgtcttcctcagccaagcattgcctagttccccatgaaaggtaacccatccaccttggggaggtctgggagtccgagtgggccggccagggccctccacagctctgaccctgtggtcgcattgtaggcgccaaggttcaggtacgcctggaggcccgccaggaaagggtcctgcttggagtgagttgcatgtatttattggcacgggtgcaggggagatcacacgggattcagaaaggagggaacaggacagctccacccggccgcagtctgacaaccacccaacacctccccacctgggcggggttgatgccagcggcgacctccaaggcgcccaggcccgccccgcgattgacccaggcgcgcagcatgcgcagcacagcggcgcccttgttgtactcgatggagtcgaacagcgactctatcctctccgaagtgttgacgcctgcaatggtgtgagggggttggcttggggtacctgtcattcgtcgggagaaccccccgcacccctgctggcttgaggctgggaagactgcggcgaccctgcccgagcgcgcccctcagcccacccccatcatgccttgtgggatggacagcgggtggctgctgttcagcgagtcctcctccagtgcgtcggggagcacatcagtgtagaagctgaggaagatgtccagctccggggaggctgcatgaggcattgtatgagggaaatttgagacaggagttcccaccctgaacgccacttccggcccacaggcttgaagcctcaagcgggtcatcagaccagcccgacgtccgcaaannnnnnnnnntatgaggcattgtatgggggaaatcgagacaggagttcccaccctggacgctacttccggcccccaggcttgaagcctcaagggggtcatcagaccagcccgacgtccgcaaatcgcagtcgaggcaggcagcagccctccctgtgacctcaccggcctgagcgcccaggaactccaggtaggaggcaaagccctcgttgagccacagctctccccaccactccatggtcaccaggtcgccaaaccactgaggggatgatgagagaggggtatgatgccttgtgtcccttgaaacagggccaccacatgcagcttggggcctgtgcattccacaattccaggtcctcagcatcggcagaccctacacaagcaaaggacccgaagaacaacgcccagtccctagcccctcaccatgtgcgccatctcatgcgccaccaccttggcaacccagcgccggtcggccaggctgctggtcggggaggtaagcagcgccgtttcccggtacagaatgaggcctgctcgggggttgggaggggccacggagcggtggtggggaacgtgtggccacagcagacactgagaccatggatgttcatgttctccttgattcaaacacaacagcaatgggcctgccacccaccagtggacgaccccctcttgccccttctcagcagcaatagccccggcgcagcgacgcaccccagttctccatggcgccnnnnnnnnnnctgcggccacagcagacactgagaccagggatgttcatgctctccttgattcgaacacaacagcaatgggcctgccacccaccagtggacgatcccctgttgccccttctcagcagcaatagcccgggcacagcgacgcaccccagttctccatggcgcctgcagagaagtcggggatggccaccagatccagcttgggcatggagtacggcaccccaaacgcggcctcgtaggccggcaggacctttgaggcgatgtctgccgcaaactccaggctggcacgcctggggtggaattgaggagcgggcacagcgtgagcatggtctgaaggagcaacccaacctggaacgtggctgggtgcccaatcagctctcctcgatgacatggcatgagaagggttggaaccccagggacagagacagcatggcatgcatgagaggcttggatttcttgctggctcttgtcatcaagcaatggacccagaattccaacattcacgctccctccttgcaccannnnnnnnnnctcttgctcgctcttgtcatcaaatgatggacccagagttccaacattcacgctccctccttgcaccacacccttctcctgccgatggggagaccattgtcccaccacccattcacctgtctggcgttccccagacggtcacgttccgagggtctgcccctgcagtcgcacccggggcgaggcgagaggtccccgccagctccccaatcacaatcgcgaggaggtaggtggacatggggggcgtgggtgggaagtgccagcttgccaatgccgggccatgcccctctccctcctcatgatgctatggggaaaggaggggagaatggaagatagaggaagtgagtctcatggcccagacnnnnnnnnnnggccaatgccgggccctggccctctccctcctcatgatgctatgggaaagggaggggagaatggaggatagaggaagtgagtctcatggcccagactcatccttcccaagggagcggccggcagcctggggttggatgatggtgggtcattgacacaaaggagctgtcccccgccaccctttcctcacatggtgtactgcgctggcgggcatgttggacagcacggtgtaggttgctggggcctcaacggtcagcacaaagacggcctgtgcggggtaccattgggagcctcagcaaggggctgggcacgcgcccagatggtctgcgggtcacccctgtgggtgaagactgcagcatgctgacaagcgtacgggcccagcactcctccatcctccacgcaggcgacatcacatgcccacttcttcaccttgagggctggctcgtcaaagcaggggaaggcggagcgcgccgacgtcgcctcaaactgcgtggtggccagactgtgcgtatcggcccccagcgtgtacgagctcctagagggggaaggggaacgagaaggggttagagagctggcaaactgtgcatgtcctgagagcccaccaggcagctgccaggcgctccttggagcagggcagcggcagcacagctgggacgttggcggtgatgcggtgccgccagaagaccagggagaggcagcgcctttcagagggtttcccacatctgcatcccaagctcgcagccctgcctcaccgtcccccgccaccaaccgccctcccaccgcacgcggttacctgtaaaacccgctgaggccctcggacaggttgtaggcaaagcggaagtgcaggctattcccctcccccggctgaagggtggagggaaattgcaggacgagctgctggtgccccgggcggtccctcagctcgccctgtgcgccgccggtgccattgcccagccagacgccctggatgcccaggccggaggcggcgtgcaggacaacgcacctggcggcctgcatgtgagcaaggggggagactgtttgaaaggacccctgcannnnnnnnnnggctcgcagccctgcctcgccctcccccgccaccacccgccctcccaccgcacgcggtaacctgtaaaacccgctgaggccctcggacannnnnnnnnngcgctatctgtgattccaaataaccaaggttgagaggtgccgcagcacgggaccatctggcaggggatccgcgccacggagagccctgtatggccccctgaaccctgctgccccggggccnnnnnnnnnnccgctatctgtgattccaaataacaaaggtcgagaggtgccgcagcacgcgaccatctggcagggcatccgcgccacggagagccctgcctggccccctgaaccctgctgccccggggccaggcaccttacggggcatcgcctggtgacattcagcgcaccgcctccccgcctccccttccctctacctctaacccacaccaaaccatgccacaccttggtcacattcaggtctatggtcaggctgccctccacggcgtacggcgccgccatcttcgtgcccagcgtcagcgcgtaccggcggggcacgatgcctgggggcaggcgtggctccacccaggcgcagtactctgcgtcgccgcgcccgatcaggcccggcagaatggagtggcccgaggcggcggcggcggccagcgcagcgatcagcaggatgaaggtgagacagcaggcggcgccggagaggagcaggcgcctctggcgcttggtgtaggtccaccaccagtcaggggggcgcgggcgagcccaggagggcagcgtccactcgcggccgcagcagcgaaagcggcgcagccccgcatactgctcccaatccagcagggcgtcgtcgtcgctgtagtccagatccaggttaaacacggcctggggtaaagtgggtcatgggaggttcagagtgggggaagagtgggtcccagtgcatggggaaacccaaaccatgaagtgcctggggacagaccagaggaactcacagcgtcactgctggggcctgtcccagtcgtcaggccccgacgatcctgcgaaggggacaacccagagggctctgcatccagctccacctcgtccagggtgaaccggggagcggtgtaccctgggcggccgttggcagggggcccagtgtcgcgactcatggccaccgccaggtatttggagaggattcagggaacagctccggcggaataaagatacccaaaccgatcaaaagatcggtggcgcaactttctcctttgatcgtggtgtgagcgcgttaggagagggtgcacaccaaggactcgagtctggatcaccactggtcccctccgcggcgaaggaaggcacaagaggctagcttgctagggctctatactgaatagtatagagcaaggttgcaagcataccgttcatgcgcgctgggatcccaagcatggcagcaaaaatnnnnnnnnnnccaagaggctagcttactagggctctatactgaatagtataaagcaaggttgcaagcatgccgttcatgctcgctgggatcccaagcatggcagcaaaaatgacattgcgcgcagggaaaatcgggcgagatcgacctcaaggcattggggatgttcccactcggagggaactgtgccagatatgttatcacacaccgccgcatcggagctctgcagctcgcaagcattcacctatactgaaaaaacgtctgaggaccactattaacaagggtcaaggccagtacttggcattccagctctgagcctcaagcnnnnnnnnnncaggcattggggatgttcacactcggagggaactgtgccagatgtgttatcacacaccgccacatcggagctctgcagctcgcaagcatttacctgtactgaaaaaacttctcagaaccactagtaacaagggtcaaggccaatacttggcattccagctctgagcctcaagccagccagtgagatgctccaaaccagccacatccgaggcagtgaatgcggcggggagatttgagtcaatgtccagcacagcaatggcagtgccattgctgcgatcacacaccgggaccacaatctcggagagggtgctggaggcgcaggcaatgtggccagggaaggagtggacatcggggacgagctgcgtcctggcttctcgagctgcggcaccgcacacgccgcgggagaaggggatggtgaggcaggcggtgcctccctggtacgggcccagcttcagcacgccaggggcagttgtcctgtaaaaccctgtccagtggaaataatcgaatgctgcatgcagctcggacgcgacagtggacatggccacgatccagtcgtcttcacctgatgcgagggtgggagggcaggacggctgagtgatgggatgcagcagggttggtgcgtcatgcatttgactggtggcagtgagtgtcctgagaagacacagatggcgaatagtcctccaggataacgaccaacagtatatcctgccgatacttaccatcaagcaggagcactacacgctcaaggacagcagcgtactgctgctctcttgcggcgtcacctgcacccaccgtcagcggggtgaggaagtcggccaccaccatgggtgggagaccgattgtgaaccagatcgatggattcaaaatgctacaactgttcctcttctgtgcatggtcaatcaggtcagggcttcgtgacgacctcctgggatcttaagcaggacagcgatcaacgtcgagcttcgcgccttggcaccttggcctacggggtgctcatcatgcatgaagatggcaagctattcagacataattcagttgatattcaaatcaggactctctatttttaatacttgaacattgttgtatttcgtcgtaggactccgacggagggtgccgagcccgagcacggagggcctgccactgcactgcccaccatggtacccccttccctcttcgccggtctattccctgtggcaaaggggaagcccctggatatttttgcgagtagtaaaaaattcaagtccaaggtgcgctcgaaacctgatgtgctgctagctgcagcagtgcaggctgcgagccaggcagacacggcagcagctgtgcctgaaggaaagcctgcggcctcgaaggcttcagggagcaaacagctgtccaaagggcgcccgacatcagcagcagtggccacgggggagccagcagccgaggccgctgcctcgagcattcctctgcagcaagacaaggcagcgaagaagcctggcaagggagcggccctcaagaggccgtcgccggagagtgcctctgagggcaaggccaagggcagcagcagcagcaggcccgcgtcctctggcaacggcagcctgccgaaaaaggctcgcaggaaggaggaggtgctcgctgtgatcacaccagccatccaggaggctgctgccgcccaggctgggcccaaggcgcccgacgcagagacttgcacggctggggacgcagacgctgcgccgggtgccagcacccagccggaggcggtcgagcggaagatcgacgcggcgctccacaggaccgtcttcgtgggcaacctgcctgccagcgcgtcaaggaagagcctcaagcgcctgttctccaggtggggcctcttggagggggcagccaagcattagaggcatgcatgggaaggctggggatgtagtgcctataaaatgggttgccatgcctgcctgagcatgccggcaagtgtttccactgtcttgcgtcccaaaacaggctgctcaggagtctagaagattggggcaaggaggttccaccccaaacactggctacccaggctgcccgtctcacacacttgcgtcttgtcattcctgcctcacgatgcagctgcggcgcggtggagtctgtgcgcttgagatcgctggccatcaaacaggacctgaagatgccgcgcaagtccgcgctgctggcaggggaactggacaaggaccgcgcctctggccacgcctacgtggtcttcgaggacgaggcaagcctcccagctgccctcgccctgaacatgatggaggtacgctgggttgtgtgtgtggaggaaatgttttcaacgccaggcggatcctgggcggcgtgatacgcgaatgcgccagactccagtttatatccctggtggccgtcctacatcctacccgtacttctctcccagcacgaggggcggcacctgagggtggacagggcggcagcaaaccgcagcgtgcagagcgcaggcggcggccccagcgtgtcgaaggaggaaggtgtcgtgtacgacccaactcgctcagtgttcgcaggaaatctaccccgcagcgtcgaggtgagaggccatctgttgatgtgtgtctcctggggtatgtttctgaatatcctgcacgttgctctgcacagcggagcaagcaggcaggcagtcggcgcggagaaggccgccgagccagcaggtttctcaccacgtgccacggacgccatcattccacgacaggatgaggatgtgatccgatttttctccgacggcagcatcagcagcgagcttcggacaggcattgaagctgtgcgcgtcgtccgtgatcgcaagaccacgctcgggaagggtgagtgggcggtgcacgggggctgcgggctgcatgctgtgcatgagcaaggggtggaagtagatgcaggcctgcacacgtgaacgagaaaggctgcaggagcagggctgattactttgaatgattgagagcatgtgtgctctcaggccttcctgctggcacgggtgctcctgtcctctggcaactcaatttcaagaatgcccgcctgaccagcatcattcgcatgttcccctgtggaacacagcaatgccttgcgtcctattgctttgctttacttccacaccctctgtccgacccacccgattcccaatcaccacgctgcaggcatcgccttcatcctgtacaagacgcgctcagccgcccgcagcgcagtactgctggacgggcacgaactgggcggtcgcaagatcagggtcacgcgcgtcaaggcctccgcggtgggggcgggcgcgtcagcgtggcagggcgccacggctggacccaagcgccgaggcgtggccgctgcgggggtggccgccaggtcagcaaagggcccagccaagaagctcaagcgggcctcggaggggaagcggccggcggtggcggcgaggaaggcgcgcaccctcgccaaggccgcccgcagggcctgagtggaggagacaccgcggtgcaagagggcagggagtgcgaggtgccgggcaaaggttggcgcccctgccttggctcttggtctccaggctttcgatgtggatcctttccgcaggccttgctgagatctgtgacaagcaccatgacgagcatgcacgcctggtgggaaaaggctcaagcgatcagggaaaagcatcaggtgccactcacactgctcgtgccatctgcccctccacacactcacgcgcggctgcacagctgtcaggagcgtcgcctgcggcggtcttgccgctcgtccacggcatggcccctggcccgctcgacggcccggggcgaaggagcagagcctcgcatgtccgcgtcgccatgtgccctcttgccatggcgcggcacggccggcgcagcgcccaccgccttcccatcgagggcggcctcgtacttctcggctgcatgccgccgccgcagctgtcgctgaagcatgtcacgctcctcctctagcgcatgcgcccgcgattcgagctctgaggggcgttggaggttgccaggggtgggtgaggtggccaggcactgcagcacgcagaaggtgcagtgatgccatctctttctgcacttgagggggggccagctctggccctgtcctcacagcagacttccactcccacccgcgttgaggccccaccaagacatcgcacccagcctggaagcatgtctccctgcaagacaggacacttcgtgccacccctgaacacaccgtcgtaagcagcctgcaaatcccgcagctctgcccgccccagctccatgacctgcttcagacctccagcagcagcagggaagggttcttgcctgggtcctgccgcctggacctcctccatgccctggtgtcacacagtggatttgagaggtggcggcggtgatgggcgccgcgaggagcaaggagctgtgccggtggtcgccgcaaactgcccccctttcagtattctgaacaatccaacatgtcaattccaagccacacaaaacacttcctgtaaacaaaggcagtgctcatcaccttgggtgctcgggggtatggggcggccgtgaatcctggtggccctcgcttaccagcctgcaggcaagagggagcaagcacaagcaatctgtgcgcataccgactggcacagctggcaaccccaaacaccatgcacagttgtgccccgcccgctttgcctgccctcgtccagattttccctgcagatgcgaccccacctcagcaaacaaccaaacgccaagccacggcggctcaccctcccagtcgcagggtcgtccggtccccggcccgacctacgctccaactctcgcttcagcctcgccagctcagcgttgacggcggggtccaggagcacctgccgcagctggaccacgctcggttcggcggcccgttgcgccgccgccagcgcatccctcagccgaatgttctccagggccatcgcactcagggaggcatgcagctgcgcctgcgcggcctgagaggtccccagctcggtgcgaagggtttctgcctcctgctgacgcctgcagtgggttgagggaagttaatctggtggatttgagtgggaggaaggatggctggcgcaagtgtcgacgagttggccctgatatacggcccacctttggagctcggccacgaccacctggggctccatgcggccggagaacccggcaaacagctgttctctctccccatcaagagcctcctcccatgcccgtggggcatcaagcgcggggtctggggagggaccatcggaagagcgcgcagcggcctcctccggcctgtccccggcctgtgggggcgcggatgcctgagggtgcatcagatgacaactccagtcggcatgccaacctgtagacggcttcaaatcatgcaggcaaagacatcagacgaccgtgggaatccattcacattcccagcacctctgcaagcacagggccctctgaaggttcaagaggctcgatctgggagtttacagacacggtcggtagatcagtgtacacatcgccaaattcttcgtcctgtggagagggaaaaaggatgagagagtcggcgatcgctttgatccttcttggcgccaggtgatgctctaccctctcaccgcacctcatccatggtatacgtcaccgagggaccactgatgtgcagcaatgcattctattacgttggtatctagaaatcatcgtgcgagcatcagcttgtctgcgtggtcaggtgtcagggcgaccctgttccggagggcgagcgtgacgccagcgcatgcaccgcaggctctcgtcgaaagctttgctgctccatcgtgcacgcaaagcttgtcattctgggaagataatgccctgcatcccctattttactctctagatagattgctcaacacacgcttgtgattttctgccgccctgaagggctgtgcggacctactccgtggggccggggatggcacaaaccactctcgtgtccctttcaggcaaaggcaccaacccgaagaccacgttgtatgtcggcggtctcgaggagagcgtgacagatgccatcctacacgcagccttcatccccttcggtgacatcaaggacgtatctgtccccatcgaccatgccagcggcaagcatcgcggctttggatttgtagactttgagactgcagaggacgccgcggacgccattgacaacatgcacaatggaggtgggtgtcttgtagggctgtggagtgggagtgctgtggttctggcatgggcagtgtgggggcaagccactttccatcacatgcgagggtccctggcgcaattgttgcgggccaggctccaagccagatgtgtgcggtgtcgtgcccactgcacacgcccaccaatttctcacagagctcttcggccgtgtcctgcgtgtcaactatgcccaacccatgaagatcaagggcggggacaagggctgggcgtcgcagcctgtttgggcagatgctgatgactggtaggctgctgggtgggtggggtggctgacaggcgtggcactgggagtgtttggtcctggagagccttttgttcgtggtgtggctgggtcgagggaggcctctatgtgacgatttggtggtgtgttatgactttgagctggcttgcttgcggatccttcatgctaatcgctctggcgccctcgtcaagcactgagaggccatgatcaagctcagattcatcctgcctgacccttgcctccttacgtaaaaaaacaggttcgagagggccgaggcggagaaccagctcgaggaactagaggaaagggaggccaaggctgctgagcgggcagctctcactgcagccgctggcctggacgccatgcaggcagttgaagcagagggtgcacagtagaatctcctgccccactcaacagcactcctggtaaacaattgttatctcctgattttgcaccactctccttccgctgactggagtaagggtcccctgccgaccctcttcttaaatcttgcgctacagccttccttctgctcctcattatcttgatgacaaaaaggtgatacagcccacatgcaggccagcaatacaatgccacatcagggagtgctaaaagcttgggcttggggtgaggggccctgtgtctagggggacatacaatggagccccttcccgatgatggaagggttggtttggggcaggacagaaggcggtggtggtacaggacagcgcagttgtctggtgagggtacaggagggccactggagggcaatgggctctcggcgcgggagcggtggggtctcagacatgggtgtttggcacagccgagatgttggcacagcgtgagcgcatccctcttgggtggagaactcccagggtttgctttgggaatgacgtcacaggaggaggtgtgacttcacaccatctcgaagggatcctctacgtcgctactggaggagagggaggcggaggtgaggggcgagacaggtgcccgactgtcaagcccaagaaccttagaccgctccaagatgaatttgtgctccttgtatcgctcccgggggtcctgagccctgatatagagccaccctaccacctgtgaggggaaatggtgggaggtaccgtgtgagaatggaatggtggaagggattatgctgatatgagtagagtcggtcacccaattgtgcaagcgttgagctccaccccacctctcggcagcacgtgcagtgaatgtcgcacacggtatgtcgccccgtcgtcagctccctctcctggaggggtatgttgaatcgggagctcctgtcagatagttgaagaaaagaagcggcctcatcatacctcagcgctgcactgtcgaggttcccagtccccgtacgtcccaccctcgcacttcggcagggccagccgtgacgttcacgcattggtggaataggtacgccgggccagatcgcgagtgaaacgactgcatgggtcgatgggacacaagtcagaagtggcggtgcgccgctcgactagaaccaggggcagatcccggaagccagagaaaaataccgcacaccccgctgggggggccccgtagcctcttgccttgctgagaatgtcatccaggcgagccagatgtacagtctctcctccgagagcacactttttacatgcatacacccccttgttggacggcgactccaggaactcgatgaagagccggcccatgagggccccgacacaaacgacgcgggcaatctacctcggctgggagaggggtatgaatacggggcccaattcagtccacgaggctgacgctcatctgagaagcccttgacatgctggcattgagaccactcgctgcacttgtatccccccgaagtgatctcggggtgtcgggattgcgcgcgaaggcatcactgcttcgcgcgccctcctcattggattgcggaatcccccctgcacctgaactcctaactgctggaaactcctaccaacaccgagcttcggttcatgttgcctgaccagcctttacccccagcctcatgttgttttgtgtgtgctgccactgcactcccggattccagcacttgcatcagcacttgcatgaaggagctgtattctgtttggctgcagacctctggccaagcggggggggaagtggccctgcacatgatcttgcggggcatgggcaccggcggtgtgccagatgcacatatcctgcgcatgcactgcgtggtgttctgagcagcccaccaggtcgcaccatgctgccatcgcgcaaccatggatccccggccccatcagctcgcactggtgtaggagtagagctgctgcatgccgtccaggatctccagcagccggccccctccccagccaaccagcggcacccgctccagcttgccggccagcctgcccagcgcaggccgggtgtggcttgcaaacaccggatcgcgaaggaggtagaacagcaggctcgtgcgtcggcgcagcagctcctcagactccgccgccgtgaacctgtgcatgtgtgattatttgggggaggaaagggggccatcaaccttggcactgattgttcatggggtatgaaaccccctgcacgccaaagccttgcagatgcgattccccaggcacccccctcaagcctacgcccacacaacacacacctgatgccctggaggcggtacagcaccgccatgctggtgccctgcaccgcgggcgaggcggcggcggcgtaggcggcctggcgcgaggtggcggccgcacggaagctgagctggcggctggccaggtccaccagcaggctggccagccaggggcgccaggcgcgccgaccccagcgccgcagcgtcgccgcgtagatcagggggcggagcacgtgcagcgcttcggcggccgccagcagccgcgccgaccgcgcctgcgcggccg

SEQ ID NO: 24982 - DNA, 61 bp, Chlorella protothecoides
atatcttacttgtagatgcagaagtggctgtgctaaaaggttgtgcaggtaggctggctgt

SEQ ID NO: 24983 - DNA, 7535 bp, Chlorella protothecoides
  modified_base (2390)..(2399): a, c, t, g, unknown or other
  modified_base (3304)..(3313): a, c, t, g, unknown or other
  modified_base (6421)..(6430): a, c, t, g, unknown or other
ccccccccgactccactccaactgccgccagcccgctcccccacctgaagggctggatgtgcagaggaaagcgctgcacggtgtcggccagggcggcatcaaaggcgtcgtacggcttgttctcaaaaatggcctccagccgctcctcccacctgtccagcgcctaggagtgtatggtaggatggacagccgtgagtgcctccctccacggatttgaaaggaggcaggcgatgaaacccggcatcgcaagtcaggaatcctctcccccactccatgtcaccattgggatcccccatctcaacaagagaagtacgacactcacggcagggttgatgcgcgaggcgttggggccgtccaccagctcgtcggtgcgccggcaccagacgtagatggcccagatggcgcgcgccttctctggggtcattagctgggtgcccaggtagaaggtcttggcgtgctccgcggtgaccaccccgcagcgacggtaggcctccagcagcccctcggcggaccaggggaagccgccccgcgccaagtctgccgccgcgccctccatgacccgccgcgcgcggccgctgcgtgtctggggcgaccccgcctgctcgttcatgaagtggtcgtgcagctcgagctgcaggcgcagagcgtgctcctcagcctccgcgccacccgtgcacgagccgtgcaggggggtgggggtggtggggtcgccgctgctcgggcccggccacacagcccctgtgtactgcccggatcccgccggcttgtgcagtgtggcggaggcgcgcgccaagcacttctgcaggtcggtgggatggaggtcgggtggagggtgagcgaggagggtgagcagggggatgcacggtgggttggcatggcacattttcctcggtgaatccaccccgaatccgggtgccacccagctcggcgtgccttggggggccgcttggagaccgtggggcgccatgggtgcccaccacacacccaatgctgtggggtggtggacgctagcggagagcccgccagcatgctggtcggcgccgcggtgtgaaggccgtgcatgttcgggtgggagtctgcaagctgttgctgacgatccaggcagtactcctctgacgcctgtgcgtggttcgcaggactaactctccaaaattcaaatgcttcagtcagttcctgctctgactccagtccatgggcgcatgggcctcgaagtgcttgcacggaactcgcggactgggctggtcacgcggtgaacagcttcagggatgcacctttttcctcgcgacgcagatcggggtcctcaaaagttcatgatacagggcagaggatgtcagattagggaccatgtctggaggggctgccccgcggaggccctcccactcctccacatccacaggatcattgctgcgtcgacccggggaccgcgcggggccacgtggggtcgctgtgcacaccaaacctgcatccggtgttcatgttctggtgccaacagataaacctaatcttgcctaagaggacactcctatgctgcatcatccaaaggggttggggaccctcccaagcatcgccagcgcaccggtccacatttctgcccaaggaccagtctgcctgatgacccgcattgactcaatgtctctcatcatttattacagtgccggattcttagaaaggttcgcaggtctcgagaatgggtatcaggttcatccgcaggacggcaggtgcagggccttgcgccactcctcggcctcaccgcatcttgtacttctggtcgccagaccaagatccctcggacccctcaaaggcgtaggtaatgccaatctccaggtccctcggattcttggcatttggaaagcacgtcacggttcctgatgggggtggaagaggtgagggatcgggtaaaggggatgctgcacatacatgtaccgggcaggtttgggtgctggaggatggtctggcagccgagttgggtcgcgtgatcccccctcctgccgacactcctctttgcaacgcatgtgcggcgcctgggaaagactgtgggcatcgtgaggatgcaccagtctgctctgcccagggcccccttccccacctgtgatctcctccttggggtgcaccctgagcgtgtcctccaggtaaaacaccgtctgcttccagtgggtggaccgactgcgcggccccgtgctgaaggcgatgggcttgtggcaggcggcaaaaacgatgtcaaagtaggccaccagcgcgtgcacatagtccttgcgagtggtggtgagcgcaaagtttgcctgcgggtgaggaggaggggggaagtgtcgaggacggagttggatttcacacgagtggtccctggactgttgtgtgagtaagagtcaggagtatgcggggatgatacctcnnnnnnnnnnggagtgtcgaggacggagttggatttcacacgggtggtccctggactgttgtgtgagtgagagtcaggagtatgcggggatgatacctcatagcacgctggcaaccacgcacggattctgcactgacaagactcatgcctcttaagtttgcaaacaggactgggcatggcccattcccaactgaccgtgaacgatgcatcctccttggtcatggtcttgatgtcaaaggtcttcagcaggcaggcatgggtgcagatctggttggcgtcgactgtggtgagaaggaggcggggagatgagagaggccatgagggttgtgtccccccatcaagccggatgtcagaatgcacacacagcaggcaaatcccaccggctcaccacagtccacgaggggctctgacagcgcggtcttgccaatgcaactcatgtcgaatccgtacacgttctgccaccagtcgattttttccgttctggaggagggagaaaagggtggaactcaggatgccaactttgtcgaagcacgatggcaatgtggtgtgacatgagggcaggcctcgctgctgttcagctggagttcacaactatcccctgcaaaggtactcccaggaatgtcagtcctgagggaccccatccttccctctggcccaagcaggagttgcatgcatgcgcacttgtactcagcgtcctcgatggccaccaggtggaggctggccttgtcggggaatatgaggccatggggcgccagccacttgtccctggcccacaacacggtgtccagcatggactcatacacaaggaagtagccctgcgagggacgggaggggaaggtggtaatgaaggggctacacagtgatgtgctgggtggacgaaggggcagcacagcagagtgccactctcacagtccnnnnnnnnnnagaggggaaggtggtaatgaaggggatacccagtgatgcgctgggtggacgaagggacagcacagcagagtgccactctcacagtcctgggaaaacacacaacatccttcctgcacctgccgcacggtcctgaatgtgtttgccaccccgcctcaccatccactctgagatgatgatgtcaaccgtgtccactggcagctcgacctcctccaccttgccccggaggatggtgatgcggtccttcgcgcaatatgaatggtctcgcatcaatcgcagtacgagcaaggtaaggaatgagggctggacgtgtgcgctgggaactgcccactgctcctgaacccagcctgtgtcacataccactccgctcctgccactgcaccaaagtaccgtctcgactccctcactgcaccccgccacgaccatccccggcgctcctcaccgcatagccgttgtcgcgcacaatgatcttggcctgttcggcgatggccgacatgtcgatgccgtagacatgcttggcgccagccttggcggcgaagaggctcaggattccggtgccgcaccccacatccagcaccaccttgtccttgaataggtgcccattgcgcaggatggagttcatgtaggtcttcgtgcgcacctgtgtgcatcgtgggggagagcaggatcctgtgaaacgccgtgcatgttgcatgggaggtcccgctgcagcgcatggtgctgagtgccagacggcgggcagcaaccgcatgatcacatattcgaccgctccagggatcccacctcatccttgagcatctcctcatggattccaaagtgcccgtagctgtccgcatagtagtcagcggccgtcagctcctcctgatgtgggccaggcgaggtgcggctcagggcggcgcagagagagggctgatgacatgcggaatacccaccttcgatgcatcaacacgatttacctgcattttaacgtccatgggatgtaaagtagtgagggacagagcgcggaccaggtgcactgaagttgctcgtgctccggatgcacaagacgagctttgaagagcgggtcgaaaaaggatgtatcctcgaaaagtaaggtttgtatgtcaaattctttattgcatgggcagcctgagggaagcccgaatgcaaaggtctctctgcatgagcaacaactgcttggcgagaagggtgccagaacaaacactcccgttttcttgctttcccgggaggccgcctgactcggtaaggcctgcccataagaggtgtgcgggcctcggaacactccctctccatcacgagtagcacacaggggtcggcaggtgaggatgcgcagctgttgaaatgcgagtgtgtgcgtagagggggtccccgacgacccctcccgggtaccaggcctgggagctgctgagcgagactggccttggtccgctctcaccccggagggtcactggcacattccctccatccacttcgtagaatggccaagtccaagaaccataccgcgcacaaccagagcgccaaggcgcacaagaacgggatcaagaagcccaagaggcaaaggtactcctcccagaaggggtaagttgccggggagacgggagaaaatggtcggagatggttgtatccagctcggaaatggggagaggcgagcgatgcgaggcgtcgagttgggcgatgcgcacccttagcgcctgtgctgtggtgagatgagttcggcagcccctggcactcagcatccctcattccgtcgatccctttgcttccatgcaggatggaccctaagttcctgcgcaacctggtgagatatatcagctggctttagttttgggggggatgtggcatgggtttggcacagcatggccgtcaggaaatctgctaccccctgcacatccttctcactctaacgccctttcattccccatgcagcgctttgccaagaagcacaacgttgtcgccgagtcctcttgaatccactcaggagtctaaataggggtgggacccacaatgcatcctgcggtatggtgcataaaggctgcacgcttgcgctttctgtaagctctgcggtgtaatcccctctatggtgcagtccagatatgcacggaaggtgacagcgggtgggatgctcgttcacctgcactggatgctcttgggcagaaggatgaagtccaatgcagaacacagcggagcatatatttctgcgatgctatgtcacagcatcagggtctctcttgaaatcaagcagaaattctgaacatcgttgttggaaacctgtaccacccctttcggtgtatgggggggggcgctccatactacgtccagccgcagcgctgcctgaaaatggcgacacccgctagagggtccgtgctgggcgtgccaggcagatcccggcgcggcggacgtcggccatgcatggccggggcaactagccactcgcgacccactcaccctataacaatgcacatttagtgtcgggaacaggtttcactcgacacaggacgacacccaccttgctgcaggaggaccggggctgactgtcgggtccagggcgcacggtcacatccctcccctccattccctctcaacatcccgctgctgccatggggaagtcggatgcgtccaaggaggacaccagcaggggtgcgcagggggggcttggtacgtccaccccgcagcgcatgcccgtcagtactgccccggtggtgggacagtcgtccaccttccgccccctcatccatccttcgcagacctcatcctgccccagaaaaccacccccgccctggacaccagcaagtggcccctgctgctgaagaactatgacaagctgaacgtccgcacgggccactacacccccatcccctccggccacacccccctgaagcggcccctccaggtatgtctgggatgcattttcagcaagtgcccgcactgcagtcagagatggcgtggtcgatatcgcttctgtgcctggacatgtcagaatgaaggagcggcatgttcatccctccctccagccctccctcgcacatcccaccccatctccatccccgtgacaccccgccgccattccactccaatttctatcccggttcactctctcctccccaccccaannnnnnnnnnatgacaccccgcccccattccactccagctcctgtcccggttcactctctcctccccaccccaactccgcttcctcaggagtacgtgcggtacggggtgatcaacctggacaagcccagcaacccctcctcccacgaggtggtggcctggatccggcgcatccttcgcgtggagaagacggggcacagtggcacgctggacccaaaggtcacgggcgggctgatcgtgtgtgtggatcgcgccacgcggctggtcaagtcgcagcagggcgcgggaaaggagtacgtgtgcatcgcgcgcttccactcggcggtggagggcggcaccgcgcgcgtggcgcgcgccatcgagacgctgacgggcgcgctgtaccagcgcccgcccctcatctccgcggtcaagcgccagctgcgcatccgcaccatctacgcctcgcgcctgatcgagtacgacgaggagcgtcacctggcggtgttctgggcgtcctgcgaggcagggacctacatgcgcaccctctgcgtgcacctgggcctgctgctgggcgtgggcggccacatgcaggagctgcgccgcgtgcgctccggcatcatgggcgagcgcgacaacatggtgaccatgcacgacgtgctggacgcgcagtggctgtacgacaaccacaaggacgaggcctacctgcgccgcgtggtcatgccgctggaggtgctgctgaccaactacaagcgcctggtggtcaaggactctgccatcaacgccgtctgctacggcgccaaattcatgatcccgggcctgctgcgctacgagtccgggatcgaggtggacgacgaggtggtgctgatgaccaccaagggcgaggccattgccgtgggcatcgcccagatgagcacctcggtcatggccacctgcgaccacggcgtggtggccaagatcaagcgcgtgatcatggagcgtgacacctacccgcgccgctgggggctggggcccatggcgcagaaaaaaaaggcgctgatcgcagagggaaagctggacaagcacggccggccaaacgaggccacgcccgccgagtacctacgcgcgctgccggccgaccccgccgcggcggcgcccg

SEQ ID NO: 24984 - DNA, 61 bp, Chlorella protothecoides
aggtgtgtgctctcttctgtcgtggctacctcctgccgatgtcagggggttctggaccatc

SEQ ID NO: 24985 - DNA, 79 bp, Chlorella protothecoides
cgcatgcaccaatctggatcgtccagcggtcgcaatccgccaggatttagtcactcatgggctgcccgcctccctcatc

SEQ ID NO: 24986 - DNA, 64 bp, Chlorella protothecoides
gggagaagaaggggtgttgttgactttatgtctggactgttccagcgagttgttggctcgctgg

SEQ ID NO: 24987 - DNA, 75 bp, Chlorella protothecoides
ccgagcaccgggcccctaccggcctcgtctacagggacgcagggggtggaggggatccgaccatggggataggca

SEQ ID NO: 24988 - DNA, 74 bp, Chlorella protothecoides
aagaccgtaaactaaggtaatcctccacgacatcgccacaattcgaagccttaaggttccagaccggcacccca

SEQ ID NO: 24989 - DNA, 2952 bp, Chlorella protothecoides
  modified_base (479)..(488): a, c, t, g, unknown or other
  modified_base (575)..(584): a, c, t, g, unknown or other
  modified_base (661)..(670): a, c, t, g, unknown or other
  modified_base (1425)..(1434): a, c, t, g, unknown or other
  modified_base (1795)..(1804): a, c, t, g, unknown or other
  modified_base (2665)..(2674): a, c, t, g, unknown or other
tgcccatggcagcaagaaagggaggcggtgacacagcaggagctggcgcccgaggagctcgaacaccatgatgatgaaaccggaagtggccgcaatccgggaggcggcgcgcatggccgcctgcatgcgattctcctccccggagacgaggtcaggcgagcggcggtagccgtggaagggcaggatggcagccgtggccagcagcattgcctggtggatcctggtgcgatgacgcaggtaggtacggcaggggagcaggacagccagcagccctggaatcgcctgcatgcatggatgcgagggcgggccggcatatcggtcgtgggtgggtggaggtacactcggagagtggaagttccaattctgctcttcacactcatttgaacccccctcacacacgaccggctctcagcaacaattgcagttgatgatgaggaggagctagggcatcaatggcctgcccatctgagcacgcctcnnnnnnnnnntggcataccgatcgtggatgggtggagggacactcagagaggggatgttccgatcttgctcttcacactcatttgaacccccctcannnnnnnnnntcgaggggatggccgatgaatgaacacaggcaaacccgagtgccctaatccccaccaacattgcagcccgtcacctnnnnnnnnnngcgagggaatggccgatgaatgaacgcaggcaaacccgaatgccccaatccccaccaacattgcagcccgtcacctcgaaggtagcaaacatacacatgggtcgcagctcatccaacggcatggcccactcctgatccgtctgaggatgatgtcgtggaaggaagcagtgcttggcacatagctgttgcggggacaggctcatgaactcagatcccgacacctgtggcgtccgataagccgctcctcgctctcaccatgcctgtcttggtaaggactatcattgcgtacaaagctccagtcagtatgaaggagcccatggcatcttgcctgcgatgccgtgctgcatggtcggtgtggaatgcagcctcgagctgggggtctttgaaaccgagcgtcatgccccatgggctctcctgaaagccctccatcagcaaggaggcccgcttttcatcttaagctcgggagttatttcagatgtaaaccgagtgtagggcaggatagacaatttactggggtggcgtatctccctggccaggtgtcttttcgatcttatggagcggggtggtacagtccacgtgacgagatcgatctgaagcttcttgagatgcaaacgcacatcagaatggtttcctgccatctacaacttcctttttaggttggtgtgagggattaatgctctttatcatgcaagtggggcgcatgtgaggggtctgagaaggccactcgcgtcaatatggtgtatggttcttgcaannnnnnnnnngtttactgggttggcgaatctctttggccaggtgtcttttcgatctgtggagcggggtggtacagtccacgtgactagatcgatctgaagcttcttgagatgccaacgcacatcagaatgttttcctgccatttacaacttccttttaaggttggtgtgagcgatgaatgctcttcatcatgcaggtgggccgcatgtgaggggtctgagagggccattcgcgtcaatatggtgtatggttcttgcaaggctcttgaggcaccccactatgtgaactgcagcaatgcagcctaaacgaggtgtgcatccacattctctatactctcaagaatttatgatcacggtctgaggcgccatgtgnnnnnnnnnnaaactgcagcaatgcagcctaaacgaggtgttcatccacattttcttaactctcaaggatttatgatcacggtctgaggcgccatgtgcgcgtatttggtcattgggtggttagaaggataggactgtgaacagatttgccctagagtattggaccccccggatttacactattttcgtcccatgcctgcggtttggggcattatacataagatcaaggcacgtgctacagcgttgggtgacccaaggacagtccttccccccgcattgctgtctcagtcttcttttctcaacgtctgaaattagcccttcaatggacacatccattcaagtcctgcaaggaactcttcataacatccgacattgtgcaggcaagggagacactgcaccagattgtggagcaggtggtgggtttcggcctaccaattgtcccaggaagcaggggggccccacaggtccaacctgaatcacctcgtctccctttcatggcccgctattcatcacagcacccccccgccagctccaatgcttgtgtgcgctcattcagcaaaagggtcaatgaaatcgcctccaagtcctgctgggctcaggtctggcctcctccgtcaccatgtggtctctggggccctggtttgcatgagataggcgttccagcgtgcagggagggcgctcagccggtttggcggcacggcggcgagcgcatttgccagcagccacatcccgcctaggacggaaggcaagagcaggaagttgtccgccaaacccttgctcagcttgagcctgggcgggggcaggccgcgctccctcagatatcttgagcgatcgcgcacttctgcaaatggaagccgggcaggaggagagnnnnnnnnnntgcctgctatggagggcaggagcaggaagttatcctccagagtcccgctcagcttcagccttggtgaagtcaagccacgttccaccagatatcgtgaccgctcgcgcaattctgcaagaaggagccagacagggggcgagggctgaggtgctcccgaccttgggagaacccgagtacctggagaatccgggccttcccagcctgcgtcgtctgggctgatgcaagcaccctatcccgtcatccccactgagaaaatctccacctccacccccccccac

SEQ ID NO: 24990 - DNA, 80 bp, Chlorella protothecoides
gatctcgaccgtgctgggctcctgtctcagcaccttgacgatgaatcatgcttgcagccctgcttcagcccatctcctcg

SEQ ID NO: 24991 - DNA, 66 bp, Chlorella protothecoides
tcttgccacgagctggaaagcatcctgcaggtacgtgaactatgcgtggcgtgcatcattgcgtag

SEQ ID NO: 24992 - DNA, 68 bp, Chlorella protothecoides
ggtcgctgcagcaccgcagcggcgtgctggccccggccgcgcacgccaagtcgctgcggcgggtgaac

SEQ ID NO: 24993 - DNA, 210 bp, Chlorella protothecoides
tgctattgacttcggtggatattcacaccctgggtcgaattttctgcgcccatcccattcacatccatgccgtctcatgcttccctgccatcggtggagggcccggggggcgtgggatgagggaccgcatcatcaatgctttcaattgagtgcacaacgttcggtgccagcaatcgactaacttctggtgtccatcaccccagtgcctcc

SEQ ID NO: 24994 - DNA, 61 bp, Chlorella protothecoides
gtgcacggctgacaagaatggcaacattggtaccggaaacaaggggaagaacaactttggc

SEQ ID NO: 24995 - DNA, 61 bp, Chlorella protothecoides
aggcgatgctgtcgatgattgatcgccgagaccgccactccactgcctccggtgtgtctgg

SEQ ID NO: 24996 - DNA, 67 bp, Chlorella protothecoides
agcaaagagcatcggctcagcctgtggcccccgaatgcaggaaagtgaaaaggcataccagcctggc

SEQ ID NO: 24997 - DNA, 61 bp, Chlorella protothecoides
atgaagggcccagaccaacatgggtttggcggccctggagcagggcgtcctgcaaggcacc

SEQ ID NO: 24998 - DNA, 71 bp, Chlorella protothecoides
tacgtgtgccatgtatcgctcttgatcttccgtccaaaaggctctagtgccaagcctccggctgcagcttg

SEQ ID NO: 24999 - DNA, 118 bp, Chlorella protothecoides
agggtgggcattccaagcaaaactggcgacaggcttggaactcgagctcagcatacaggacgatgaaatagactacatctccatgtactggaatggtgatttggtgtacaagcaccct

SEQ ID NO: 25000 - DNA, 175 bp, Chlorella protothecoides
tacccactgcgacaggaggccaggtaagggtaagcacccagaggtgcagcatggcaaatgcttcctgcacatgaaactgcaatcttgagtgtcctgtcgcattgctgtgctggatcgtatcagtcagatgtgtttgaagcatctatcaccgataatgtctcagcaatgcaaagag

SEQ ID NO: 25001 - DNA, 61 bp, Chlorella protothecoides
cgaagctatgaggtctacccggagcgggggtggggtagaagggttccatgaagggtacagg

SEQ ID NO: 25002 - DNA, 289 bp, Chlorella protothecoides
gtgttcacgctccatgcggtgagtttctgatggagtcggacagtgaggaacgggaaggggggtaggatatgtggcggtgtccagtcgggggcagagtacgaccttgcatcccttccacacgcctcgattgcggagtgcatggcagggttgaggaccttccaaagggctggcgtgccttgctcatcgacacccgctgcgcccaggggggttgcccatgcatttcctgactcgatgcctcgtcccacccccttttggtgcgccacagggcccgggcatgctgttcaaggcg

SEQ ID NO: 25003 - DNA, 69 bp, Chlorella protothecoides
tgcatgtcaggtggttggaaaatgactcttagcaaccccgactcgaagggcgcctgctgggtgcgtgct

SEQ ID NO: 25004 - DNA, 61 bp, Chlorella protothecoides
gcacgcccgcgatcgctgctatcaaaggcccccagctttcacagcaggaagcactccttcc

SEQ ID NO: 25005 - DNA, 70 bp, Chlorella protothecoides
cgccggcacgacactcgcgggcgctccaccgccctgcgcccattgcccatgacttccccctcctcctctt

SEQ ID NO: 25006 - DNA, 958 bp, Chlorella protothecoides
  modified_base (770)..(823): a, c, t, g, unknown or other
ccggcacagaggtgggtggggggtgggggggggaagtggggggcatggctggcccaagatcggtccatgatcatgccgtgcagccagggcagcgtagcagcggcagacgcggggctgcggcgaggccatcctctctgtgcggccccagagaacgtgccgtctggctggcagctcctacagcaccctgaaggtgcttcaactccacccactccgcagacgccgacttcgacacgcggcgcgctgcggtgacgcgccgcctgcccatggacgagctggcgccggaccccgcctccccgcgcgccgccgacctgcagggctttggcagcttctccatggtcctggggtcgccgcccaagaaggcgcggatggccacgcccgtccgcggcggcgcacccgcgcccgccgcggacgcggcgcacctgctgcagccggagagcgtgggccgcaccgccctggccgcctacctccaggagggcctcgggctggcctcgggggggcggggccggccaggcagcgccgcggccgcgccctccccgggcccccccgccaagtgggcggggtccgcgacggcggacatgaacagccgcagcgtgcgcaccagcctgcacgccctgctggagcaggtgtgaggatgaggtggggagccgcagcttcccccattatttaccgcaaagcttgccggcagcgtgcagtttgctctccatgtccacacccctgcccacacatcaccccttgtgtacgctacccctccccccccccccccccccccnnnnnnnnnnnnnnnnnnnnnnnnnnnnnnnnnnnnnnnnnnnnnnnnnnnnnnccgcccaatgtacttgtgctcctcggtatcactgtaagattctccagggtcactgtggtggtgttgattaacaccaggtgatgggttgatggcacggtatcccggccttactacgctcaagcgcgctcgccacgg

SEQ ID NO: 25007 - DNA, 62 bp, Chlorella protothecoides
tgcaaccgcagcttcaggttgtcatcctccctgccccacccccagaagtctgtgccaaagcc

SEQ ID NO: 25008 - DNA, 452 bp, Chlorella protothecoides
  modified_base (231)..(240): a, c, t, g, unknown or other
tggggctgtgccctttccctggcctcctccgaactggtcttcgggcagccacagcagcagcggcaggggcagcagacgatgacgaggagggcgtcgaaaatgctgcagatgaggttgcagggcagacaaataacgtccgtgcagcagcccatgacgtctcggctggggtttggatacaagagggcgaaaccattgagcgaatgccgcggacaaactatctcaaaagcatannnnnnnnnnatacaagagggcgaaaccattgagcgcatgccgcggacaaactatctcaaaagcataccggcgggtgcaagagctcgggtaagcgactctggtcctgcatgaaggctggagaaaggtcgtcccgattacctggactcggcggtgttagacctgctgttctccacagcccacgcgactgcagtaaatggaacaaactactctgttgtggcaga

SEQ ID NO: 25009 - DNA, 148 bp, Chlorella protothecoides
cagaacgatggtgtgtacctgccagcgctccaggaggggggggggggtatgatagatcttaataagttcaaatggtctttgagggtgggaggggtgatttgaagacaggcctgcacattggaactgaaatggaggtaggggatgggga

SEQ ID NO: 25010 - DNA, 133 bp, Chlorella protothecoides
cttgtaggcccgtgccccgtgcctgccagcggggcctccgggtccccaccattcttgtgagcatcgtgcacaccgggaccggtgccattcatgtcatgcttggtttccaaggccggcagatccgcgtccactc

SEQ ID NO: 25011 - DNA, 61 bp, Chlorella protothecoides
aggtggtgcattggccagagtgcaactgccgcttgtcagcactcagactgaaagatgtgca

SEQ ID NO: 25012 - DNA, 103 bp, Chlorella protothecoides
gaactctatctcagaaagtacggcatctgtccctgttacggaggcatatcgcctgccccgcaacaattttgtctcggaaacatggtttcccgatcttgctagg

SEQ ID NO: 25013 - DNA, 61 bp, Chlorella protothecoides
ccatatcctgccatgggtatatgcactgactcttttgtgcatttgtggaatcttgaggcat

SEQ ID NO: 25014 - DNA, 102 bp, Chlorella protothecoides
aggtggaggaaagagggggagcgtgcagagtggtgcttggggggggggggttctggagagttccaggaggacgccagctttgtcggcgggcgctctcgtctg

SEQ ID NO: 25015 - DNA, 75 bp, Chlorella protothecoides
ttccccccagctgctgaatggggacccattcgaggtgggggccggcatgtctttccgactgtcgaccagtgcgtt

SEQ ID NO: 25016 - DNA, 80 bp, Chlorella protothecoides
cctgttctttgtgtccttttaccaaaacattctcctgctgctcatcactttgcctgtctacgccgcctggcggcatgcgg

SEQ ID NO: 25017 - DNA, 79 bp, Chlorella protothecoides
gcccagcgcatagtggcgcagcgccgcagcgcagtcacccgccgagagcgcggcgttgcccgcggccctgtgcgcgtct

SEQ ID NO: 25018 - DNA, 663 bp, Chlorella protothecoides
  modified_base (342)..(351): a, c, t, g, unknown or other
gccgcagccggacgccgtgcacagcagcacggccctgaacgctctcaggacccatttccccccggccaccaacacgctggactggcagtcgggctccgcggacgagatggggtgaggggcggaggccaggggaaggagggtggaggggtgctggaggaggctggcgtggggctggtgtggcctcgagccagaggggcatggggatcagtatggcctctggtccatgcacacctgtcgtcacccacctcgccgagcctccgtgccacgcgatcggcttcacaaccgacgcacgggacttccacatgccttcaccctcctcccctgacgcgccgacactgcgcnnnnnnnnnncccatgcacacctgtcgtcacccgcctcgccgagcttccgtgccgcgtgatcggcttcacaaccgacacacgggacttccacatgccttccccctcctcccctggcacgccgacaccgcgcaggctgttcaaggtgaggctggtggtgaaccagggcgagttcgtggcggaggccacctccgacgtcaccgagaagctggccaagcagctcgcggcgctccaggtactgcagcagctggggtaccgcgtcgacttcaccctgcgcactcacgcggtgcgcggcgggcggggcggggcgccctggccgcccgg

SEQ ID NO: 25019 - DNA, 66 bp, Chlorella protothecoides
tcaacagcttcctattctcttctggaatccctgaggccacacttctgtgacgtgtggatatgcagc

SEQ ID NO: 25020 - DNA, 220 bp, Chlorella protothecoides
attgcgtcggccatgtatatgcaatctaaacacccttggtcgcatttcggtgtgcacacctttgcgcgcgctctgtcggagatcgttcaggagcatacgaacgtcagtcgcacacccgccaggacaggaagacaataaaggaggaatgtattatataacagcataggtgtgttcttgaattgttgtcgcaatgcctcgctttgaaggctgctgctcccac

SEQ ID NO: 25021 - DNA, 66 bp, Chlorella protothecoides
ggcggtggagacttcttgacagggggtggaggagacttcttcgtaggcggcggtggagacttcttg

SEQ ID NO: 25022 - DNA, 78 bp, Chlorella protothecoides
ctggctggagctcaggtgtcaagagccggtcccgctctaaaattcacagaagcagtctctcagagctccgccgacgga

SEQ ID NO: 25023 - DNA, 86 bp, Chlorella protothecoides
gctcgtggcagaatgatccagctgcaatccattggaggatgagggcttctactccatgtgcatcagtgtcaatggaccgtgcaacc

SEQ ID NO: 25024 - DNA, 61 bp, Chlorella protothecoides
aagcctgaccgcagtgtggagtcagactggatccataacagaatggtagcggacagggatt

SEQ ID NO: 25025 - DNA, 64 bp, Chlorella protothecoides
caacagctggcgcatcgtcaacaaccaggacgctgtgtgctcggtccctcgcctcatggggtag

SEQ ID NO: 25026 - DNA, 80 bp, Chlorella protothecoides
tcggcgcagcaaagaccagattgagcaaaagttaagcatgcgtcaggctggcgagcatggtcacaaaggagcggacagga

SEQ ID NO: 25027 - DNA, 80 bp, Chlorella protothecoides
attcccgcagccgtcctcgctcccacgcagtgcgagcctgcacccacgggggatggccgtgactgccacggaagccagcg

SEQ ID NO: 25028 - DNA, 71 bp, Chlorella protothecoides
ttgtctttggttgtcccatgcctgtggaccgggcccgggttccaaggggagcctgcgaggtggtgcttcct

SEQ ID NO: 25029 - DNA, 105 bp, Chlorella protothecoides
tacagaaaaacggcgccctcgcccccttgcaagcccacacatgctcatccgacaccccactcactgtgcactggatggcgcagggcaggtcacagcaaaggttgc

SEQ ID NO: 25030 - DNA, 71 bp, Chlorella protothecoides
agaagtacttttgtgtgactaaatggctatttggtcgttgttggatgtgacatcttaacattcaggttgtt

SEQ ID NO: 25031 - DNA, 64 bp, Chlorella protothecoides
tgggcatcctcgatctcgccgacacagtgaacctggccgggtgagccttcatctcaatagccag

SEQ ID NO: 25032 - DNA, 101 bp, Chlorella protothecoides
gcgcccagcagggcccagcgggcgtggatcacctcgatctcgcggtagcgggcaaaggtctcggggtcggcggacagaccggcggtgtcccagccgtagtc

SEQ ID NO: 25033 - DNA, 70 bp, Chlorella protothecoides
ttcccccaagaggtcgccgcctccttccccagcgaagagttcaccacctacacctcaaccctcttcacct

SEQ ID NO: 25034 - DNA, 117 bp, Chlorella protothecoides
ctgaaaagacacacaagtggcccaatcccaccttgttctgcaagccccgctgcagagaccaccgcagaaagatggatcgctaccaccggaggctccacccagatggtgagtcagctc

SEQ ID NO: 25035 - DNA, 146 bp, Chlorella protothecoides
cttcagtgcctgtggagtagttaattcagccagagcacgcgccggtcgatgtagtataacggtcagtatacgtgcctgtcaaatggtgctgagtgccagtcctttctggacgcacgtgatccgggttcgattcccggcatcggcga

SEQ ID NO: 25036 - DNA, 77 bp, Chlorella protothecoides
cactcatcttcgactcggtttcttggtaatccaaagttgctcctccaatgttgctccttcgatgttgctcctcgttg

SEQ ID NO: 25037 - DNA, 190 bp, Chlorella protothecoides
cagcagcgcatatgatatttgcaggttcgttctgagctgtatttggtcttatcactggaatgcatgccatagatgatgacattcctcatatggctggcactgcctgataaaccctccccaataaacgcattacagatggatgggctacgccaaggcgggctctttcagagagaccacccttcacgtcctt

SEQ ID NO: 25038 - DNA, 141 bp, Chlorella protothecoides
tgctgggaagcctgggcctggatgtatgccacctgaccagcagcctgtcatgtggcagtgctgcctataacatgcagcactgccagccacaaaccgcagcaggatgggtccgagggtcataatgacctgccagggaagcga

SEQ ID NO: 25039 - DNA, 80 bp, Chlorella protothecoides
ttgcttgctgcctttcttcagtgatgtcgcgtcaggaccacttccccaaacccattgcagctgaaccagctgggtctgct

SEQ ID NO: 25040 - DNA, 79 bp, Chlorella protothecoides
ggggggggggggggggggggggggggagagtgaggtttgggagggctgctgagctggtgcaggtggggacaatggacga

SEQ ID NO: 25041 - DNA, 133 bp, Chlorella protothecoides
ctgagcgatgctgagacaatcgaatctctggggagagaattcattaccgagtgcccggggcagattctgctgtgagatcgagtcaggaagctcgggaagcaaataccgcatgtcacgcaatgccccagtaccg

SEQ ID NO: 25042 - DNA, 117 bp, Chlorella protothecoides
cttctggccgtcccccttgtaacacgcggagcctccttgcgtcagggtgatctcttcgttgtctgcagtgcagtatcttaccatctgtagaatgacagcggcaaggctgacacccaa

SEQ ID NO: 25043 - DNA, 61 bp, Chlorella protothecoides
tagaatgacagcggcaaggctgacacccaaccctgccatcaggaggatctaccgtagatag

SEQ ID NO: 25044 - DNA, 64 bp, Chlorella protothecoides
cagccggccgcgccagcccccgcgcagacttccggggatgcgccaccagggcaggcgggcgagg

SEQ ID NO: 25045 - DNA, 76 bp, Chlorella protothecoides
cagcccgtgctggatgcgctgcgtccgaccacggacgacgtcgtcgcagtcgtctccgagttacgcaccgtcggcg

SEQ ID NO: 25046 - DNA, 69 bp, Chlorella protothecoides
gccactgaccgtgctgccaccactgccgctacctctgcaatcaccacctctccaatcgccaccgccgcc

SEQ ID NO: 25047 - DNA, 140 bp, Chlorella protothecoides
ggggacgggtgcaatgggtgtggagggtggtcggcgggaatggtggccctcgagtcagcaaccgagttcggcatgtgtcgtcgggggtatggggccagaccaccaccgatgtttcccacctcgagcgcggccacgcgctc

SEQ ID NO: 25048 - DNA, 62 bp, Chlorella protothecoides
ggagcagcgccgccgccggccaagaaggcggcgcggtcgctggaggacctcatgggtgcgtg

SEQ ID NO: 25049 - DNA, 61 bp, Chlorella protothecoides
tagagcctgatgttctaggatttcggctggtgcaatgatcacactgcgcacacgggcggag

SEQ ID NO: 25050 - DNA, 72 bp, Chlorella protothecoides
ggggagggtgagaggaggaaaacaattgccgatcctctgccggcaggcaacttgactccagaaacgttcacg

SEQ ID NO: 25051 - DNA, 116 bp, Chlorella protothecoides
cagcaccatgcccgggcgctgcgacgagatcgctcctagccaatgtgacgcattttgtcacgaaaaagacaatccagatccagtattgctattcgaaccaagtgaaatacctctct

SEQ ID NO: 25052 - DNA, 71 bp, Chlorella protothecoides
gcgtcattccacgctcatgcagctgccgtgcccacggaacccctcccctcccccacctcccagacattctc

SEQ ID NO: 25053 - DNA, 80 bp, Chlorella protothecoides
ccaacggctcccagttcttcatcaccaccgtgaagacctcttggctggacggccgccatgtcgtcttcggcaggggtgag

SEQ ID NO: 25054 - DNA, 61 bp, Chlorella protothecoides
cctcttcaggtgcgactccagctggaaacgaatgtcggctgcagccaggatagaatggcgg

SEQ ID NO: 25055 - DNA, 61 bp, Chlorella protothecoides
cgcgaccaggcgcagcgcggcggcggcggcgcgccagaaggggatgtgggagaaggcggcg

SEQ ID NO: 25056 - DNA, 61 bp, Chlorella protothecoides
cgtggtggacgagctgatcctggacgtggcgacgccgcgcactcgcgcgctgctgcagggc

SEQ ID NO: 25057 - DNA, 72 bp, Chlorella protothecoides
catgccctccacctctggtgagaaatggaggatggggagatgggagggattgctgcggcgtcgaagctgggt

SEQ ID NO: 25058 - DNA, 76 bp, Chlorella protothecoides
caaatgcaggagggagcaacgtgtcttgattggatgcctatggaattttcattgaatagttccttgctgccagtta

SEQ ID NO: 25059 - DNA, 72 bp, Chlorella protothecoides
ggcggatgttcagcacgtactgcgcatgcttggccaggcgccggaggaactctgtcttgatgtagttcttgg

SEQ ID NO: 25060 - DNA, 77 bp, Chlorella protothecoides
gagggtcacgaggggttcagttgaaggcccttgttttgtgtgtgtgtggggggggcataaccgggagggaggccgca

SEQ ID NO: 25061 - DNA, 72 bp, Chlorella protothecoides
atcacccctgcactgcatcgactatcgtaaccccctctccatccccccccccccacacacacacactcttca

SEQ ID NO: 25062 - DNA, 69 bp, Chlorella protothecoides
agcgatggcaatgaactcggcggggatgaccctcccctggtggatcagctggtagaaggagtgctggcc

SEQ ID NO: 25063 - DNA, 166 bp, Chlorella protothecoides
gtgggggcgtatggaggtcaatgtcctcctggcgggcctggtcagtggtcaagaacaggcctgcagcggtccgcggggcggtgtgctggggtactgcgcaggggtactgcgcaggggcactgcgcaggggcactgagcatgattctctgccgtccatctgaggggc

SEQ ID NO: 25064 - DNA, 77 bp, Chlorella protothecoides
ttctggacgtcaccggactgggcgacccttcccagctggcgatccgactgagggccgacatccaggcggccacgggg

SEQ ID NO: 25065 - DNA, 71 bp, Chlorella protothecoides
cggcccctcgtcgtggtccgtcgcacacattcagcgctcaccgcacccctgcgcgtcggggcagggccgtg

SEQ ID NO: 25066 - DNA, 71 bp, Chlorella protothecoides
acccctgctcaccaatattgtcatccccaatgttattggtaccaaaattgttcttgcccctgttgccggag

SEQ ID NO: 25067 - DNA, 73 bp, Chlorella protothecoides
tggtcatctgaatatgggtggcgggggggggggcactctgataaaaaagagcatcattcgggcctgggcccac

SEQ ID NO: 25068 - DNA, 72 bp, Chlorella protothecoides
cacgagccttgcatcacaaaaggccccatcccctccactgaagaaggcatcacctcttccaccacgaaaggt

SEQ ID NO: 25069 - DNA, 80 bp, Chlorella protothecoides
acatgcatgtttgtgtagtagaggggagacagtgacggtgtctcgctagcaggcagtggatctgttacaaactgatgggg

SEQ ID NO: 25070 - DNA, 66 bp, Chlorella protothecoides
tggatctgttacaaactgatggggactggatcgagtgtcggcatccgtgatgaaggtcccagcgtt

SEQ ID NO: 25071 - DNA, 76 bp, Chlorella protothecoides
caaaccagctgcatgcatgtcctggttaaggcccaaaatgcaacgacacacctcaatggcggggcacaggaaggtg

SEQ ID NO: 25072 - DNA, 1047 bp, Chlorella protothecoides
gcgggcacgcactcgccgggcgccggcgccgcgacgctggagggcctggaggcgcgcaccatgcgcgcggggccgcgccacgacgctggcgctgcgcacgccccaacgctggcccccgcgccggagctgctctacgccgtcgactggcgggtggccgacgtggcggatagggagcttgatcagtcctcggacgcgtcctccgctcgctacagactcaccgacgcgcccgctgcgacgcccctggctgccacggccgccatgctggcggcgctgcagggcggcgacgacctcggcgtggccgccgtgagcctgcacagcgggctgacggccgcggcgggtggattggtggagacacaggaagcccccaccgccgccgcgtcgggggcggtgtggggcgccctgcgcgcctttgcgcaggaggcgcccggcgtcgcccacggcgggagccagggcgcggaccaggggctctccctgagcctctccacggtccccggaaccggcggggacgggtacggcgccagactggcctggggcacgacccaggcccccgccctggtgccctcccgggcgccgcccgcgcccatgcgcgccttccacctgatgccgcgcccgcgcggcgccttttccggcctggtgcccgagcccgtggaggccgggcggccgggctggctggatgtccaggtcaaggctgtgggcatcaacttcagggacgtgctcaacgtgctgggcatgtacccaggcgaccccggaccccccggcggcgactgcgccggcatcgtgacgcggatcggccccggcgtgactgcactgtcccccggcgacgccgtcttcggcctcgccgccggctgcctgggcacgcacgtgctggcctcgggcctcaccatggtccgcgtgccggccggcgtctgcctggaggccgcggccaccatgcccaccgtgttcatcaccgtggacgcggcactggacaggctggccggcatcaggcacggcacgcaggtgctggtgcacgccgccgcaggcggcgtgggcctggccgcgctgcaggtc

SEQ ID NO: 25073 - DNA, 61 bp, Chlorella protothecoides
cttcatccccggcgtctacttctcctacacaccctccgccgctgaggtgtgtggggcgtgc

SEQ ID NO: 25074 - DNA, 61 bp, Chlorella protothecoides
caccttggaccacttggaggccaggaagtatgggcaggccctttgaccccgagcaaagctc

SEQ ID NO: 25075 - DNA, 205 bp, Chlorella protothecoides
tgggccacgccctgtgagggaggcgaagccggaggcgatgggatgcgggggctggtccgggtgcacgaatcagtgcctgcacactcctcagccacagcgcagtgagcggccccaccctgcacgtacgcctaccccgtgggcggcggggcctgggagcagggcatcctcagcctccgtcagccggttcagggaaaggcatgccgtg

SEQ ID NO: 25076 - DNA, 69 bp, Chlorella protothecoides
gcgtgagtggatgtgacgcaacgttgttgttgtcgaaaagggcttggacgaggtttgcagcgtccagag

SEQ ID NO: 25077 - DNA, 512 bp, Chlorella protothecoides
  modified_base (103)..(364): a, c, t, g, unknown or other
tgagctggaaggaaggacgaatcctcacacgcatacttctggcatggaggtcgactcctctcccgacgcacatgctgaaggtcagtaatgagggagcacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttgaacgcgtaattgtttgttgggtgggtgcttgacatgccaaattgcacgagcgtgttgggctccgacaccggctgggcattctttgaccaccctcagtcccacaaaggtaccacacatggcacatgtccctcaacactatgcta

SEQ ID NO: 25078 - DNA, 80 bp, Chlorella protothecoides
cgccgacagctctcccacacccctggccccggatccacgtgtcttacagcccccagcttctcggccgaggagctggagcg

SEQ ID NO: 25079 - DNA, 74 bp, Chlorella protothecoides
acctcttccaggtgaggcgtgccgcttgagcaaccagggatgtacacatgcctgcagcaggaccgctcctcacc

SEQ ID NO: 25080 - DNA, 102 bp, Chlorella protothecoides
gcggtgtgtagattgatgttgcaaagttttgttcctctctgtccaatgtatcggtgccgcgccatgggctaatgtcctgccggccaagcgagatcctcagaa

SEQ ID NO: 25081 - DNA, 3539 bp, Chlorella protothecoides
  modified_base (127)..(369): a, c, t, g, unknown or other
gcagaacaattcatgggaaatccacaccaggtatatcccaaggtattcagtcagtcatcatctcgtgcgcgaaatgggtgatgcgaccattcgccgacctcatcctcgatgtgggaagctgacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaggggcactttcgctgccatgtagtctgctcataaaccttagaggacaagttgctctttgcagggggggaccgcgagcagcgctgcatgtgtgcctgggtccacgtgggaggccgtgcagaacatcggcacccggcactccgtcagcatgtgggagtacgcgcttcaagcaactggcttgaacttaaaactagaaggagacaccgatatttcttctctcttcattcctctggacgacttcacactgcagtgccacagtgcaggtgaggagggcatcggttatttgtgggcatctgtgtgacaaagactcaaccttgtggtaaaacagggtaccagtgcacaacagctagcgtacgaggtgaggggtgatcaaccctcaaatcgcgtcatacattcctgagcagtcgagtgcgggcagctcgattcatactggaggggtgagttgacgacccctacacactttggcctactcctccttcactggacgctcagcaaattttcgtcgaggatgatatttccatcccttgatggagactcctacgtggcggacacaatgcttgaggccgttttagggaataccacgggcaacaatgagtggaaattggcagccaagatgacaaacagcagagtggtaggattgagaacaggcccttgtgcaggaggtttatgaggctgggctgtgcaaaaacatattcttttagctttcacgtgaatgaacgttcagaaagccctccatagacatagggtgcttgtcatgcagtctcctagggtaaacaccagggccaccgtcgcgattcccatatacgttctaaattaccttttagcaaccactcatgcaggcctctgtgtcagttgttgataaccatggcaacgcaaagaccgccccctcaggcgtggtggctacttattccacatgtagtggaacacttatttatgtcattcagcagcctatgtccccatccaactttccaaacatgaatgccacccgagttccaggtcttcaggtatgttgacctcagcctcagatctcacgtgtccacagtacatgcacacccatgaggatggcgatagcttatatgacgggtagggcggtgcattttcaagcaaaatatagtgcaaaattggactcaagtagtcccatagtggattagcagccagagataggtaccctgatcctccctctttgcagaagttctgctggaggagtctttggagcgctgggtttcaggtcccttaccaggtgaccgtcaacaacgatactgaaaccttctttaggttttactcactgcggtatctctccttaatatcctacttcaccggcaagtatcctgaactgcacttgaatctggatctcgcacaaccaacaacgaatgtcacactccttattccggcggacagcttcctagccgaaatcctggccatctttggtaagggaggaaacttatgggatggcagcctgccgatgcttttcaaaacgggcaggcatgctctgcaagaaatccactctgcaacacaccaaaccacgtgcagaagagataccttcagaagagtataggagggcacacaccgtcatggcgcactttttcatagatggtatgccaagacctcccaattaaactgtagcacctcatcttgggaggctgttgaggcttacggaaggcctcatcctttgcaggtggacgctgtctgggcagtagtagtgaggggcgctggatccccaccctggctgcgtcgcacctgggtcaaaacctatcgcttctcgttacacctggaagcaaacctgatgaggcatggcgtgaagtcttgcaggatgattgccattagcatacttagcaatgggttaaggaactggggcttgcagtgtgggagctgctgtacaacttttgtctagcatcctaatggtggatcacccactcccaccccctgaaaatcactgcacgcagattcagttccgtacctccttgcaacctgacaagcctgtccccgccaagtttctcgcatctggctgctatagcacgatctatgccctggatggcgtgctgcctctgtggaccagatggcaagacatcccaccatcagagcctaaccacttcccacgtgtggaacaggatcttctttttggcgtgaacccaacctgcaggacaggagatgccctcattggggtgagaaaggtgttgcatggtgaatttgtactttgtgaacggcttgaaagggcctgtttcattgcttaagtacgtgttcttagcccagatccttcctcaccaaattttgccaaaaatgcaccatctgttccacgtctgttgtcccagagatacagcggcttggatcagtttgttgaaggccctgctccttctaagagcactggcctgagcgctggtgccattgtgggcattgtcatgggcagcctggctgcagctcttgccctggcttatgggctgttgttggttggcaggcatgccaatgcgcagcaagtgagtgacaaacgtacacggaaagcgcttggttgcacattgggccaaagacgcatcccaattctgaaagagggatttctccctcttacatcatcgcagctgttccataaagtctggttcagaccacgtggttatggtgaacagggagcagagcgtcccgccaacaccagcagcaaaggtagggcaaccttgcaggtgctctctgtgtcagcaggtgggcattgatgattaattgaagcaggtgtgagacgcagctgccatgctgcatatcatacaatgaaacagcaataacaagcaatattgacgcaggtgacacaagccggcaggcatgtaacagtctgcaagcctcgccgcggcgtgtcttcagttacagagactttgagaatgggatcatgcagcccagcgacttttcattcgatttagcacctggaacccatgagagagtgaggttaggctctggaagatatggccaggtgggtaattgcttcctcatgtgacccagttttgatctgacaacgcattcttaattgtgatactcaagcaagttgcacctcgcacgatgtgcctctaccttgtgctttgaagcacagccacctaccctgagaagcagcaggaatgcagggacagcgaatcacgactccccagctacctcacccacacttccacgccaggtgtttgctggccggctgttgaatgg

SEQ ID NO: 25082 - DNA, 72 bp, Chlorella protothecoides
agcggacgaaagggcatgggacgggggcaaaccagattaaagtgcaggtgcgccagggcccggcactcatca

SEQ ID NO: 25083 - DNA, 76 bp, Chlorella protothecoides
gggtcatctgcaggtttgttgttgtgtgtgtgggggggggtgtccgtgaggagaggggatggggttcctgagagtg

SEQ ID NO: 25084 - DNA, 61 bp, Chlorella protothecoides
aaggtgctgaatgttacccagcgcatgatgcgtggggttcgggactgtccacaagggttcc

SEQ ID NO: 25085 - DNA, 67 bp, Chlorella protothecoides
gctcgactgactcggtgccctgccagggctagggaaaccctccttggaagtagcatgtctggggtca

SEQ ID NO: 25086 - DNA, 226 bp, Chlorella protothecoides
tggtacacctcgtcggtggaagcaggctgcgtaatctctgcgcacaatcctggaccaagccatggtggcccaacatgaagacagcacctaataaaaacatcgactaaataataacaatatgcatttcgggattctttccgatttggaagcgcgatacctgacgatcgcaagcatgtccagtagtcacgtgacggacggtggttccggctccgtgaccctcatcgac

SEQ ID NO: 25087 - DNA, 233 bp, Chlorella protothecoides
ccccgccaacatcaccaacccagacaccatctcggggggtgagtcatagaaatgctgtttgggagggggaaagggggaggtattggaagaccacacatggggagagggcgcatgggcaaggctgcagggagggggaggttgatggcactgtgactgagcgagcgggcgtgctggtggggtctgcatggcgtgggcaggcctttcccagccgcgctgtccgtgcacgtgttgac

SEQ ID NO: 25088 - DNA, 109 bp, Chlorella protothecoides
gcacttctcagcccccttgcccgccccttttcaatgcctgtaatcggcttcttgacccaaaggtcaagcagccagtcacattccacccttactatactgccagatgctc

SEQ ID NO: 25089 - DNA, 61 bp, Chlorella protothecoides
tgtggtggggcgatgttttgacctgccacgcagagatgctatatcgatcctcattcaggtc

SEQ ID NO: 25090 - DNA, 75 bp, Chlorella protothecoides
cgatgtgcgcgccccttccacatttgctcaagtagaggccagggtcccatgggagttgcggcacccaacctctgc

SEQ ID NO: 25091 - DNA, 124 bp, Chlorella protothecoides
gatcaaggtgtgtgtgatcctcaaaatggagatgaagaggctgaagtgagaaacagtgagcctttgccgtgaattcgcgtcattccccttccttgtgctacagggcagaatccgtttggtgctg

SEQ ID NO: 25092 - DNA, 94 bp, Chlorella protothecoides
tgggaccttgtcctggctccacaatgtcctcgaggacaaaggtgctgcctgggtcctgtgtgctgtcagcgggcgatgcccccccggctttcgc

SEQ ID NO: 25093 - DNA, 67 bp, Chlorella protothecoides
cgagaatgccgcaatgctggtgagactgcagctaggttgcagtagggaaccattcatcattgcacca

SEQ ID NO: 25094 - DNA, 61 bp, Chlorella protothecoides
ctcggcctgggggggtgggatcgagcctctcactgtgagtgctcgtgtgagtgctcgtgca

SEQ ID NO: 25095 - DNA, 65 bp, Chlorella protothecoides
caggcacaggcaccactctggggtgcaagaagctccagtgcaccatgtaaatctaccctggtgcc

SEQ ID NO: 25096 - DNA, 77 bp, Chlorella protothecoides
agagagcgaggaggttgcctcggtccaggggcaggtgtgcctggctggggttgcgcactcgtacctttcgatggcca

SEQ ID NO: 25097 - DNA, 286 bp, Chlorella protothecoides
gtcagcgggcgatgcccccccggctttcgcacgctgtagcgatggagcgcgctgagcgctagactccccggctccctcggtggcctggtccgtagaagagtctcgctccatcgatctgtcggcaggtaaggattgacaaacacgacctccaagtcctcttgacagcaccaaacggattctgccctgcagcacagggaaggggactgatgcgaattcacggcaaaggctcactgtctctcacttcagcctcttcatctcgattttgaggatcacacacaccttgatc

SEQ ID NO: 25098 - DNA, 2863 bp, Chlorella protothecoides
  modified_base (1929)..(1938): a, c, t, g, unknown or other
cggccgcccggcgcgccacccggcgcgccgcccggcgcgcggcacgccgagggcccctcccgcctcctggcctgcttcatccaccgcgtcgcgccgctggcgggcaccttctccatgctggcggcgcaccccgcggacgcaccgcccccgcccaaggaggagctgctgcggcgatgggcccagcgcgacatctacttcctcaagacgcacgtcggcatggccgcccaggcgaggaggggtagggacgaggcaaatcgaggcttggatgtttgtgaagaaggctcctgtgcacagcgtgcatggggactgcctggagctccgacccccggcgcatgcgcatggcgcgtcgcccatgcagcccagtctcgctccccattcaggccttcctcatgggcctgctggacgcggcagccctgcaccggatcgcgaagacggcccagaccgacttcgtgcgtatctgggggcgatacggagggcgcacggcaggtgagactgacttgggtgggcgcgaggttttgacatggtgagagatgcttggcatgccttccattgcacggactctgtgcacatggcggttggtgccacgaccggccctggtggccatgcctgagcgcgtctgccgagctccaccgcaccaatcgtccacccacccccaatgccaggtcgcaacctgccccgggcgatgaagcggctgaatgccgacatcgcacgcgtcaaccgcctgctgcccgagagtctgcagctggaggggctggcatggcctcaagcggccgccctccacgaaccccagccctcgacgttctccaggaccttctcgcccgccatctcggaggtcagctcgcgcctggcggtggcaccatgacacccttggcttgataccagggaaggctgaagggcatgcaggggaacactggcatgcgcccctccatccctttcaatctttcattttgactagagtattggggaacaattttttaaaggagttttactatcccaccttgtggactattgaagaatttggtgagtgtaccagcccgtagttggacattgcgagcagctgagtggctgccagccgtgggcgccagagatccgctgcatgccgattgaccaggcgagtggaggcacgcaaatggcctacataccaccacgcctgccactttcagagaagcacgatgtcgacatcactcatataaaggtcacatggctagcttaggtgttcactgcagctgtgcatgggaggcacaactcacttgctccactggcccacgacacagttacctacgctgtctcagaaggggcctcggcggtgaacgctcgccccagcttaggcagaggataccaacatatgctgtatatatagatgctctgccatcgcttggccgcagagaccatgggaggagtgtggccttctctgcgtctctggcccgtggacaccagggcgtcgacagccacataggcgccgagcggccctctccttccccgcgcgagcacacgggctcatcccagcgttctgcctcgtctgctggcaaagaacctgcttcctccaagaatagttatacccgcaagcttcgaggtgggtatggcaaaagcctgtgtctgctctgcacgacaatggtgacgtcctggcatttcacatgccacctgggacccacagtgggtgtccattgcgtcagacaccagaccctcccattcatgcacttgaaagcagagctgtgcagcagtgggcagctggatgcggcgtgccggctggccgaggaagcctgcgcaggggccaacccccccagctacacgaatctacagcatgtgctgaatgccaccctgcaggtagctatgtataagcgtgcgctgcaatgcttattttccagtgggagatggacggttcgtagcttgatgatgacatcagtagtcggccagctatgcgcggttgcnnnnnnnnnngagcgtgcgctgcaatgcttgttttccagtgggagatggacggttcgtagtttgatgatgagatcagtagtcggccagctatgcgcggttgcatcaccgtgtgcttgctgcaatcacccccttgccccccccaagctcccctgattaccccattcccatccggtattccctgctttcaaccaggcacactcgcccttcctggcggtgcgcatcctgcgtgcgatgtcacgggcggggtacgcccccaacaaggtcacgtactgcgccctcatcgcggccctgggcagggaggggccgcgcggcggcgagggctcggtccaggcattcgagctgtggaaggagctggaggcccagaacatcgagctggacgcggccgccatccgcacaggtgggggggagcggaggttgggtggtggatgcctgtttggctggtcaggaattcgatggggagggcctcgttgatggggaaccagggagggcaaatggggctcaaggccaggctgcgacctgcaaggtccccgtttctcacgagatgtctggcctgctgagcttcagagcacgcacacatggacgtgtttgggcacaaactctccactcacacatgtacacgctccctcgtcctccgatgcacaccaggcatgaaggcctgcgtgggcgtgggcgacctccccgccgccgaggccctgctctccggcctcctctccggcgcacaccccgccccgcccgacgcccgcgccttcaacatcgtgctgtctggccacgcgcgcgcgggcgacgtggagggcatggagcgcacgctgcgtgcgctgtgcgccgccgacgtccccgccagcgacgtgacctacaacacgctggtggacgggtacgcgcgcgccgggcgccccgccgccgcgcgcgacgtgctcgcctcggcggcggcggccgg

SEQ ID NO: 25099 - DNA, 79 bp, Chlorella protothecoides
ggtttcggaccgccaggccggcgcgaccctattcagccccacacgatcaccccatgactccacaggagccccacaagta

SEQ ID NO: 25100 - DNA, 518 bp, Chlorella protothecoides
  modified_base (278)..(441): a, c, t, g, unknown or other
gcgctgctggagggcaaggagtgacggaggtctgacccaggaggttgactcaccaggagaagttgggaggtggaggggacggttttcggcccccggacttcgctgccgggcctcccttgagaagaacatggggcgtgccggggctgctccatgtcctcccctgcttttccacccggggtgtggagacgctcaccgctctgcaaccccctctgctcagctttgatccccaacggctcgaaagccgccgctcgtctactctttccttcattcccgctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatctgagctgagcgtagagcacccaagcagcgcaaaggccccctcctgccctactccctccacgcgacgtgcacct

SEQ ID NO: 25101 - DNA, 74 bp, Chlorella protothecoides
cccgctgggcggtgcggctattccccacaaacgggcctggagcgtgtcgcagggtccattcatggtatggccca

SEQ ID NO: 25102 - DNA, 163 bp, Chlorella protothecoides
gatcaggcgtccagggaggctgtcaatggagcgctgcacacggcaagaggtgccaggcgggaatgcagtgggttagtgtgcagttgctgtgcttccccaccttggtcgctttccagtagatcccgacgaagagaagtgctatgcccgccaacgtagctaactc

SEQ ID NO: 25103 - DNA, 61 bp, Chlorella protothecoides
tcgaacttgcgaaacattaccccgagcccccgaaaaagccatcatagataaggaatttaag

SEQ ID NO: 25104 - DNA, 64 bp, Chlorella protothecoides
aaaaggcccagcggcttgtgctctaatgtatttgtggcaggtacttggatcaaagggcgacaaa

SEQ ID NO: 25105 - DNA, 80 bp, Chlorella protothecoides
ggtgtgattgcatggtgagaatgtatggattaatgacgacgtataggcgtagaggaacggcaccccttgaataatcctgg

SEQ ID NO: 25106 - DNA, 61 bp, Chlorella protothecoides
atgccaagtccctttgcacgtgggtttagactgtgtctactgcaatcctctcaccctcttg

SEQ ID NO: 25107 - DNA, 80 bp, Chlorella protothecoides
cgtccatgaggatgtggttgccaggcatgggtcttgagtcgatgtgcagtcccaccagctccaatcgatgcagccactgg

SEQ ID NO: 25108 - DNA, 76 bp, Chlorella protothecoides
gaggcgctcggtagcccagccgccctcccgtctgtgaaaggggacgccatttcgacgcaccagccgtactgcttct

SEQ ID NO: 25109 - DNA, 6114 bp, Chlorella protothecoides
  modified_base (4869)..(5072): a, c, t, g, unknown or other
  modified_base (5401)..(5410): a, c, t, g, unknown or other
  modified_base (6048)..(6057): a, c, t, g, unknown or other
ggggggggtgagaggggagcgtgggggggtttggagcgctggcttgcttcgaactctggaggtatagccgcttgacgctcctgcatgccgcctctcacgctctaaggctgcatagcgatggtagggtgggaggtggtcgtggtccccccttgcgcacagcgccctgcagaccgtgccgctgtggaggcggtgcggcgatctcaggcgcaggcctccgcgccaactcactcccaccgacctcctttccacatcccctcgccgcctgccaggcggcggccacatggttgtggtgggcacgacctcgtccccagacagcctggaccccgcgctgcgccgccccgggcgcttcgacaccgagatcccggtgcccgtgccagacgggccggcgcgggtgcacatcctgcgagcgctagcggcgggcctgggcgcagcggctggcctggacctggacgagctggcgctgggctgcttcggctactccggcgccgacctggcggcgctgtgccgggaggccgcgctgtccgcgctgggcagggtcgcgggcggcgcgggcgagggttcggggatggagccggggcctcggagtccccgacagggagccggtagcccaggccccagggaggaagatgtggttgtaacgatggaggactttgagtcggcgcgctcaaaggtggtcccctccatcacgcgcgggctgaccctggactttgtgcccgtcgcctgggaccagatcggcggcctcccggacatcaagcggcgcctgcggtgcgtggcgggttggaggtcttgcatggggggagggcaagaaaggcgtatctcaacagggcacagtggcaccggcaggcaatgcaggcacttgccactggggtacagtttggtgcctcgagggtctggtcgccctaccttttgttgggagcaaggtctgtaactcacacaacacccctggtcacgcctgccccgcgcacacaccaggcaagcggtggagtggccgctgcaacgggcgccagccttccagaggctgggcctggtccccccacgcggcgtccttctgcacggtccccccggctgcagcaaaaccaccctggcccgggccgtggccacctcctcccgggccacctttgtctcgctcagcgtgtcccagctcttcagccagtacgtgggcgagggcgaggccatcctgcgccgcgctttccagagggcccgcctggcagccccggccatccttttcctggacgaggtggacgtgctcgtgggtgtgtggcgtgcttgttgtggtggggcagtatttgtggctgtcatgggtggtgatttgagcaagtgatgctggggtcgacgggccatcagccggcgggcgattcatggggagggcaatgtttgctcccgcgcagaatgcgtgtagatgctgcccttcagtcctcactcgtgaacccacaccgtggcctcgacccaatgccgctttcctccttggccatgcgcagggcgccgcagcgagggcgagcagacgcaggacgccacggcccggctgctgtccaccttcctcaccgagatggacgggctggaggccgccaggggggtgctggtcctgggcgccaccaaccgtccctccgccatcgacgcagccatgctgaggtggggcgccgcgcccggtcgtgctgtttgcctgttggtggggggcggggggcggtcgtgggggggacacagggtccctcggcgccagtgcactgcctgtcgcgcgagtgtcgcgaccccacaccacaaccctaggccccacccgagcaggaaagggcgactcgccaggccccccctgcgcgccgcgcatgacacacggccatgcccccttgctgagtcgatgaccacctcagcacaacccccctcctccccgatgctttcctcctttccaccccaggcccggccgcttcgacgtcgtgctgtacgtgcccccgccggacctggaggggcgggaggccgtgctgcgcatccactcccgcggcatgccgctggcgccgggcgtggacctgcgggccctggcggcgcgcacccagcgctacacgggcgccgagctggcgcaggtgtgtcgcgaggcggcgctggctgcggtgcgcgaggacgggccggagaggtgggtcggcccggcgcactttgaggccgcgctggaggaggtggcgccggcgctgagtcagcacgacctggacagggcggcggcgtggaggcggcggccggcacccacgcccctgccctcgcgagcccccggtcctcgcaatgaaccgacggcgacggcgccgtgacggggcgcgaagactgtacacggtgcgggggcccggcgtctccagcccagagatcaggcagctggggcaaggttcagcgcggcagcagcaacggggcatcgcttggcacagacccactgtccctgatacctgctcggttccagcatgggtgcagcacgacccctgcctgctgatggagggcggaaaactcgagccatcatcaaccttgtcctcaggggcgctgccgcctctccagcgcgcccacgtagtcccgcgcccactccgtcagcagagacctgagctttcggtgcgcgttccgcggcaccgcggcggcaaacaccgcggggggcagcgccggctgggcggcgctgtacgcgccggtgatctccatgacctcgctggcgtgcatgccgagcaggaccaaagtgcgtgggctgccggatccgtcctcgtagacgatggggcgccccggtcttttcctctgtggggaaagggtgtgtgagcagaaacgtgtgagattcgaccagggaagctggagctgcccagagtagatacatcaaggcctcacctctgaagggccctcccttgtcttgagcgcttgggacaggggcatgtccagcattcggtcggtggccacgatgagctcaaccatgtgggcatccagttctaccaacagcgccctcagctcttccagctccctggggctgaaacccaccgccagcatcgcctgaggaggatcaagggaaggagtcgggttccacgacatgcatgggccatgcacgtgtcgtcgacatgcaactccgagcaggcgggtgcacagatgcggctaccaagttgtcgctcggcccctcatgctcatgacctggtgatcccttccccaccacctcaggagaaaactcgccatgggcccactcgggttggcggtggggagctggtatccctcgtcaagtcgaacgatgctctcgtctcctagatacgcatgcaagcttgcagcggtgcgcctcttcgatgtctgcgccgatgtgggtgtcgggacacggggactctgccatggcacactgccctgtcggaaaggtgacccacatatgcgcggatgcagcgtggccagaacagccgtcattgatggtgctctgctgatggaattatgtcgaggaggcatatgatgggtgacgaagctagctcgtgcttgtgcatggtgtgggtgagcgcggaaaatgcttgtaggtatttcagtgtcggtgaacacgtgctggcaggatccggttcgggccatcataggcgccattcctcatgcatgcctgagaaccaaattaagaaactaagtcgtagccaaccttaatgggattggatggaacgtactgtgtatgtgctgcgatgtacgttcttgcagggattgcccggaggggaagggtgtctccctggacactgtgcaaatctgaccacccgggactacactgaacgccaagtctgacgccattcgagccccctcgtgttttaaaacggagctgaaatgcgaaatgccgctcgatcaggctccgagaacctcagcttggacggctcccagttttgtcacttcgcgaggccttgtcgtggccagtcggggatgggaacgtaccgcacgaggcgattttcatgttaaaccccacaggaaggtaggctatcgagtgcaagggcgatggaatgcaatcggctcatattgatcgtgcccgatgccccccattggctgttgaaagaccgagaggggcctcctcatatccttcttccttccaatgtgccagagggaaggtggggtacagatgttctctgcagcgaaacttcttgagcttctggcttccaggtcccatcccaggcagtaagcggtgggtgcttatgccatgcaatgtcagaggggccatcctaaacccaaacaagggaaccccttaatgattgattccagcgcagattgtggtcaaaatcagatgtagtggcagcttttaaaatatggtctattgctgacacgcatcctttgtctggcctcatctccacccctgctgggaactctgtaccagaccttcctcaacggagagcttcgaggcaggggaggagtcaggtctgaaactggccgtcaccatgtgtgcaagttgcatatctggcccaatgtgatgctgtcacaatccgggagttgcagctggccgcacacctttcttcatactaggattgagcgtgtcaaaagggtaccaggccgctgcaatggatggcggcccggtggccgcgttcctacgggcccgagcccttttcgcacctactgggcatggccttggtgactgagaagacgttcgcacttgggttccatatccgaaacccttatcggtatttccgccctgtgctaccactccacatgcaggtgagatttgggcagctgattggtgaggaattggcgttggtgcgctgcggcttgatggcgggtttgatggccaagctggtcgtgaacgagcagccccgagactcgctacgggcaagagtatggcgcgggggaggactgccttcacacatccatttccctaggggccaacgatttcacgatatagcgctcattgcctggtccatccgtcaggtgaagcaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttgacacatgaggcagccggagggtcgtccggatgcggagatgctattcctgaggcggcgctgaggagttccaaagctgccatcgccatcgggtgacttgtcctggatccaatggtatatgaggcctgggataaagatttagattgctgaaaatcggttgtcactcccttgcgagtcaactgaatggatccaacgccgctttcattctgcatcgttctaccatgggacacggcagggtctttccggattccctcggagagcatcaagggcgtcgctcatgttacccctgcacccataaatgctgcaagcgcaggggcccagtagnnnnnnnnnntccgcgaggagcatcaagagctttgctcatatttccctgcacccataaacgctgcaagcgcaggggcccagtagattaattgcaacacttgcagcgtgatattcgaccgaggtccagcgaagaaaaggcgtaccgacgcagggcaacgcatctcatcctgaccgcaaacacgttcagcattcggaacaggacgagcaccgcgaggtgcaggatgccaccgtccgtcaggaaccctaccttcctgactggcctcgtcctgctgctgaccagatgtgccttcgcggtgggttggattgctccctggtcgatgtcgatcccacgtcagctgcccttcgcgagtgccccattttcgctcactctccccgctttcgagcacaccgcaggccacatgcagctccactttcgtctcgcttcccagtgcaatgtgaggcttgggctttgttcgttgtgggagaagagagcggggtttcaaggtgcttcacccttgccgtcactgttcacacaaagccatcgcgcacatcgctccggtcgagcccggggtccctatgcagctctctctagcgctgacagacctgctgcctcagtcatgcacgtatagattgcacccgagatggaccactagcgcatgtctcttcccnnnnnnnnnntcttcagtcacgcacgtatagattgcgcctgagatggaccactagcgcatgtctctt

SEQ ID NO: 25110 - DNA, 68 bp, Chlorella protothecoides
cctggcgggtttacgaccgaagatgcacacggcctcctaacaccaaaaccattgcaactttttttttt

SEQ ID NO: 25111 - DNA, 74 bp, Chlorella protothecoides
tgcaggtgccagaggggcagtcgctcgccgtcccgatacaggcatggagaaacgctgccctccctggacaccgc

SEQ ID NO: 25112 - DNA, 61 bp, Chlorella protothecoides
aggcgatgaataaataacgctcggcagtaactcatgaagggtcatctagatacatggaata

SEQ ID NO: 25113 - DNA, 80 bp, Chlorella protothecoides
gtcccagtccttggtcttctcctgtgtgccgagaggggcgggatcgggggaggggggagggatcatgagcgagggtttta

SEQ ID NO: 25114 - DNA, 288 bp, Chlorella protothecoides
ggcatcgcaacggaggtccagggtgcgtggtcgtggaccctggccggtcctgagagcaatggtgcagggaggggtgctgtgcgagggggaatgacaagatgaggagggtgggtgaggacccacgggaggagcagcgcatttatctcagtccatgagcgcctgccgtgtgaccgagggacgtgcaagctcatggaccccagctgtgtgacaggctggagcccacgccatgcgctgtgcacgaaatgacaccccacatcagtttgtgcacacctggcacttcaatgacat

SEQ ID NO: 25115 - DNA, 135 bp, Chlorella protothecoides
acgccgcgacatgctcctgctctccgccggagcgcgggagacgatccgcttcctgcccccgctcaacgtgagcgaggaggagattgacgccgctcttagcatcttcgaggactccctggctgaggcggtgcgcga

SEQ ID NO: 25116 - DNA, 153 bp, Chlorella protothecoides
ctgtcaccgtgttagcatttggaaaagactcttcagactgagatactgagcgtgttgaaggaatctggtttttgattacgttctcctacttgagggtagcagccaccttcaggagcgcttcaaggcacggacggcatctgccacctcttgttc

SEQ ID NO: 25117 - DNA, 64 bp, Chlorella protothecoides
cagtccgtcttcttctcctccctgtcgcccgtcgtcttctcctcctcacatggtcattccgatc

SEQ ID NO: 25118 - DNA, 75 bp, Chlorella protothecoides
ggtggagcatcgctgctgctgtccacagggtgtgggccagtggtgctgtccagtccttcagtgtcaggctccttg

SEQ ID NO: 25119 - DNA, 169 bp, Chlorella protothecoides
ggaacatgcagaggcaggagatgcaatcatgagaccgatgttcccttgaggtcaggaggccgcccacctccacatggccctggtgccagttgtacgaggccaacaccatgtaccctgcgagccatcaaggaaatggttgggaactggacccctgcaacaagcgcccagg

SEQ ID NO: 25120 - DNA, 70 bp, Chlorella protothecoides
tcatcaaagcagttgtgtagaagaatgaggtgttctggtgatcttgaagattccctggaggatggcagtc

SEQ ID NO: 25121 - DNA, 13147 bp, Chlorella protothecoides
  modified_base (318)..(327): a, c, t, g, unknown or other
  modified_base (710)..(719): a, c, t, g, unknown or other
  modified_base (1004)..(1013): a, c, t, g, unknown or other
  modified_base (1870)..(1879): a, c, t, g, unknown or other
  modified_base (2779)..(2788): a, c, t, g, unknown or other
  modified_base (3027)..(3081): a, c, t, g, unknown or other
  modified_base (3782)..(3791): a, c, t, g, unknown or other
  modified_base (4476)..(4485): a, c, t, g, unknown or other
  modified_base (4954)..(4963): a, c, t, g, unknown or other
  modified_base (5575)..(5584): a, c, t, g, unknown or other
  modified_base (5957)..(5966): a, c, t, g, unknown or other
  modified_base (6204)..(6213): a, c, t, g, unknown or other
  modified_base (7283)..(7464): a, c, t, g, unknown or other
  modified_base (7562)..(7799): a, c, t, g, unknown or other
  modified_base (7901)..(7910): a, c, t, g, unknown or other
  modified_base (8863)..(8872): a, c, t, g, unknown or other
  modified_base (9417)..(9426): a, c, t, g, unknown or other
  modified_base (11009)..(11018): a, c, t, g, unknown or other
  modified_base (11444)..(11453): a, c, t, g, unknown or other
  modified_base (12252)..(12261): a, c, t, g, unknown or other
  modified_base (12369)..(12386): a, c, t, g, unknown or other
  modified_base (12694)..(12703): a, c, t, g, unknown or other
cgggggcgggggcggcggctgccgggcacgcgcgtcgccgccctcgcccgccagcctgcccctccacccagtcggcccggggcccaggctgtccaggtcggcgtgcgacccttgcttggcgtaggccgcggccgcggcgcggaccgcctcccaccgctgctccagggccttgcgcagctcacgggggtcaaactgctggcgcaggctgtggggtaacggcgaagaggagcccgggtgaatgctgacggagcgaatatggaggcaaggacgtgcacacgccaggcatggggccctgcaggcgcagcgtctcgacaatcnnnnnnnnnngcgggggtcaaactgctggcgcaggctgtcgggcaacggcggagagaagcccgggtgaatgctttcggagcgagtatggatgcaaggacgtgcacacgccaggcattgggccctgcaggcgcagcgtctcgacaatcgcggcctccccatcccccttcgagcctcgccacacctggggtcgttcttgcgctgctcgaactcggccttgacggatccaccccagaagtcggcgaggtactgcttgtactgcaccccagcctcctccacacccacgctgtcgtccagggacagggcaaactcgcggaagctgacgggctcgtcacggccggtgcggcgacgatcctccgggccacgggcgtagcccccgcgtcgtccgcggccgnnnnnnnnnnacggaagctgacgggctcgtcacgaccagtgcggcgacgatcctccgggccgcgggcgtagcccccgcgtcgtccgcggccgccacccatgcctctgcaccagggggcgtggggacatgtgcacgcgtcaccctggtgatccagccactttgaacctgccagcatgctgcgatggtcacacccccctctggctctcacgctacgccgggccctgcgcagtgaaacagactccaaccaccatgctacgacaggaagagccaggcacggccgtggggcctcacctgnnnnnnnnnngacgcgtcaccctggtgcgccagccacttcgaaccggccagcatgctgcgacggtcacacacccctctggctctcacgctgcgccgggccctgcgcagtgaaacagaccccaaccaccatgctacgacaggaggagccaggcacggccgtggggcctcacctgtcgtactcatcgccacggaaccgcttttcgtagggcggtgagcggtcccggcgatacctgtcgggactggggctgcgcggacgcctcctgtcccccatcggaccaggtccgtagggcatcctcctgtcctcgcgccgcggactgcgcctcctgtccccgcccctcatcatggccgcccactcgctggcaacctccctgaacaggaagcgacggcaccgtcactacaggcccaggcatgggggaggaagggatgaggactcctggattgtccagtagtttctgtgtaatgcagacaaggggagaaagcatcgaccccaggtccctcggcaggatggtgccagggaagtaaggcacggtgatggccggtctgcaccccatctcctgctcgtcaacagtgccgaacacgcgggcacgcacctgacttccagggatctgagaatcccaccgagcaccagctgggaggtcgtacctgggcttgctccccaggctgcactggcacccaggacctcctgcaatgtgatgattggaaatcgagaaacttttgagaagcgtcgtgcattctgcttgtgttttctccccatatgcgaccacattcttgaacagactacaacaaaacaataactgaaaggcttaatcagcggactcatacattagcaagcgtgccctgctaagagcaaggacttagagacgtccnnnnnnnnnntcacattcttgaacagaccacaacaaaataattactgaaaggcgtaatcagcggaaccatacattagcaagcgtaacctgctaagagcaaggacttagagacgtcccagtctgacatggcgctcctcgctgtgacaggaccaattgtcgacacggccttcgtacaggagattgctgcagcgcatgcattagctgtgtctagtctcaagctagtcactcaggcgacgaagctggaggacaaagctctccccgcgagcgcatttgacacggtcgtctcggttgctagcacgtctggggaacacagccttgcctacctgggcaggcttgcactctgtctgagacctggaggggcgcttgtagtttctgagccggtgagtcgatttcttcgaaaccgtttggtggagcggacgatgatgtattccatccactgaactcagggagcaatgtgccccctcctcattgctggcagggtgcgtctccagctggactccagaagaatctcaccctagctggcctgggcactgcatcagcaggccccctggacagcgtcgtctcttccaagccggcatgggagaccggcgcgagagccgcaatctccctcaggaagaagccggctgcagttcaggccgcacctgcctggaagctgagcgttgacgacgaggatgatgacatcatcgacgatgagcagctgctcacagcagaggacctcgttcgccctgcaccagcaggtgaggtcggactgcatccggggttcgtgaggttggcgctttctgtgagatcactcacccccatccatccctgccactccatcttgtgcaatccgcagcgccaggttgcggccccgcagtgagtaaagcgtgcaagaactgcacgtgtggacgtgccgaggctaccgagccgnnnnnnnnnngctgggttttgtgaggttggcgttttctgtaagatcactcacccccatccatccctgccactccatctcgtgcaatccgcagcggcaggttgcggccccgcagtgagcaaagcgtgcaagaactgtacgtgtggacgtgccgaggctaccgagccggtcaagctgaccaaggccatgctggagaagccgacctccggctgtgggagtgtgagtgggcgtggcctcgagggcgggggggnnnnnnnnnnnnnnnnnnnnnnnnnnnnnnnnnnnnnnnnnnnnnnnnnnnnnnnactggacttgcccacgaacaagtgtcatcaacaccacaacccaccctcgcagtgtgcgctgggggacgcctaccgctgcggcggctgcccataccgcggcctccccgcttttgagctgggcaagaagatcgagctgccctcggacttcctggtgacagacgcgtgaggcggcacccaggcgcagcagggctgaagacagtgtctgtgctagggcgggctgcctgcagcgcccccagcctgtctggtgcacccatgtagtataacagtgatctgcaccctcccagagctccagttcagtgttcctcaaggggcggggagggacgtcaccggaacagttctgagccgaaggccctgcagcatcgcagcccctcaccggccgtgcacgagggcgagcagcgcccccagcaggcgcctgccctgcgcccccgtgactgggtccacagccctcagcacatcccccgtcgcggtggcgttcagggcgggcacggccgcgttcagggcctgcgcggccgccagcttgctgcaggacgcctctatcgaggtcatggccgacatgtccttgtgcgcggacctgcaggcggcgatgagggggggggggttggtccttggtgaagcgcagacgagggcgcagccagtgcacccaccccatgcgctgccggcgggcccctcaacccgccgccctccgcaggcgttcctcgatnnnnnnnnnngttagtccttggtgaagcgcagacgaggacgcagccagtgcaccccccccatgcgctgccggcgggcccctagacccgccgccctccgcaggcgttcctcgatcccagcccacgcatcaggcgctcccacttgctgcagcggcagcccacctggccaggacgaggaagatgacgcagtggaggaccagggcgtaggccatcagcgccgacctggcagtacgcgacctcgccaccaccgccccgatgcggtacgcggcgcgctctgtcagcggcatgccccgcgtcgccgccgtcctctccttggctcggaacgctgggaggagatggagagaagaggaaaggttgacggatgaggagtgggcggcgtggggcagcaggcatgacaggtttcggatgcagcaggcaagcagcagggtcgtgtgctgcgccagggcacctcctctccgggcgacatctgggccctcccgctgctgacccaccgttgaaggggttgacgccgtcctcgtactgcttcatgtaccgccccaccgcgtccgccccgctctccacatcccccccggcctggacccggccatagctctgcaggcggggcgtggcggtggctcggggacagggttgttacatctttggggcagtgatgccttccactaattgtcccccccccccccccccccccccccggggnnnnnnnnnngtccccctcggcctggacccggccatagctctgcaggccgggcgcggcggtggctcggggacagggttgtttcatctttggggcagtgatgccttgcaataaatgtcccccccccccgcccttccccccgggggggggccttgctcccgcccacactccctcagagtgtcctgcaaacgccccgcctgaagttgacgcccgacgcacctggacatacttgagccgctccgccagcgccaggttgtcggccctcgccgcctccagatcgttcccagcctggcattgtggatgagtgcgcatcataatgaggagggggggagggcatggcaggcgcgaaaggccgggggcgccagggcccaactcctgcacccgggagcgctcagggtcgccgggggtggagtctgtgcatcgctgtcatgcgtgctccgcaaaccctagtgcgacccagccagtccgcagggagcacagnnnnnnnnnnagggggcgccagggcccaactcctgcacccaggagcgctcagggtcgccggggatggagtctgtgaatcgctgtcgtgcgtgctccgtgcactcaatgcgacccagccagtccgcagggagcacagctccccctcctgcatgcatccagtcaaaccacgcccgagccgccccacacgctcccacccgtgccagctgctgcgtctgcacgagcaggtgctcctccagctcgcgcacgcgcgcacggaagcggtcccgctgcccgctcatcaccgccagcatggagggcgcctcgtcttccctgccgccccccgcggcggcgccaggatcggggccggcgcccgggccgccgttgggcccctgctccgcgggccccgacccagaggccgccacctggcgctgcgccagcaccaggtcctcctccaggcggccagccagctgctgcgcggcttccagctcggacgccaaggaagccgcctgcgcctcggccgcgtcgctcgcgcctgaggagttggggtggcctggctttgaggggctgggtgcctccaggcatgtgacaggacttgcggtgcacgcggtggagcagagcccatgtgcagcctgctctcaccccnnnnnnnnnngaggacttgcggtgcatgcgatggaacagagcccatgtgcagcctgctctcaccccacccctcccgtcctcaacatgccccaccctagagccttctcaccccccccaacagcacaagcaccacccactctgcgcctgggtggccgccagccgcgccagggtgagctcgtgctcaagccgccggctgcgctccgccagcgcggccgtcacgccgtccaagccctccgcacccgcgctctctccgtagcccagggtctggagcaggcgcacctgctgccgcagctcggccaccttgcagtgagaggggaggagggaagtgggtgctgaatgacgtgcatgggttgggcaggtttgaccactggggccagccaggnnnnnnnnnnggtgagaggggaggagggaagtgggtgctgcatgacggtgcatgggtcgggcaggtttgaccactggggccagccaggcacgagcttcccaacgggtggggaaggtttcgaatgttctgagaccctgtgcctggggtacctagagtgctgcatgccacacccacaccacagcatccaggccatcatttcccgggatctaggaccctgcctgcccacccagtcggccctgcccaccagnnnnnnnnnntccacaaccacaccacagcatccaggccatcatttcgcgggatctaggaccctccctgcccacccagtcggccctgcccaccaggccccacctcttcctgcgtcggcctggaagccagagcggcctccagagccgcgctctggctgctctgggcctccagcagagcccgcaccccctccagctttgagtcggcggccgcgccggactgagccagctcctccctggcagcccgcagctgtggaggagggcgtgccgaggtcggcgtcggtcgtctgcacgtcggaggagagcccggccggggaatagcattgcagcgagcacccaagcaaccggtgcccgcagggtcacctcacccgcgcgccaccagcaaccccctcccaaagaccccagtgggccctggcgcgcgtggtcgttgcacagacactgcacgctcgtcccaacagccagcccttgtggtacaccaacccccatgtcccccgctcacttcggaggccaggcgccccgcaagctcccgctggacgtacagctcctgccgcagggcctcctccgttcccgagcggtcgacgggctcaggggcgctcgatccctcgccaccccgctctccctgtgcctgctggcagggcagtgagggctgcgagggtgaaaaggattctggatggcgcgccaccggtacaacccccggctgcagctcccaggccgtcgtgcaagctgcaaggcctcggccaggcccgccccacgacacagatccaggcatccaccttctcgagcatggcttcgtgctccttttccagcagcgccagcctggcctgcgccctctccatctcctccacggccaggtccagctcggatcgaaggttcacctgacggacgcagacagtgggcaagctactgacgatattggcatcatgtggtggccctgggcactccctctggtatagaaacacaccaagcgccccttgcacccaaccagggctccaacgcatggcagtccaccctcttgacacatgacgcccaaatccctagcatgatccccgactcgtcttcccttcactcacacaccccatcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggatttgtcgaggctcttccccccagcatcccagagacctggcctgccaggggcgggaccaatacagaacggcaggccaatcctgccctgcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctccaccatcccagcaagagacctcattctgagcagcattccttcatcccgctcccaagccatctcttaagtgctcctcaccttttcttcaacctgggcnnnnnnnnnncgacacacggcgctcaaattcccagcatgatccccgactcttcttcccttcactcacacaccccatcagtacctgctcctcctcgctgcgagactgcatggtcatgacctgggtctgggaggcctggtgcagccgccgcatggcctccacgctggcctgggcctggaaggagaagacagcggagtacagggatttgtcgaggatcttccccccagcatcccagagtcctggcctgccaggggcgggaccaatgcagaacggcaggccaatcctgccctgcgctggcccccgtcgggacatcccacctgtgccagctcgtcggcaagcctttcttcacgctggcgcatctcggcgacgatcgcttcttgtgcctcttctgcggcgctgcgcttgctctctttcacttgtcggtcctggggcagttccaggagggttggggcagctttaaatacaatgcaggtggacaggcaagcgggcagattcttgattgtgctcctggaaactttgggcaagcaacgcaccaagaatgtccaatgtcttcaccatcccagcaagagtcctcattttgagcagcatcccttcatcccgctcccaagccatctcttgagtgctcctcaccttttcttcaacctgggcctccagactccggaccttctcctccaatcgccggatggtaaggtcctggttccgcagcgctgagctctcttccttatactctgccagctcctgagccaggcggttggcccgtgcttcagcggctgtgcatttggacgccagctcctgtttgtgacgggtgggggaaagggattcttggcacgactgacaggttaaggcagcaaaacaccgccacgacagcatcgatgctcttcaagattctccacggtcattaaatgctggacagcgctcaagcatgcctccctctgaggacctcaccactccaagcgcgagcgagnnnnnnnnnngttcaagattctccacagttaataaatgctggacagcgctcatgcatgcctccctccgaggacctcaccactccaagcgcgagcgagggagtggggtcgggagcatcatacaggcgctggtacaactcgaggaaagcggattcgccagtcttggccctgcagcattgggaggagttgtaagggagtagagggcctttatgctagagagtccggttttaagtgcatgttttgcagtctctggtaccagaaaatgaggtgttgacatgaaggtctcaccacacctggtggtgagcctgtcgatctcctcctggtaggcccgcagcaaagggccaacctccttggaaacctctgggggaagcttcttcctcagctctgcagaaaattgtgtttgacagggagcttggtgacgtactctctgatgaaaatagatgccagagtctgttcgcacgcggcaagacctcccagttgacttctcactccagcacaaagtctcggcagtgcagttggggcgcccaacccccataccttttgtgttcccagccagnnnnnnnnnnatctgcagaaaattgtgtttgacagggagcctggtgatgtactttctgatggaaatagatgccagagtctgttcgcacacggcaagacctctttattgacttctcactccagcacaaagtcttcgcagtgcagttggggtgcctaacccccataccttttgtgttcccagccagctcctttcggctcctaagggaggcttcctgtgcctctgccagggccattgcctgcccgtcgagctgtgtgcgcaaaccatccagatcaaactctgcaccaggagtccagggaggagccacacgtgatcatggagatctgtcccattctcagcgagcagagccctccctttgttgccagtaacgatccagtacctttccaaaaggcttgcacgctcacagccgggctcgggtcggatgcaggccctacggcactcgtggactctgtggccatcgtcaccaggcttgccctgtcccgaggctagtgcatataaattttctgtgcgttccctgaagcggatctagccttcctggagatgggcggggggccaggcgcagaccgctgcgatggtattttcgtctcggtgcaccttccggtcgttgtgctttagcgcgcgcggatcgctagcacatgatccgaatggacggttcactgcctcgccagcaggggacacgttcaagaatcattacttcaccattcagtgaatccaagcgcaactttgatataccacccaccgtcctgatcccatggctttcgtcgcgggcctgtcgaccacctcttaaccccattaccccactcttctctgggggcatgttgggcgctctgcaccctgcagagcttcagatctgccacatatctcgcttctcatggtttaaaagagcacctgctgggcgagctcgagctgctggacgcaggtggcaggtcccccgcgccgagcaccaggaggctcccgcaaaggctgggcgcgacgccctcgcaggccttgatgccggggccctgtgcctggagatagagcccggcaccaataactcccgctgcatctacgccagcaccgacgtgccggcccccaaggagaccctctggcgactgctcaccgactaccagcacctcaatgacttcatcccgggtgcgttgttgtgggaacccctggccaggccggcactcggacctgtcgccagtcttgcaatttgagcctgacgtggccgtaagcgccagccaccgtgtgctcccccatcctgaaatccccaacctccaagtcttcctctcccaggcctggccgtcaaccaggagctggagtcctttcccgacggctgcaaactgctccaggtggggcagcaggagctggccctgggcttcaaattcacggcgcggtgcgtgctgaacatccgggagcaccccgacggcatccctggccgcctgctgggacccaatggcggcagcggggctggcaatggtgatcgtggccggtccgcgccgctagacggctcctccttccccgcaccgcgctcgcagatgggggttgatgcgccgcacgccgacattgtgtttgagtcggtgcaaggcgatttccaggtactcgtagggcttggannnnnnnnnnttccctaacctccaagtctccccctcccaggcctggccgtcaaccaggagctggagacctttcccgacggctgcaagctgctccaggttgggcagcaggagctggccctgggcttcaagttcacggcgcggtgcgttctggacatccgagagcaccccgatggcatccctggccgcctgctgagacccaacggcggcagcggggctggcaatggtgatcgtggccggtccgcgccgctagacggctcctccttccctgcgccgcgctcgcagatggggaccgctgcgccgcacgccgacatcgtgttcgagtcggtgcagggcgatttccaggtactcgtagggcttggagaggggggagctgggcttctaccaggagtggctgttgtgagccctttgcgcactgtctggctgtacatggactccnnnnnnnnnncctatcaggagcggctgttgtgagcccattgcgcactgtctggctgtacatggactcccgtgtcatcgccacccctgcccaaccctcccccctcccaaaccactcgagcaacaggtgttcaagggcctgtggcggatgcaggcccgggacacctcgcgcgcccacctgtcctactcccttttcgtccggccgcagcgctggctccccgtgcaactggtgcagccccgcatcgagcaggagatccgggccaacctgcttgccgtctgccggcacgccgcctgctgccacgcggcggcgggcgggggcgagccggacgccacctgacgtggtcaattcttttcatcttgcccaagggcgcgcgctgatgccgtgcacgtccacagtttccatgccgtgtgagagcctaggccatgcagaggcaggggcaggagaggggccgggcagcacaggtcttctgggatggtaggaggtcggcgcctcgtcatcgcctgtagcgctgcctcctgaagttgaagtagacgtgcaggatgccgcggtcgaagacggacttgaagcctttcttgtgattgtactccctgcgtgcgtgcgtgtgagggtgctgtgtgccgcggttgtgtggcgctcactcctcttgcggtccaggttaccaagacgatgccctttgcttgggcctgtcgatccctgcggcatccccacccaccaagggacccccccgcaccctcctgaaaaacaccccaaaaatgcgcaccagtccttgttgacgattcggaaggcgatgtcctcgtacggcggacccgcnnnnnnnnnnatcgaagacggacttgaaacctttcttgtgattgtactccctgcatgcgtgtgtgtaagggcgttgtgtgccgcaggtgtgtggcgctcactcctcttgcggtccagnnnnnnnnnnnnnnnnnncccgccacggcgttggggtccttctcgatcttatacaccggcgacttggacttgtcgatgaggtccgggtagaagatgttgaacttgtagccctgtcattttggatgggcaaggagggaatatgcgcggcgtgtcgcacggcactaacacacacacacactcacacacacacacacacactggcctgcctttcagttccccacctcagtctatgagaggcatccccaatgctcgcaagatgccaggccatgaatgaacagacccccccaaaaaaattatcaaagcaccccacccgcagcaacaccccnnnnnnnnnnctgcctttcagttccccaccccagcctatgagaggcatccccaacgctcacaacatgccgggccatgaatgaacagaccctcctcaaaaaaataatcaaagcaccccacccgcagcaacacccctcacccacctgcacgctcttgggcggcgggttgtcaccatcgtaatgcgtctggttgtacttgttccactcgtaccccgtgtgcacgcgattgaagtacttgggccggcgcgggcggtacttctcgtgccaccagtaagcctggctctccagcgccacctcgccaccaaagggcgcgtcgcccgaggtgcccaggtcgcccatggccgcgccggcggcggcgcgcaggcgcgcctcctctgccgtgtctcccgcgccgctggcgcccggctcccgccccgaccgcatggcctgctcgccggcctgcggcgcggcgtcggc

SEQ ID NO: 25122 - DNA, 61 bp, Chlorella protothecoides
cgagtgaagaggtacttgtgcagcatccacacctcgccatccggtgccagctggtagatgg

SEQ ID NO: 25123 - DNA, 61 bp, Chlorella protothecoides
gtcctcggacccggcgccatgggaggggggtgggaggggattgaccgataccacgatccaa

SEQ ID NO: 25124 - DNA, 16634 bp, Chlorella protothecoides
  modified_base (138)..(147): a, c, t, g, unknown or other
  modified_base (691)..(700): a, c, t, g, unknown or other
  modified_base (1578)..(1587): a, c, t, g, unknown or other
  modified_base (2132)..(2141): a, c, t, g, unknown or other
  modified_base (2574)..(2583): a, c, t, g, unknown or other
  modified_base (4104)..(4113): a, c, t, g, unknown or other
  modified_base (4417)..(4426): a, c, t, g, unknown or other
  modified_base (4972)..(4981): a, c, t, g, unknown or other
  modified_base (5167)..(5176): a, c, t, g, unknown or other
  modified_base (6019)..(6028): a, c, t, g, unknown or other
  modified_base (6451)..(6460): a, c, t, g, unknown or other
  modified_base (7095)..(7104): a, c, t, g, unknown or other
  modified_base (7572)..(7581): a, c, t, g, unknown or other
  modified_base (7646)..(7674): a, c, t, g, unknown or other
  modified_base (7858)..(7867): a, c, t, g, unknown or other
  modified_base (8287)..(8296): a, c, t, g, unknown or other
  modified_base (8688)..(8697): a, c, t, g, unknown or other
  modified_base (9690)..(9826): a, c, t, g, unknown or other
  modified_base (11585)..(11594): a, c, t, g, unknown or other
  modified_base (12180)..(12189): a, c, t, g, unknown or other
  modified_base (13121)..(13130): a, c, t, g, unknown or other
  modified_base (15473)..(15482): a, c, t, g, unknown or other
  modified_base (15769)..(15778): a, c, t, g, unknown or other
  modified_base (16135)..(16144): a, c, t, g, unknown or other
ggagacgccccgcctgtgctggccttgctggcgaaattccagtcgatgaaggcctggatctacgcatgcctgtttcgatcaagccgttgccaggccctccgaccctccccctccgcacccgtaggacttgctggtgannnnnnnnnnaggtgcagagggatggcgcccagtccgggggagcgctgccgcgtcttacgcaccgtcaccgcacggttgtcccccttcctgtcggggagaggggggagaatagagcagggggccattgatacagcaggctagcacagcacgacgccacacatggtgaaacagattgtcgagatggagcgagtcaccggcagggagacgccccgcctgtgctggccttgctgccgaaattccagtcgatggaggcctggatctatgcatgcctgtttcaatcaggccgctgccaggccctccgaccctgcccctccgcacccgtaggacttgctggtgaagccatacttcttgcactctgcatgcaccaccgcccggtcgtggttggacaggcccggcgggaacttgtactctgccgtgggtgaggtggcgtgggggaacgacctgttggctttgggaagcatcccaacatccacattaaagcagacaaacagccgatccctgatcactgctttgcctgagccgcggccaggatccaaatattcatgcacccttnnnnnnnnnnaatcccaacatccgcatcaaagcagacaaacagacgatccctgatcagtggtttgcctcagccacggccaggatccaaatattcatgcaccctttcacctgtctcctcgctgtgctggaactctttcagctgctcggcaatgctgatgcgatccccttccgtcactgggcggctcccaggcgggagtcgaccaccacgcccaccgcctctgcgaccgcctccaccacgcccacctcggccagggtgtccgccatccctccctccaacacgactgtacatgctccagaagctagaagaagtattgaggtagctcaagggtgaattgtgctctgcgcatggggagggttcgaaccctaagatggccgacggtgcgtactcgcgagcaggcttaagccagctcgatctaaaaaagagactctgcaagtggattatcttaaaaaatgaacaatccttctctgcgatgtgcatgtacccgttctaatcacttgcagcgagtgctcgggcgccagggcgcgagaactctgtttcggtggccgactgctttttcatccggtcacaacccatgctgcacatggtccctttatctgaagcccagcacatgccaagtccatagggatgaatccatacacggttcttctggtatgtaaccctatacagcaggcatcatggtgtgctcccaccccagcaacagccgcttcaggctgtcagtaccccaacgctgccggccccccatccgagcggcccaggttggccagactcccaaacctggcaggcaggtgtaaagggggaaggtctctggctgagagcatgtgcaattgttcttgaccagcaattcctcttgctgggcggttcagtgtcagtgcacccctccaggccannnnnnnnnngaggtctctggataagagcatgtgcaattgctcttgaccagcaaccccttttgctggggggttcagtgtcagtgcacccctccaggccacaaggaagctttgcaccagcattgggtccccacccagaaccgccaccaccctgccccaagccctaccacaacaccagcatgccccgaatacgccacaatagttacgtacagctggagcacactggcagagaggtgcttggggtggagcatgtcggctcggcctcctgccacccggcccccgccacgaggcttggaggtctggctgggggtgggccgagccgtagggccgtgcatgcggcgcagcagggaagagctgggccgagcggccacgggcgcctgggactcctgggaagggagttggtgaaccttggctgcccggcagtcgttcgtctgcttgtcatctcagcagagacactgctcaggacgcggttgcaaacggtcactccatgcatgccactgaaccatgtgagcacacctcccaaaaccgctccctcccagccacctttcgcatcctcnnnnnnnnnnaagacactgctcaggacgcggcagcaagcggtcactccatgcgtgccactaaaccatgtgagcacaccacccaaaaacgctccctcccagccacctttcgcatcctctggtccttggaggcggcccgccgggcggggtctgcggccgagcgcttctggccccttgggccagcctgcgtcctgaccacctgcatgcgcacgagtgagcccccaaaggaatgtcgttcagaacatgaccatcagtaggttgaatcagtgtgggccgagggcacttggtgtccggctctgtggccatgtaaccccaggaggcatccctgccccgcccacctcgggagcagcggggtgtccttgacggtcgcccgccccggcgcccctgccagggtcatccagcgtatgtgggttaaccgccaccaggaaggagtcgggtccatgcnnnnnnnnnnagggtgtccttgacggtcgcccgccccggcgtccctgccagggtcatccagcgtatgcgggtttaccgccaccaggaaggagtcgggtccatgctcctcctcgccctccccgctctccgtgccatcccccccgcccagatccacatactttttgcctgtgttgctcggaggtggttggggatggatggagccatgacaagacatggaattgagctccctttggtatatggcacgagacaacatccttggcacacacccaacaacactgtgctggccgccgacgcgcctggtgacttgcatgcaggttcggcgggctcctgggcgggagctgcggggttgtggcgacccgcctccgccgccgccaggccgatgccggccaggagctgtttgtgctgactcagcatgacctgcatgccgtcgatgcgggcctgcaggcgggcggccactgcacgtgcagcttcggtctccccgcattgcacctgggtgggggcgagggggaacacttgggtgacgcagtgtggcacgtgtcacgaagcaggatccagtgcatggtgactgatgctcagcctgcgtgtgcctgtcaatgcagcgctcatcacctctcccataccctccacccccataccttaagctgcgactccttgtcttcggccaacctctcagccttggacagctgggtctgcaggttcagcttctccagcacctcggtccgaaccttggcctccattgcatcctgctcagcaagtgaggagaaggaagcctggtgtaatttggcgagcgagatgctgaggcaggcattaggaaagaaggtaagattaccgagcggtatggactccatagcctggatcgatgaccaggacttgcccaccagcctaccatggacttggtcatcttggtctgtgaccccctcatctggtggagctcctgctgtgccattgccagttcctgagggagtgcaggcaggagtggttcttcgagcctgttgggcactgtgacggagggatcacatggacagagaggctgcctgcatacctgcaccgacacatcgatgttggcctggagggtctccagctcctgcttgtgctgtgctgcaacctgtgccagctcagcgcgatgtgcccggtgcagctcatccaggttctgcagtgttggggttggcatggcaacaagatgttgggtggcgcaggatggtgatccggcgattcaggctctctcgggtctccgcatgtcctgaccttggccgttcggtgaatgagggtgtcttccttggactggaaggacagcatggcagccctcagcctggtgtgcatctcgtcagatgctatgtgcaggagcttccggctctcggttagcttcccctcgagggcgttcacctctagagcccaaacctcctgcacatcccacaacatgccatgaggcgtgagtgcaggtgctgacagccggggacacagcgcaccccgtccatgtcctcacgactgtcttcccttgcatctcttgttgtcatcatccaacacatacgcnnnnnnnnnnccccacaacatggcatgaggcgcgagtgcaggtgctggcagctggggacacagcgcaccccgtccatgtcatcacgactgtcttcccttgcttctcttgttgtcatcatccaacacatacgcacctcttttgcctcagacttggcatgttccagagtgagacgctggtgaaggtccaggacgtcaagctgtgcgttatccagggcaaccccaaccagcgtctgccatttgggggacaaggtaaaggcacgtatgaccctggacactttccataattaccacagcgccgtgcatgatggtgtatnnnnnnnnnncgcgtctgccatttgggggacaaggtacaggcatgtatgaccctggacactttccatgattaccacagcgccgtgcatgatggtgtatgtatattgcttagagaaggtggtctgtaactcctccacccacctcctgggcttgcaggcatcgcactctctctgtggcaccggccacttgctcctgcatctgtacgaggcagccctcaagctcctgctggcggatcgccccggctttgagctcggcttgagcctggttgaccgcatcctggttcaggaggcgctcgccctccagcacagcctgggcaggccgtgtgaagggctcagtcaggccaggggcagatgggacacaaggcggctggtgcaatgatgaatggttccctactgcagcctagatgcagtctcaccagcattgcggcattctcggcctctgccgcgtccagctgccgatttagcacgcagatcttagccatggcctcgcacacctcctcctgaagctgggcctgcaggcagtggttcgaggagcaaggcctgcagaagtccctacannnnnnnnnnttttagctcgcagatcttagccatggcctcgcccacctcctcctgaagctgcgcctgcaggcattggtgcgaggagcaaggcctgcagaagtccctacacacgcatacatggtgcagtgcattgaaaaaagcctccatccacacctgtgtgacggcaaggctagccttctccgttcgcattgattnnnnnnnnnntagggccccatccacacctgtgtggcgacaaggctagccttctccgttcgcattgattcgaggcttgtggcggctgcctcgagcttcagatcactctcaagcagcttggctgaaaggttctcagcctccactgacagccgtgcgatctctgcacattgcacctccctgtccttggcagaggattcgacggccctgctgagggagtcctcgatgctcctgatgctggccctcaagacctgggcatcagcctcaagttgctgtcgctgggcgcacatgtcttcgtgtgccttggtctgcaggcacagcatgcgagaatggggaggtgaaccaaggctctcaagtgtggaccctcaaggcagtccatctgcttgctttgctcaggcaactggacacaggacgtgcaacagcttgcgacactgaaacaaaagcactgtgctgtagtacagagcccaccatgctatgcagccgcgactcgtgctcggctgactccttgctgcgacacacgagttgagcactcagtctctctccacgtgcacgctctgttgagggaggagggaaatgcagtttctgtggtgagccatccagtgatcagcgcctacccatgtatcagagcccttctgacctgacttcagtttcttgtttgtctccttcagcagggagatgtactccttgttgtcgttcaacagggcctgtagagagggtgtgggttccctatcagggactatttcctgccatcaaacaacacagaacatgcttccccgaatacctcccattctgacctggttctgctcaaattcctccttcatacagttatggaggtcctcacgcttcttctccactgtnnnnnnnnnngccctttcctgtcatcaaacaacacagaacatgcttccctgaatacctcccagtctgacctggttctgctcaaattccttcttcatacaaacatggaggtcctcacgcttcttctccactgtaaacatgtggggttgcactggctgggtgagacagccacttggagttctagggagagaagttatccgctgctcacccatccatggcatgtcccctctgtagctccccaccttctctcagggctatctctagcccataatgccttgtgaccatagcctcgtggtcatccttggacatcctgatggtttccaccagctctgccaggcacctccggtctgcaagccatagagagatgcttgggtgtggagaggtacaggatctaccttgaaatcgctctggatacacaacagcgtaacctaccgnnnnnnnnnnatggagaggtacaggatctacgtgaacattgctctggatacacaacagcgtaacctaccgctccgtaaggccgaagccagcttctcattgcgggtggcctgctccatgtaggcctgctggatgcgctccatgtcggtctgcatatcctccatcctcgcttgggcagcacatgcctttgcctcggcacgagcatgctcggcaatcaggagatctgcagagaggggattccagtcagatatatgcaagaagtactcccagcgcatgtcgcccatcacctcacctgtgctagagatgagctggtcggtgttggggtgggactccatgcttttcccgtccatgacaggccacagccaatctccggaaccgctgcagctctataatatatactctggtggtgtatcgagccgtaatatgtattcggaacgcggaatgttctattgcaaacctccatcatgccgattgttaaccccatttgtggttggggttttcgacaagaaagggggcccgcgctctgagagggtcgcccttccactgtcacatcagagaagacaatcatcacggctgaggatcgaagtgatagaagaggtacacttagttttattgatttctatcacttaacacagcaggatgtcaannnnnnnnnngtactgcaaacctccatcatgccgattgttaatcccatttggggttggggttttcgacaagaaagggggcccgcgctgtgagagggtcgcccttccatcgtcacatcagagaagacaaccatcacggctgaggatcgcagtgatagaagaggtacactctattttattggtttctatcacttaacacagcaggatgtcaatgttgcgctgtactggccatgcgaaaacctttcaaccggggtggggaacccgcccttgtgcctccccagtgccattcctagcccccgtaccccagactggagggcctcagcatccgcggcatgcctatgttcctcgtactggaagattattgagaccttgcaccgccacaaagcagaaatttggaagctttcaggaactgatccaggtggttgtgtggcggggcctgtggaagcagtgctgatggggctaccacgcaccctgtagcannnnnnnnnngctggagggcctcgccatccgcggcatgcatatattcctcgtactggaagattattgagaccttnnnnnnnnnnnnnnnnnnnnnnnnnnnnnctggtcctggtggatttctatgcggtctggtgcggtccttgccacatcatggcggacgtcatgacggtaaagaggaggggcgtgcaggggtggtccggctgcatggtcgtacttgcaatgcatactctgccagacaagcaccttgcctctctcccacgcacgcacgcacagaaagtgtcttcgnnnnnnnnnngaagaggatgggcgtgcaggggggtggtacggctgcatggtcgtacttgcaatgcatagtatgccagacaagcaccttgcctctcttccacgcacgcacgcacagaaagtgtcttcgggcctgagcgatcgggtggtgttcgtcaagatagacaccgacaagtaccctgccctggcatcccagtaccgcatcgaggccctaccgacgctggtcctcttcaaggacggcaggcccatcgacaggatagagggcgtgctcaatgtgggccagctgcaggcccgcctgcagctggccctcggacccacaaagtgatcccttgtccagcacaggggccctggcctccacggtcggctggaggcgacggcgggttcgcacagcccgcggcactagcactgcctcgaagcatcctctcctccaggnnnnnnnnnnccccttgtcctgcacaggggccctgacctccacggtgggctggaggcgacggcgggtccgcacaacccacggcacttgcactgcctcgaagcatcctctcctccaggtcaggccctcccgttgagaagctcaatcccaaattcatgccacgagaaagagatcttaaatatacattcagactcagcgccgaggcgaggcaggcctcgctgtcaaagagccaagcacaccgagcggggcgcggcaagcggcgagttcttatgagattccatacggcacagtcgcagggcgaggcggggacggccatcagtgttggtggtgcacgtgcggcttgtcagcctcctccggccccacgatctgcagtgtggagtgctggatgcccagccgccgcacgnnnnnnnnnncatgagattccacacggcgcagtcgcagggtcgaggcggggatggccatcagtgctggtggtgcacatgcggcttgtcagcctcctccggccccacaatctgcagcgtggagtgctggatgcccagccgccgcacgtatgccgtgacgcgggacagcacctcctccccctcggcgccaggctgggtggccacgtgcgcgcagagcagtgggatgcctggggtcaacgaccagacgtgcaggtcgcccaccccagccacgccctcgatctgtgacgagaagggaggttgggagcgcagggaggggattgggctgcagcaatcgctcatgccggctctttgacaggtggcacagctccacgaacttggtccctgaaccactgcgggggcgctcacgcgtcactctcgccgcacagcaccctggtcaaacaccccacacccccgggcactcacggcggtgatgtcatcctcgatgtcggcgatgttgagcccccgcggcacacgctccatcagcacgtcggcgatgtcacgcagcacgcgcttggtggtccacagcaccagggcggcgaagaggaaggtgcagatggggtccgccagcgcccagcgagggtcgtcctgcggggtcgagtggggtgggaacgaggggtgtggcaccaagtcgattcggcgcgggtcgtgtggggacgatggggactgactgcgtgggtacgcaccctcagtcgcatgctgaggcccccgcacacccgggcctcacctggtggatccagatcagcaggcccgccaccgccacgccgatggactgcaccaggtcgccgatgacgtgcacgaccgcgcccatcatgttgatgttgtgccccttgtccagtcccttggctttgccgtggggcaggaggggcgccgacgcgccgtccgggtcgtggcaggcctccaggtcctcaagtccgatggctggcgtgtgggtgtgggcatgaccatgggcatgcttgtgcccatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtcatcctcgtggccatggccatcttcatccccgtggccgtggtcgtggccgtggtggatgcccaggacgaagagcaggcccaggttgaccgccacgccagtcaccgccagcgcaaacatgactgccgagcgcgggaaggaaaggagcggggtggatgatcggcggcggggcgggtggctggtgtgcgatgcatggagggtgcggagcgcgtggacactccctgtcacctcatccccgagtcgattacctttgccgttgacgggctctgggacgaggatgcgctggacggcctccaccagcaggatgccggtgaccagccagacggtgaggatggaggccagggcgcccagcacctccacgcggtggtacctgcaggtgccaggaggttggggcccagtgagcgcgggcaggggccggcagcatgggcttccctgggggtcgcaagggcgtgtgcaagaccagcaaccgcccaccagccagggtgcaggacggtggtgccatccgcacaccgaccccgccgccccttgtgacgacaccagctcaagcccacgtcctcgcacccataggaaaagtggctgtggctcatgcgggccgcccagacggccgccagcgcagagacgccgaagccagacacgtctgacaacaggtgtgccgcgtcggtgatgatggccagggagtgggcgtagatgccgcccaccacctccacgatcatgaacaggaaggcgatgaccagggcgatgaggagcttgcgctgcgtctgcgggtcgtggggttcaggtggacgggagcccgtcatggtctcccccgggaaagcgagggacgccggtgcatgcgatgggcgaacaaccctggtgcaccacaggtcatgccctcgcgctcttgtgacaccactacctaccgctttgtattccgctccccgctccccagtcgcccccgcggccagcacgcaggctgagtactgcctcggcaggtctgtaccatgaaggaggtggtcctattaggcggtgatagcatgtgaaagcctcgaaactaaattcagttaccataatcatatacctgcaagcgctggtagccttacaggcacggaaacttccccttgctgggcctcgcccagctggggaagtgccgcatcgcccaccgctgatggctgggcggacccggccatctcagaatgtaacgagaccttgatcggcccagaaacaagcgttggcactagagtcgttgggactggtccgcagctgatgaagggattcgtggggtgcctgggtccatttgggacggaggcccccctgcggaccgtgctggggattggaggaaatcggggatgctccaactcgagcaatacatagctacccagggcatcccagagcaccacagccttccaaagatgatcgaactgggtccttcgtgcagtatgttgcccaaatttctatttaaaatccactgttgttgtcctagggccgctgttgacgagctcgaactcaatcaggaggaccatgcccacactccaccctatgttccctggatggtaagtttggtcaccagctgaatatcaatggtctccatgagtatatggtcgataacaactgttgatataccttcttgtttagctttggcttggattgcatgaggcatgtacaagtgtttgtctgttgcctggtcacgacaagatatacctttgcatgcaaaagttaaggtgtgataagtgatcgttttcggactctccaccgagtccaatcgcataagcagtatgcnnnnnnnnnncaaggtgtaacaagtgatcattctcggactccccaccgagtccaatcgcataagcagtatgcattaatcgttctgcatatacaacgccatgttttgtgcggctgtagcacgtgtcagtgtctttggtggcaccccggcttgggcctaccgccgagcgatcgtggcgacccgctgcatccgggcatgtcgacggacaccttctaatattgctcataggctggcaaggtctggcacgaaccatgcgggcccgatctcggccgcaagcacctccgacgccggctcctcccccgctgccgagtccctcttcgctccagcgggcaccacctttgccggcctgggcctgagcccgggcatctgcgatgccctggccgcctcaggtttccaccagcccaccgcagtccaggtgccgtgcatgtacatgatggtgtggtggctggatggcttgagggctggacggcctcgcagccttcaccactcaactgcatcaaagcgcccttaccacccccacatccaagaaaacatgcacgctctccccccccactgcccttcacccctccaaggccctcgccgcccctgccctgctggnnnnnnnnnngtatacatgatggtgtggtggctggacggcttgagggctgggaggcctggcagccttcaccgctcaactgcatcaaagcgcccttaccacccccacattcatgaaaacatgcacgctctccctaccaactgcccttcaccccaccaaggccctcgccgcccctgccctgctggccggctcggatgtggtgctggccgcggagacgggaagtgggaagacgctggcctacctggccccactgctgacccgcgcgcaggcgccccaagcctccggcgccccaccctctaccctggtcctctgccccaacgccgcgctgtgcggccaggtggcggcggcgggcgcggcgctcctcccctccgcgcccccgccctggacggtgtcctcccgcacgctgccgccgcgcacgctgccaccgctggtgctggccacgccggggtcactggtcaccgccctggacggcgcagcgggcgaggactggacgcgcgaagggctgcctcgctgggcgcgctgcgtcgtgctggacgaggccgatatgctgctgggcggcagctacggccgcgacatcgaggcggtgctggaggcgctgcgggcgggggatcggcgcgacgccgcagagcgcgtctgtgcgcagctggggatggaagaggaggagttccgggccctgcctcgccacctcaggcagagcgcctacgccggtgcgggtttggggaggcgttgtggtggggggaggcgggggttgcaacgtccgtgacggtagatcggcgtcgtgtttgaggagagggaatcgtgtcgctttgcacagcctggcgtccacaagtaaaaccccttggtgagcggggcatgcctcgttttacccatccatccgctcctccaggaggtcgtgctcacctacctcttcaatactgttctcccttgccaggaggtgtggcggnnnnnnnnnntacaagtaaaaccccttggtgagcggggcgtgcctcgtagtacccatccatgcgctcctccaggaggtcgtgctcacccacctcttcaacactgttctcccttgccaggaggtgtggcggccatggtcaaggaagggtacacgccccccttgtcccagacctcacccccacacacagaggggccctcggacagctggcgcaggcagtacgtctttgtggccgccacaatgcccgtggatggcaagtacgaggtgggcaccaagctgcgccgcgctttcccgcaggccgtgtggctcgcgggaaagcgcctgcaccagcagacccgggacctacagcacgactggcgtcgggcggagggcgagcaggagcgcgcccgtgtgctgcaggtggggccatgctgtgatctggctgcagggtttcgtagggtggggccagtccaccattgtttactgctttgtgaggatgatgtcagagtgcttgtgtctcaggatggcacttgcattcatattccatgctcaggagggccttccccccaagccttgcacctggaaggcaaccatacccttccccatccaacccccgcgtccactcgtgcactcgctcaggaggtcatcgccggggacaaaaccatgggccccggcacgaccacgctggtcttcgcacgcgacgtgtccagcgccgacgccacgctgagcgcgctgcggcggacctgcgcggcgcgcggcgcggcgctcctgcgctaccacaaggaggtgccgcaggcggagcgcgaggacctgctgcgcaccctggcggcgccggggtcgagcgcgcgcgagcccatcgtcctcgtctgcaccgacgctgcggcccgggggctggacctgcccagcgtcaaccacgtcgtgcaggccgactttgcggcatccgccgtgcacttcctgcatagggtagggttcgggagagtgggggggcgttcatgggcgaggacttgcgtgggatcaggccacagtgggagccaccctggtcagttccttgccgcttgatgcctgtgggatctggtggacgggggcgaggcgacccgcaaactccctggatgcaccttgtgggcaactccctcgacccccgcccgagtgccgattatcagagcacccaatccgcctttcctcaccacgcttgcgacaggtgggtcgtacagcacgtgcagggaggaaagggcgcgtgacgtccctgtatgggagcgaggcggaacccctggtggacgccctgcgcgctgccatcgccgcaggtgccccagtgcttggtgttgggcatctgagggtccctttttgagccccccacacagaccctggctgctgcactgctgacctgcccgggggactctgcacagtttcaagacgggtgaatgacacccatgccctcccctctcccaacccctgcccagatgagccggtggagggggcgttcagcaggaagaggtccttccggaagaagttcaaacggtatgggcagtatgtgccgcgtgggcagacactgtcgggggagacaggcacgggcagggaggcccgatgatgcaattcctgcgcgctgcggcggcgtcgtaatcgccttccacccaccccacccacgcccacctctccttggccaccttgccatcccaccatctctcagctgtcctcgaatgttcttgcttgctttcgagactgttacattagtagggtacccggcattgacagtgtggttcgtcttgcgacactgcaagcattactaatcgtcaaaaggctagggacatcttctcaaagaatttttggggctgattcatgttgtttcaagaaaatcgtctcgatgcttggtgaggggaacaaaaaatgagggtttgcttgcctgacgacatggaggatggggaggtcccatcggtcactcgggttgcacagcgcgcacgcaagctgaagggtagatggaacatcggtacgaagggaagtaaactggtaagaaaaggatctacggcgcgcaccggtagagtggcggggcagatgcaagttcgtgtggaatgttctgagctcttagggggcatgcatcaacagccgtgaaggcggcttggggggtctggaagagggggtggcctccagggcccaactcgttgcaggcatcgactcgttctataatagcgggggcatgcggagcatgagccatccggtgctggctgtggagcggcgtgggctggccacagcacggggcacaaaatctgtggaagggatcgtcaaaaccgatggctcgacagaaggaatggggggcaggcacacacccaaagggataaggggggagttcagggtagggatggcggtggaaggcaccgtccctgcnnnnnnnnnnccacccaaagggataaggggggggagttcagggcagggatggcggtggaaggcaccgtccctgcggctccgttgaggggggcctgcggacatcgacgcaacttttcgttcgaaggtgctggatgtggaggaaacaatatcaaggaacaggatggaaggggggggaggaaggcaaggggacgatgccacgccatcaaaaatcgttacctctactcgcaattttcccggcgcaagggcgaatgaggaggtgtgggttaccgccgccgtgctccctgctcagcggggccnnnnnnnnnnaggcgattgaggaggtgtgggttgccgccgccgtgctccctgctcagcggggcccgtgcagcgcgcccagcgcgttctgcagcccggggtcctccagcgtgagccccgtcaggcccaccaggatctggggccagtcaggggtcaagcctggagcatgacgtggggagggggtgggaacttgaggattgcgggcagagtgcatgcatttccctgctgccttggcaagttgttgtacagaggactggggtacagagagtccctgcggagcaccactgcagtcttccccctcccaccctccgcttctcccacacgccgctccgccatccacccccccaaagaatctcaccggcctcacgnnnnnnnnnntctgaggattgcgggcagattgcatgcactttcctgctgcctttggcaagttgtacagagaggacgggggtacagagagttcctgcggcgcaccactgcagtcttccgcctcccaccctccgtttcttccacacgccgccccgccatctacccccccaaagaatctcaccggcctcacgacgcgcgtggatgagcagcgcggcggcgcccagggagggcgtgacctccagcagatgcccgctctctagcgcagcgtgcgcatcggccagcgcgcggccgccgacggcggcggccgcgtcctcgccgcctgcgcccaggtccacgcccaggcgctccatgtagagcttgaggatgcgcagggcggagatggcgttggtccccgcgcccagcgcggcgccgacagcggccaccgccgcgtccagcgcctcctgggtcaggcccaggccggggtcgagggtcgcggcgcccggcagcggcgcgcctgcgttgg

SEQ ID NO: 25125 - DNA, 61 bp, Chlorella protothecoides
gttcaggattgtgcgggagcccggtgtcatcgcaagatggcagtgagagtgcacaccgtgt

SEQ ID NO: 25126 - DNA, 74 bp, Chlorella protothecoides
ttcgcacatcaccctcccctccatcgcttcccatcaccaaccacccccctctcctttcaggtgttgtcggacga

SEQ ID NO: 25127 - DNA, 66 bp, Chlorella protothecoides
cgggatggctgctgcacatctaccagctgccatcgctttgctcccgcaggactggcaatggcaggg

SEQ ID NO: 25128 - DNA, 73 bp, Chlorella protothecoides
tgttctgtgcaatcccaagagtgagattgaagcccctagattgcaaccgaaacgtacaagttgaagagtatcc

SEQ ID NO: 25129 - DNA, 61 bp, Chlorella protothecoides
aaggggaagtgatcagggacggcgggcgggggtgtactcgctggcacgataccctgtttgt

SEQ ID NO: 25130 - DNA, 61 bp, Chlorella protothecoides
ctttccatggtctggatatacatgccgcccaaaggcctcaaatttacccccaactggtgag

SEQ ID NO: 25131 - DNA, 69 bp, Chlorella protothecoides
cctcctcggtggcatccacctggtgcaggtgtggttggcttcctgctctgtgggtctcatcaggggcct

SEQ ID NO: 25132 - DNA, 73 bp, Chlorella protothecoides
tctagcttcccggcagggtcaaagacatggataccttcccaccctgacgctcccgtccacctgctgtgccaag

SEQ ID NO: 25133 - DNA, 70 bp, Chlorella protothecoides
tgcagggcacgctgcaggatcaccgggtgctccaggagcgtctgaagcggctgctgggtgacctcacctt

SEQ ID NO: 25134 - DNA, 102 bp, Chlorella protothecoides
cctgtcgtctgtgatcatggaaggatgaggcactagcagaccaagcttgccaccccgatgccggccgtcaaggccctcttcgccggtgcctgcaacggcagc

SEQ ID NO: 25135 - DNA, 63 bp, Chlorella protothecoides
ccactctctccgaacgagcgggctttattcatcagagcagcacgatccccttgaccacagcat

SEQ ID NO: 25136 - DNA, 712 bp, Chlorella protothecoides
  modified_base (334)..(343): a, c, t, g, unknown or other
ccccctgcaagagctctgtcaccacgatgccctccattcaccctccaatgggcaatcatacacctcactgcctttctcttgcagcctgaggacaaccagcctggctcccctgaccccttgctggcctacaaggcagggtatgccgatggtcaggctgatgtcgaggcgcagcgccctgctctggtccaggaaactcagcgccttgaccagctggagtacgccatcaacaccgagctgactgcccagatgatcagggctgcgcagctggccgcaatgcgcgctgaggcggctgatcgtgcagcacagctgaagcgcctcacctccatcctggatnnnnnnnnnnccagctggccgcattgcgcgctgaggcggctgatcgtgcggcgcagctgaagcgcctcaccttcatcctggatgctgctgccggcggcgcccctggagccatggctatgaaagtgaacgccatgctgcatgccgagcaggaggcctgggccgcggcagagaaggagagggcgggcgagtacgaggagggagcttctgactccgagccccagggccggcccaccgctgtcttcgagtgcgagctgcccagtgaccccaaggtgcgaggggtgttgtttcttggggtgtttttttggggtatttgcatgagcgctgcagactgtccacctgttgtgccagcactctcattgctgagatcgtcgcttcactc

SEQ ID NO: 25137 - DNA, 68 bp, Chlorella protothecoides
cccggcatgctcgggaggtcggaggatgaaaggcccggccggcgacagggacgacggactgcgcctct

SEQ ID NO: 25138 - DNA, 154 bp, Chlorella protothecoides
ttgatgccaggaagccggccctggcaccccacccaccctatcactcccgtccactccgtctggctcaccccattctttgctgcgcgcttggcggccttggctgcccgctgcctctcgtacagctcagtgtcataatatttttggtgtggcaggg

SEQ ID NO: 25139 - DNA, 121 bp, Chlorella protothecoides
gggggggtcggggtcagggcaggtatgtgttttggtctggaaggtgagtcacgcaaagggtcggagcatgggaagggcctgatccaacctcaagactgctttgatggccacattatgatgg

SEQ ID NO: 25140 - DNA, 125 bp, Chlorella protothecoides
agatgcatgccagcagctggagcctgtagaactgtggtcatgtgcaggcttggaagatgtatcccacgccttgctgcccatcgcggctgagcccaagctggcttgatgtttgagatctcagtatc

SEQ ID NO: 25141 - DNA, 62 bp, Chlorella protothecoides
cacgcacattcactgtgtgtgcttgtcagggaatcgttccaggcgtcgcatcttggagcaag

SEQ ID NO: 25142 - DNA, 100 bp, Chlorella protothecoides
atcgttccaggcgtcgcatcttggagcaaggccagcgtgctgtggtggtcggtcggtcaatacccgccgctgtttaatttcaattcgtgacgggcatggg

SEQ ID NO: 25143 - DNA, 62 bp, Chlorella protothecoides
agcggatgcggcgcgctttgccatgttttggggctatctttgacagtggagactagagggcg

SEQ ID NO: 25144 - DNA, 379 bp, Chlorella protothecoides
  modified_base (133)..(304): a, c, t, g, unknown or other
cctcgaataaccccaccaaaaccacctgcatgccattggaactggcctgttcctggttgcaatatgctaatcggcagtgagcggctcatccttgcagcagggtgaagactcatgcattgatctctgtgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggccggggtactctcacttttataagcgtctcttacaacataaatcgcacatcccatctttttgagtgcttc

SEQ ID NO: 25145 - DNA, 159 bp, Chlorella protothecoides
tttggaggcaggcaatgcatggagaaaccctgcgccgggctgctgcggcaggctttggtcggagtctcatccgcaccccgaggccagggcacttgtcagcacctcattgggagtgtccggcctcggtgcttcatctcagaggggtttggcgatccaacc

SEQ ID NO: 25146 - DNA, 75 bp, Chlorella protothecoides
ggtgcttgagcatgggcatgctcatacgatctacgaattgttcagcaagtcatgtaaaactctgtacactcagca

SEQ ID NO: 25147 - DNA, 70 bp, Chlorella protothecoides
cattgacagcgttggcaggagagaccaatgtcattgcacagcaggaagtgagaccccacaaccaatgcac

SEQ ID NO: 25148 - DNA, 74 bp, Chlorella protothecoides
gcgccgccatcttgtccgtccccggctccagcgcctggaaggcatggcgcgcgcccgccacgccgcggtgcagg

SEQ ID NO: 25149 - DNA, 101 bp, Chlorella protothecoides
cttggcggctcccaacaagtcccctgccctccgcgcttgtcctctcattcgcaatgcacaccagccccccgggcacccacccagcatggcgtcgtagccgt

SEQ ID NO: 25150 - DNA, 428 bp, Chlorella protothecoides
  modified_base (118)..(326): a, c, t, g, unknown or other
gccggattgaggctgctgggagtgctggaggatggagagcaagcgggcatgcctgagtgacattgcgagcataattctccagccattcatactaatcacatgcgccttgacctggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaggcggatctgggcggggggaagaatgggggggcaacacgacatctggcaacatccaggagcagaggtgtcgatgcagtcatgtagtgagcagtgtttc

SEQ ID NO: 25151 - DNA, 132 bp, Chlorella protothecoides
caggatgctggctggcgaaggggcgcgcgtctgggcggcacagcgtgggctggagactgccgagagccgggagcaggcatcccaggtggggcaaacctgcaaatgtgcaaagctgcctgtgccaattcccat

SEQ ID NO: 25152 - DNA, 69 bp, Chlorella protothecoides
gagcggcggcgcgacaggctcgcccgcccctcgcgctgactggcgctgtccttctccacccactcaggt

SEQ ID NO: 25153 - DNA, 75 bp, Chlorella protothecoides
tcctgcacggcgagggccgcatgttccgaaagtccttccatcggcaggcccaccccgcaacccaggttcgaattc

SEQ ID NO: 25154 - DNA, 79 bp, Chlorella protothecoides
tacaggaagcagtaatgacgagtgcggctagtctttttacccgagttctatgagaagcactaatgcttggcattggagt

SEQ ID NO: 25155 - DNA, 105 bp, Chlorella protothecoides
cgatgggggcgaccagggcaggtggtgccgccgtctcgaactcggcatacatggatggcacggggccccttgccggctcgggccccgtccagggcgccaggtagg

SEQ ID NO: 25156 - DNA, 62 bp, Chlorella protothecoides
ggggctggccttgggggatgggctggggctcaccttgggggatgggctggggctggccttgg

SEQ ID NO: 25157 - DNA, 61 bp, Chlorella protothecoides
ctccatggcctcgtggatggacacgcggtcagcgtcgttcatcttgtcgaactcgtcgatc

SEQ ID NO: 25158 - DNA, 62 bp, Chlorella protothecoides
gcgtcgttcatcttgtcgaactcgtcgatcaggcacacgccctggcgtgtgtgttggagtgg

SEQ ID NO: 25159 - DNA, 65 bp, Chlorella protothecoides
tgtgtatactgtgacttgcacatatgtatcgatctggagcgtcggcggcctgcagctgttgctct

SEQ ID NO: 25160 - DNA, 7279 bp, Chlorella protothecoides
  modified_base (606)..(615): a, c, t, g, unknown or other
  modified_base (946)..(955): a, c, t, g, unknown or other
  modified_base (1038)..(1047): a, c, t, g, unknown or other
  modified_base (1751)..(1760): a, c, t, g, unknown or other
  modified_base (3255)..(3264): a, c, t, g, unknown or other
  modified_base (4128)..(4137): a, c, t, g, unknown or other
  modified_base (4402)..(4411): a, c, t, g, unknown or other
  modified_base (4700)..(4709): a, c, t, g, unknown or other
  modified_base (4956)..(4965): a, c, t, g, unknown or other
  modified_base (5195)..(5204): a, c, t, g, unknown or other
  modified_base (5753)..(5762): a, c, t, g, unknown or other
  modified_base (6172)..(6181): a, c, t, g, unknown or other
  modified_base (6498)..(6554): a, c, t, g, unknown or other
ctccaaacccatggccaatcggaacagtactaggtaagtgtgtccttgcattacctgttggtaggggttacatcggattccgacgaccatgataacgatgctactctctcgcgcatggcacctgctgctggccagtcccgacccaatgccgtcacacgagacgccgagagccctcgcccccacctccgtcaacagggtgttgggcgtgagatttccgcagcccaaactgggcaatcgcctcaagccgcgcggctgccctcccaccgatgaggctggcattcggcgtcgcgcacgctccatgcgatgcgcagggtttgaagtgtggccgggcgacaacgtgcgccgcatacaggaaaactggtcggcactggctgccgctggccaccctccgcccaggcatgctcgggtagcttgtctgggactgtggaagctcaaggttgtggggcagatgcattccacactgtcgagctcctggcatgcacggatgcgttcaaggtcgcaaaagtggcgaatgtcgcgaggagctaccgctcatcccagccacgcatccacgccccgcagcggcactcccagcgaagcggtccagccaggccgcaagaagaggcnnnnnnnnnncgctttccacactgtcgagctcctagcatgctcggatgcgttcaaggtcgcaaaagtggcgaatgtcgcggggagctaccgctcatccctgccacgcatctacgccccgcagcggcattcccagcaaagcggtccagccaggccgcaagaagaggcgcacgacccgtggagctgtggcgacggttgatgacgacgatggtccatccgccttgagaccccttgcctctgcggttcaggtgcatagttcgatggctgtcctggagtgatgcttgttgtgggttttgctggtgagctgtagaacaaccggcgggctgtcctggaatggtggttnnnnnnnnnngaacaagtggcaggctgtcctggaatggtggttttgctggtgagctgttaagcaaccggcgggctgtcctggaatggtggttnnnnnnnnnnggtgggttttgctggtgagctgtacaacaaccggcgggatgtcctggaatggtggtggtggtggttttgctggcaagctgtgcaatatgcggcgggctgtcctggaatggtggttttgctggcaagctgtataataagcggcgggctgtcctggagtggctgctctagcaaaaaggtccaatacaccgatgcagtccccttgccaaacacatccctcaccacacctcagttcgtccctgtgccatgggacctggaagcgcttgccacggaagaagggccgaccgaggccgaactcgctgccgaaacggcagcgatcgaggccgtgatcaacgagtggtccacggagagggcgccggcagcagccaggggagacggcgacgggacctctggaaaggtggacgaggtgctcaccaccatcaagtgtaccttgaacgcctttcgtggcctgccaaagccgccaagggggaggagctcgcaggatccgctgcggccgaccctggacaacatcgtctacaccatggcggtgacgaccatcttgggcggcctcctcgcggagctccacgttttacgagtcgtggaggagtttgagcggcgaaaggcagccaagtgcgcagacgctgacaaggtgctgcacccccttaataacacattcttttacaggtgcaggtcttgtttgtgtagtgtgtgttgtggttgggaaatgnnnnnnnnnnaaaaggcagccaagtgcgcagacgccgacaaggtgctgcaccccctaacaacacattcttttacaggtgcaggtcttgcttgtgtagtgtgtgttgtggttgggaaatgtggtggatctggtcgtttgtccggatctttccttgcatgccggagtgtgtgtgtgtgtgtgtgggtggtgtggtggtgggggcgggggttcatattaaaggggtgtggggggggatgtggagtgggtggatgtggggtgggtgggagggagggagcacggggctcttctctgtcgagtctgcagaatcttgggtttcaaagcaggacaactcctctgcgggagagcgagccgctcagctgtggtgtgatgcccacaaacattcaccgacaccctctaccgacaatctggcagatgtctgagggcagtgtcggggctgcgcccggagcccgacaaaaaggggtcagaggagactcgggaggctttccccttcctcctggagaccgcggccatcttccggcggacgtgcgaggaggcagtcggctcctaccagcccccagacctggagcacctgcattacttcatggatgaggcagcgcgcgagatggagacggtgaccaagacctactacaagcgctagtttttcaggcgcctgaagcagaacgcgcagctggagctgggctgcagcgcgcggcgggcgtacagctgtgcccgcgccgtcctggccgtcgagtttgtacgccgaccggccgccgtgcccgctcctgctggtgcagccgccccgccggcgccagccgccgacgcggccgcggcgcccggcctgggcgatgccaccggatcgctggccccggccgcagttgctggcgacgcagcagccgttgctggcgacgcaggagcggccgctggcgacgcagcagccgccgatggcgacgcagcagccgccgatggcgacgcagcagccgctgatgtccacgcagaagccacggagcccgaccggcggagagtgaccgctcggccccttgcatacttcaccgagcagcaagtagagtggatcgaggagctgcgcgggtgcatgcccaagaggccgaagaaggacctgtgggaaacctatccccacctgtgcctccctctcgccaaacggctcctggcgaagcgagagcgtgttgcaccggcagcagcgcaggctcccgagagcgcggcgcgagaggagccgggcgaggcgacgcagctcgatgcttcccgaaccgtgaggccaattggggcgtgctgcgagagtgtgtatgacgagggtggggggatcagcagtgtctcactggtggcccctctgctgggtggccccttctgctgggtggcccctcctgctgggtggtctcttctgctgggtaggatgggggtcgtgaccaaatgcttcatcctttcttcacaaccaaacccttctcccgccacgcaggaaggacccggcgcgtcgtctgccggcggcggcgccgtgcgcgagctcggtgcacgcnnnnnnnnnncaccaaacccttctcccgccacgcaggaagggaccggcgcgtcgactgccggtggcggcgccgtgcgcgagctcggtgcacgcattcgcgaggtcatgcacgagcacgaccccgccaccaagaagcggcggggcctcggcaagaagcagcgcgctgcggcggccgagcgccgagagcgcgccgccgagcggcagcccgcagcccgcgagcccgccgcccgcgggcccgccaccgcggaccccccgaagccaccgccgccgcagcgccacgtcggccgcctgtttggcctgctgccttgcaagcagggttatgaggcggcgtatgtgacggggacgctgtcgtcgctgaggggtctcctgcgccgccacgaggtgctcaaccacggcagcgtggcggagttgaccggcatgaacttgcccacgaaggccctctggtgtgccgcgccgatggacgaggtgacacccggtgtttgtctgggatggcgaaaggggccaagggggtcggtcgatgccgctgtggggagggtgtgcgtccctggtatcagcgcaaaccgcccacagcagcatccactcagcaatgaaaagcatcggcgatgcccttcactccattgccttgccccccccccaagtgccagcgtggcaacatggtgccgcctgtttccggatccccaggcaaccgcctccttcaccgtgcctccacccaccgctccgctcccaggtgctggcgaggctcaacctggaggggtgcaggttaccccccggaaaggaggcggccatcagggcctgcctcctcgtcaagcaaaagtggcacaagaagaaaaaggccctgtgcgtccacatcggctgggcgttcttcgcccgcctnnnnnnnnnncagtagcatcgctgttgtggtcgtcggaacccgatgtacaccctaccaacaggtaatgcaaggtcacacttacctagtactgttccgattggccatgggtttggagcgaggggactgaaggaggtcgagaggtgtcggtgcttgaccgcagagtcaagcgacccggctccttctgtcggacagagcatgacggggcgtcggtgcagtcgatcaggtgttttcgatcatattgaaggcacaatgacgacgacgggtggcctgtcgnnnnnnnnnncgcttcgagcacggccgctggacttcgggggggcactggcgtaccaacgggtacaccgtcgctgtcaccctgcagcgacccagagaccccccccggcccggcgaccccccgcccccccctcccaaggaggcaaaggcgggcaagcgcaacaacgctggggcgtccaagggcgcccttcatcatcagagccgagagattgccaacgagcactaccggtgcgtggcacgggtcggtgccagaccctgtgcgtttgctttgcgctcctcccccccccccccccccccccccnnnnnnnnnntgaggggactgaaggaggtcgagcggtgcaggtgtcggtgcttgaccgcagagtcgagtgacccggctcctcctgtcggacagagcatgacgggacgtcggtgcaatcgatcaggtgttttcgatcatattgacggcacaatgacgacgacgggtggcctgtcgcttctattgggaagtggacgacgggggcatccagtggagatcaactcccgatctgcatggcgtaaaactccttggcgcagcannnnnnnnnncgcggaaaaagagggtgggcggcatcttgtgtcatcgacaaagtgccgtgccggtctcgaggcgctggtcatggcgtggggagtctgggctgccgtcgtgtccccgtcacgcgattgtgtacctccgcaaggtgtgccctctcgacacccccactctgccatccaagcacggcccaccctgtcccaacccctcccccctctcaccgcagacatggactacccctcacggnnnnnnnnnnaccctgtcccaccccctccctcccactcaccgcagacatggactacccctcacggaagccgagatccacatggtcgtcggcatggaccctgggcgggtggccatgtttactgccgttgacgagcaccggaactcgaccgcctgcggcgccaaggagttttacgccatggcgcagcacaggcagcacgagaagaccatctcggggtggctggacaaggcccctccctgcgtgcagaacctccgcaagtaagacgtgtgtgtgtgtggtggggggggaattgggggggcagggggagcgggagggaaagcgcaccggcgaagcagccctctggccggacgcagcatcaacgctcccagctttcctgtcgtcctcgccccacaaagcaccccaactcaacccaagtcaccccctcaactcacccctcaactcacccctcaactcaccccccaaactcaccccccaaaaactcaccccccataaactcacccccataaactcacccgcctcaaccacaaccacttcgcacacaggtgcccaaccttcaagacnnnnnnnnnntgtgtggggggtggggggagggagtggggaaggaagggggagtgggagggaaaacgcaccggcgaagcagccctctcgctggacccagcatcaacgctcccaactcacccccccaaactcacccccctcaccaactcatcccctcttcgcacacaggtgcccaaccttcaagacggccagcatagaggcgctgctgcggcgagtaaaagcagtggtgcaaaatctgcaagagggcttcgcgtggatgttcaagaaacccttcaggaagctgcggcaccgcgcgcatctccggcgcgagtgggccatcaacaggctggcggagcagttccgcgccccacccggcacgactacggtcgtcggcgccggcaactggtcggcacaggaccgggggggcatcatgcgggggcccnnnnnnnnnntgacgaccgtcgtcggcgccggcaactggtcggcgcaggaccggggcggagtgatgcggggccatccgcccgggccctggatgcggttcctgaagcgcctgcggcgggtgtgcgcggtggtggtggtggacgagttcaggtcgagcaagctgtgctgcgcctgccacaccgccctgcacgcccaccagtaccagcgggtgcaccgcggagtgctggagacgggggacgtctgggggaccaagcgctgcgccaacagggcctgcgcggccaacgtcgcgaaccgcgacgtcaacgcggcggtgaacatgctcatgctnnnnnnnnnnnnnnnnnnnnnnnnnnnnnnnnnnnnnnnnnnnnnnnnnnnnnnnnnggcctgccgcgacccacggccttcggagggccgcctcctcttaccgctcctacaaacggttggccaaccaactacaccaattgcgcatgagttccatcgtttgaaggggctatgcagccgcgcgcattcaaagtgcaagcccggcagaggggcatccggcatgacgtgaccaaacgttggaaatgccgggtgcctgctcaggccgtgggttcgatccattgtaatatgagaagagcctgactaatatcagatacagcatttgaataagcggcaatttgagaaaggaggaagaagaatttacacattccgatgattctctggaaagggtttgtacttgaactaagttttaattcattttgcaaccttgaaattcctcacgcctggtttgccccaggatgcccctgtagcgcagtggatagcgcgtcgatttcctaaaggaaaagaaaatagtcgaaggtcgttggttcgaatccaacctggggtggatttttttgcgtttttatcggtgttttttcaatattcagcattcgttttgcgattggaggcttcccggagcgccggggggtgccgtgcgataatttccatggtcccgactgctcccgctgcgcctccttggccgggcccttgccccgccgaggtgcaacaaaactcacagactaacgcggatgaagcttgccataaaaagtgtccaatctccggctgacagcgggagtttccgaccgatc

SEQ ID NO: 25161 - DNA, 78 bp, Chlorella protothecoides
aaagtcgagtgaaggtcttgcagccagcctgatcatcaagctttgagcggctcagcaagatgaaagccttctgttggg

SEQ ID NO: 25162 - DNA, 68 bp, Chlorella protothecoides
tctcggtgcccatggcggtgtcggtctgcatggtgccgcgcctctcggtcttcatggaggtgtcggtc

SEQ ID NO: 25163 - DNA, 72 bp, Chlorella protothecoides
tcagctgtacattttgagcgtcctgctcatccacaagcatccgccatccaagctggggcggaggatgcaccc

SEQ ID NO: 25164 - DNA, 61 bp, Chlorella protothecoides
taggcaaccctgcatggtggtggatgtgcgcgtgggaggtgctgggacattatcgtcggag

SEQ ID NO: 25165 - DNA, 142 bp, Chlorella protothecoides
ttggggattttttgggacctgtggaagaacaggttggcatgggatgcaggtttgaacgtacggcgtcaagtcaatggcagtgccccgcggaagtctctatgagacaggaccgtagagatcgctggcccctgctccatcgccc

SEQ ID NO: 25166 - DNA, 126 bp, Chlorella protothecoides
ccttccatacttttgcacgccagtattgtgcagcacatggccactgcctgctttctgatgtgagcaattgctttgaccagcagggtcttattgaaaatgccatccatcgttaaaatgaccccggcc

SEQ ID NO: 25167 - DNA, 73 bp, Chlorella protothecoides
ccgaaacagcactagccaccactcagtgccttgcagatcaacacaccctgatgacgcacaccatgacagcgca

SEQ ID NO: 25168 - DNA, 61 bp, Chlorella protothecoides
ttccaccacctcctggtggccaggaggaggacagcgccccccaggaggggcaggcctcccc

SEQ ID NO: 25169 - DNA, 75 bp, Chlorella protothecoides
tgcccgaacccagccccatcaccccgaggcacacctctgcactgccgctgcccttgtacttctccttcttgctcc

SEQ ID NO: 25170 - DNA, 75 bp, Chlorella protothecoides
cacccgccgcgccttgaatgaaaggggcagctggaaatgtgggttatgcaagggccaaggaagcaggagttgtgg

SEQ ID NO: 25171 - DNA, 75 bp, Chlorella protothecoides
atcccacgcaggcgatgggtgaggagggcgtcaacatctcattaattggcatcgtctctcaaacgtacaggcgat

SEQ ID NO: 25172 - DNA, 61 bp, Chlorella protothecoides
gggaggggggtgagccggacgcgacactgcagtccatggacgatggcaacgaggagcccct

SEQ ID NO: 25173 - DNA, 173 bp, Chlorella protothecoides
ctgggatcgacctgcatcaggtaaacttgacctacaggacgcagtttcggcgcttcagcacatagatccacatcccccaaacctcccggtctcccattccgagcaccttgtaaccagagcagtcgtggccggggcatttcatggcttcgctggggttcttgctatacagtgcc

SEQ ID NO: 25174 - DNA, 126 bp, Chlorella protothecoides
gaactgcgcatggggcaggtgtatgtgggggcacatgagtctttgtgaatggagaggattgcattttcctcccagtctcgagcgcagaatggcactcatggacgggtcgctcatgccgagtttcag

SEQ ID NO: 25175 - DNA, 1076 bp, Chlorella protothecoides
  modified_base (256)..(265): a, c, t, g, unknown or other
cgcccgcccgcccggcccaccacccgctgtcctccctgcacaaggtgtccatgctcctcgcggacgcgccgcccagcctgctggtggacctcctggccctggtgcccaagtgaggcagccgggctgtgtttcagagggggaggggggggtgccagggcggctcaaggggcatacgtgcgcaaggctgggcatgcatgttcccgctccctcggtgccaaggccataccacggcacgtcgctgacctcttatcaaacnnnnnnnnnntcgggctgtgtttgggagggggaggggggtttgccacggcggctcaaggggcaagcgtgcgcgaggctgggcatgcatgctcccgctccctcggtgccaaggccatgccacggcacgtcgctgacctcttatcaaaccgccctctaacacccttgacgtgcaggctgatcgagccctcggagcacgacgccgctgtgggggcgctgctcaccttcctggcggaggcggggcgccagacccccgatctggaccgcggcctctggctgcccgtgctgaccacctgcagcgccctctgcgtcagcaccggcgccgcctttgtggtcgtgcagggcatcctccaggtgtgtgtgtgtgtggagcaggggggggggattatcctcgatgggctgggtctctcgggcgcagcatgcccagcacggcgtgtcacaccattccatgcccgctgcttctcagaggttatgcaagcccatgcacgttgtctcactggttttcgtcatcacccccccccacacacacacacaaaatcaaaaccaaaatacaggcggtgcccttcctggccgagcacgagctggcgccggcggcggggctggtgcgccgcatcaccgcaaacgcgcccagcgccggcccagcgggcgccgcgctcctgcgcacactcatggacctgcacggcgccgcgccatcctacgtggcgcgctgggcgcgcttcgcgcgcgccgcgggcctggcgggccgctacgtggccgattcggcggcggcgctggccaaggaggccgccgcgacgcgtgacgcgcccggccgccctgctcggccc

SEQ ID NO: 25176 - DNA, 61 bp, Chlorella protothecoides
agactgcatgacacgaaggcactccctcggcaaagagactcggccgtcaccccagacagcg

SEQ ID NO: 25177 - DNA, 106 bp, Chlorella protothecoides
ctcccggtcgatgatgaagaggccgcgcagggccacgccgtcggcggacagcacgccaaacttggtggagatctcacgcttgaggtcggagaccagggggtacttg

SEQ ID NO: 25178 - DNA, 77 bp, Chlorella protothecoides
gcagagtccaccatgcgcggtgatcacacgacgcaagcggccatggtgtgcgcgcctgcagcatccctcagggcaat

SEQ ID NO: 25179 - DNA, 61 bp, Chlorella protothecoides
cattccagttttggtcccaagtgtcctgcctcggacgctctgggcattgcaaggaggtccc

SEQ ID NO: 25180 - DNA, 145 bp, Chlorella protothecoides
tcgccgctggcacaccaaggtgccaaatctagcagggtgcatggaaggtctcggtatggcactagcccctggtcagccgggcttgcctatggaggatgacttccagcgggaaggtgcatgctccaagcctccccagcacaccctt

SEQ ID NO: 25181 - DNA, 75 bp, Chlorella protothecoides
cacaggcgacctgggccggctgcggaattgggggggagaggggggggcccgaggcgagtgaggacctgctcacag

SEQ ID NO: 25182 - DNA, 76 bp, Chlorella protothecoides
ctcgtagtagggctgagcagcctccatggctgccacgggctgacaggggtggcgcgtcctgatggcatgcaccagg

SEQ ID NO: 25183 - DNA, 75 bp, Chlorella protothecoides
gtcaggaggaaggtgccgtccggcgaccactgcacgcccttgaaaaagttggagtttggagccgcagaggctgca

SEQ ID NO: 25184 - DNA, 65 bp, Chlorella protothecoides
taggtgggggtggagacttcttggcggagggtggaggagacttctttgcaggcgggggcgggaag

SEQ ID NO: 25185 - DNA, 465 bp, Chlorella protothecoides
ctttccccctccgtctcctccaccaccccctccgtcgcctccaccatccccgccgtcgcctccaccgcccccaagcccaccatctcctcccccaagctctcctccaccacccccagttgatgcgtgcacgggtgcgtcaaaaatagtcggagaaaaatgtgccgcaggcctttacccaaatgtctgcgtccgacagggtgtctacaccgccttctgtgctgcaacgaagccaagctctaccataccgtgccaaggtacttattttgcacctgtgaatgctgaatgccatgaaggacacttccttgccttgatggtctgtatgtcagatgggaattactatgcagaatgttttgcggggtctaactagcccccacattgcggaatgctgtatctgatctgaactcaaagatgctcaggaaaatggccctacaagcagtgtgggcattgggtgtcgttgccgtgtgc

SEQ ID NO: 25186 - DNA, 74 bp, Chlorella protothecoides
gcgataatgtggtgaaagaacggtactctgtgtgcgcgccctgcaggggtggacttgggcgcgagctcggagga

SEQ ID NO: 25187 - DNA, 182 bp, Chlorella protothecoides
gcccctggctcaaattgaatcagggttatctcgtgtgaacccatcaacgcgcgcgcccgggggttgcgtcagcgaaacgtccccgaggacctcaatgcaccgaggccctgccgacacgaggttcttggccgtcacggcatacataccctcacagtactttcaatatatacaggcactgcatt

SEQ ID NO: 25188 - DNA, 165 bp, Chlorella protothecoides
aaaggcgcgctgcaggagcaggcccgaagcggtcacgatgctggacctcaggatgtgggccgcgccgcctaggtgtggcagcagcaggctcacgtgcctcgccagcagcctgccacaggatgaaggggtgggggtggagatcaggagaaaggcttcatgcgctgc

SEQ ID NO: 25189 - DNA, 76 bp, Chlorella protothecoides
gcatctcctacggagcagctgggccgattcaatgattcaataaaacccacgtgcctctgtctcggacgtgttgttt

SEQ ID NO: 25190 - DNA, 36578 bp, Chlorella protothecoides
  modified_base (445)..(509): a, c, t, g, unknown or other
  modified_base (34557)..(34585): a, c, t, g, unknown or other
cggggggcgccgggacgggtggccccgcggggggccgcggcggggccggcctcccggcctcgacgccggcgtccccggcctcgcccgccgccagctcctcctcctcctcctggacggaggcgtcctcggagggcgacgcggagggtgatcactcgcagcgccgcggcgccgcggcgccgccgctgcaccccatgtggctggggcgcgcgctgtcgcgccaggacgaggagctgctggacgcgatggaggaggaggaggaccagctgtacaacggcagctggccgctggacccgccggagcacgccttctaccgcggcgacgagtgcgaggccgactgcggcgacccgcaatgcatggtgcacagcaagctgcgcatgatccaggtgggccttcctactttttgtgggacatgaagttgtgtgtgtgtgtgtgtgggggggggggnnnnnnnnnnnnnnnnnnnnnnnnnnnnnnnnnnnnnnnnnnnnnnnnnnnnnnnnnnnnnnnnncatcgcataccacgacgcctgctgctctcgtcatgaggattccgctggagtggcacccttctcaacgccggcacatcctccccaaacgacctcagtcccctcaagcccacccattcaccccaccacacccccattcaccccaccacccacccattcaccccattcatgcatagatatctgtgaccgggcaggacctggaggtggaggtggtgaagctggacgacctggtggacgcgggtttccagtgcatctccatcaacctgccggacgcggaggggctgccgtgcctgctcctcatttccatctcgtgggagaggtttctggacaagctcaatgcgtcgggtgtgtaagaagggagggggaagttggggatgtggggggaacaaggcacacagggagccgggcagggtgctttgcccgcgcccctggggcttggagagaaccacctccatgtcaaacacctcttccgccacttgaagtgcgccatcctcatcaaaaacgttctccacagacacaccaccctcttcttacaccgcccctccctccacgcatcatcctgcctcgcagcggtggaggtgatcgaggtgaactcctactcctcctcagtgcatgtggtggagcagctgccgggggcggcgatcaacgcctacgccagctcctgcgcatttgtcaacgcgctggccctggtggagggccgcgccggcgacgtctgggacatcaagagctggatgggcggggacagcgagcgcggcatcgtgcccaatgcacgcggctacgccctgctgcgcaagacgtcgaggtcgcggtgactggcgtgcaggggcttggtcgaagtgctgtgatttcacttcaccgcacgagtgctgtgtgccaggcacacacagtctgcactgcctccccctgccaacacccgtcgtctgtgtcgcccattttttctatgaacaagacgttgctccccagaggcagagcaagacacatggggttgagagggttaccagaccacgacaacctctggcaaagacaaggtcctgggccgctttgttcaagtgtggcggctgagtttctcaggtcaggggtagggtgcgtcccgtactgacttcagtcggtccggctcgccggcgtgcgtcgggacggcccccagaggaagcaaggcggcgagcccgccgcacaaggcgtctcggggcccgccgcacaaggcgtctcggggcccgccgcacaaggcgtctcggggcccccgcgccgacctcccccgcggcttcacgcctgcttgaggtcgccgtcctccacggtctggttgtaggacttggcgttgatcatgggggccaggaggaggatggccacgccgcaggcggccagcagggtggagaagtaggtgggccagccgtaggccttcacgatgtgggccagggggatgccggcgttggcggcgccgaggtaggccacccagcccaggaagccctggctggcgcccacggactcggggcggaccagctccgcgccgcacagcccgatcatcatctggggcccatacaggaagaagccgatcatgaagacggtggcccactggagccaggacgcagatgcgggcgtggcggcaaaggccgccagcatggcggcgatgccaatggtgtacgcgatgatcacctgcacgcgcttgcccaccgcgccgccgcggccgccggagcggttgaccaggatgtcggacagcttgccggcgatgagggagccgaacaggccgcccagctccaggccggagacgcggagggaggcggcgcccgcgtcggccacgcccttgacctggatgaggtagaagacaaaccaggaggtcacgccctgcctcacgacgtagatgaagaagtaggtcagcgccaggcccaccacgtacgggttccttggaggggtgtgggtgggtggtttggggggttactttgggagtggaaggagcaggaccacctcggggaagggggctggccaggggcatggcatgcgccatgaggtcaaagcatctggcaccccaccggtacatcaccccccttccccacacacatcaccgccatccctggcctcacttgaggcagtcgttgacgaggagggcgatgagcgactctttgggcttgggcgtcgcccccgccgcgacgggcgcggccttcttcagctccacgggcgggaagcccgcgtcctcgggcgagtcgcgcacccccgccaggatgagcaccgacatggccaggccgacgatgcccggcgcaaacatgccccacttccagccgtacatcttggccgcggtgccggccaggattggtgccgcgaagccgcccatgttgtgcgcgatgttccacatgccccagtaggtgccgcgctccttggcagcgaaccaggaggtgaggatgcgggcgcagcagggcgcgcccacgccctgcagcatgccgttggccgcccagaaggtgcagaaccagaccagggaggtggagaagccaaaggccacgttcagcagcgcggtcaccgccaggccgccggccaggaggaggcggggggaggtgcgcgcgcccagcacgccggagatgaacttgctggtgccgtaggcgatggggaagatggaggtcatcgtcccaatctgttggtgcatgtgtggggagggggggttggggagggggtgggcgggttgctcggaagccaccacacctctccaacaacaaagatacccccccctctccctcctccaacctcccaacaccactcgcctccttcatgccgatgcccagggtggcgtcctgcaccatggccggcgcggtgtaggtcaggctgttgcgcgtgaggtagaagcaggagtagcccagcacgatgcccgcaaaggtgatgaagcggcggaaggtgaaatcggaggggtaggcggggaggtccgccagggatgcgggctgtgtggaggggaaaggggcagtcgcggtgtttctggagctggtgctggggttggctcgcgccggggactccacctcgtgcacatgtcatcattcacagcacaacggcaaggccctgcatgccaacctgcaatgagcccctgtgcctccacaaaccgcaagcccaacaccgcaatgcccctcaaaagcatggagtggactctgcacaccttggcctcggtggaggagtcctgggggtcactgggagaggcgcccgagtatgctgcctggacacgcatcagcccagcgggggcgcgggctgccggggcgctgcgctggcgcagcacaggtgcgccatgcatgctgcgggaggggaggaggtgccgggccagtcggtgcgggacattgatcagctagggtacccctccctcccaaccccatgccaaggtggcccaactgacgtgtcggggaccccaaaacccagccatgctgcgccatcgcagtcccacctcttcgacatttgtccaaaaggagtcgtcttgcatgcgcgggagccacgctgcgcgggcaaggtggtgcccctacaccccaccaccgaggtctgcatcgcgcgcgctgagctgggggacgggggatgggaggcgtcgatcccaacacctagatggaacagcactacattacgattcaatgagcatggtattgggatttgcgccgagcgagtacgcgctcagggatctggccctgatcctgatcgagcgcaggtcgacctcaccgcacccctgatacccaccagaaacgtgaagagagtcggacagcgatgcgggaaaccctcgatgctacttgtagaagatgtgtatcgctctccttggcaacagtcggccttcaggtaggcccgggaactgatgcaatgtggaggttgccaggtaaaaaaggtcgcggaggggctggcgcagcacgcagggcatgcgctaacagggtgaagcttgatcccactgaggtccctgactcgctaaatcgatgggacatagcgaaatataacatgcttcgcaatctctaaacattccaagcagccctcctgttttcaacctttgctgcccatcctcgcttcacaagcacattgaggtgagattgggcctttggccaagtcttgacaggttactcggctggtccacggtatgaaaggatcgtgctgatcgtactccactgatctcgaaggatggggaaatgggtagcgggtcggtcgatactgagcattcagcacggtcaaagggttcttttccaggagtgtgaagctgaacagaagtcgcctcaggggagcttggcgcaacacccccgccgagagtccccggagacccctgagcaatactgcgtgtcgtcaccggtaccatcttcacagatgaaaccttcagccacgtgagttgttcgtcagataagaactttggctgtgttcgccatcccaacggggccaccagagttaccactgcacagtttgccatgtgggacctcgtggctactgccgcggcaggtctaaatgctggcgtgggtctggaggctgctgtggcagggtgtccttccgccaacgatgcggaagcgtttggacgttttgtggtacggtctcgcatgctctcccttttcctctctacgctgagctgcggcgcggcgatcgcagcacatcaagcaggtacaatcgcatgatgaggaagctttacgtattcgatcccgtgcgatgactcccgctttgaagctgtaaaacggctgtaggatcaatagtgggcgtctagaccgagtggctgcctaccatgtgatgggagacccgactctggccctcaccagcccctcttcctaccctgaatcccagagggacacggctcgttgtggattgtggcggccgtgagcgcaggggtcagcatcccctacaacctcctgctcatgagctcgccctccccggtgccggcccccagcaacctcagctcccgccgtcccgtcacctttgccgacccgcctgccagcacccttggcgcggaggacggaggcctggaggacggcatacagtcccccagcgcatttgcggggcatcctgggtttcactctgcggacctggatgcgttggatgacctgggcatggcgaagaggcgctcgccccagcagccagctcaggcgcgtcgcctgatgtatgccaagtcaggtgggcatggaggaggtgtgggaggtggtacatcactctcctgcacagacgattaaagtccggacagccgcagtgaggcgatgtcagggaggattttgaggctgattttgtggcaggcagggaatttgctctgctagccaatgaccatgcccatccaccgtaatggcaattacgaagtcgtccgcttgcacatccaaatctgatttgctgcccatgtgccacattgttgcaggcatcctggtcaaccctgtggatctgtcaaggtcctggtcaaggaaggtgtgtcgagatgtcaggcatcctgctgttacccggcaggaattgttaggattaacagggtagagaaagccagtgcttctcttcccgtggatgctgccaggccacactgctggcagcttgttccaggtctgctgaccactgaaacctggcccaaacttacttcagcatttcacccctcccgcttgtagttctggttccaagcggccctgtccctcacggtctttggcggcatggtctccatcctggcaacccgcaaaagttctatgacggcgggaggcggatatgcgccattctgaaacctccgtcaacagaaatagggtggtctcggaggtagtgcaggaaagtttgtgtgccgatgatcatgtcttcgctgcactgctcttgttcaataaaacttgcactgggaaacgcatctcatcgaggagaatcttagaaccctctgggtgacatgtggttatcaggtttgacgagcacgcttacattggccacttcatgacttggcaggttcttcaggttccccatcctccagctcctcctccacccctgcacctgtcgcctgaaagacaaagtgggccaggaattctgtgttccccgcattcgcgcccttgatgggtgagggcatgtggccctggggcaccagcccgcgcgccatgcaggcctcctgcacccgtcggatgacgtctgcgtgcacggcgggatcccgaaccagcccgcccgctgacacctgattgcgtgggggagagagactgtggtcgccactcttaaatgagctggggtcccacggtgtgcgacgccctggcatcaggactgcctgcttgcatgcacatccagccgaccctcactggcatcgacattcatcggcatgccacaacctgcaggggtcaggaactgccccgggcgacttgcctgcgccttcccggcctcgaactggggcttgatgagcacgatcaggtgcccgcctggcttcaagacatccagcaccatgtccagcaccttgatgactacagggatgatgtgttgggatgcaatgcttcatgaaatttgttggaaaggaaatactcatgaaacccatttggtccctttctgggaggcttggtatgacaatcatgcatctgccattcaggcgccgtccctccggaactgaccctgcagcacacgcctcggcctctccaccatccaacacacaggcttgcctgagatgaaggagaggtccagggtgacgaggtccaccggctcaccgccaggcagggccgcgcggcgcaggtgccgcacgtttgtccgctccatcacggtgacggcagggtgctgacgcacgcgctctgccacctggccataccccacatccacgcccaccacgcgcctggccccgcgctggagtaggcagtccgtgaagccgccggtggagaggccggcatccagtgtggtccatcctttggggtcgaggctgaagtggtccagggcagcctccagcttgagcccggcccggcagacgtacctgggagggtcggccagcaggtctatgcgagaggaggcggggtccactccggtgcccgccttcaggacaggctgcccattcactgtgaccaggcctgcatggatggcggaggaggggccggtttggttccttgctgcagtcagaaacatgaggaggaggcatgcgtgatcagggtgtgggtgagcaaggacccaatcacattcagtaacgccacgaggaacagctccaggaacccacgccaaatgatctcaccctgcgcaatccaggactgaattacgttcttgctgtacatgggatgcagctcgacacacacttcgtccagcctcctccgctttgactttttatatgcctgggtgtgtgcaacagtaaaagcagcatgtggggcgcctgccagcaagcaagatcgaggcttctctgttcatgttctcccaccgcagcgcacccctttattcgtgacgggcgtctcgtctgctgcatgggcagccgagtccatggctgatgtcgtgaaggggccagcgtccgcatattgcggccatcgacgacggggtcgagtttgccacaacgccctcagcaaagaggcattgctagggactcgagacaaggtgaatgcgcgcatcgtgtgaagtcctccgaagattcagaatacactgcttaacgatcctgctgcgatgactgaaaattaagtcagatggccccttccgcaggcttggtgtacaaaacgcaaaatcctcgccggacaataataaatcgggggccttccgcgcatgttattgggacaagaagatgtatgaaaagatactgacatatgcgacaagagtggtttgcatttggttgtacagactacaacacgagccgctcgataccgctcatgcacagcatgcgctggccacagcttgatgaaactctgtatatgatctcggcgaaggcaatgaatgcgatagctgtgtgatgcgcatgcttgtgcacggagccttgcttgtatgatccaggccttcctggtcatatggccgtttggggggatgtttccgtcgtgtgcttaaagaaatacaataggaagggcagagatatatttgttctcggcatcactaccacgatgaccacgaagctcgaaagagtaatacgtctatatgttgccgcccgatccttcagttgaccccagtgggcagcgtagaggagaggagcatggagacatacaccaggcgggaaaactaggggttttccgatttgatgttggctgtcgtattccgtcaggcgcccgagcgccagggcaaggatacaccaccgacaccaagactcctagcggaacttcacaggaaacaaaattgaatgaggatatgacggctcgctaagatgccggtgaccgagcacatcaggtgaacgggctttggtcatccgtggggcgcaggaagtttggaatggggcagagctcgtgtctgctgcaccgcttcgatggtcctgagatgaccctctgaaacctcttccaaccattttggcctgcatcgcgcagcgtgcacgtccgcgtgcgccctctgagcgatgccgaggtcgagcgaggcggaggggcatggcgggtggagggcaacaccctctaccaggtggaccccgccacagacacccgggtctccgattcgccctacaccctggacaccgttttcgacggccggaccaccacccgggaggtgtacctggccaccacccaggccatcatccaccaggtggtccagggcttcaacggcaccgtctttgcctacggccagaccagctctggcaagacgcacacgatgcgggggggcggggagcaccccggcatcgtcccgctggcggtgcaggaggtgttcgacctgatcgccgccactcaggaccgcgagttcctcctccgcgtctcctacatggagatctacaacgaggacatcaatgacctgctggcaccggagaaccagcgcctgcacgtgcacgagagcaaagaagccggcgtgcacgtggccggcctgcgcgaggacatcgtttcctccccggagcaggcgagctgggtggtggtggggggggtggggggcccggggagtgggatggtgcctagctgcctttgcgaggcacgggccatgggttgctccctgcagctctatgagcaacaaccagtgggcgccccatcatgggatgcagacgccacctcccaggggtgtctgggcctgcctcctcggccaccatgctcaggcctggccatctctgaggggtgccttccaccagtgtgtggagaatagcctcgtgcagcacccgtcacccccaacatctcccaccaccgttctccatcccgcaggtattggcactgctggaggagggggagcgccaccggcacgtgggcgagaccaagatgaacaagacctcctcccgctcccacaccatcttccgcatggtggtggagtcgcgatcctttgccgacgcggccggcggcccctcccccgaccccgacgactttggcgccatccgcgtctcctctctcaccctggtggacctggcggggtcggagcgcatggccaagacgggcgcggaggggcagcgcgcgcgtgagggcgcggccatcaacaagtccctgctcaccctgggcacggtgatcaacaagctgagcgagggcgggggcgcggggtcgcacatcccttaccgcgactccaagctcacccgcatcctgcagcccgcgctggggggcaacgcgcgcaccgccataatctgcgccgtcacgcccgccgcgctgcacgtggaggagagccacagcacgctgcgcttcgcctgccgcgccaagcgcgtggtcaacaacgccaccgtgaacgaggtgctcagcgacgcggcggtgctgaagcgacaggcgcgcgagatcgaggagctgcgcaccatcctggaggggtcggggtgagcggggtgtgtgtgtttgagggttttgttgtcgtgctggaggggaggggtaggctggcatgcaggaacggaaggacaggctgtgcgggtggcggaggacggcagggagcggggttggggcctgggtcggcaggacatcgcactctgaggccacagggtggatggtgcggggctggaaggggggagcgcatggcggcgcactgaattcgcgcgggcctgctggaggcccaggctgacggggcggcgccgcgctcctggctgcagctgtcacagcatcgaggacctccccgggccttcacatcaccatgaacccctccccccctcctccccccgcctcggtcgccaggtcggcgcgcgaggtggagacccagatccacagcctgcgcgccgagctcctgcgcaaggagcaggacaacgagcgcatgcagctggacctggcgctggagaaggaggagagggagcgcgcgcagcgcaagatcgacagcatgacgcgcatgatgctggacggcgcgcgcggcggcgacgcggagaagcccaagtcgaagcgcgagaaccggcgggagacgtggtgcccgggggccggtcagcgcaagcggcccctcctccccgccctggccggggcggtggaggagggcgaggaggagggtggggtggaggacgagctgggcgaggcaggggcggagcgccccgcgctcccgccctccaggaggtccgagggcgccgccctgctcctgccgggccaggcgtcgccgccgcacaagctcagccgcggcagcggtgggtcctctggtgtaggtgtgtggggtgaaaggcagggttgaaatggacgctgcgcaggggtgcactgggactgctggctcgggtggggttgccctgtggcgcaaagggctgaatgcagagcggcgcaaaggccaggactttggtgttgagcgctcgattatggctgtcctcgtggccctgctcagactggggctcctcccagatgcccctattcctgccacgctccgtcgagcgctccctcaccacccccttcccaaatgcagagcgcatggaaaccggcgagcagcaggcggccgactgccccagcgaggaggtcaggctgctgcgcgagcaggtggcggagctgaccaccgcgcaggggttcatgcagcgagagctggaccgcatggtcgagctggccggcgagcaggcagaggccctgaggtgggtgctgtggtggtttggtgttgtggaggtgtgggggtgattgttgttcgcctgccgacagctgggcagcagggccacaccacgtgctcgacagcccaaggagctgggcctgaggtgatccagacataccctgggtgaggacccctgacctcggagcactcagaccctatgcccacctccaacctctgcacaccagggagggcgaggcagcagtggcccagctgacggaggaacagcagagagccaatcccaaggcgagtggggcatcaacatgggatctggggaaggccattcgttcacactgcgatgtgtctgtaaaccacatggccatccatcagccgcggaaagggtcgcgcacccctgctgcagatgaaggagatggagtggcgcatccggcagctggtggggcagctggaggaggcccaggctcggctccaggagacggaacaggtctggttggtggtgtggatttgctgcatgcttgggggctcgagctccttgcctcataccgcgagtcgaagcggtgcagaggctcctcaacaaatcatacctcacacctgtcctaggctgctgcactggaggcgaatgcccgggaggagagccagcaggcttggagtgcacagcaggaggccctggaagccaggtgcaccgacctggatgccagcgcccagaccctgaagcaagaggtgagcatggaggtgtgcactgtggcgttccgtaagaagatgtctgtactgcatccatcaggtgggctgctacacatcaccttgaatatcacaccgttcctgtgtcaacaaggttggggcgacttccttttgccgtccagagctgccgctcgtgaggccggtctcagtcctgttgacgaccaaacctgccccgcaccatgtgctcaggcactgcaactgaaggctgagctccaggctgcaactgacaggctggaggaggtggggcgagagcgcgcgatctctgatgccaagagcgcgcgtcagaagcaggtgagagttgggaaggggcggcacttcatgatgggcgtcagccacatcgtattgctaccacagtgccaagctgattcgagaacccaaaggtgcgtttacaaggtccttgtgtcgctctgcctgaaaattcctccctcccaactgcatcctgcaggagcttgacgagctggcagccacagttgctgcgcacacagaagagaaggcggctgtcaaagctgcagctggtgggttgggcacgtttgaccaagaggctgtgcacggcatggaggatgatgactacatgcattgcgctgtccccagtgggtactgttcttgcccaaggttccagcccttagattgttgcctgtaagtgtctgtcctatcctgccaccccattccacagacacggccaaagagaagctggcggaagccgagtcgcgcgtgcgcaacctgtatgaggagaacacccgtctcaccgcgcatatctcggtgaggaaccgatggccgcagcctcttgaattttacaggggctgctcgcacttgccccctcaccgctgtcccctgcaatcctaccatgagtcgacagagggaaccgagatttggcagtcctggtctacatcatatctcttgtccctccgcaggacctggagtctcggaagcgcgccccgctttaccagaagaagcaggaggaggagctgcgtgcagccctggagggtgccaaggaggccgagatccgggctgtcgcagcagagctggcagccaaggaggccagggtgaggtgacagggctgggacaaggtttccctggccagggagtacagctattgccctttgatctgcagtcatgggacagctggtcgcccttcaacaccgtgccagacattgcaagggtcatggattggtcaaggtcctgtcatcaccacatccattacccctccaggtcaatgaggaaagcgcaaccagcactgtgtcagagctacgccagaccatcacccgcctggagggggcggcacaggaggcggcgctggaggccagcgccaggctcgaggccgctcatgcaaaggcagccaccgagactacccgccttgaggtacgttgtaggtacagtttggaagccttgggacacagttccccaggtctacaccctaggctgcgccagcctgggttggtggcagggcctgggcatgctggagggccggccggcaagctcgcagggaggcacatggtccttgcctacaagttgcattgcagaggcgcagcaagctcatcgcgccatccaccatcacaccggcccaggccgcgcttgagctgatgcgcagcgagcttaccgcccagctggaaactgcgacagcagccgcggctgtggccgaggtgaatttcgagcaacaaggtgctgagctggaggatgcccgcgccgagatgtgcaggctggaggaggagatcgtgggtctgaaggcctctcttggtgagtctggcggtgtgactgggcgactgcgccaggagccaatggggcacacttcatcatcactgggaggctatctcagggaacgactgccaagggttgatgctcgtccatgcaacagctgttttcatttaatagccctcgtcctttcgagtccctgcactcaccttggactaccccccttccaatgtcgccagaggaggtccaggcctgtgcggacacggccaccgtgcacattcacttcctagaggagaagggggaggccgacgcggctgcagctgcagaagcggcggaggcagcctcacgccagcttctcgagaccaggcgtgtttcgtgatctggaggaatggcagggatgccagaggcagatgccattcatgggagactagtcggggcctgagttgaccagcactgctcaccatgtcaccaccccttgtcaccacctcttgtcatcaccaccacagggatgccctggctgctgccgaggctgccacccagcaggccctcatgcaggctgcagaagaggcagcacgtctggcgcaggagcacgaggcggccgtctcagctgccctggcggcgcacgaggaggtgggttgattgggggggagaactggttgccgagctgtcgggatcacactgagttgctgaacggcggtccccagcctcccacccacctcggccccttaccctctttcccaggagttgggagcggcgctggtggagaggcaggagctggtggccaagcgacgggagctgcaggacaccgtcaagtccctggaagagaagctggccgccgccgcggcggggctggccgccacggaggagctcaaggacctgcgccggcgacataaggaggacgtggcgaggctgagcctggcgctgaagaacgcaacgcaggggtccaagggcacggagaaggccagcgatcgcgcccagaaggaggccgagaagctgaggtacggtggttttggtgggtgcctggaacttgtgggagggttctgggtcaattccccttgagcaggcgaaagctttctaagactgcttcaagggatccatgcatctcggggctgcagatgagcagaacggtgtgcagggcgatgctgagatgcatgcaaccatgcaccggcctttcgcactccaggtcaaaggtgaccgagctggaggccaaactgcgggccgccgtccaggacaagaactctgcgcagaacgagaaggctgcggcggagagggagctcaaggcgatgcgctcccaggccgagcgcctgaccaagaacatggacaaggtgggtttgggaaaagttgacgctggtctgcaagtaggcgtgaacagaacaatactcggtgggcgcggccggtctgtgcgcactgtgaatggggatgtgctgggccaggcagcgtcagcagctcgatgtaagtgcgtggtaatcccaccctgcctcctgcagatcactggcgtggaggagaagaagcgcgagtccatcatggtgggattcaatcagacaaagagccggctgcaggtaaatggagcaggggttggccgtgtgctgatggacggggctgtcgaggagaggagtgccctcgtttcgaagtgaacagtgcgcctgagacgcatccagacctcccgcccatgacttcctgcccgccttgtgtggctcagattgctgaggagggcctccaccgcgcatcagtggaggtcgagaagctgcagttcgagctgtccatcaaagcaggtacatgaaggaggtggcctggatgccgtcctatatccctggtgacaaagctgtgctggagaattcccgcagtggctgctcacctgctcagacgcaatgagcaggtcaaagtggcaacctggaaacctgccagccgtataaaaaccgcccatctgtgacatctgcaggggaagcccgcgcccttgatgaagaactgcaggagagcaagggcgaggtggcgcgtctgacagatgtaagtagagtgtccttggcgaggagaagaccccaactgcaaggacaggacgttccgtgtctgctgctgggcgcgatcaaccgctgccccgcagcagggattcagtggctgccccatcaacgcagcattgagtgctccctttgttgctgtcaatacgccactgcctcttcgatccactttcacaggagcgagacggcctcaccgaccagctggcggcggcgaccgaggatgccgagggcctgaggaatagcctggcggcctctgccgcgtcgacacaggccctctccgaggagaaggacgccctcgcggcttcactcgcccaaggagaagacaggctggccgacatggaggccgccctggcgcaggggcgtgcggaggcggcttcccgagaggaaaacattgcgtcgttggccgcgcgcctcgaggaggggcagagggagctggaggccgaaagtgcaagggtgggggacctcgagaaagaactggagtcggtgcgggtcaggctgaccgagcaggaggctgcgcacgcgcaggccgcggaggcggccgcggagcgtgaggcagtggcgcgctccaccgtcgagtgcctggagaccgaggcccgggagctggcggaccggctgcgcggcgcggaggccgagcttgcggagcgctctgagtccgcccggagcctgaaggctgagcttgacctggcgacgcaggagctgacccgcctccagggtgcgttgcgctttgtgttgtgggtgcagggtggttgactgggccaggtgcatggtattggtggtgggtggtcgcaaggtgtccatcgaagagccacggtttggacatgctcgcggctcaggtgatgactgatgtggttgctcaccacctccctctcctccttccccatctccacatcattgcaggcgcgctggcggcggcaaggactgcaaactcggtgctggagggcagcctggggacggcccgggcggagctcgccgagctggggaccgcacacatcgggctagagcgtgccaaggccgagctcgaggcggccctggccgccgagagggaggcgggcgtcgcggcagaggccaggattgcgcaggcccgagaggagactgcagagtgccaggcgacgctcctggccgcccaagaaaacctggcgcaggcaggagcagaggccgaggcccgccagcgacatctggctgcggaggtggaaggtgggtgccggtgggggatgacgaaaagggatgtggtgggggcgcatgggtttcgacgccgctgcccttccacgcttctcccaggatgggcctgggtaggaaatctcaagctctgccactgaccgcctcgcgcagatgccaaggccgcggcggaggcggcgcgggcgagctcgggcgaggagacggcagcgctgtcggcccggatcgatgagctcgagcttcagctgaccggcgcagctgaggcgctcgcggcgtcgcgggcagcccaggaggcagccgaggcgcaggccagccaggtgcaggaggtgctgcgtgccgagagcgatgcgctgcggcagaccctggctgcagcgcaggccgacctccaggccgcccaggcggctcacgaggtggggttggaggaggcatgtgggactggcccctccgcaaggctcctgctgagtgtttgggggggatggtatggaaagccgtctgtctactcgtatcatcaccattctacctgcggtgtgacgggcttcccccaaacgccttccccgatccacgtcccaggcaacccagagcgagctggcccagctgcagtgcacgctggaccaggcgcagcaggcacagcagaccgcgctgagggacctccaggtgctgtggagggttcctggcagatcccggtgctagggctgcatgtgcatgcaggcagtgcacgtggtgctggaggatgaccatggcacctgctcctccgcgtccctgacatgtgtacttcttcgggctccctcctcccaacccccacaaacaacacaatctccaccgcaggcttgtcgggcagacctggagaagtcgcaggaggagtgcacggacctggacatgcgggccatgcaggctgagggccagtccgcggcgctgaggcaggaggtcgtcggcctgaaggagcaggccgatgcctggagggagaagcgcagcatgctgagcacgcagctcgctgagctggaggacgcactgcgggcagcccaggtgcgtgggtggccggcgctgggtgccaggggtcccagtgggcctgctgattgcggggttggggtgcggggggtttgaggggcggattcctgcatccgtcgtgcagaaggcggtagctacacgctgggtgcacccggccacccgtcggatgcactgttcctgccaggctgaagaaatacgagtgcacctcaccctagcatgccacccatcacactggccaagatcatctgacccactcacctccaggagtctgcgaacatggctcgccagcgcctgggagcagctgagacccgggccgaggccgcggaggaggagctgcatgggtgagactgcgtttcggggtggagggtggggctccgagcgcaatacgtgctcgcaggaacaccccctgcggctcgggccttgctgccatgctggccgcacgatgcccggcatccacccacaccccctctcggtgcttcgcagagcggagctgagggtggcggcggcgcgccgcgatgcgcaggaggcagaggtccagtgccagaggctgcgggacgaggtggatgcagtggaggagcagctccttgccaggtgctttgagacaggagtgcaaggggaggccagtccgctgtgcaggattccctgtgtaaagaggtcccccagggctggcttccaggatacactgcaatgatcagcacagcctcgcgctgccttgcatggctgcccgctgtcgtatgatgctgatccgtctttctttcgatgcagcgccgacgacctccagaagcagtctgagcaggcagccgcccagctccaggtgactgcacgggagctagccgtgtccagtgcacgactgctcccctgggctccgtgccatgcaatgtgatggctgcagcgcgtcatggggtgacgttccccttgcatttcctgcgcacaggccctgcagaccgagctcgcggcagcccgcactgtgcagcagcgacaacaggtacgcagcgtgcacgggggcattgaggcagggggctggcgggtgcagtcgcgattgttgggcacgtgcatgctgtcattataatgtcgtgcgcatgcgtgctttgaacagggcatggatccgccacgcccagcctccctgcgattgccgtgacgtctgaacagctcgctggcgacccgcccacccgatcccagcacgccccatcccaccatcaccacgcacaggttccgccctcgccggccccggcgccggcggatcgctgcgccgccctggaggcggagctgcgcaagtcgaagcgcagggaggagaagctgcaggcgctgcagtaccggctgcgcgaggacgtcaaggcctgcggcggcgacctggcgcggctggaggatctgagggagcggcgcagcctggagtacgagctggaccgcacccagaaccaggccagcagggagaaggccgcgctgcgggaccagctgcgggcggcgctggccaagtgcgcggctctggaggggggggtgaaggggggtgcgccccgccccggcgtgctgcaggccagggagaatgtgcggccctgctaacaacgctgcaggagcacatgcccgtgccggatgttgactcgactcgattggcctgacacctgtacaccgaccgtgtggaaacttaagcctttggcctgccatgcacttgcgagtatcaggggacacctctgttgctgtgcatgctgcgccacgagggcgccccgagctatcctcgacacgacattgcgcacgcgcgagggttgcacacatgcgctgctccccccatcatctccctccgtaccatgagcgcccaggggagccttacttcgggcccttagccatgctccccttgcatcggtcgaggcctggcacacgaccagaatggactgtgcagcctagctccaggccgcgcaggtgtggtacgttgcaccttacggcacagtgctccaatccaatgagatcagtcacagctcaacgagggcttggcttgactataggccacccactcgcactgatccaggcagaggaagccctccagctcgctcacgacctatctgtggacggctggtgccatcttcgccctcgtgacatatttcttgtaccgcacactcagcaatgcggatgtcaaggtgggcaggggctggagtgcaccacaggggacagctcatcatcgcgcgccgtccaaacaacaggatcagatacatgccagtctgcccccgaatcctgtaggaagccacagtcgagctagagaagctgtattctcgtccctccccagagtactgcttgcggaaaacgcccccactggtgtgcggccatggcggggacagcagcgacgctccaccgaactccgctcgcgctttccagaccgcgctccaggacaatgtgccctgcatggaggtggggtccggagcgcgtcacacactgcagggcgtcggggaggcagagggtggcgaccacttgtgcacagggttgctcatgaccgccgcaagcatgcctccaggaagcccgcgtcaatgtatgtcgatgtgcgcctgcccaggggatctggtgcacaccttcatgcaggtggatgttgcgcgcaccaaggatgggcggctggtggtgctgcatgcccgtgagctggccgccttgacaggcaccagtggcaagcaggtatggccagagctgttgaggcaagcggtgcggcgatgtagcaccgctgggatgccgggacttgtgcgtcagttcggtgcatgaggcgagtcaggcctcaaagggcatgctctggggtacacactgttcctgaacacccctggatgggcatgatgccctgttctgcttgcgcagcctgggatgagtcgtctctgacacttgcatccccgtcgttcaggtgagcgagtactcctggcctgagctatcccagctcagatggggggactctgacgagggagtcgtgccggtgaagccactgttgcagctgctgcagcctagcctccagaccatcattctcgatgtcaagcctactctggatgtagggcactggcgtgtggttggccttctgttgatggcttgctatgcttggcttgtctggttgcttttgcttgccaaaagtctcactctgaaaccatgcatgagagcgatggacccgccaagaggggcccacagccgcatgctgcatgtcttcatcatatcatttatgttctgcagaagtctgctgcacagaccacatcatcatataggtagtgtgcgaactcagcaactctaatccacaacacatcacccaacaggacaacatgcagcccactgacctgccagtcatgacctctgctgtggctgcactgctgcgagaggtcccatgcccaaactgcatcgtttgggggaagtttgatgagctggcactggcgcttcgccaggctgtcccaggtcagagcgtgggctacgtcgtcatgaatgagaccgccgaggtgcgctgggcaagggagggtgggctttgtggcgaggatgccacctgctgtttttgacatttgctggaaagtatggttcagagtgcaactcgatgccgggcccgcactgctaggctacctcttgctagccggtggtggtgaggctgcctggcactgctgggtgaccttcgtacaccccctcccgtttcagctcctgtcatcattgctgcacacaggtgcgaagtgcagggtgggatgtccccctccgctcccccgaggctcaagtgacggcgctgcactatgccatggcctccacccagctcctggacctcctccatgccgctgcaaagcgggtgatcgtgtggaccgccaatgcgccgcacatggtgcgactggctctggacgcgggggcggacggtgtcgtgaccagctacccaaagatggtgcagaaggcgctgatgcagcggcgagacgcatgtctccggctgtatggacatgcgcccgtgggctgatggcctctgagcaggcatttttgcatgttgatgtcctctgcggcgtcaagcttctcatcgctgttgtccactgcgatgggctgcccccccaggcaatgctccactcctcttactttgtcatcgtgatcgcatgacccctgaccaagcattcttcatccgtgactcatactgactgatactctgtgtgctcaaaaacagtgacccctgaagtgatcacttttgacacccaaaatcttatgcactcctaaattagtacacaccttgccgctggatgaggttcaagatgccctggggaccagccaggatctcattcaggaacgacaggatcgcaaaccaggcgatgggggacacatccagaccattgaaaggtttgatgatcttcctcgtgggcgccagcaccggttctgtgggagggcagtgtgaggctttgtgttgtcggcgatgctcggctggtgcttggaggggcacacgtcatgaccggcaggcacaatgcccgagccagcggcttccaagtccatccagtcatcacctgttggccagtacacaaacgaccaaggaagcttctgcatgtctatctcgggataccacgccaggattatcctgccaatcatgcccaggctcagcactgtgagaatgggcttcagtattcccagcaggagcccagcgtcggctggagagatggccaggagcatgaggtcacctccactcgggactgctcgagggatgtttttcattcccatatgttgcctgtgtctcagagctccagctcgaatggacgcatgggccatagggactgggcaacattgctgcattggcgttctcatgaggccgctgtggcatcctgctgaggacagtccaaagctcatcatgccggtccacgcagggctcgcaggtcttcgacaggatgagggatacagtatcgatgttcgttcgatgtgagagcaagttcgactgtgatgctctctgtgctgcatggtgccctcacgtcctccatgaggcgcgaaacgggcgggagtgatgtttggccctcggcagcaccggagatcgatgacatacaacaccccaacaaaaggcaagcgtaacacacgaatttgcacaacaactcgttggctgcatcgggaagcccattctgacctccagaagagttgcgcccaggaagaccagtcccaagtatacgttacaggacagtggtccgggccccaacatctacagctcgccccggcatctgtattaccctcgccatggcgcgacggagcttggaccttgtgaagcacgtcaagttcctcgcccaggcgggtgccatcaccaagccaaagtggctcgacgtcgtggagaagtgagttgcagccgaggccagcaggggggttgcagcgtcatgagtatagtgaaaacgcaccaaacaatactctcaatcccatgtaggatccaccctgccgtccctgctaagagcagtaagaagccagccgtgctcaggttcccagaggatgacctgctacaggcctactatgccaagcaccccgaggtagaaggctgtgcctggcatgggcaggttcttcaaagtgtgctggggctatgcccatcctgcccggtgcagaccctctccagtgtccctcactcacgcgcaggcgaagatggaaccagttgacttgagctcctttgagcccaccagtgctcggaagtttgtgttccgacagctcgaggtgatgcagacgggcgtgccacgaaaggaggcctacgacattgtctccaaggaggtggctgaggcagcgtgagttgggaggttgggagctctgtcacaccttttccgggatgctgggcgcatgccctagcacacaccaggattacagttgtgagatctggcacctccggccgggcgtgctaaactggcactcgagatgaggaatcaaccctgtgtggttgtacacctctcataaatctgcctccaaccgatcgagcaggagcaccagcgacgccccagcactgggcagagtggtgctggaccagatccagcaggaggaggagtggcacctcatgaatgccatgagccagttcagggagaggtgcgagctgaggcacctcatgctgagaggcacatgccgagctcatgtctcgactttgacacccccctcccccctcctcctgcaggcatcccacggtggccaagctgtcgccgaagaagccgcctcctgcaaatcccaacccagccaagggcaatgcgcgacgaccaccaaaaaaggcgccgcggccgacccctgcgccgccagcgcaatctgtgcctgcttgactgtcaggagcttagggccccgtatggagctagcattggtgtcctgagtgatgtacgtttacaggatcaggagtagacagagcttgtgtcgaaaaggcatctcacagggtggccaccagggcagtaacgaagtcggcgtgccataggaaggcagcgagtcccagtgcacaaggttgtaggggccacggaaacagtgcataaaaggtcaaagatgttggggaagaatggaccacgagagggctgtgctgtgcatgatcagcgaggcccctcggcattcctctagcactccttgaatggggacagttcatcgccaaatgtatctgagttccatcatctttgccataagtagctccgtgcagatcctcgcgtcgattctcgtcagtcacccacaccctgcatgaacacctcccgctggtgacccagccacttcatgacgatgctcgcgtgccgcacaaaccttgcgaaagtcaatgtcggctacatggcctgtgccaggactccctgcatgtcacgctgcgtttcgcggagtctcaaaacatcagcggccggtgaggtggtgatcagcgagagccttacgtccacaacatctgcccttcactcaaacgatgcaatgctcgcacacacacaaacatgcagccagccaagaccagcgagttgcgagcccatccaccaaatggtagggcaatgaaaagaggcatggagcccatgacatgacgagctctctctcctccgggcatgcccacatcaccatgccaaagtcacgtccctccggtgcagggcgcaggcgatgatccagttgccacctttgcctcgtgggtgccatgtgataacaccacagatcaagcagcagatgccagacctcaaagacttccggatcggtctagcccacctctttgtcctggtgggtgggggcagacttgcccgcttggcggtgtttctgcatgaaagacatccttttgccccatggacatagggtgctgcacttcatcgagtgtctccctgtcaactgcttgtgtgccattgatgaaatgaatttcaaaagcagatacatgttgtggtgagattcgcctcattccagaacatttccactccagactgcttgctgcatgtggcagcgcccatcttcctcatctctcacctcctgcattctggtgcagcacacgagctgttcgctgacgatcaacgagaatgccagcccggatgtgccccttgacctggccgacaccctcgacaggattgtgcccgagggacggcagtacaggcacctggacgagggcctggatgacatgccggcccacgtgaaggtcaggcggcttgtttcgagggaggactgggattttcccaaggattgccctggccatggggagcactagtgacaggcatcagctgggctagaatgattcctgtcggaacaacactcgcacaatgcacatgtgctgatccgccattgcactccattgccacagtcctcgctcatgggagctggactcaccattccagtgcgaaatggacgtctggcactaggtaagtgccctcttgaggatggaccgttaggcgtaccctcatatcatggaggaaatgacacccattgtgctcctgcagtacagccgaagaccgagctgcccatgcctgtccctcctgatctaaacaggaacgtggcaaggcatttacttgaatgagcatagagactatggcggcagcaggagcatcatcgtgactgtgcagggtcagtccaccgcttgagtcctcgttggtgcaaacgcagagtctttggcaagcaaccgccgcccaccatatttttaagatggggcgtgtatagtccatgaatgatgagcaaacccacacgctcgccctgtaaccatacaaagttgtttggcggtgcccccctcttgtgagaaaagcagtgctggtttcactcatgtggtgtcgcaggctgggtttcaaacccggattacactgcctaggactttgccacattagggcgagcgacatcgagtactgcagtgtagctttcacacatttgtacagggacttgatatcaggcgaccagaacctgggcggggccactgctctgagtttcggagtttcgggatggcggcactgacgggcaggatgctatgccacatcccaccggcctccctccaggctaggcaggctcgggcaatcggtttaaatacacggcgacaaggctcttggcggacgcagacgcgctggaggaggccacagaccctggccaccgctgcaccggtgtccccacccacctcgccatttgcgaacgttgagcacgaggcccagctcttcgccatcctgaaagcaggcacagcgagtgggaaggtacgtggcagtggatttgaggagtctgcgtttgcagggttggatcttggcaaggagcctgttactagccttgcgacaccagggctttgctaggtcctttctccttgtcccctgcagatcccgcagcgcttggtggatggcatcatggagctttacgataactacaagaaggcggtggtggggagtgggaagcctggggccaccgaggactttgttgccaaggtgcgtcctgttggctccacgatgctcctcctccctgccctgacacaaatgtggaccttgggaggccacagcaggcctctctctcatctgttcagccaagcccgtcgtcacccaccccccatgccccctgcaggtcatggccacggtgtgtgagcgagtgttgatgcaggtccagcagccctttgtcttccagtccacacacaagctcatcctggagccgtacaactactacctctttggccagcgatacatccgggggctggtcgactttgacaagtctcgtttgggccatgccgagcgtttcgccaccatccaagaacagctggaccgaggtgagggctggtgcactttcttcaaaggatacgacactggagcccttgtggatatgccgaggactggcagggatgcgacgcccagttagactcctgaagaaagcttttggcgtgtctgggatgggcggatccctcttttgggtggatgggccgccccacaactgcaggtgcactcgatagtcggcgccacaccatgccatgccacgcaggggagaatgtcgtgctactggccaaccaccagacggaggccgacccggcggtctttgctctcctgctggagacgcagttccccaggctggccaccgacgtcatctacgtggcgggggaccgggtggttaccgacccggtctgcgtccccttctccatgggacgcaacctgttctgcgtgcactccaaggtgcggccggggaggtggagaggggtttgggaggcttcctgatgggcatgccgccagagcggtgagtgtaggaggaagtactcccgtcagcgtaaggctgatgtcggtagggcgtgccgtccgctaggggtcgctcgcgccacctggcatgcagcacgaagagaacggtggggcgtccagggagcagcagcccgacgctgctcgtgggcttccacagatccaccaggggcctcctcactcctcacacgaaactgccccgggcaatccccctcccgctcacagaaacacctggacgacgtcccggagctcagagccgacaaggccgccatgaaccggcgcacgctcaaggacatgcaggcggcgctgaatcgcggcggccagctgctgtggatcgcgccctccgggggccgtgaccgcaccatctcccccgagaacggtgcggtgtgtgtgggggggggccagcctctcttgatgagaccccgagccaatatggagtctcggggggggtgggggcggggatggatgatccaggtgctcaagcatggagggtaatagcttgacgcagcacactagacctgcccgtctgcaacgcaggcgagaccgtcccggacgcgtttgacccggcggcggtggagctgatgcgggcactgacgacgcgtgccaagccggtgggccacctgtatccctttgccatgtactcgtacaagtgaggcgtcggctgggcgcatggctgaggatgggaaatttgatgcaagtggtgattcaatgggccgctccgagcgggttctccaactcaatgggcggattttggagctccctggaatgtgtcacatggaacaggctctcgcctcctgccgctgctgccttggattgacagcattcccaaaagtccggccattcacctgtggccatgatgatcgacggcgtcgccagcactcccctccctccctttcctcatacagggtgatgccgccccccacctccatagagaagaccatcggcgagcagcgtgtggtcaaccatgcgggcgtaggtatctcagtcgggcccgagctggatgtggacagcctgttggccgccgtcccggcggacgacaaggccgcacggcaggcggcgctctcctctgcggccttcgacggcgtcaccaccgagtacaccgccctgtggcgtgctgtgcacgctgcacccgaggacgtggcgcccgagtacacccagccgtggaaggctgagccggctaggtcgctggtggactacctgtgatgagcagggcgggctccctgtgcattactcacggcagtctgcccatgccctcctgcccagattttaggtggcccagcccagctccgctgtgccctttccctcattagttccgtgtagcgcagtacagcctggaggggttcattgcgagacctggcgtggcacgagcggtggggtgcagtattcactgttcttccaagggattgtcttataggaggcgaggggtacgtttcctggtcaatgcattcttcggggtccagtgagcagagcatagttggtagcctcctcagtcagcactggacgactgcctggctctcagtacaggtcctcctccttgtgggtctggatgacgcagtcggtggttgggtaggccacgcagagcagcgcataccccttctccatctgagagggcaaagcgacgatgtgagtaccattccacgcgcaggacaggagtgcatcatacaggctgttcacccccggtcgatgcaggcgatgccctcccccccttccaacccccaccctccatggcgcacctgggtatcgtccaggaagctctggtcgctctggtctacttcaccagtgatcacctttcccacgcaggtcgagcaagtgcctgtggtgcaaggctggttgacattcacccagcgccactgcagcagcgcgactcagttctcccagaggcacacgagatgcaaaacgtatgccatccatttccacgtacctgagcggcaggagtagggcaggtccaggcccgcatcgtcggcagcatccagaatgtactggtcctcagggacctcgatggtctcctcctcgccattctcaagctggaaggtcactttgtaggtattgcaagccaaagaagctctacggtgagccagcgtgcagaggaagaatggggcacgagcgggagctgcagtgctggcgccaggggtttgcaccctgccgaccctcgcagccagcacggggggacggcttgccagagcgtttgccattctgtctatgcttaactaaccgtactatcgaaaattttgactctgagggtgtagaaatagaatgtctctacaaccaggtgatggagtccgcttgttgtctcgttgggttgtggcacgtgtccctccgcacataagagtgcgactcgccccgtgcatgccaacgccaacagcttggatctctccagcgactggttgcgaacgtgcgtcaactttgctaatagagcactgtgaactcgcccttgtctattcctgttgttacgtcccttagcaagcaatgggaaaatctctatgcccagccatacttgcgcttggtctccgtcttgttcctgataccagcagcatgctgtgaggggttggtatgggttcccatgagtggttcttgactgatcacgtcaggatgttatactgctcaagtatctttgagagtaggctcatccttgctaccccgctcattgttttaaggccaccctggaaacctgtcacccttgacccccctccactctacttgggtagcgatgcatcccatgcaatccttcacccttcacaccttctccagcatctccaactcttgcagcttggcctgctggaagagcgatccgatctggtgctttcgcttttgcatctttccaacatcaggccctgtggtggatggaaggagggacagcactctcagcctaggctcctgcggtgacgagccaccctgcttggtattgtcagacgagtgcagccagcatgcggaagccttcctccctacctgcttccttgcggaggcgtgcctcgtagtctgagcctaatgcagatcgcatggcattcagctcagctctctgtcctggatccatgtaccgcaggactgctccattcacctgtgtacgaattggatgcagaatgggtacagtttgatgaaagcaggcctcttgtatgccctcggtctgcaaggtatatccaaacacacctgttcccactctcgctcctgcaatgctcaccctgatcagcacaaaacccctctcccccgccctcgcctgctctgcccacctccttgaactgtatgccggctgcagtgaaggcagcaacgtctggaccagcaggggctggcatgccctgtgatgcatagtagtctgcgtggggtgcttgggcacctgtgccctccagctgccggccgctggtgctggcgtgaaccccgtcaccgagctgctccgagacctcaggatcaccaccacctaggaagggcaccatgtggatgggaagtcgtcgttgaagcatgcaaaacttcccatggaccagcgggcttgcaaaacctacgagccccttgcagggagagacgccaggtctcacctggcccaagggtcatggcggtgccatcattggcacccagagccttcagctcgtcctcgtcatcagaggccccacccgcagtgtacgctgtgccctgcgccatggactggggcatgtagaaagtactggccgtaacataaccctgcccggtctccatgcacccgcagtgggacgggccaccagggcagcgttctgcatcgctcacccttccactgcgtggggggagcaccgcgttcttgggtgatgggaggaggtctgccaggcgaccgctgcgtggtgcagctggagcaagctttgccggtgcttcctgtgtggcaagatgggcatacgcggtgggggtgggtgagctcagcggggtgccagcaatggcggcctacagcaggacatgatggacattctgtccaaattcacagacctgcatcttctccaggacgtctggagtcactccaccaaagtctatggggacgccaaagcgggccttgggaagtttgtgctgacgcttgggtggcgccacgccagagaagagggggacctggcgccagggaacggccaatcagggtgaagcaggtctaggaggcacattcgaagcacctggtccggtagtagacaagcacacctgggacgctttgggtgggggcagcctgaagctgggaccaggatgttcactctcgacggctggagcgcttgtgacgggtgctaattgtgccacgtgctcgggcgaggatggttcgcttccatcctcactcccgtagccggccaggaattccattagagccacccaggggtctcggtggtgtcgcccagcctggcgtttctctctgcgacaccgacacagcccacgaccacaggtctaccgatgcaatgttcctttatttttttgtggaatggacgatgttccgcgtaggacttgtaaagcttctgggacgtggatcgtcctgcaatgtcgcgcatggcgagggagacgatccgacgcgggagtagcctccatttcccctgctctggatttcatgagtactgtgaagcatccccggtaccagctccttagaatccctgtgcggccttctctacgcgatcatcagttttggccgtgtgcagctagacggtatatgccctccagtatccacattccttcccaaatcactctgcaggtctccagcgccaaattgctgcagccaaactgcgcctctgccaactgccatgtcctttaaacgttacatcactccacccgctcagtcaaacagggagaagcccatgtcctgcattgttcgaggagtagtagcattagatgtcattgccaggttggatatgcggaaactgctctctgcagccagtgtgaacaacaaactctcccaaagacttcacagcacccctcagagcattgcatcgccactcaccgcatcctcctcctcagactcctccttcttggcctcctccttgggtgcctcggccgcagccgcaccagcggacgcgccaccggcagagggggcagcgccaccagcggggacggaggccagcttggacagaccagatgcgacgatctgcaggacgatgtttggggagatggtggagcatttgcaagcccgccagcaaccaacactcgaccctgctccctgcccgaagctaaatccatcatgctgccgctgctcatgaactgacctcgttgatgtccttgccgtcaacctccttcagcagagtagcgacacgctcgctgtcggcctcgatcccaactgcgaggaggtcggggaaagggggggtgggggctcgtcgtcgacacgtcgacgagacaaggagcagatgcgccgacttccctcaacatacagcatcatggtacagccggatttcaggagttcctcaccagaggacaggatcttggagatgtcctcagcggagggggtggcgttgccgcccagggcagccaggaggtaagcagcgacgaccttcaccattgtgtttgtgccgagttgacctgcaaggatatttaagggctatggacccaccagacaggctcaacaccggatgcgaaaggggaggagtcgggctgggggcgggagggacatagcactcgccacacgggaggcggcccttcctgggtctgcctgatgttttggcgggaaacatctgtcggcaaagctctctcccgaacaagcacgccattcgaactgtgcacaaacaggtgtcgcttctctggggacgaagactttctcccactcccaaaaggatatcaagtgctgtacttgacactgtcgagcgctgttgagcgaggagtcgagtgccggacactatcaggacgctgggctcagagacagcatgcgccatctggcttgagcacagcccaaccgcactcgtagcgcaaaatgggaaaagaaacggccttgggagtaagttgatgtggagtagtagagctatgctgggcctgagagcgctctgatcccgactcacatccactctgtcctcaccaaccaggccgaggtaccctcccctcctccgtcctcaaagtttgcttctgcagactccattgccagcagcatcctatacctaaaatctgtcctagcgagtacgtgagtgggcgggtcttccccatgggcatctgttctgcttgcagtgcttagacgcccttcttttgccgccgacccgtacaggtcaaggatttgggcacgagctcaaccttctttccaccgatcccgacgatgtggcggccacctgcaacatcatttacgggctgatggcccagcagcagagggatcacaccttccgagagcatctgaaacaaggtgatgttttctatcgggagaggacaaggaggagatggagtcggaactgcacactcgtgtgtgctgtgaggtctggagcgcatcatggcttaacggtacctatactgagcagccatgcaccgagaaccacgccccttctgctcctggtagaggtgttcaaggcgcgatcccaactcactcaagccgagaaggagaaggcgcggctggagatgcgtatggccgccaaggaacgggaggtcttcgcgctggctggcaaggtgggggtggtgaggacctgagtgcaacgaatacttgcaagggccatgcatggcctgaaggtgatggtggggatgtcctccagagtggacaccctgcaccaaagtactgattcccggcgtcctagatgccccattggcccttgcatgacctcaccctggccccatgcacacaaccagcaactggcggatggggaggggctgagggctgacctgcgagccgccaagcagggcgccgaggatgccgggcgcaagctggtgggagccgagcgacgggtcgtgcagctgcagcacgaatccaagcggaaggagctggagtacgaacgactccaggaaaagtgggtggaaagcggatgacatctgcgagagggggggggggggggggcgaggggggggggnnnnnnnnnnnnnnnnnnnnnnnnnnnnngggagggtggcggccagagctggcggcacccaggtgcaccccagccgcagcctgttccttgccagcagtcgccctttggtgaagatgccgccccaccccagcctgatcccccatcgccccacgtgccaggctgtctcacatcctggcggacaagaggaagagcgagaaggcggtgctggacatggcgggcaaggtcacccagcagctggggatcggtcccgtgggcgccggccgggtggtcaagtccgacgaagggctcaaggtgtgtgacgagggtggaggggcgtcagacatcggcagccctgtgttctagtcaaacatcgcaagcagggcaatctcgcagaacagggcgagagggcatcactgcaagctgcagtctccgtccagcggtgttgctggaccacatcgctcaccttcacctcacgccgtctccttccgtgcaagcctcgccgaagcctccccctcccctgcaccacacaggcgctcatagcggctcacgaacagaagcaggcagcactggaaaaggagaataagaatgtcaagtcagcgctgctgtccctccaggtccgtgtcgcctgatttcaaccatctggccggcatgcagttcctgatcttttgccagggcggggtggggtttcacccctgctggaacagaagggaatgcgccggccccagacgtgcgcaacttgactggcacggagtgcagcgcatgcgacgacccggcacccgagcgcgtgggcccctcccctccacccgtcgagcaagccgcccaccccgtcctgacgcaggcggagtacaaggagctcgtgaactcccgacagcgccaggccgctgcagatgccgcggtctcctctggcgccgtgtccaacgagttcatcgcatgtgagctgggtttgagggattgagctgtcgaagcttggaggtttggggtggcgtgtacgccctctgcacgcatctccgagagcaggcaggcaatcgggtctgtggctgcctcggagctgatgccgtgactggttgtcaaggcacccatccctcatcatcactttttcctcacaccacatcccccatcccacccaaccccgcctcgcccgcccagccatgccgagcatggacctggaggccctgtgcgacgaggtctcgcagcgccagtccctgctccagcgccgcctgcacggagcggcggggggcggtgacgagccggccctgctgcgaggggtggtctgcgaccagagggccctgctgacgggcatgctggcggccgtcaggtcctccagaatggtgaggcacgcgcggtcggggagggcaccctcggcggtgtgtggtcttccgcgtgcgtgcccgcccagcgccgagcgtgcgctcagcatgcccagcgccccgctgcccaccacgcaggcgcaggaggcgctgcaccaggccgacatgcgccggctggtgcacgaccaccagacgcagcttgcggccgccaagacggagtgggagcgggcccgtgtggacaaggtgggtcaggggacgggggtggtgctgggatcgaagaacggaggatcggcacgctcatgcgtatgcctcggcgacatgtcttgactggagtgaggttgggaacaacaccatgccttgcaaccgatggctgctcccctgaagacatccggtaggaacgccaaccccggacccccccatcgaaccctgcaggaggggagcgtggagggggagctgagcacgctgcgggcccgggccacggcccaggaggcggagcggcaggaggcggaggcggccgcggaggcccgggcctccgacctcctcgcccaggtgcgggcggcgcaggcggccctggaggccgcggaggcgcgggaccgcgcccaggcccgggagctggaggaggtgcgggggcgatcggtcgccgccagccaagcagcggccgaggccgagatcgcggctgcggcgcgggaggctgcgctccgcgaccagctggcggggctggccgcggcgctcgccg

SEQ ID NO: 25191 - DNA, 67 bp, Chlorella protothecoides
cggccagaagcttgtgcaaattagccagcaggtggcccggtcccccagcgctcatgccgtgcgcctg

SEQ ID NO: 25192 - DNA, 144 bp, Chlorella protothecoides
actaagagtggtgccaagcacccgtgagcgcagaacctaaggaactccctcatcgacaagactcatagctcaaacccccacgccagccctattgacccccgcggccgctgccgacgcgcctgaaggtggcgccaggctccgtga

SEQ ID NO: 25193 - DNA, 74 bp, Chlorella protothecoides
agggctgggagatgggctgggactgggactaggaccgggagacagactgagactgggactagggcttggactcg

SEQ ID NO: 25194 - DNA, 73 bp, Chlorella protothecoides
gtggaccctgctcattgccctgcggatggtggagaagcgtccgtggatcagcaccgatctgcttgcatgccat

SEQ ID NO: 25195 - DNA, 111 bp, Chlorella protothecoides
ttggcggcggccaggctcagcgtgttggccaccaccaggtccagctcggagaggaaggcgtcgccccgcgtgcgcgcctcatacgccaggctggaggcgattgtgatggct

SEQ ID NO: 25196 - DNA, 79 bp, Chlorella protothecoides
cacgccggcggagctgtcgcgcctgatgcgcaagatgcggttccgccccggcgaggcgctgtcggcggaggcgctgtgc

SEQ ID NO: 25197 - DNA, 160 bp, Chlorella protothecoides
gtggagctgaacacgccgccggtgatgccggagtcatacctggtgagtatgttgtgtttgtggtggggttgggggaggttctggggaaagggattgtgtgtaggtgtgtagagtgcacaaggtggcgcgggcagtactgcaactgagagagcgcctgtcc

SEQ ID NO: 25198 - DNA, 61 bp, Chlorella protothecoides
gcccacgcgcgtcgcgcgcacgcgcagcgtcccgcgcaggttcaggctgccgcccaccacg

SEQ ID NO: 25199 - DNA, 62 bp, Chlorella protothecoides
atgctcctccttgttggtccaatgcattcgctcatgtagtgatgcctgggcacggagccagc

SEQ ID NO: 25200 - DNA, 64 bp, Chlorella protothecoides
cccttgtatcagaccaggcttgcacagagctctgcgagctgcatgactgcaggccaggaccccc

SEQ ID NO: 25201 - DNA, 61 bp, Chlorella protothecoides
ggcgcactgtatgccctcccactgacgcccatgtcgccgtcttacaatcggctcttctcac

SEQ ID NO: 25202 - DNA, 719 bp, Chlorella protothecoides
  modified_base (418)..(493): a, c, t, g, unknown or other
actttcatggcacacgatccatcattatactcatctccaggatgattcttcctcatttttatacaatggcgccttcggttgtatcagcgcgagttccgactccctgtgatcaagagcatgattcacaagcagactagcgacacaggcatgtatgaagagcctaaggttccccattttgggtagagatcagaaaattgatattttcgaacaggctgagtggtgagagagtaatttaaggagcaggataatgtaggacaggctcacaacgcatattaataatgctctttcggataacctcgatggggaaggagctcgtacattgccatggcacacctgcgtcggttattcccgctgtgtgtttccacaaatcgaggattcttctagatttggcgattccttttatatttttgaggactcnnnnnnnnnnnnnnnnnnnnnnnnnnnnnnnnnnnnnnnnnnnnnnnnnnnnnnnnnnnnnnnnnnnnnnnnnnnnagctggtatgcacgtcggtgaacatcagcagcaaagacacataagctcgagaatgctgaaacacgctgaggcctattggcttcaatacgtttcaagaggaatttggaaatagtttctggaaacttacgcatatgatagcagcagtcccatgtccgccgttttctgggatttcatactctggtccactcggattacgatcggatgtggatttccctagctgctcaga

SEQ ID NO: 25203 - DNA, 61 bp, Chlorella protothecoides
tatccagggccccgggggggccccccgcattatgcccccccggtcctgggcccaccagttg

SEQ ID NO: 25204 - DNA, 96 bp, Chlorella protothecoides
caacccacaagacagccagcacagaggtgcgcctgtcgcgggttgcgtggatcgtccccaccttgtgacggggcctggcctggcacagggacgaga

SEQ ID NO: 25205 - DNA, 70 bp, Chlorella protothecoides
ggcctcccacctccgcgcccccgtcaacattgacctgatcgggcagggggccagcgggaagctggcagag

SEQ ID NO: 25206 - DNA, 127 bp, Chlorella protothecoides
cgcgctgagagctttgggcgagtattcttggtctgatcccatcgatcgctgcatgcagacttttggtgcttatgggtcggacgaagtgcatgagtgggtcgagctgcatggcgttgtttccctctcc

SEQ ID NO: 25207 - DNA, 77 bp, Chlorella protothecoides
gatcatcagagcacctgtcaggcatgcttggagtgcagggtgcccacccgccaaacctgtgtcgggcattgcgcaca

SEQ ID NO: 25208 - DNA, 206 bp, Chlorella protothecoides
ggaagagtatattgtatattatgcttacaatggaatgagacaagcatccagctgttatgacacagggaatattgagaggaaaaactgccggtgacgagcgggggcatgcactgttgagggcacagaaggcgaagtctccttgcagtgaccctgtcatcagcaccccagaagaactccagtgccttggagtacaaagggtgcactgc

SEQ ID NO: 25209 - DNA, 61 bp, Chlorella protothecoides
ccactccacctacaaaactgcaagcatgagtagtacaggaagcagtaatgacgagtgcggc

SEQ ID NO: 25210 - DNA, 122 bp, Chlorella protothecoides
atctctttcatagtatgcggatggtccatcgatgcacactcgtttacaaggtcccttcaccgccatgcacagacccaaaaatgggcaagtgaacagcatttaaatggcatgtgagtccttca

SEQ ID NO: 25211 - DNA, 61 bp, Chlorella protothecoides
gagggtgccccacaacaccatggtgcatcccgactgtcactcctcctccacaaacttgttc

SEQ ID NO: 25212 - DNA, 135 bp, Chlorella protothecoides
tgccctccctggtggaggccgggaggtgaggagttcagggtggtgctgtgcagtggggtttcatgggtactcaccccgcatccacggtccttgcatgacgggcgtagtggcgaagcccggtcaggttttccgagg

SEQ ID NO: 25213 - DNA, 61 bp, Chlorella protothecoides
tggccgacacctctgtcggcccccaccccccccgccactgagggattttgtggggggggtg

SEQ ID NO: 25214 - DNA, 97 bp, Chlorella protothecoides
ccccctcaagaccccacgtccttgccgtcatcatccgctgccctctcattcatgccaagcaggggacagccaggccctgcccggctacgtctccgtc

SEQ ID NO: 25215 - DNA, 88 bp, Chlorella protothecoides
cagtgaggggcattgccggactttccccaaccccttcaaggaaactcctcttccagggcccccctccccgatcactacccatgcagag

SEQ ID NO: 25216 - DNA, 126 bp, Chlorella protothecoides
gtacattatatgcatgcactcggtcagaatcttggtacacaagatccatcttatcagtcagccaacaatctctgtctcctctatcccgttgaccctgtggcaaactgagccgtatcgtcacggaca

SEQ ID NO: 25217 - DNA, 97 bp, Chlorella protothecoides
gatgtgaaacgatcctgatggcgctagtaaggtggagatcggctcccaacctaccagggatgagctcgcggtggtcgacctcgccgcaaggaggggg

SEQ ID NO: 25218 - DNA, 61 bp, Chlorella protothecoides
cgccgtgcccgccgcacgcgaccccagcgttgcgctgccggccgtgctggaggccctgcag

SEQ ID NO: 25219 - DNA, 78 bp, Chlorella protothecoides
atactgtgtgtaagctctgcaaaagacaaatatgggcattctttttggaaatatgaatctcacatctacttgtgaggg

SEQ ID NO: 25220 - DNA, 259 bp, Chlorella protothecoides
aactgtgagtgaagtggtctgtgacggggagtgcccagtgcggcgagagacgcggggacgggcactgctgcggcgctgcgccgcagagaaagggcaagggcagggcacttgttttcaacgcctgggatctgatgatcgaggtgtggggtccgatggcacggtatgggacccctgttccggggtacctctgctcacccgctcactcgcatgttgccaccccaactgcacacatgccgcgcagacccctaccccagcggat

SEQ ID NO: 25221 - DNA, 640 bp, Chlorella protothecoides
  modified_base (308)..(317): a, c, t, g, unknown or other
cccccctccccccctcctctccaccacccacttgcaccccgtgatggcaatcgtccccgggagctggggcgtgccctccagctggatgcggaccggcttggtggcaggcgggatgttcagagacaccggcttgttgcgccacgccgactgcagaggccaggggtgggttgatttgagagggggtggaggcgggttgacggccccacactcgccgagcaggcgccgatcacggggatccagccagggcagtaataccctgttgcagcctgtttccttcgacttcctacccagaaaactcccccccaacnnnnnnnnnnggaggccaggggtgggttgattgagagggggtggaggcgggttgacggccacacactcaccgagcaggcgccgatcacgaggatccagccagggcagtaataccccgttgtagcctgtttccttttgacttcctacccagaaaactcccccccaaccccccgaaacacacccaccgtgggctgggcagcgggggacacggggcgcgcgtcgtgggtgcccaggtactcgacctcgagcaccatcctgtcgatgcgcaggctgacggcggaggggttggacacctccacctccaccgccgcgggctcgcccaccacccactcca

SEQ ID NO: 25222 - DNA, 87 bp, Chlorella protothecoides
ctctgaattgcatgccaagtgagagcacaatggtcattactgccccgagaacgtcatgcccgtctgcactccctggcggcacagccc

SEQ ID NO: 25223 - DNA, 175 bp, Chlorella protothecoides
agctcaaagagcggacggtgtagagcgtgcctgcgccgcccatcctgcctccctggctcgagtcccccgccctgtctttcagtgttcacccaacaagaaggctgtgggcatcacctaaatacacacattggtacaaagccttggggggagtggggcaaggcagccacacacaggg

SEQ ID NO: 25224 - DNA, 195 bp, Chlorella protothecoides
accaggggtgcaaagccatatatgtggttaccacagctttgaacaactacatctgttcaaggtggggtgacactctgtggtgaaaatgcatacggaggctgctctggtgccgtaacaagtttgcaaacagttatactaccaatacaccgttggatgggatacgggtgcgcaattcctccaggcgcatgcctcgag

SEQ ID NO: 25225 - DNA, 104 bp, Chlorella protothecoides
tgcccacaccaatggcctcggtacgattgttattacatacaagtgactgtgcaagggagggatcttgccctgctccgagcgcaagtgggcgcacggctgcaggc

SEQ ID NO: 25226 - DNA, 81 bp, Chlorella protothecoides
cccagcccctctcctccgcccagcccccctccctcgccacctacaccacctacacccagcccctctcctccgcccagcccc

SEQ ID NO: 25227 - DNA, 19074 bp, Chlorella protothecoides
  modified_base (449)..(458): a, c, t, g, unknown or other
  modified_base (692)..(701): a, c, t, g, unknown or other
  modified_base (1246)..(1255): a, c, t, g, unknown or other
  modified_base (3449)..(3458): a, c, t, g, unknown or other
  modified_base (3828)..(3837): a, c, t, g, unknown or other
  modified_base (5176)..(5185): a, c, t, g, unknown or other
  modified_base (5871)..(5880): a, c, t, g, unknown or other
  modified_base (6313)..(6322): a, c, t, g, unknown or other
  modified_base (7563)..(7604): a, c, t, g, unknown or other
  modified_base (9883)..(9892): a, c, t, g, unknown or other
  modified_base (13976)..(13985): a, c, t, g, unknown or other
  modified_base (14161)..(14170): a, c, t, g, unknown or other
  modified_base (15104)..(15113): a, c, t, g, unknown or other
  modified_base (15715)..(15724): a, c, t, g, unknown or other
  modified_base (16542)..(16551): a, c, t, g, unknown or other
  modified_base (17682)..(17691): a, c, t, g, unknown or other
tgtgcatggcagggtatactgctcttctcacttgcaggacaactcagatcagtgctgatatccatcaccctcagatactccaagcgcctacaagagaacttgatgcagttggctgcccttgcagactcccaagcagtccctgcttcacagcctccagtaactcagcaatctcagtaggggcgctgcaacctgggagtctcacaaccattccgggtctagtgggctcggaatcttcacttcaaccacactgtgagctaccaatctgaaggtgggcagcaattcttctcacacagatgaccagtggcatccaaggtgccatcaggcatggactgccaacgagacactggcatgtgcgcattatgcctgaggaaaggaagagagccctgctcagcttcaacgttgtacttttctgaaaatattggtgagatggtagttccctggcaaagcannnnnnnnnngtggactgccaacgagacactggcgtgtgcgcattatgcctgaggaaaggtagagagccctgctcagcttcagcgttgtacttttctgaaaatgttggtgagatggtagttccctggcaaagcattctggccctgtgcccatcacggtcgtttagtcggggggattccatcagagctggagaggggaaggggttcttgcttctagctgacactggtgccgtgcaaatatggcgnnnnnnnnnncattccatcagagctggagaggggaactggttcttgctttcagctgacactggtgccgtgcaaatatggcgatagcttttgaatctcgtgtgaagctgttcaccctgtccatgattttccttgtccgtctttcccccacccgtctgtttcactgacgtaccagctttggcaatccactcagggctcctccaactgaaatgcctctatatggcctgaaggcctttcgctgaccgttgatgacgtcaagtactttgtttatacttgcatgtaaattaagcttgggtgttgcttcgatatgctatggtccatccgtaagatgaaagcacacgaccattgcagattcaggtgggcgtgggtctggcagcagtacagtacacgatctccgagaaagatcctgcgactcgtacacgacaatcgcagagacgattcgaataaaaaataaaatgtctattggatgcactgtgaatatttgatgggctaagtaaagggaagcaaggccagatcattcagggggcggagaggatggcagcagccgtcgtgtcccnnnnnnnnnntaataaaaatgtctattggatgcactgtgaatatatgatgggctaagtaaagggaagcaaggctagatcattcaggggccggagaggatggcagcagccgtcgtgtccctgcagccacatcatgtcagtatagaagcatcatggtgtcattatatgtactgtgatgcgcttgatgggggttgagtgccgatgcatcgcaatacttgaatctcattccgcccccgattacctccggccatctccccaggccgagatcttgtttggcaaactgggcacccacagcaaatgcgctggcgctacgctccaggtacctccaagggggttgctggtgcagggtgggtgtcctctgtcctaaaatctccagcaaggggtccatactttctctgatgtcgattgtgcaacccattcacttagggtgttcccctcgtgcccctcctcaatgccagccgtcacacctacatcacgattccctcatgctgctgcagctgcgtgacagcttcctggccgaccatctgggcaggaaagtcctggtgcacgcccagacgcgcgccgtcgcggcctccgccatccaggtgatgctcttccagctgagccacaccgccaatgccgagacctcgctggaggcgagccagtggcagtacctcgataacaaggtgggtttcactgttggaggctcttggagggggcaagcacttgtgctctgtgcagccgcaaccagggaggctgatgcagggcatgcgtgttgcaggtcgggcaacgatgctctccaagaatgtgccgcacatcggcgagcccccgactctctctgttgatgattccccgtccccgctcaactgcagggcaggaagcacggtccctacccgctgtccaagatggtgatctgggccgggaagaaggcgttccccagcgagaccatgcccgtgcagcactcgggcctgcgctgctggatcccgctgtggaccctcagcatggttgcgggccaggctgcaggtgctgccgagtgtggagcgatggggtcctgggttcatacctcatcttgtcgccagcacccctgtgctttgcgatcgtgtgtaattatgtcctggaacccgctccgcaccctgaatgctcgactccattcaccacgcctcctccatcgcacccttgcaacccagaggcaggcgcatcggaggaggaggccatggactgggagtccatggccgccgagctgaagaaggagcgttcggcgggcgtgctgagcgccgccccggacgccggccgcctgctgcccgacttcccggagctggccgccgcggccgccggccccgagcccatggagctggaggaggccctgcccgtcacgctcgcggctggcggcggcgccaccgcccgcgcgctgatcgtggtggacaccaacgtgctcatctcacaccccgccaccctggagcgcctgctgcacgcgctggccgccgccgccgacccgccctcggctgcccgcgagtcgcggtcgctggaggtgcaggccctggtgccctggatcgtgctgaacgagctggaccggctcaagtccagccccgacgggggcaaggccgcggcggcggcacacgcgctgcagcgcctgcgcctgctgctcatgacccgggacgccggcatccggggccagacggcggccgagcacgccgccgtgagtgatgaggaggggtgggaggaggatgtcgtgcctgaaattgggagggtgctggtcgatggggccagagagggtgcgggggggcaaggcgtggcaggtgctgcggaagtggcagcacagcatgctcgcaaaaggtacacgagcagacaactggcgctcgcagtcacagcaaagcactgtatgccctcacacatgccaaccggcgatcccagcgccttcagcatccccacctcctgactgtcccaggccatggcggctgcgggggaggcgggggccggcgcaaaggacagcatcagcaacgacaccgccatcatccagagctgcctgtactatgcatcccagctgtcgttggtgagactgatggggctctggcggcgctatggcctgaatgtgcgtgccttcgggactgaagaggcatgcagggctcgtgcacacaggcatggcgtcgatcccggtggttgtgacttttggggtgccacatttgtgggtccattggtcttgcaggggctctcggtatccccttccttnnnnnnnnnnacagggcttgtgcacacaggcatggcgtcgatccgggtggttgtgacttctggggtgccacatttgtgggtccattggccttgcaggggctctcggtatccccttccttccccactgacctccctcccaccccaaaccctcccctctgtgcgccctgccagagttgccaggagaacgctcgggtcttgctgctgagcaatgatgtgggcctgggggtgcgtgcaggcgtcagtggcgtcctctgcttcaccgcaacacgcttcccgcggagtcggcatgctctactccaggtatgggaggggcagcaatcgaggtggtgccggggacccctggggaaaatggcctccaagtatccctcgcggcagcctgnnnnnnnnnnagctctactccaggtatggagggggcagcaatcgaggtggtgtcggggacccctggggaaggtggcctccaagtatccctcgcggcagcctgccactcgtaccgtgagaggggcgtggagggccaccgtcaaaatccatcaggtcgaccctccaacagaccgccaacgatggcccagcgacgccacaggcacagcccctgggcttcactcactccctgtgctgctcgtgaccccgtgcaacgatgacaccacaggtactcgacgggcatggcccgccggcccccgctgccgaggcgctcgagcaggaaagggagaagctggcgcgcctgcagcggcagggggagagggagcggggcatgcagttcgatgccgccccgcccccgcagcggcaaggtgcgccgtcgctggcgagccacgagtccacgctgtcctcccgagcgctggagtcggcgcacgcccgggcgctgcgcgagcagcaggagctgagtctgcggctgaccatgcaggccgtgcagcagcagcgtctgccgccagggccccggcaccacagcgtgggaccggcgcctctggcagcggggccggggacggccccgtttttcctcggcggggcgcccgcgcccacgcaccacggcccccccgccccgatctccctgggctgggaggcgctgcgcgggtccgcgggcttcagctgggcggacgacgacgagtcgccgtcgggcgcggcggccagcgccgcgcagcatgggttagggggccacgcctccctgttgtcgcagcaggcgcaggcgctggcgcacgcagaggggcttcgccgcgccggccagccgccgccggccgccgccgtcgaggcgcagaagcaggcgcagctgaggcagctcaacatgctgctgcaggcgatgcatcgggagcgcatcggtggcgaggcgacccccgcagcccctgtgcaggcttcatcagtggggctggggcgcgacggagccagtggccaccatggtttggtcgcaggaggtgtgaggccgcaggatgcacccgcgcagattcccggcagggcgcccgcaatgctccctccggcacatgaagtcagatccgagtccctggccgacatggtctgcgagatggaggcggcggtggttgagaacctccagcctgccgtccagcactatcgccagctggtgggacgatggggtgccgggcatgggggttgcggagtgggtttggtgccagcttagatttggcgaatgccacagcatcagacacctgtttcaacgtgccttgacgccagatgagcaggtgctgcctcacctctcacctcacctctccagcaatgactaacgttgtnnnnnnnnnnttgtttcaacgtgccttgacgccggatgagcaggtgctgccacacctctcccctcacctctccagcaatgactaacgttgtcaccaaaccccttcaggatgtgggcgacctgtggctggagacactgaaggaggaggatcggccgccctgggatgccagcagcaccctgcgcatcctttcctcccacaggtcgacctactggtgcgtaggcccacgtcgagagctgcgaagtgaaaggggggggcttgttgataccgttcagtacccggcaatgtgggctaccctgcagctccagcctccacgggatgttgtgcggccatcccatcgccaccccatgctccctgtccgcaccgcccaggcacatcatcccgcgagcacttgaggccgaggtgaagtcactggagcgcttcttcggtgctcgggccgggggcagagccctttcgctgcacgcgctcgccagcaatgcgagcagcctgctggacctcctcatggctttctccaccgccaagccctcctcaggtgggcagcagtcgatcggtatggcgcggcctggttgtgatgcatgcccgcacgcttggacctccaacaggaacacactgattgtggccctatcttgtttgcggggagtataacgcaagaggctgccccaccccaaccaagcagacccgccgacctcggaccccagnnnnnnnnnntgcacgcttggacctccaacaggaatacactgattgtggccctttcttgtttgcggggaatataacgcaagaggctgccccaccccacccaagcagacccgccgacctcggaccccagcgacatcccagactacatcagcatcgaccaggcgagctccgccctgcatgccggagtccagcggatcaagggccttcttgacactctgccccccgcctgagtgcgccgccgtgccagcagcttggcacctcgacgacgagacactgtttccgggattctggttcctgatgcatgagagcagagcgtgtgatgaggctcagaccgtacagtcggcaggatgagggagatgtgagggtaacaacagacggctccacgcggcattgtggtggggcagcagcaaaggtgccggctgcattcggcggcgcccgccagtgnnnnnnnnnngcagacggctccacgcagcattgtggtggggcagcagcgaacgtgccggctgcattcggcgccgcctgccagtgcctcacacattggcgggcttgaacaggttgaagccatcggcggccgtggtgaccatgaggcccgggatctgggcgtgccagtgcccctccttcacgtctcgctgcccggcatgcacgaagagcagctgcggtggcagctcgtcgggcaccgcggcgttcgtctccggtgccagcgccgcctcctcctccgggtcccgctccagggccagatcccacaccgcggtctggccgtcctcgccggtggagagcagcatggaggactcgtgcggcgaccactccagggatgtgatgggcgcgctgtacagggggccggagagtgaggttgcgaggggggagaggtggaccagggcttgcttggaagactgatggtcatgaggtgcatgccgcctgagctgcagcatgggactgggcagcacagagcgccgcacgactggactggtgctcaaggccccctcctacgagagggcctgcaggctgacagtgctgctctgcaccgcctgcaaaccccgctctcaacacctctgctgcacgtccccgcgcccttccccctcacctgtggtacttcagggacgcgacgtactgccccgaggcaaaggcgcgcaggtcccagacgcgcagcaggccgtcgtcgccgcccgaggccagcatgtaggccgtgctggcactccacgcggcgacgttgacctccgcctcgtgcgccgccaccgtcagcatcggcttcgtctgtgtgcagtgtttgtgggtggagcaatgggtgggaggggggggtggaggggttcctgcaggagggccgcaaggtgcaaactgccaaaagctggcccagcgactgccatatagcagtctaccggcctaaccctccaggtaccagcccacacccaccttgccccagggcccctcccattcctccattccccactctcaaggggcccccccttccaaaagtaccttctcccgcgtgtcccagatacgcagcgtctggtccgcccccgcgctggcaaacacggtgtcctcggtgggcgaccactgcaggtcctccaccggtccctggtgccctcggtacgccgcgcccaccgcccacttccccgccggcgcgggctcccagacgtggatggcagcgcggcggtcgcccgcggccaggcgccccgccgccaggcgcgaccagtccannnnnnnnnnnnnnnnnnnnnnnnnnnnnnnnnnnnnnnnnngaccaatccagcgcgtacccctcggcgcccgtgccgtgcacgctgcgcggcgcgatgcgcgccaggcgctccgaccgcgacgcgtcgggcgagggctcggcgcgcgcctctgccagcggcgcgcccaggtcccacacgcccacgctcccggcctcggaccaggccgccaccagggcgggggactggggcatggcgcgcacgcggttgaccgcgccggcgtgcgccacgcgccggatgtgcagcacgggcgcggaggcggatgaccccgggccgggggcggggcggccgtcggcgtcctcgtcctcggagctggagctgtccgagtcggagtcgtccaacgggtcctacaggcattgaggttcatttgggggggtggaggggcgtcgtgagtggaaaggaaaggggggttggatgcgctcggagggggcgagggtggggcggtcgatgcaccaggaggcaaggagcgccggaggcgcgggagttcaggcggcccacggatgagcaaggcggccggccggccgccctcggggtccagcgcagcgcaccttgccgtggcgcagggcggtgaggttggtcacgcagcacactgacaggctgttcaggcgggcggagggcgcctggctccccgccacaaaggacagcgtgtgggggaaggcggtgcgctggtcgcccagcgcgtcgggaagcatgtcgaagctgaggcagggccagcccaggctcagcgtggtcaggcaggtgtaggcggtggggtcgtagtccagcccctcctcgtcaggctcggcgccgggcacgccgggcatccatacctggagtgagcatgggtgggtgggcaggggttggggacaggatggtgagggaagccggtccattccccggccagagtcccagccacagaactcgtatgagaatcaaatgctctcccccatgcatacctcgggctttgtggggacggcgggaccggccgaggcctgcgtggggcggggagcagggcgatgaacgctggcagggcacgctgcacaccatggcatgcatgaagggcccccgcctccatccaccttggcggatgcagacttcttcttcccctttttactggacttcttcgtcctcatgccgcctagtcgacgcccagcgaggggccagaggctggggaggcggtgtccgcgcggtgcagaggggccagggggcaactgcgagcgagcgggtcgtggcgagtaggatggcgaaacacccttttggcaacgtttcaagcgtgtctggtatgctcgagctggtcaagagtgccatgcacgggcgtatcgggtgccctcctcttgactctcgcgcgcgcacctcagggcgcgccgattgctggggatgagtggggggtggggctgcccagccttctggcctcatgttgcggtgcagcagcgcgagcgtccggccttccagtctccaacgattggcacaatgtcgaaattaaatagactcaaagtacatgaacgcaccgcaggcggcgattgttgacgaatggcagccgcgccgtgcagcaaggtgtcgtacaacccacaccacctccacggtgggtcagtccacccgcttccactccacgtcgatggtcgccggcggcaccgagctgtcatccaggcgcacgatctttcccgagctcagccgcacggtgagctccagtggcccagcctggtcccgaggcccctcccccagctcgcgctcggcgagcgcctcgcccacgatgcgccccccggtatccgccacgggcatggtgaggatgatcctctggcgccgcacgccgttgatgctggtgctggtggaggcctggctgatggggcccagcagggtggccgggccgcccaacaggcgccgcagctcggcgctggactgcaccaggcgcgcgctgcgttcctgcgtggcggctgcagcctccgaggcctgcgccatctgctccgccaccgaggagagggcggagctgactagcccccccagcatcctgcccatgatgctgccgccaaatagctgcctccccatgtctggagcgtgagggtgagggttggatggtgtggttatgtggggttgtgggtgggtgagtgaggccaagcagcacgtcgcagatcaaaagagaggatctcacaaacagagtggcccacagcttcctcaattagggtcccttgctaattcgattccataagacagtagtatgccccaccaaagccctctctgtggcatcgaagcagcgtgccgggcacacagtcccttcgtgccaaagtcacctgaaggatctggtctcnnnnnnnnnnttcaatcagggtcccttgctaattcgcttccataacacaatagtatgccccaccaaagcccgctctgtggcatcgaagcagcgtgccaggcacacagtcccttggtgccaaagtcacctgaaggatctggtctccccggggtctgcctctctgatcggtcatgcgatcccggcaggagactcgaggctgccttcttgagggtattgcccaccttggaggccgtgtctgtgacgagtgacactcctgcttgagcgatctcggcccagcttggctcggttcccctgccagcataacaccggctggcgtggaagagcatgccatgtcgatgatgctggatccttgccggatagacacggggcagctccctctgggagtaaacggtagatgtacttatttgagtattggacatgctggcgcatggtcgtgcatgccaggaccccccctcccatccctctccgcagcaccttccagataccgagggcgacatctgtgcgcaggcctcgcagcgcggcattcatctgggtgctcagacctgaaacttttgtgtacaatctcaggctacttccccgtaggctgctggtcgctcaactccagtgccttgcatactccgaaaggccactccggatctcatacacgcagcattcaggcgcaacacccccagcaccgagatattgtgcatgcgccgatctgggcggaaagacatccgccccacatcgcgactcagcgaaagcaaatctgcaatgtaatgaaattgggataggaagggtgagacgtagttggctcgggaaccttgaagccggctcgagggactggaagctgcgctcccctcctcccgagcggatgtagccagcgagctcgcccagctccatggcagccctgctgggagtatcgttggccatactatctggaatttgtaatggcagctttgggtcgatgtccaagctgcgggtggttcgagacgcggaggtgcgcttcgtaggccggcctggggcgcgcgtgtctcccgtgtcgagggggttctcactcagtgcatgcacgccatcacacccaacatccgcgccacatcgaccgcagatcccgccccacgtccacgggcactggatggcggagggcgcgggcctcgcgggcctcctggtcctggccttgcccgtgcaccggaccttcaccccctggggcctgctgtccggcgccatgtttatggcctccaacgtagccacttttcccgccatcaaatccctgggcctggccgccgcctgcgctgtgtggagcgccaccgccgtcctcgcctccctggcctgggccctgctgggcgccggcgaccgcctgcgcagcccggccctggccgcggccgcggtgctgctgctcctggcgggcatgctcggggtgtgtgcggcgcaggcctccgtgccggtgctgcccgtgggcagcaggtgccacggcgacgaggaggcgggcgccgggccgccggcccaggagcccctcctcccccccggcgccgccgccagcgacgacgtggccgactgcaccaagtcggaggccagcctggggggccccgcagagcccgcagcgccgctcccccgcgccgccggcgcgctggccgccgtggccgcggggctggttggcgggctggtgctggcgcccatgtcgcacctaccccgcgtctgccagggcctggcctacatgcccagcatgggcatgggcgtgctgctggccgcccccctggtcaccctggcccgtacccgccccgccgacatgtttgtcaaggcgcagagccctgcggccatctggcccggggtggtggcggggacggtgtggggcgtgggcaacgccgccgcggctgccgcggccgccgacccgcgcgtgggactggccctggcctaccccatcatgcagggcctgggcatcgcggtggcggcggtgtggggcgtggtggcgttcggggagctgccggggcggggcccgcgccgggcgatggccgcggccgacgctgccatcgtggctggcgtcgtcctgctggtccgggccaagggggcggcgccctagccagggcggccgcccgatgatgtgcatacccactcccttccaaaataagtgcaccggcctggcatgcctcctgctggcccggctgtcccacccagtactcaagggctggcagtacagagcttgcaatggggaaaactcgggtccagcgggggagcggggagttgcattcatggcaccaagacaaataggcgccggcggggtgcggggagtcgttcgtacagctggagtggctcggcagcgcctcattcagcttcaaaaggagtcgtggccgcacgatgtgcgccagattgctccatcggcgagctcagcggctggtggccagctcgacgccccacctgcccaccatgccaatgagcgccagcaggccaaaggcgttgaaggctgcggcgggtggagctcgggtggagttgtgagtcccgtgggcttgatgcacacaggccaggatgcaggggcagagagcggaatgcacaccagcaccacaggccgccactggcttgggtgtgggagacacgccgcagaggccggcttcagtcgaggtgttcaagacactgttctccccacccaggtcacgcgcccctgcaggcctcacctccgcggcggcggttgtcggccttgcccgtgctgtagcccttgaagaagacgatgcggcccacgatgtacaccaggcccgccacggaggcggcaatggggtactgcagatgtgggagatgagatctacaggtggacaacgggccaaggagcaacagcatgcactgctgaacgacagaggacgtttcccctcgaccttgggatcaggttgctgccaccactcaccctggcgccagccacgatgagcagggtgttgaaggtggagatcatctccagcgtgttctggtgtgccctctgcgagatgagtgagtggagcattggcgaggtgagggcgccaggaggtctactatgcaggggcaagaaccaggagccttctcttgaacaaaggccaacccggagcctcgaattgcctaacccagcgcacacctggacacagttgaaggtcttggcgtcgggagtgtcctccttggcatacatggtggggtagcacaccttgtacttgcggcgtgccatgcccacctggatcgccatccacacattctgcgtgcgtaagttggaaatgagcagcgtcaatcagcaaagctggcattgatgaagcaattgaaaagccacagttctcgattgatgtatgggttttgtccacactttgggcacaagtcagagcacctgcacgaggacaccgccgaccaacgtgccgagcacgtaaccgtgctggggaacgagcgcgagtgacatgtttgacagtggggatctagatcttgctatgctccagggaatgtttgtgaaaatggtgtgatataaaatgtgttgaaagaccccaatggaaacatcttgaagggagccacgtcgcccactaattacaacgtacctctaacgtaataacaacgtaaattatcacgtggtcattactaattttttgcatccgtgagcttcgcctcgagctcagaagtgaaggggggaaatcgcattgaattgtaaatctgattacacgaaagcacctaatggatactgtggccgagatgaacgtccatggctgcacgctggatcttcatgtcgatgccgcggaggtggtgcagagggtggatggtctcctccgatggatgttggagaagattgcctcccaccagctccctgacataaatgtggtgcgcaggaagcggtgggagaatttgttcatgaatcgcatcgcccgagacttggcgcgttgttaactggccatgtgcaccttcatgaccgagatacttcatgcatgcagcacacatcctccaagaccttgactcggcgctcgctaattgggagccacccggagagtgcagagcactttgctcgcattttcgctgtgctgcgggaatgcaaagcggcgcttgtccagggtgagatggttgtgccatgggcgtatccaagggctgtgatcctgtgtcactggttttgctcgacatggtaatctgcattnnnnnnnnnnaatggtctcctccgatggattttggagaagattgcctcccacgagctccctgacataaatgtggtgtgcaggaagcggtgggagaatttgctcatgaatcgcatcgcccgagacttggcacattgttaactggccatgtgcaccgtcatgaccgagatacttcatgcatgcagcannnnnnnnnnctgggcggatccaagggctgtgatcctgtgtcgctggttttgctcgacatggtaatctgcattgcacatgtactgccgaagctgtccctcagccatccacaccccttgctgcaggggtacccgtcaatcagcgggaagtgtactacaggctcaaagcacaggaattggttcgctgccagcgagatgtgtcctgtagcttgctggactgcgtcagtctgctgaatgtgccccgcgacgccctgggcgtgctgtccagcggcaagggcctggtgtccgggagcatcactctgcacaccaggggtatgaggtgtcggtggtcaacgctggggggcccggagtacaaggcaactatgcaagctgactcagaaatgagtctgggcccgccatgctaaacaatccgacccaccgcctctccctggtctcaggtcgggaggtggactgcacccaagaggcatttgcactgccgggagatgtcgaagggctgcagcgctttgtgctgcagtccgcaggtgccgcttttgtcctcgtgattgagaaggaaaccgtgtttcaggtcaggcccaggattgctggtatgaacttttggccccctgccgtgccgcttcgagccaccctcctgcagcagtctgatatcttatgtattggtggcgcgctatacctcccctgtccttgaacgtcgcttaggactgtcgagttcctcccctccatccccgtgcaggccctcacccgagctcagctgtgggaagagtgtccatgcatcctggtcactgcgagagggatgccggaccttgccaccaggtgctcgggggctgtggggatctgaggacgaccatggtgtatgcggggatgcacagagtcctccacccggttccagcctgtcacgagatgcctggtgcatccaggattcctgcacgggagctctgtgcctgagccnnnnnnnnnnatcccagtctgtcacgagatgcctggtgcctccagcattcctgcacgggagctctgtgcctgagcctccaccctgcatatggccatgcatgtctgccaggctctgaggctctgtgatcagctgcagcgggccactggccctcaccttgcccctccgacagagccttcttgtcgcacgtgagcaagtcgttcccccgcctgccgcttttcggactggtggactggaacccggatgggttggccatcctgagcctgtgagattgtggtgtgcccctctttccaaccagcagaggcattggaggggctgtcttgtgtgaccaagctgtcctgcattgtggtgcagactgccgagtcctgtgattgatcccccaccccgccgtcctcttgttgtcaggtaccgctttggatctgccgccatggcgctcgaatccccccgcttcacgctccccgggctgcgctgggccggtgtacacgccagctggttgcagacagatgggcagcacatgcaggtgggccgggggggaagcgggctggcttgactgactcccccagggtgccgccaggggtgtagtgagggacattgtgccacattctggcaggacnnnnnnnnnncgggcagcacatgcaggtgggcctgggggaaagcgggctggcttgactgactcccacagcgtgccgccagggtgtagggagggacattgtgccacattctggcaggactgtggccggcttcagagaccagtggctcacaagcttgtcaccccttcccacttgccccaggcgctgacgcagcgcgaccttcgggtggcccaggggctgagggagcggctgaggggtcccgctcctcactgggccgccgagctggacgccatgctggccgcggggcgcaaggccgacattgaggcgctgcccggtgccctggcgccaacgctgctggaggcgctccggtgcgccatgtagaggtggctgagtgggagccgggcccacatccctgccggcagcgcgccgctgtcgccctggtcatgcagcaggtgtacaaatctttgtgtggccgtcccaaggcccagcgggcctgggagtgtggtgcggcgggggatcagcacatgcgatcgccttgtgcggggtggaggtgggtccacgcctttggtcggcctgttccactgccagctggcgccgatccacagcagccggcgcctgcgtgccgggcgggatgggggcctgtgaaccccccagccaaggagattgacggaccgagggggtcgcagggcgtggccaggtgaacgcagacccacctcctccctcatgtcaacccccgcaccgcacatttctgagagggacccctgcggcctgccgcagattcctctcgtcgaaaagatctgtgcagcgactctcccgcccacgcgctcggcacacctgccgagcaccggctnnnnnnnnnnctgggagcctgtgaaccccccagccatgaagattgacaaaccgaggggtccgcagggcgcggccaggtgaacgcagacccacctcctccctcgcatcacaccccgcacctcacctttctcagaggaacccctgcggcttgccacagattcctctcgtcaaagagatctgcgcagcgactctcccgccctcgcgctcggcacacctgccgagcaccggctcagaagggcggccgctcctcggtgccgggccgttcttgcacgggatccaggcccaggggctggcgatcccggctgggggattctggcccttgtcctctaccatcgcccgcctttccctcagcgagagcttcaatttcaagactccgcccgccatggtgcacgtcgggagtgtgccgcctggcatcgccccccagcgccgccagcctgtcgcccaggcctgagtgccgcgtgccgacctcgcgccgctgcaccgccagctccagcggcgagggctcccccggcctgctcgcctggaccaccaccagcagcttcttggcgcgcgtcagggctgtgtttgaggcgggagggatgtgcgggggaaggtcccgcccaggaagagtgtcaacctggggaatgcggccaggcatacagcgcagatcagcgaatcccaggacagccccccacacgctacgctcgctctaccgacgcccagcaaccctccaccatcgacccgcacccactccccagccccccccaccccccgatcgcacccgtgtacaccagccggcggtccagcatgcggccgtgccctggcgccagcaccagcaccacgcagggcgcctccccaccctgagctttgtgcaccgtgatggcgtaggccaggcccagcgcgcccgcctcggagccctgcgcggggtggaaagggcgggagggtgtgattgtgtgggggaagggggaagggggcccagtgcaccagtgccgaccaggtccagctacagccacgcctctatttccagtgctgggcccaaatccctcatccacgaccgcctacaaatgcgtatgcagcccatggcctgctcaagcaaaggaaaagccacccgacattaccatcctgaaaaaactcctgacctggtacgagcagacgccgtcggnnnnnnnnnnaacgttaccatcccgaaacaaatcctgacctggtacgagcagacgccgtcgggggcggggttggcacctgctcgagcggcaaacgacgccggtgcttccgccctctcggcggccgccgcctccaccaggtgaggaaactgcaccttgaccaccttgccggcggggtcccaggacaccaccttcgtggagggcatggcatgcgtgagtcggcgcaaggggccgtggtgccgcgcgccagcgcatgggtcggcagcaagggtcctgggacaggcacgctttgtcacgaagccccttgcatccccttccctcccccagcacaacaaccaaatccccctcaccttgccctggtcgccgttgaagacctcccggtcatagtcgttgaccagctgcatgacccggtcccccgggcgcaggccgtggctctgtgctgccccgctcctgccgccgacagcatcgggaccccccggattcagcaggccctgcagcacggggttgagcgcccccgtgccgaccggccccgcacgcatgggactgatgacctgcacgtcgcccgacgcccaggccggctcggagcggtcggcgccgcgccgcgtcagcgccgccacgacgtcgcgcgcagccgccaccaggtcccccgcccgcggcacgggcaggagcagggcagcggagccaccagcggcggcgatcacgtcccccggccgcgccagcgccggcaggcgcggcgccacgccggcctggaccgccagcgccgcgcccacgatggccgaggtggcggcctggcggaagacctggcgcaggtcggtcacggggaccaggcccgaggtgaggatgcagttgagcaccgtgccgggacctgcaggagtggttgggggaggtgtgagtgtggtggggggttaggtcaacaggacgctgatgggggatgggggttctgatgttcaaaagtgcacaaggtttgggtgagggtgagaattcgcagggccaagcgctgccgtggaccgaggccgtggccccgtggaatggcagggggggtgccagcccagaggtagacgccactgacaacctctttctccccacactcatcccctcccaccctacccacaccccacaccatcacctatgctgggcagctggtcgacgtcgcccaccagcaccagctggcaggtgggcggcagcgcctgcatcagcgccgcggccaggggcagactgagcatggaggcctcgtccaccagcacggcgtcggccgccagcggcttagccgcgcagtgctcgaacctgccgcgctcgcccaggtcgtcggcggggtcgcgcccggccccggggtcgccggccggcgcgcccacctcgcgcgctgcgctgcgctgcctgcgcggcacgtagcgcagc

SEQ ID NO: 25228 - DNA, 112 bp, Chlorella protothecoides
tggctcctgaccgtcatgaggaggtaggcgttgggaagggagtgcagaaagtggtgccaggtgccagccgcatgaagaaagaaggtatgttcctggcctctgcatctcagtg

SEQ ID NO: 25229 - DNA, 79 bp, Chlorella protothecoides
gatcaggaggggctctgttcagcttcgatgcatagtatttctgatggcacccagcgtatgccaaacgtctccagctcga

SEQ ID NO: 25230 - DNA, 91 bp, Chlorella protothecoides
gcatgatgccacaagccaataacctgccatgataacagcaagctgaggaatttgcgcacccgtgttcctggcatgcagggcttccagctgc

SEQ ID NO: 25231 - DNA, 108 bp, Chlorella protothecoides
gggaacaggccaggcagatgggctagatggggagggcttttgtggcacgactacctggacttggccaggacagatggaggaatagagcgcccgcatgggatccctgta

SEQ ID NO: 25232 - DNA, 61 bp, Chlorella protothecoides
ggatcgctgcgaatttgttcccaaaaacccactccatgcgcttccactccccgttttagcg

SEQ ID NO: 25233 - DNA, 170 bp, Chlorella protothecoides
gcgtcgtacgcccaagtagtggccgtcaagtatggacagggcagcacaaacgtcctgaccttgaactggtaaatctggtgcattgcttcccattgatggctttcaaacaatgctttctgaatggctttagggtgtgtagcccaatgaggactgcttgatggggacgctgg

SEQ ID NO: 25234 - DNA, 151 bp, Chlorella protothecoides
gaatacggcgggaaaccggaacctggcacgaaactggaccactaaagggtcagctgcctctctagggtgatcatgcggtacgctggatcttcgcaggggtatttcgaggtgttccacaattcacgggggtccggagacactgagcgacggc

SEQ ID NO: 25235 - DNA, 99 bp, Chlorella protothecoides
atcgtgctcatcctcaaagctcctggggggggggggaaagggtcatgatgatcatcgcatgggtcgctgcaagtccccatgtggagtgccaccagcagt

SEQ ID NO: 25236 - DNA, 61 bp, Chlorella protothecoides
gactgggtttgaaaccagatcctacgcaccatgtgggaatgagtgggtacatgacgaggag

SEQ ID NO: 25237 - DNA, 61 bp, Chlorella protothecoides
cctggaacctgctggaacctccaactcagtagactcggccatgggccccctcatcacacag

SEQ ID NO: 25238 - DNA, 116 bp, Chlorella protothecoides
cgttccctcttcccagggctggcgatgcatggaggcgaccggtataccaggacccttagtgcgtaaccgtcatgcccatccactcgaagcaccctgcccattccccgccttgcctg

SEQ ID NO: 25239 - DNA, 61 bp, Chlorella protothecoides
gatacttctccaagggtgatggcagcggtgacaccgtagcactcattgggcaatcccaggg

SEQ ID NO: 25240 - DNA, 61 bp, Chlorella protothecoides
tgccagcttggactcaaagcatgtcagacatatggcgaatgcctgcagggatgttgattct

SEQ ID NO: 25241 - DNA, 89 bp, Chlorella protothecoides
tcatgctccctgcacctggtgagctgcacctcctaccctgaccccccccctcaccagcgcagaggaccagcacatcgagtccgccatgc

SEQ ID NO: 25242 - DNA, 143 bp, Chlorella protothecoides
tacatggaaatggatcgtccttgtaataatttacaataaaggcaggtgcatgcagccgtctctgggtgcacctggctcattacgcgcgctgtcgaggggtgatggagagggccagatgaacaatttgcgctcaaattccatgc

SEQ ID NO: 25243 - DNA, 80 bp, Chlorella protothecoides
ccagggacggtgcacgtgccctaaaggacttggcaaggggactgttcctgagattgtgagcgactacggattgaagagtt

SEQ ID NO: 25244 - DNA, 76 bp, Chlorella protothecoides
ctgaatctgcatgtcaccccaaacctcctctgccctgctctttaaccttcatattccctctgcgctgctaccccct

SEQ ID NO: 25245 - DNA, 74 bp, Chlorella protothecoides
ggacatccccgagtcccaggggaggttctctggtccaatccgcatcacatcgcaaggaccccttccgtccaccc

SEQ ID NO: 25246 - DNA, 101 bp, Chlorella protothecoides
acctcgacatgtaggcaaatgaacgagtaacagccgatcggacattgtctggaaggtgtagcccatccttgtcatttgcctctcacccatgcagcgaggtt

SEQ ID NO: 25247 - DNA, 108 bp, Chlorella protothecoides
tgccaggcccgccaggaggaggctgccccccgagcagcagcccgggggatccaccctggacaggttcctgtctggaaattgatgagcgtgcccgctggcactgagtga

SEQ ID NO: 25248 - DNA, 79 bp, Chlorella protothecoides
cagaaggtcacatcgaccgggtcccccccccacgctcatatgtaattgagcgactactgctattacactgagtaaggac

SEQ ID NO: 25249 - DNA, 82 bp, Chlorella protothecoides
cgggcatattgtgcgcgactgcagcatcccacagagcagtaagcgtcgccaccagctgctcaaatcctcctgctggtcggtg

SEQ ID NO: 25250 - DNA, 103 bp, Chlorella protothecoides
ccccaaaatgtggcctagtaaccctaagggcccacaacggtggaccgctgaatatgacctgaagtaggaatggtacagacgagaccccgaacgcagtgtgttg

SEQ ID NO: 25251 - DNA, 61 bp, Chlorella protothecoides
gccagcggccccctggctgtgcaaacactgactgatctgcccaggggactgaggccacggc

SEQ ID NO: 25252 - DNA, 78 bp, Chlorella protothecoides
atcgaactcagggtgctcctgcgtgagatttgtggtgcagagagatgctgcgtggcctggtctctgcagacaatgcat

SEQ ID NO: 25253 - DNA, 160 bp, Chlorella protothecoides
gacggcgtcttctgggggtggcgcaggcaacgacagcgtcgacaatatgtagattgctcaggtctatctttccacgcccctcgacactctgtgtacaattcttctcaacactcgtgcttaaatcagtgtaatggcctgcactgtcccgcggtcttcatcc

SEQ ID NO: 25254 - DNA, 77 bp, Chlorella protothecoides
aggtaaggcaatgtcgggtgatggccgtgaacatttgctaatcttggcatgagctcgcttgcgcgtgcttgcagatt

SEQ ID NO: 25255 - DNA, 245 bp, Chlorella protothecoides
cgtccaagagaagaagcggcgcagtatattatggccataatccgacaggtgacaaggccgactatttatcgcgggtagattatgaagaggttgctgatgcatgtagctccattctcgcaggtggaagggcgcttggagcaggctgaagagaatagtctgctgctgagggcatttggtcaatacttggagtgccatcttttcccggtaagtagcacgtggcaggtattgcataaagcaaacgcgag

SEQ ID NO: 25256 - DNA, 131 bp, Chlorella protothecoides
gatggggatggggatggtgcaacctgccttcgcatgcctgtgtctggcaagtgccacaccccacgcatgcttcccatccatgtcacctgcaggacggtgacctctgaccaagcacaggagcggagcgtgtc

SEQ ID NO: 25257 - DNA, 61 bp, Chlorella protothecoides
cccacagcccctggagaggaccacctcttcgagaaagccgtcgctgcgtgtgaccgaggca

SEQ ID NO: 25258 - DNA, 202 bp, Chlorella protothecoides
cggcgacccatgcacccaggagaggagttagatagcatgtaccagaccaggcattcacctgcgagtgtgttggacgggggggtgggccagactggcaggcactgaggtgagggttcatgaggagtctcaatccaggatcttcaatcagacatagtgtgcccttctcccgtgtcgacgcacattctgggctgcagtggcattg

SEQ ID NO: 25259 - DNA, 156 bp, Chlorella protothecoides
ggttgagctgttcggtgcacaggatgcagattctaaaggggccagtgcatgcctgccctgaccgagcatgtattctgagtttgcagaggtcatggtgctgtacacactgcaccacattacgccaactaaatgcacctctctctcatcctgcgctcc

SEQ ID NO: 25260 - DNA, 129 bp, Chlorella protothecoides
aatcaaaactggcgcgatcgacacacacacatttgcaagcacccgacgcccaggagctcggatgcagtcgaagaatatcacccgcgcgctcgcgtattgtcctagaacagagactgcacagggatccgg

SEQ ID NO: 25261 - DNA, 78 bp, Chlorella protothecoides
gtgcagtaagtatcctcggcgtgtagcaagagagtataaattactgtctcccccaatcatcctcgaacgtgctcctca

SEQ ID NO: 25262 - DNA, 76 bp, Chlorella protothecoides
ccagccagaggtttgcaaccagctgctctacgacggcgagtattgccccacctcccagcctgagtggtccgccttc

SEQ ID NO: 25263 - DNA, 99 bp, Chlorella protothecoides
atctgcatctggctgtttcctaagcctcctgcttctgtaagcgacaaggatgtgagctgatggctcgacggtacaatctctgcatcatgagctctctct

SEQ ID NO: 25264 - DNA, 61 bp, Chlorella protothecoides
ggggggggggggggggggggggggtgaagagggtgaatgtgccagtacgggagttgtgtgc

SEQ ID NO: 25265 - DNA, 61 bp, Chlorella protothecoides
tatcggtgtgagccacaaggcaggagcacaaccgccgcaccggtgagcccatacagggctg

SEQ ID NO: 25266 - DNA, 4706 bp, Chlorella protothecoides
  modified_base (1716)..(1725): a, c, t, g, unknown or other
  modified_base (2234)..(2243): a, c, t, g, unknown or other
  modified_base (3359)..(3368): a, c, t, g, unknown or other
  modified_base (3707)..(3716): a, c, t, g, unknown or other
  modified_base (4174)..(4213): a, c, t, g, unknown or other
  modified_base (4551)..(4560): a, c, t, g, unknown or other
ccccccccccacacacacacacaccagtatggaagaagccgtcggcgtccatgtcctccttggttttcttctcgtccttgtagtagccctggaagagcatgggcccgcggatgcagacctcgcccttgggcggcgagtcctccgcgctgtagttcagctccttcacgctctccagccggaactcgttggcggagagggggggccccacggagtaggccaggcgcgggtcggggatcatgaggaaggaggcggcgcaggtctcggtcaggccgtagccctgcagcaccggggcaagcgccacgttggcaaagtcctccacctcaggcgacagcggcgcaccgccagagacgatgaaacgcacgcgcccgcccatggcctggcgcacgcggctgaagaccacctggtcgccgcccaaacccgccagcctgcagcggggttgaggaggtgggtgggggtgctgattggctcggagcgaatgattgtgtgtgtgcacgtgtgattcctttcgacaaacaatgggtgcggtgcggcgcggcgcacgaggcagggcaagtacagaggggtggcggctatgccgtgcgcagcatccctgtttcgcccccggcaccacccacactcctgctgctcagacctcacgcttcgcccctctctccctcacaccctgcgtctcacctcccactctccctcacaccctgcgactcttcccccactctccctcacacccagcgtctcttccccccctcgcttaaccccgggtttttgcccccccctcccctcccaaactccccctgccagccccacagcaaccacactcccccagccactcacccgtgggacagcccggtcttgaggagcaggcgcttggcggtgaaggcagcgttgaagagcacgcgcgacagggccggcccggcggcgaccttcttcctcacgccgtcggcgacgcgctccaggatgcgcggcacggcgatgaagagcgtgggccgcagctccttcaggtcatccatcagcgccttgacgtcgccctgccagtagccgatgctggcgccgcgcgacagcgcaaactcctccaccacgcggccgaagatgtgggccagggtgaggtaggacagcgtggagtcgtcatgcgtgacggggatgtgcccctggcgggtcaggttcaccacccccgcgatcaccgccgtcatgctggcctgggtgtgcaccacgcccttgggcgtgcccgtggtgccgctggtgtacatgatgcaggcgtggtgggagggggcgggcggatgcggcgccacgtccgacgccgacgcgccgtccaccagggcggcgaagccgtgcacctcgatgcccgcgtcgcgcaggggggcggcctccgagccgggctcgccgatcacgatcacatccctgaccagcttggagatgccattggccaccttggccagctgggacaccttcttctcctccaccacgatcgcgcgcacctctggcagtggacgttgatagtttggggtgaggggagggggggcagggttgtgtttggcctgggggggagtggggcggcgacgatggccgtggcagagggcggagcaaggtgcccacggggttgaggagggtggggacaggagtcggggccaaggcggcgtggatgagcgaccctcacatcttcgagcccccacaagctgcacccacccgcatggccgacaatgtactcgacggcggtgtcgcccnnnnnnnnnncctccggaccccacaagctgcacccacccgcatgaccgacaatgtactcgacggcggtgtcgcccaaggagtcgtagatggggactgcgggagggtggcattcatgtacttgggtgagatgggagacttcacaccaagaggaggtaaccaggttgatcaggaacaaaacacatccagtcagacacatcccaaccagactggctcccccttcccctcgagcgttgtgcgagaacgggcaccatgagatcccacccacctacgaccgcggagatgacatccacggccttcagggttagcatgtgctccacattgttggagctgtagatgcctagcttgtctgtggggtaagcaaagagaatgagcacgtgtgttctgatgacaacgagacgctcaagcacacccccaggctgtagccgccacgacgaatactcaagcaatcctggcatctcccaccactgactcaggaacattctcaccatggggctcgaaacccagcttctgcagggccnnnnnnnnnncgcccagcttgtctatggggtgggcaaagagaatgagcacgtgtgttctgatgacaatgagacgctcaagcacacccccaggctgtggccgccatgacgaactctcgagcaatcctagcatctcccaccactgactcaggaacaatctcaccttggggctcgaaacccagcttctgcagggccgccgcaaatgagtaggccttgtctgcaggcaggtgcatggagtgacaggtttcaggttgaccaggaaacctggttcagacttccaccactgtctggagggttggcaagcaaggaaattggcagtgtcagccaggcagaccctgaacagccacacaaaggccaccccacacaaagccacaagaattcctaccctgggtctccttgtacgtcagccacttgtaggggccacacttgccatccgagcccctggggcgccagcccagacacctatggtggggttcaggtgggagtgagcgtgtggcagtgccttggcgcataaacctgacggcagcgagtgcccaaaagctatgccgattgacgtgcccgattggggagcgtaagctcacagccaagccatgcgcgctggcccagctctggctgcaggcacctccagcaggcctctcccacgatggcccaagactcacttctgatcagcatgcttctcagcgctggccttgaagatctcgtacagggtagtagagccatctacagtggtggtaaacttctcggcggctgccacattccggtacacggccgagacagcgggcgtgtcaccctgctcgggtctgccgggggtgacctcgacggtgaggggcccgacgtgcttgagcgagctcatgacgctaccgctaggctacctgccagggatgaagcacgaactgatcaagcatggaattcagcggcagatctcgccaagactgcaagcgggggagcggtgtcacctcctcgcgactgtgcaaaaacacaccaaacccggggatctcacgtctccccattcgctgcgcgcccacctgtcaaatgcagactttaccaaaactaaggcttacaccaaggtgaacggaccgtgggcatggggttgagacgatcgaaaggcctccttcagcgcgtgtgtgnnnnnnnnnncccaagactgaaagcgcggaagcggtgtcacctccacgcgactttgcaaaaacacacgaaacccggggatcttacgtctccccattcgctgcgcgcccacctgtcgaatgcagaatttaccaaaactaagctttacaccaaggcgggcggaccgtgggcacggggttgagatgatcgaaaggcctccttcagcgcgtgtgtgcccctccttcctggcagatctccctgctgtgatgagctgtgtccgaaaccaagacacaggtgaaactccgaaaggtgcaattcttgtagaaacaataggcgatatagttcatggtaatgattctttttatgggcgtnnnnnnnnnncatccctgtagaaacaatagacgatatagtccatagtaatgattctttttatgggcgtaccgcaaggatgctgccactgatgctgggcatcgaaacctgtcggccggccggcgccacgagctgatgcactcgtgagggcggcagcgggtgggatggggactggaagcgtgaccgagccccatcacacaccttatctcttcgacccggatgcacagccgtcgacgaatccggtgctgtgcgaggttctgtcccacctccccgccacctcggcggcttttgggtatggttccggcgtcttccatcagccgggcctgtactccccaggcctcaccaaacccatgctggacttcatactggctgttccagaccctgtggaatggcacgcccgcaacctggcccggaatcgcgggcactactcctgcatagggagcctgggtgccagcacggcaagtctggcnnnnnnnnnnnnnnnnnnnnnnnnnnnnnnnnnnnnnnnngctctgcatcaagggctgtccaatcacaattcagcgcctgcactggcttccagtaccctcaatcagctcacatccccgccacactcctgcttctgtcctcacagatcagcagggcggcagaggggctgggcgcgggcgtctacttcaacaccctggtccccatcggcgaccaggtaaatggtgtgactgagtagtcaactgttatgtggagaacagagtacatgcccggaccccgtacattccagcgcaagtcgtttgcgatgttgtgcccctcctgcccctccatgacgattacttaatcctccctgcccactacagtccccccctgcccccccccnnnnnnnnnnatcaattgttatgtggagaacagagttcatgcccggaccccgtatattccagcgcaagccctttgcgatgttgtgcacatcctgcccctccatgacgattacttagtcctccccgcccactacagtccccccctgccccccaccgc

SEQ ID NO: 25267 - DNA, 71 bp, Chlorella protothecoides
aaggcccacagccactcgcacgcctcatcgcatggacaaaatctggtgccatgtcacggaggtagtagtcc

SEQ ID NO: 25268 - DNA, 142 bp, Chlorella protothecoides
ggatcatggacagtgagcatgagcgcgctgagggaccctcgagcgcgtcccaggtcgcaaatcacgtgtgcacttgatactctccggtcgacctcaagcacgttccgagtagatgcaggtgacagacctgtcacaccctgtc

SEQ ID NO: 25269 - DNA, 68 bp, Chlorella protothecoides
gcaaggacagcccagcagatcttctcgtgtcttggagctgctggaggcaggccgttctccccatgatg

SEQ ID NO: 25270 - DNA, 87 bp, Chlorella protothecoides
ctccccgactccaatctccaacccagacatgattggcaaaacaagcaagcggaaaacgcagcaccattttctactctcctcatctct

SEQ ID NO: 25271 - DNA, 66 bp, Chlorella protothecoides
gctgcggccgtatccacgggtacggggagtccgtatgggacatctcctcacatctcactgtaatcg

SEQ ID NO: 25272 - DNA, 71 bp, Chlorella protothecoides
gggagtgttgcgagggcggcaggtcctcctcgcggggctcacctgggtccctctctggggctggtgatggc

SEQ ID NO: 25273 - DNA, 68 bp, Chlorella protothecoides
cctgggtccctctctggggctggtgatggcgatgcttgtggtcaagcacgctccactgcgctcaaccc

SEQ ID NO: 25274 - DNA, 113 bp, Chlorella protothecoides
gggggtgggtgggagcagcctggaggagttctaattccaatgcagatcgatcatatactcagaaagacacaaggagctgcgcaatggttgggccagcgtaccgaggttcactc

SEQ ID NO: 25275 - DNA, 70 bp, Chlorella protothecoides
cggggccccagttcagggcgcggtggtgatttgggtcttggcacccaaccccggcgctgcgaggcgccgt

SEQ ID NO: 25276 - DNA, 76 bp, Chlorella protothecoides
ggtgggtgggtgtgttcaagggggaagggggctgggtgcctgaggcattgatgccagaggaatcgaatattgggat

SEQ ID NO: 25277 - DNA, 80 bp, Chlorella protothecoides
cccctcctcatacatcgcctgcctcgttgcgaagctagtcgcttacaaacatgggatccacaccaggtgcaaggtcatat

SEQ ID NO: 25278 - DNA, 125 bp, Chlorella protothecoides
gcaggcccaaatctcgctcccacacttgccagggacccccagcactggcgcccaggttcgaagagagacagagtgggggttttccacgcctccattacccttttgaaaagccaatttggtcaaag

SEQ ID NO: 25279 - DNA, 137 bp, Chlorella protothecoides
ttaacggtgaatatatccgttgatcagtgtttttgggatttacaatgcggaactgatatgcctgttgcttcccaccaccaggcaagtagggggtggcccctaccgcacgagtttcctccctttctaccacggaccct

SEQ ID NO: 25280 - DNA, 168 bp, Chlorella protothecoides
gtgtctgccaaccggtctgaacggctaccacctgttgtgagaggtgccccctgttcatggcatgcaccagcaatcagatgaggtgccttcacctagtgcaatgaccagtgccggaggtcatttcctttgttgtctgcaggagagaatccgcaagatccccatctcaat

SEQ ID NO: 25281 - DNA, 66 bp, Chlorella protothecoides
catgtgggcttccagtcacatacctcgaaaacatagttccgtgattggaaagttgtgcatgctgtc

SEQ ID NO: 25282 - DNA, 71 bp, Chlorella protothecoides
gaagtatggttcccatcaggccaaaatgcatgagcaccactgacgacactggcaggaaaggaggatgaagg

SEQ ID NO: 25283 - DNA, 121 bp, Chlorella protothecoides
ctccacctcattcaagatccttggggacccccccccccacacacacacacactcgcgcacaaaggtcgtcatcaagtcccagatcctggcgggcgggcgcggcctgggcaccttcaagtcc

SEQ ID NO: 25284 - DNA, 74 bp, Chlorella protothecoides
aaatctcagccctgcagagtgtttccttgattctactatggaagtcgatgctgacaccgcataatgcctcaagc

SEQ ID NO: 25285 - DNA, 79 bp, Chlorella protothecoides
tgccttggatcacgggtattgatcggagcagtgtcctccagactggtgcgagtcagttggtgctgcatgcaggcaggga

SEQ ID NO: 25286 - DNA, 76 bp, Chlorella protothecoides
caggcaccgcaactgggtgtactggtcggaggtggcggccatccctgaggccgacctgaagacggtagacgcgctg

SEQ ID NO: 25287 - DNA, 61 bp, Chlorella protothecoides
tcgacacggacagccaacatcctcttcctcaccgccacgaccttcaactccaagacacaca

SEQ ID NO: 25288 - DNA, 63 bp, Chlorella protothecoides
ccaccccaggggtcgtgcccctgcccactgtggtaataatactaatcagattgaccctcgtgg

SEQ ID NO: 25289 - DNA, 72 bp, Chlorella protothecoides
ctttgcctgatgcagatggagcaacgacactagtatctcaccgtggggaggagggggaggggacacgacggg

SEQ ID NO: 25290 - DNA, 64 bp, Chlorella protothecoides
gtattcggggtcttgcctgtaacattcctaacttaggtcaaatacagcagtccacgttgtaggg

SEQ ID NO: 25291 - DNA, 64 bp, Chlorella protothecoides
tggccgccccttcaagggtgcgagaaagtagcattgtcaaaccactgccaatgttcatacactc

SEQ ID NO: 25292 - DNA, 78 bp, Chlorella protothecoides
cgggaatgcgcagtcgcatggcaattgtccacaggccggttccatcaacccaacgcccgccaccctgtgccaacagga

SEQ ID NO: 25293 - DNA, 62 bp, Chlorella protothecoides
gctgcaaatcgcacttggttttgcatgcattggctgtgctgccctgccgctgagaaggggga

SEQ ID NO: 25294 - DNA, 76 bp, Chlorella protothecoides
atagatatcttatgtaccgtctattactatattccgtcatactatgtgtcatcatcggatgtccaggtcaacatct

SEQ ID NO: 25295 - DNA, 478 bp, Chlorella protothecoides
agaccacgctcggggcggcagaatgcaacccctgatctccccgcccaggggcacaccgccttcctgctcgcccttttgacccaccccccgacccgccctgtgactgagcgcttgaactgcggtgtaagcaacgagccctggcatggcacacctgttgcttggactcatgcagcaatcgagggttgcggaaccttaaatgcagcggccccgacaagggcgggcaggagtcatgccctgcttgcgcggcatcagtcatacaactcgaatggtacaagagctggggaaaagggggccacgcgtgtcacctcttttaccgtccactgaatccctttccatccttcaccaccgagggtggtgtggggccgggggtccgcccctgctccaagcatggcgcagcccgcccccccgccgacccctgtgcccctcgccctcctcgggtctctcccctcgcgccggggcctgctgtgcgcgctgggcc

SEQ ID NO: 25296 - DNA, 79 bp, Chlorella protothecoides
tgcacacctggatgcatcccagcatttgtccacataggcacactcgtcttcctaatcatagtagcacgccgtccgggtc

SEQ ID NO: 25297 - DNA, 61 bp, Chlorella protothecoides
gcaccccacctgcacggctgtgcatctgcagagcaagaggtagcaccccctcctgacacac

SEQ ID NO: 25298 - DNA, 78 bp, Chlorella protothecoides
aagcgagcagagtgaagcttgagaggtgtggagaattatgttcgcaagaaggagggcagcatatcgccccgctgatgg

SEQ ID NO: 25299 - DNA, 73 bp, Chlorella protothecoides
ggcagactgtttcgacgggcaaattaaggctaaggtgaccttatacctgctgtaattcccatgtctgtaagcg

SEQ ID NO: 25300 - DNA, 148 bp, Chlorella protothecoides
cggcatggggagcgaggctcgtgctgtactcgcatgtggggatgtgtggcaacgagagaatcacgccccacagccccgtgctgtgaggtctccggcacagccaaccatatttccctgctgcatgccgccctgccgtgtcatcaaccca

SEQ ID NO: 25301 - DNA, 61 bp, Chlorella protothecoides
aggcttccactgccgcaataccggcggcgggggggacgtaggtggtgtcggagatggaggg

SEQ ID NO: 25302 - DNA, 1052 bp, Chlorella protothecoides
  modified_base (587)..(636): a, c, t, g, unknown or other
cccccccctcgctcccctttctctctgctcagtctcccccgacgcgcccaccaatcccgtcctcttctggatggggcacgtcagcgcggatgggctcaagttcgagctggagagcgcgcgaggccccttccgcctggacctgggcgacgtgctctatgcgcccaacgtgctgcaggaccgggaggggcgctggctgctctggggctggctgcaggagaagcggcgcgtcggctcctacgactacgcgggctgcctgacgctgccgcgcgagcttcacgccacgcccgacggtcgcctggtccaggcgcctctgccggaggtggggcgcctgcgccagggcggcggccacgccgtgcgcgacgtggtgctgccccccaccaaggccacgccgctggagggggtggagggcgactgcctcgacatcgtgctcacgttggagaggtgggtgggattttctgggggggaggggcctgggtggaggcgggtcaagggagatgggggatggggaggttaggggaaggaaggaatgagggagggaaagggcaggaagggtgcggggggggggggggggggaaaaaaagaggggnnnnnnnnnnnnnnnnnnnnnnnnnnnnnnnnnnnnnnnnnnnnnnnnnnacctgcccttcagtctagggagccatgcttgcgctctccaggccatcgctgaatatcagcaatcgcgcccccccccccactcttcaccacgcaggggcggcgcgtacgcggcgggcctgctgttcaagtcgtacgaggccggggacgaaaacggggctgccctgctgtacgactgggagacggggcggctggaggtggtgtttggcgtgcccccccactgggccaccacccacctgccgggcctggcgacgcagggcccgacgcccacctctgcggcgggcggcggcgccgaccagcgcttcgcgccggcctgggagcacgtcgaccctgccctgctgctcaccacgccgcgcctgggctcggccagcggcgccgcgacgcccggcttcttctcgcccgggcgcgacgacgccggc

SEQ ID NO: 25303 - DNA, 138 bp, Chlorella protothecoides
aaacattggaaccggcaacacaggaaagaacaactttggagactacaatgacggtgacaacaacattggtgagcaggactggaaaggcaatgtcttggcactgcactcgaaggattgcccgagaatgaggggcaggag

SEQ ID NO: 25304 - DNA, 110 bp, Chlorella protothecoides
agatataagaacatttccccattgatcacctgatatatactgctgcttctagccttttcaccaatcgcaggggtggctagtcctttataatttgcgtacatcacgccggg

SEQ ID NO: 25305 - DNA, 105 bp, Chlorella protothecoides
ggctggtgctttggttgagcccggttgacttagtaagttcccccccttgaacttgaaagctgccttcagtaccattgcatgagggacatggtccattgtcacgag

SEQ ID NO: 25306 - DNA, 61 bp, Chlorella protothecoides
tcacattcacccgctcaaggcatcaaagcgtgagcagatgcacggctgcacatcatccctc

SEQ ID NO: 25307 - DNA, 101 bp, Chlorella protothecoides
tgcccgtaccaacatacaatgcaatgtattggtttgctgatgtcggtcgtgtcgttgcatgtgcgggcgtcgtgcactcctgcatgcatgaagcccattgg

SEQ ID NO: 25308 - DNA, 91 bp, Chlorella protothecoides
ggtagatgtgggcgcctggttgctggggggctggactccctgcagagcctctcatggtttacatgtggatctatgtactcaagtgcacagg

SEQ ID NO: 25309 - DNA, 66 bp, Chlorella protothecoides
cagtcctgcggaatcttcggaagctgtccttcagcatgggccatccagggccctgatcccgtcatc

SEQ ID NO: 25310 - DNA, 95 bp, Chlorella protothecoides
cagctgggcgggcatgccttgtgagtgcatgtaaagatccagggcatgcacggtgacctcccttgctcccactccaccacgcagctctttgctgc

SEQ ID NO: 25311 - DNA, 240 bp, Chlorella protothecoides
aaacacgcggagcacatttgcacccttcatggcgtgcacctgggcagcaggaggagcatggattggttgctgatacgagtggttgatacattgtcggtcgcagagaaaatcaacggcatggttgcttagcctgtaccgatccctctatcaacacacagcgccgtgtatgttggcaggtgtactgctcggagaagatgcagaatcaagctggaggtccattcatgcatgattacttgctgg

SEQ ID NO: 25312 - DNA, 61 bp, Chlorella protothecoides
gcagacccttacccagctcatccacgccagtcagatgctatagttcaccatggtcctgaat

SEQ ID NO: 25313 - DNA, 101 bp, Chlorella protothecoides
gcatacagcacttgctggtgtagtagtgacggccaactcgccatgggagcaggcatggactctcaacgaacttcagaaacaaaagagatcacgtagaaccg

SEQ ID NO: 25314 - DNA, 74 bp, Chlorella protothecoides
actcattttccatccagcaaccacacaagaaacaaccttactgtaacgtcggcgtaggcatatggttgtgagat

SEQ ID NO: 25315 - DNA, 243 bp, Chlorella protothecoides
catgctgaaggccagcgggatgaccgttcggagcacggagggggaggaggagggggaggcagacaggctcccggcggacctctcgcagccgctcagctccccggagcaggcggcactcagccctggggagctgcatacgagcatcctagaacctgtcgatccccagaaggcctgacgctctgcacgattctttcccacaggcctttcatatggatcagccttgcgcctctcaccaccagcctg

SEQ ID NO: 25316 - DNA, 61 bp, Chlorella protothecoides
caaaaaggcaagccgttgttggcgcctgtcgcccaggatgtccatgatgctcaggagaggg

SEQ ID NO: 25317 - DNA, 67 bp, Chlorella protothecoides
gcgcgcacagattcgcatctcacactggttgtgcccgggtcgcaccctagcaggaagccgcagctcg

SEQ ID NO: 25318 - DNA, 61 bp, Chlorella protothecoides
agcttcggcccccatccaatgtcatatgggcccccccgaccattctctccagcaacctgct

SEQ ID NO: 25319 - DNA, 77 bp, Chlorella protothecoides
ctagggtaccagccaatgcaggtcggtggggggaatgggggaggatacttcactccctgatgaagcttgctctcaga

SEQ ID NO: 25320 - DNA, 79 bp, Chlorella protothecoides
aaggggaagataagtttgcagcatgactgtggtcatatgaggatgttttctgacttggaggtgcaggatacgcatgcaa

SEQ ID NO: 25321 - DNA, 75 bp, Chlorella protothecoides
gcaagcagtcgatgcagcagtgtaacacaaaataatgtcaaacaattgctgtggcttgtctttcattatggacct

SEQ ID NO: 25322 - DNA, 61 bp, Chlorella protothecoides
ccgtcacatagttgagtggatgaactgtcggaagtctgcattgcatcctctagcgagacat

SEQ ID NO: 25323 - DNA, 105 bp, Chlorella protothecoides
accgaagtggccgctgtgctcaagggagtcgggggtgtatgctgtgccaaagtcaaagatgcccagcttgaagaccacgtggacctgagggaccttgtgcttcag

SEQ ID NO: 25324 - DNA, 105 bp, Chlorella protothecoides
tctccttgccctgcccctggtacctctcaacctcctacgctgcacggcacctcttcgctgatgtctacaggatttgagcagtgcagtgcagagccagtgcgccgg

SEQ ID NO: 25325 - DNA, 94 bp, Chlorella protothecoides
caaggctggacagaaggcttgcaccgcggataaggatggcaatattgggacaggaaacaaggggaagtacaattttggcgacaacaacgagggc

SEQ ID NO: 25326 - DNA, 61 bp, Chlorella protothecoides
ggggcttgtgccatgccgcaaatcatcaggttgatcaggacgaagtcggcgtccgacatct

SEQ ID NO: 25327 - DNA, 61 bp, Chlorella protothecoides
aggacgaagtcggcgtccgacatctcatatatcttcctcctggcgtacatcttgggcctct

SEQ ID NO: 25328 - DNA, 90 bp, Chlorella protothecoides
tggcaggatactcagggaagctgcaatttggcgtcttattaatccattataagaggaaacgggtaaatttgagagctgatgatgcttcgc

SEQ ID NO: 25329 - DNA, 78 bp, Chlorella protothecoides
gtttgacaatcgaatgtgacaaaatttgcttggaggaatcgggatggttgctgccgcgcatgtcatgtgccccctggg

SEQ ID NO: 25330 - DNA, 66 bp, Chlorella protothecoides
gccgcatgagtctcgcagcaccatcaatgctgttgtggggccccctctccggaggcttcccccctt

SEQ ID NO: 25331 - DNA, 11298 bp, Chlorella protothecoides
  modified_base (99)..(108): a, c, t, g, unknown or other
  modified_base (821)..(830): a, c, t, g, unknown or other
  modified_base (3527)..(3536): a, c, t, g, unknown or other
  modified_base (3931)..(3940): a, c, t, g, unknown or other
  modified_base (4314)..(4323): a, c, t, g, unknown or other
  modified_base (4525)..(4534): a, c, t, g, unknown or other
  modified_base (4773)..(4782): a, c, t, g, unknown or other
  modified_base (5130)..(5139): a, c, t, g, unknown or other
  modified_base (6011)..(6020): a, c, t, g, unknown or other
  modified_base (6360)..(6369): a, c, t, g, unknown or other
  modified_base (8238)..(8247): a, c, t, g, unknown or other
  modified_base (9275)..(9284): a, c, t, g, unknown or other
ggggcacatctcatgggggaagtgtgtaccagagcaacctcatcacgctgtagtgagggcttgtgtaagggatcaggcaggggcggcggaagtctgggnnnnnnnnnntgaacaacctcatcacgctgcagtgagggcttgtgcaaggggatcaggcaggggcggcggaagtctgggctgtgatccagcagcagcaacaggcccctctctcacccagcacatgcatcgccggctgcagaagtggcctgtaaagccagaaagcatgccgctcaggctgccttgccgcctctcacccatggccctcccgtctccttccaaacagctgctgtccagcccaaagagcagcttgaatgcctgcaacgagagccactggtaccgcgcggccgaccagcggtgggtgcccgagttcgagagcgcctcgctcaagctgcatcactggcgcaagtcctggcagtggtttgccctgagccgcgtccacgcgaggttggtggtcgcagatgtggaggtggaggcccagttccagcagcactgccgccccagctgggtgccggagtggaggacgttccgcgtctgctactctggtgggtggagcagcggcggctgaggaagcacatgcacggtttcctgcggggccggtggccaggagcatggttggcgacgcctgggacttactgtgggctgggtcagaggggaactaacccttgtggcctccacacaccgagccctgccccagcaaacctgatgctggtgctcggccaagaatcatctttcacgtcctcctttcccatttcccctttctagacgagcactacatacccacnnnnnnnnnnccggcgacgcctgggacttactgtgggctgggacagaggggaactaaccctcgtggcctccacacaccgagccctgcaccagcaaacctgacgctggtgctcggccaaggctcatctttcacggcctcctttcccattccccctttctagacgagcactacatacccaccctcctggctgtccatggactggacaatgagacggactgttcggggagtaccactggtgagaagctgttgggtagccattccccatggagcctggccctgttccatggacttctgtgcggggtgatacacatgccaggtgcccttcaggccccgcaacgactcatacatacctcctctcccttctgcctgcgcctgcaccagacgccaactgggaccggagggcggacaagtactccccccacccatacgagtacactcgatgtgagcatgactggagcgaatgtgtcattctgtgctgtgccgccggatcgaggctgggatatctgcctggtcatcatcaccggatcttgcaattcttcccagtactcggcacctgttgctcttcccggtgcgggatcgaagaaccctcactgccctaccctggctgcccacattccgccaggggacatacggttgggcctgctggccgccgtgcggcgctcttccctagcccagtgcgcgcacggcgagcgggagaaccggtctgtgcgcggcggcttcctgcagctgggccaggacccggcgccatccccagaggacatcgccgcggccgcgcgccgcgccgcgggttacgccccgctgggcagggactgcccgctcctggcccgcaagttcggggagggggtggtggcccaggcgctggcgctctttctgcgctgtcaccccagcatcggcgtgctgaacggcggcgactgccgtgacggaagggggctgtcccaccgcctcgcgagcgctgccctgccgtgggcggcggccgccgcggtctgctccgctgcagcgctgctgtcaggggcgatggccctcctgctgcaggcgctgttcctccagcacctggcggagcacgcgccgcacgatgcgccgcaggtttgaggggcgcctgtgcgcaatcttagcattctcgcgctggggcgacgcgagcaggagtaccacagagcagcggtctgcatataccaacttgaatgaacagggcccccatgcacgagcaataatatggactcgcttgctggggcgcccatcgaatagcaggacagtgatgaatgatacttcatgcattgctatttttgtgagaacttatcatcggaggctcagcttgtcacgtgcagtgttggcggtccttcactccgcgaagaggtccgcatgaagcctgcatctgtcgcattcgtcggggtttatcggtgaggatattgcaagctgtcgacctgtatgccttgaacattccgaggtgctaagagatgagactttgcttttcgaccgcgagtcagctcacgtagccatgtgtgaagggtatcgattcgtgcagtgccgatccgaaactgatgcggtgtacaaacaggttctagccctcgagaagaaatgcttctccaaggcagactcctggagaggtgtgtgtgcggcatagtgggttgctccaagggtcaaaagacagatcagcagccggcttcaggcttgtgacggcgcactctggggttcatgtatctactaccagcgttcacgcgacccaccacgcgtaggggacatggcgctggagctacgacggaggaacaccttcatcatatgcatgacaatgcacgcggatcagcatgtgagtgtggttgctgttgcaggtccagctttgctggccaggcggccgctgtgagatgcatgcatcgcacaacacggcaacgagtgcctcatcagccctgcacagccgcttcactgacgcgcaacaggtgttggcgtacatgttatacagcatacacagcttggcagcccacattgcacggctggctgtctgcccgctgcacaggcgggctgggcatgccaagaggctcattcaacatgtgacccgtgagctacagcgcgcccgccgtatcagcaccttctccttgcatgtcgccgccgtgaatgagccggcactcgcactgtacaaggcgtctggattcaaggaggatgctttcctgcaggcaaggccttccctgtgtggcgtgagtgtcgtgatcccggaactcaggtgctaccctgtatcaagataagcacaccgcgtcggtgctgtgccccaggctgtgactgcctgcctgattgctggtcctccatcaactcccacaggactactatgcacccggtcggcatgcacacaggttgatgctggagcttctatagggactttgatgtacgtatgaaacaaaatgtgacaccatgtgagatttactccatgagaccttgagaaagcaatagtcttgggacacatgcaaggtgctcgagacggagctggatgtgtagggcgggcgctgcgttgcgcgctgtgcgacatcaggctcgactattacaccctccgtaatacattcaaggcttccgagtcgatcaactcgccaatgagcttgtggcagcagaagtaaacagattggagactctcttcgcatcgtggcaaaacctggcggatatggcagcgcctgccgaggagccttcgccggtaaaggtcacgaggaagcctcagccacaccggtgcaannnnnnnnnntgggcgggcgctgcgttgcgcgctgtgtgacatcaggctcgactattacaacctccgcaatacattcaagccttccgagtcgatcaactcgccgatgagcttctgacagcagaagtaaacagattggagcctctcttcgcatcctggcaaaacttggcggatatggaagcgcctgccgaggagccttcgccggtaaatggcacgaggaagcctcagccacaccggtgcaatgctcgcttggaggatctcatacaggtcagtatatctttgtcgtcgctatggtttaccctgtgacttcctgaactggtgcggctgagcaggttgaggtaatgaagtatacctaaatgttcagaccggtgcttattccacaacctgcgcagtccctggtcaccttnnnnnnnnnnataatgcagtacacctaaatgttcagaccggtgcttaatccacaacctgcgcagtccctggtcaccttcgagctctctgccaagatccagccggcttggaggaatttcagagcgtgcctagcgtcagaggaggggtgaggcatggattcttagtgggagaaattgttcaccggattgcgttctgcatgcacattgcggctgtgtgcttcgtttgcttgccgaggtccattatttgcagtcaatgcctccatgagtgagatggccaaggttgtgccaagatatggtgcccccaaactagcctccttacctcattccgtggcacacaagactcccagcattgccctttgtgcaggagagagccaaccggtccttannnnnnnnnncccgtggcactcagactcccagcactgccatttgtgcaggagagagccaaccggtccttaccttgtggtagaggatccatctgcctacctcgatccagacagggtctttaacaagagaagaggccctcagtgagcagtgttacgttgcatatacccatgtgctgtggagactttgggaagcgctcatacaggtgtggatccnnnnnnnnnntttacattgcatgcacccatgtgctgtggagaatttgggaagcgctcatacaggtgtggatccgtcttcctcttcctcattccctgaaatcaattcctctatagtatttttccaactccaaggctttgccttgtttctgttacgtatctgagcagttcctgctctgaaccctccaactttgcctggagaacaactcccgacacacaagtcacggcggcccaagcgctccggaacatcgnnnnnnnnnnacaacgttgcctggagaagaactctcgacacacaaatcacggcggcccaagcgctccggaacatcgactcggtcgatttccaggcattcagtattcccacgtatcacatcctcccgtccaaccatgatattcataagcattctattattgccggattgaggcagaggctgtgcccatgcaaaggtgctctgccatcgtgagcgatacgcaccgcctgcactagggagcccaacgggacgattggcccttcgacgtcggcctctggccatgctgagatgcatgcctagcctttcattggcactcctgcgcccagcacatggcatagctgggaggtgggctgttcgtggnnnnnnnnnngtctggccatgctgagatgcatgccgagcctttcattggcactcctgcgcccagcatctggcatagctgggaggtgggctgttcgtggggtctggacggagacacccgggcccaaggagtcggaggtccgggactccttttacgacagcacaattgagaacgtgcgctgggaggaggcttccagggaccatggatgttgcgcatcatggcctcgaagttcgctagcaggcgacctgggctcgagcatggcgtgcatgcatgcagcatgggcctctgcggagggcggtgtcctgctggctggatcacaggccagccctaccagactggcgccgccaagccaccttcccctacactctgccccctctccatgcacgcagtatgcccgtcagccgatcgtgcagctgacccttcgggggatgctggacatggggcgcgacaccctgaagggccctgcctgcaggatcgccagcgcccgcttcgtgcaggaggagctgcccaagcgcctggcgcgccgcctgctggacctccagctcctccctcacctggtggtgaccaacccccacatccaccgcgtgtacaccgcctactttcacaccctgcagaccttgctggccgtcccccccgtcaccagcctcgcgcagaacgaggagttcaccgccctgctcaagcgcctggtggacgatcatggtgtgttttcgtgtatagaggaaggggttggggttgggggaggaggtgaccaatatagggattgacggagcagcctctccgtcgcctgcacctgcctgtcatccaggtcctggctgtgccactcctcatcaatcagagccgctcgccccaccccgtgcagcgcccatgctggattacctggccannnnnnnnnnggaggaaggggttggggttgggggaggagatgaccaatgtagggattaacggagcagcctctccgtcgcctgcacctgctcgtcatccaggttccggctgtgccactccgtatcaatcagagccgctcgccccaccctgtgcagcgcccatgctggattacctggccaccggactgcgtgaggtcaggtcccggcccctcgtcggcgagcggctccacctcgacccgtgaggcagggaggggggactgtggattgcgcccaatgtcaaagcatgccatagggcacatgacacaacctttgcgccccgagtcgaattgccccgatgaggatgggactggcnnnnnnnnnngaagcatgccatggggcacatgacacaacctttgcaccccgaatcgaattgccccgatgaggatgggactggcgacaccctgcatgccagaggctatttgcgcgtctcctctgcactgcacaccccgttcaacaggcattcgtgcatgcgctgtgacccctggcccggggtggcacagcggcaccttgccccacacagcaccccaccgacagagggccccccctcccccgatcctcaacttccccgcagcttcctggagaacatgctgcgcagccgcatcagccgccgcacgctggctgagcagcatatgtacctaaaccaggggcggccggggtacgtcggggtcatctgcaccgacatgagcgtggccgagggtgtggactttgcagggcagcgctgccggcaggtgggtgctgtcttcgtatggttcttagccctgttttaggagttgactctggccattggcatcctgcattgaactcgccatcaacagcctgaggaggcacaacaggacatcgggcatccctcattggcagggagatgaacgcattggatccatggcacacacagtttgcttctgcgcggctacaggcccccttatcctcccctcacaggtctgcaatgagacatacggcctggcgcccgacgtcgtcatcaccggggacaaacggctgaccatcccctacgtcccctcccactttgactacatggtgtacgaggtgctgaagaactccagccgtgcggtggtggagcggcacctgcagcaaagcgcgcacagcgccctggagcgccggctccctgccatccacgcccgcatctgcagcggcgaggggcaggtcacgctgaggtgtgtgtgcctggcggtgaacttgtgctccgctcctgctctcatgcttgcctccatgcgcatgcggggtggcattgcctaatgctcacgtgcaaccatccccgcactcaacccagggtgtctgacgaggggggtggcatcccccagccgctggtggacaggatttgggagtttggatttaccaccatggggtgagagggagggtcggatgtctcgaatgctgttggaggtttattaggcttgctgctcggatgagggcctgtatcccaagctcttctctgaccatacacaggaaggagctgattgatggggtggagaggaccgaggggctcggctttgaccccagctttggtgcgggctggtcggttgcccagataccggtgaccagcggcaaccgcttcaggatggggggcttggggttcggactccccctttcacgtctctatgcgcgatactttggtacgtcagccgaggatggggcaggaggtggggttggctgggtggtctatagcatgacaccatggcaccccgtttggggaccccacgcgttggagagaagccctgcaatcccctctttgccagctcttcttcaagacttcctggccatcacgcgcaggtggcgacctagaagtccgctccattcaagggtatggaacagacacgtttctgaccttgaagaagctggaagacgaggactggcaggaggagtatgcagaggattatacgtcgcccatgccaaatctataccattgaacatgaggggatgatagaatcaatatttcagcgtatatcatctagagaataatctcctgtgtacaagcttgcatcccctccctctgcctttgacagttttcctggtgtggtttgtcctgccagttgggtggtacagatgaaatcttgaagcagaagaatacaaaagctcttatccacagtcaagaagttatccgcccaagggcttggaattgtatacacaaaaggtcgtgggccatgagtacgtgcatcgatgtgaggcccgaaacttnnnnnnnnnntaaagctcttatccacagtcaagaagatatccgcccaagggcttggaattgcatacacaaaaggtcttgggccatgggtacgtgcatcgatgtgaggcccgaaacttgtgagtcgcatggcgaagaggcagcggccatgggcaagcctgtgtgatcccctgaagaatttccgcccaaggcaccatgccagggagtgaccctatcattacttgctctcgggatacgctctttttatgctcgaccagctggctttgttggtctattcatcccctagacaaggccgtgggtggtccccagtctcggtgtgcaggattctgcgcgcggggacaatctaattggctatcagagcagatcgactcccagcagcacagcatggcaccgacgaaacaaatcccaaactccggcaggccagtagcattttaaattataatggaaaggtgataggcgcagcggtttgtatagatagagactcggcccgtgtaactgattggctgtccgggcggcccatgaactccatgaacggcttggcggacagggccttaacattacatggcgccggatcgggtgttgtccatcaaagagtgcagtttaagcgcttttgtatggtttccgacgtccgcgtgggcccaagccgcacgggtgcctacacccgcacagcccccatgcatggattttccatgcaccagcccgccagccgtccctgggacggccgccccgccctgcccgcgagcaagcccgtggtgaaaaaggaagatgcgtcgcgaagtgaccagacggagctggtggtctgcttggagcgcaggggagagggctggggcgaagagatcctccctcacctgcatgtagagcgtcggcctgtgagtcccgctgccaagcactggccggtgcaaagcaaagaagaggacacggtgagcactttcgggcaggctccttgacttgggcaatgtgagtgcatggttgaactgacgatctagcggaccaggtctcatgtcacgtcctccctcggcgtctgcaaccagcatcagcannnnnnnnnnaggcaatgtgagtgcatggctgcactgacaatctcgcggaccaggtctcctgtcacgctggcaggggcactccctcggcgtctgcaaccagcatcagcagctacccagtgtggggcaggagaaggctgctgcaagggactgtaccctcccatgcaccatctacctactactacatccacacatacattcaccaacaaccatgcctgctcccttgactcagcccggcgcactggaggagtccctgctctcctttggagttcccctcgccgaagtggcacgctgcgttcgggttgcggtggcatggagggtgactcccaacggcaggcccctggtggacaggcggcgctactcccgcctccgcaggaacgtgcagatcgtgtctgactacctccagtcctcgtgccatatcgcgccaggtgagcattggggcaaggcttggccgcgcgttggcacggtgcatgtcacggtgttgcaccttgacatcaatggcctgcgccagagcgaaaattgcacggttactatgtacaagaatagtggtctgtgctgcgcgcgagagctcatcacggactgtgtgttggtccttcccacccccctgtccttccctgcgggtcgctccatcagcctgctttcccccgacgcagggccagagggcgtgggcgccgtcttctcccgcttccccctggtcatgctctgcaagcccacgacaggggatcgctgggatcggcgcgcggtcgagctggcggcctttatctacacgcacggtcactgccaagtgcccctggtgcgagacttggcctgtgcatgcttggctaaatcgcgtgtgtctgtccactaggggccccaggatgccgtcgctggcttattcaaatcctcccactctcttcctgcgtgcagaggtatgaggccagccctgacctgggaccgtgggtgaggaggcagcggctcctgcgctgcaccaaccagctctcgcacgaccggttgctgctcctgcaatcgcttggctttgagtttggggaggttgcccagctgaccgaggagtgggaggtgcattttgaccaggttcgggccccgtgtgtgtgctgggtatgggagggagtctgggtgttgctgacaaaggcagcgctggcatgtccagaagcgccctgacctctttccatgcgcattgaatgggtattgacggatgggctatggcctgtgtgtcacaatgcgccctcgtcccccttttcccttcagctcttcgagctgattctctggcaccgagggcagcagcggcccttcccctggctaggcctgggatggagctgctttgggggcagtcagggtaggtggtggtgcggtgatgccgcggcgctgcctgacacatcggatgcttttgctgatcccttgccactctcactctttttagcttgtgggtcacgtcctttgcaacccttgcatgtcgcatatcactcatcaactgacccccccaatcaggattggagctggccaggtggctcatcctgcagcgggagtaccacaggcggcgcatcctgccgcagtctgcgctccagaggttcgaaatcctgaacatccagtggcaccccacggtgagattttgggctgcaacgcagtggttatcgtgccattttgggttgcaatgccgatgtgcaagggatcctgcaggtagaagggcaattgcaataatgatatcgttcgtctcctcctgaacgtgctggtctcctgatgatggtcacccctgtgcccccgcagtccacctctcaccccgactacgtctggttgagcaagtttgggcagctcctgtaccacatcgagcaccagaggatgagccagggtgtggtcacatcccctggcgccctgcccaagggcctagaccagccgaagctgggccgcccgcccaaggcccgccccggcgaggaggcggggcgagcgcggcgcgcataccccggcgcgtcgccggcccctccgtaccccgcctcccaccccggctcccattcacccccccccgccaccccct

SEQ ID NO: 25332 - DNA, 76 bp, Chlorella protothecoides
tcgacgcagaagatgcttgtcgcggaaatccggagggacccttccggtgccaacgacgaaacggagcccggtgaac

SEQ ID NO: 25333 - DNA, 68 bp, Chlorella protothecoides
gcatgaggccaggaacaccaggatgcaaaactccccggacgatccactgccaactctgggtctgctca

SEQ ID NO: 25334 - DNA, 61 bp, Chlorella protothecoides
tggtctctcggcatggggagcactgtccgctcccagagcgtgcagcgtcaggagcgtgcac

SEQ ID NO: 25335 - DNA, 61 bp, Chlorella protothecoides
tgatgatttgccacagcggccggggggggggagcgtgtgtgcgtgctgaggatgatgcgtc

SEQ ID NO: 25336 - DNA, 292 bp, Chlorella protothecoides
tctcctggcgggtttcattgtgcctaggaagtgtgagatgggtcactcttgtccacagcccactagctgtaccccgcgagcaggtgccctgggcatggtgttggatgggtgggtccgatcgtagggagagtgtgcaaggatgggcggaggacagtgcccttggcacagacggatcccttcaggtaacgagaagcaggaaggtctctcgcacgcacctttccaaggcagagggtcatggcaacaccccaggccgctcctgggacccacgccactctcggtggcccttgttggg

SEQ ID NO: 25337 - DNA, 61 bp, Chlorella protothecoides
gccagctccatagattcgcggaatggcaggtctcatgcatggtatggcatgcttcaaatgc

SEQ ID NO: 25338 - DNA, 853 bp, Chlorella protothecoides
gtggagttcctgagcagggtgccctcctgcgcgccggcctcgccggcggccagggccggcgcccaagccgccgtcgcgcccgccgccgcgcgagcgacatcggagtcagagtgccgccgcaggcgcggccccgcgaccagggtggccaggccggtggagcgcagcagatcggcgcccacgggaagggcctgcagcaggcgcagcaccgcctccagcaccggcgtgtgcagggagttgcccaccgaatcctccagccagctgtgggaatggggggaaggggagcgaggcaagggggtgaaggagtgagcgcatgtgcatggggtgtgcattgcaaccgtgggctgcaccctcgacgcgcggaggggaaaggaggaggccgcagacgcgcggaggggcacggtccaatggcaaggctgggatttacgctgcgtccatgcgatgcaggatcctgcacccagaaccaccccaacccccctgcatccctcccacaaagcctacctgtggaggatggagaggacctcgggctcggcagccacggcggcccgtgcacgtgcgtccgcctgccggaggcactgcgccagggcgacacgcccggcagcgcccccggtggagtgcagcaggtctgccagggagctcacgtcgcctgtgcgccagcccaaagaggatggggtcggggggaggcagtgatggtgtgcggcggggtcgcaccggccctccagcatccctccgcagacacgcagcctgagccccgcgcaccacaccgcgcaccaccggaggcgagcaggatagcgcgccacaccaccttctgatcagcccgggcagcctctctctgtcgacggtggggggggggggg

SEQ ID NO: 25339 - DNA, 73 bp, Chlorella protothecoides
gtcgggcctggatgcgagggcggccgccattgtcatacgagcagtgcggaacgtggcagacagccagcggacc

SEQ ID NO: 25340 - DNA, 79 bp, Chlorella protothecoides
gtggatcactccgctgggtcgctgcaagcatgccgattaacatccaacgtcaaggcctccccgcaccccacactcccgc

SEQ ID NO: 25341 - DNA, 129 bp, Chlorella protothecoides
gaccaagggattaaggggccgtcgatgggttcttcaggggtgagatcttggcacgtgaaaatagcaagtgcgtcacacgagatgttgccaatcatggagcacacgaggttgctgccttccaggggactg

SEQ ID NO: 25342 - DNA, 61 bp, Chlorella protothecoides
gaagcgtgaggaacagtataggagtccgcctatgcgacgccatggtgccgcacgaacccga

SEQ ID NO: 25343 - DNA, 79 bp, Chlorella protothecoides
aaaacagtcttctgtcgaggtgacgaagagacaagaagcggggtttggggccgtggatgtgtcacgtcctgcagggcat

SEQ ID NO: 25344 - DNA, 98 bp, Chlorella protothecoides
ggagcctcatgccatgggtaccgagcacacacgacactccccacccccacgccagcaaacagcacccccaaccccctgaaacctgctgcgccagctcg

SEQ ID NO: 25345 - DNA, 151 bp, Chlorella protothecoides
tccggtgcacagggcacctgccaccagcttcgagaggtgctcgtctccgggcaagggtttccctgcgcagtatggttccgtgactcccggccacacccccgggcccctctcaccagattcatagccaggtcctaggatcaggtctgcatgt

SEQ ID NO: 25346 - DNA, 122 bp, Chlorella protothecoides
gcacacgatctgctcaaacccacttcttctgctacactcgggatcctcatgacccccccacctccttcccaccaaactcagagaggaagacctcccatcacagccacgcacgtgaggttgta

SEQ ID NO: 25347 - DNA, 123 bp, Chlorella protothecoides
tgttaggacccagtcctgaatactgatactcatataatctattaagaaatgcgacgtgcacggcgcgaatcgcggagcgccgggtccgacgggcgccgccagctacaaacgaagctgcaggct

SEQ ID NO: 25348 - DNA, 77 bp, Chlorella protothecoides
tgccgcgcctggggaggggtgtggagggaggtggaacacagaagggttgagccaatgccccactggaggagcctgca

SEQ ID NO: 25349 - DNA, 133 bp, Chlorella protothecoides
tcctgcaccacccaccctttgacttggccttcatggggttctccagcaggacgctcttgtcttgcattcggagggagtatggcgcactggagcgtgcgccgttccccgacaccaagcctccgaccagcgcctc

SEQ ID NO: 25350 - DNA, 137 bp, Chlorella protothecoides
ctacaaacccatcctgagggcgcagaggggcccaatgagaaatgtcaggtgggtgcttggcagccgtttcaatgagcaatgccaatacacccgattagctacctcacaacaccaggtcagctgcatctcgactcacc

SEQ ID NO: 25351 - DNA, 117 bp, Chlorella protothecoides
aagtcacgcattcctggtaagctgcgatagatttgccttatagattggctcccaggagcaggtgcatcctgcactcctgtgctcaagtcaacttcttattctccattctttcaagag

SEQ ID NO: 25352 - DNA, 105 bp, Chlorella protothecoides
gcatgaactctgttttccacaggcagcaaagaaacaccctttccctctcgctacttagggtacagcatgaatcttggccctgcttcacgcatagccccatctccc

SEQ ID NO: 25353 - DNA, 61 bp, Chlorella protothecoides
catcaatgcttggagggccaggctgtgttagggccatatctcccgcccacaggctgttgct

SEQ ID NO: 25354 - DNA, 96 bp, Chlorella protothecoides
ggcagggacaagcctggaggagcaagcgtggcctgccgacggtctcccacaccccacgcgcagagcgacttctacctggcatccgtgtgcatccag

SEQ ID NO: 25355 - DNA, 61 bp, Chlorella protothecoides
agccgacgcgctggaattacgtcacgtcgttcgggcggatctacacaagatactacctctt

SEQ ID NO: 25356 - DNA, 326 bp, Chlorella protothecoides
gccgccgcggtcgccgccgcggccggcttcgccccctcggccgccaccgcgccgtgccggctgtcggtgggcaatctgcacccggccatcaccgaggccgacctgcgcccgatcttcgagccctttggcctgctggacggcgtggccctgcagcacgacgcggcgggcgtgccgctgggcagcgcctgggtgcacttccgccacctcaccgacgcaacccgtgccatgcagagcctggaccgcttcacgctggtggaccgtgagatccgggtgacgctggacgcagcgggtttgctgggcgcagccgccgtcgcaggcgcccagcc

SEQ ID NO: 25357 - DNA, 65 bp, Chlorella protothecoides
gcacatgtgcctccacccacccctctgcacacacacacccgttcacaaacccgacagcccacatg

SEQ ID NO: 25358 - DNA, 103 bp, Chlorella protothecoides
cagcctcatgctgtctgcaggcgctgccaacaggatgcttggggggccccctgacgcagccacaaaggcagcagcacaacattgcaccacccactcacgctgc

SEQ ID NO: 25359 - DNA, 71 bp, Chlorella protothecoides
cggcccctcgtcgtggtccgtcgcacacatccagcgcagaacgcacccctgcgcgtcggggcagggccgtg

SEQ ID NO: 25360 - DNA, 66 bp, Chlorella protothecoides
gcgagagtacgcgaccaacacggtcatgccggaagacggcgcagacccggcgcctgacacggcgcc

SEQ ID NO: 25361 - DNA, 78 bp, Chlorella protothecoides
catgtagtgatgcctgggcacggagccagctgtgcctgcatgtcaccccagctcctgagccaggtctgtcaggcactc

SEQ ID NO: 25362 - DNA, 72 bp, Chlorella protothecoides
tggcactctgaaagctcgcgctgaggaggattcgactgaacattgggatttcacccaatgaatgaagcaccc

SEQ ID NO: 25363 - DNA, 70 bp, Chlorella protothecoides
gggcgatgaaggatagacttgggcctcacctgatggcggaagccaggaccccaaccattactctgacctg

SEQ ID NO: 25364 - DNA, 234 bp, Chlorella protothecoides
ggatcacccaaccatgatgcaacgggaactcacctgactgcgcccgcatcaccatcgcgcatcccttgacaatacgtgcttgtgatagtaagatctgctgctaaatccaaggcaatcagtgtggttggatggggcgatcgaatgctttcagaatccgagtgatggaggacagcgtctcgcagagtccacacgtcttgagcgcatggtctacagcacatcgtcatgacccaagtc

SEQ ID NO: 25365 - DNA, 79 bp, Chlorella protothecoides
ccaccgtggtctgacagagtgattaccggtgttacaagcaacccggtggcccctcgcaagggggcccaccaccccggtg

SEQ ID NO: 25366 - DNA, 61 bp, Chlorella protothecoides
aaagggaagagatacggatgggaacttgcagcggtggcatgtcgtccacctgcttggcata

SEQ ID NO: 25367 - DNA, 3195 bp, Chlorella protothecoides
cactggtggacgtgctgaatgtgttcctggagcgcaacgcagacgacctctgacccgggggtactgctttgcatgccgcttgggggggtgtgggggctccagtttccaccctgcaccgacccgtccatccaaccgtgcgcaccaccatgccgcctgcctggggcgaccttcttgtgtcaaaccgtgatcctgcagaatcccagcgggattacccacacaccagtccatgcactcctccatccttgtgaacgaggcacgagagtaagggatcaggattttggtgggttgaatgcatcagaggcctgtgacacagccacaaatctctggtgcatgctctggaagcccggtgtgcagccagtccgacccgtgtgcgccgccaagcgacgtgcccgccagtgccccgccaaacaccctgagggccaggctggccctcgccagtccctgttacgggtgaggtcgacttgtaaacgagccacatcgaagccccctgatccaggggcaccgagaacgggagatggaaaagttggatcctgtaaattccggaagtatttgagctgagaaccccgccaaattgaaaatttccattctaggatacataaggcgctgcatgcaagggttgttgggaaggggggaaaggaggtttctcaacgcttggccaagtgagtgccttcatttctctcagatggcatccttcgtacaagagatgctcaggctggacaagctcgatcaaagagcgaattctgttcatggcatgccgaatcgggatttggtacgggtgaacaacagggtccattttacgttcattggagaatttaagctgcagcttgctgtgcacgtactggtgccgactccaaccgtgttcacagactgcgcctgtgtccatatttgctcagccgagccaccatcttcactgttcgccagcgggtctggagctcttgggctgctgccatgtcagctcgaatttctggagtctatgttttgaaaagtgatcttcccaactttccgagccgatcttctcgaaacccgcaacttcggtaaccctgcccggaccctaaccattcgggcccaacagggcagaaaacttgaaataggagcaaacaaagggtagaggaagatggggtgtgttgtactgggcgatttagggtcactgcacaccagaaagaccccggaggtggttcaaacctgcttgcgtaaactgtcgtactttcacgtaacactcggggatgtgcacgtgtcgcagagaccactcttgtgacatgaggggctgactttgccactcccaatcaaaatcgttctccaagaaaacttgtgaggatatagagggttgcatgcatgtagaatgccgtcagcatgacctcgtccgccagaatttatgccgactgtaccttcgcccggcttcggtccggatatattatgacgaggactctctgcgagccatacccgtgttgtaccatgccataaacggaaatccacatacacaaccattttataaccaccagagtctgaggtaaggtacaaacgacccatcatgcggtcggcgcttctcttgagtgccgtgctggcgctggccctgatcaacccttctcaagccaccagtgccccaggtgcggatcacagccctggctgccatccccgatggattacaagactatttctcgcaacaaacccgaaattttgcgcgccgagggctcgcgttaaggtttcgccattgtcggcgatcagcgatgattatgcaatgttcagccgacgcacccctccacgcagaggtttggccgggagagaccatggcggacctgtgcggctccaactacacggactacgagtttgcatccgacttctacggtcctctgcagttcttggaaattcctgatgtggtggtggcctactaccgcttcggcaatgcatccaccgacttgccccccgtggtcctgatcatgggattctctggtaccatgaagaactggcccatcaccatgctggttgatctggcggaggacagggaggtcattctattcgacaaccgcgggcagggcttctctaaggtgtgaagtgggattggggggaggatggggcatgctcattgttccgatgactccaaggcaaggtagtgcgcttaaggtcagtcaggggacctgaacgcccacccaccctcgcgatattcccaattctggcgcaggacaccagccctgaggtacccctgagcatcgcgtcgatggccaatgacaccaagaactttgtcgaggtgggcagcgggggcgatggggtggtgtgttcgtgggtaagggggtaggggtagggggttgaggtggtggatgtaactgaggtttgataggggaaaaggtggggttagcaagggggcagcgccaaggtggcccttgagtgttgtggcggcccgtgatgcctgcacctgggaggtatcctgcccctgcaacccaatggtacatgtgaacattgaggacgcccgggttttccgtctgtgtctgtgcagccacccaagccctcccaaccctgacccacccataccccaggccctggacctggccaggccgccccacctcttcggctggtccatggggggcatgatcaccctgcaggccgccgcggtgtacggcgactcctttgaccgcttcgccgtcttctctggcagcgcgggatccctccgctcccagctgccctcccctgaaatcatggcggagttcaagggtgcaatccccgtcagtgatgtggagaggctgtcctcgcttttccccctgaacaccacagatggtgggtggcaggggcggggggaaggcaacacggccgccatgcacgagggatgatcaggaggcaaccccagcccctccatacccccctacaggcgcggaggcggcctgcaggtacgcgagggaccttcagtactccccggacgaccccgagaacaagcagggcaccaagaaacagctggtggccctgactgactttgtgagtgctctgctggtgggggtgacgtctcaaattgcctccccaccttgggctccgggcagtccatgctctgcgtgtcagcctgtagggcatccacccacccacactccctcgccaggagacttcttgatcaacactgcatgggcccaatccacctttgctcaccctcacctctgtattcctccgccttgttccccacgtctatctcttcccccccccccccccccccccccc

SEQ ID NO: 25368 - DNA, 79 bp, Chlorella protothecoides
atgctatcatagaaccactagctttcaacttggtcacttctgtaatctttgcgctcattttgagggactggcacattct

SEQ ID NO: 25369 - DNA, 111 bp, Chlorella protothecoides
tgctgcatgctccagcaggccacagggcgccggcgacagcgctggtcccggcgacaccgcagttggaacatacgggcaggtttgaggcggacgggccagtggccgacagca

SEQ ID NO: 25370 - DNA, 61 bp, Chlorella protothecoides
tattgcgcacaccactgagggggggcacgcagtgtttgtccccacgacacgatccctggcg

SEQ ID NO: 25371 - DNA, 75 bp, Chlorella protothecoides
tcgatgaacgggcggatgtactccaggtcgagcggctgaagggtaacgccagcccgctcgagcgtctcccggaag

SEQ ID NO: 25372 - DNA, 61 bp, Chlorella protothecoides
cgtcgaagagaatgatgggacgctggtcggcccccgcccagaactcctcccctggagggga

SEQ ID NO: 25373 - DNA, 163 bp, Chlorella protothecoides
ctccgtcagcaccactgcatgaatgtggggtgtccatgtgcatggtagaaccgtggcagcggtataatagcggcggcgggtcggcacggtgcaacctcgcaaccgcctcagggctggtgtcgccccccctccatcccccaccaagccttacagcaacaggtgt

SEQ ID NO: 25374 - DNA, 139 bp, Chlorella protothecoides
tcgggtgggggtgttccggtagcacggcgcatggccaccagcagaggagctgggagtgggagagaagagcccctgacgcaattgacctccccccatgtagcctccagaatgcgttcccgagcgccagatcatgccacat

SEQ ID NO: 25375 - DNA, 18830 bp, Chlorella protothecoides
  modified_base (8518)..(8559): a, c, t, g, unknown or other
  modified_base (10143)..(10183): a, c, t, g, unknown or other
cccccccctccctctctccccctctcaccttgttgctcaaaggtgctggcatatctacagagtgagggttacaagctgggcggggtccccccggcccccggcgatctgaacttggaaatggaaagtgtgttcgccttcctgaccaacctacactgcgcgagactgaatggcatgaatgccggccccgcccccccgggggttagcacggcggacctggggcggctgctgtggggcttctgcaacatgtttgggcatgccttccgctacaagcatcaggctgtttcgccggcccggggtggcatctgcaagaagttacatgcctggactctggtgtgcaagtggtggattgcaggaggtggagagcatttcttcggcattgctgtgggtggtggaaagttgtgctggaagggccatgacgaagcattggaaaagtaacccccacggaatttgcttgttgccaacactctcttggccagggtgggacgaggttaggccagaagcgacctaagaaagtctccagcacgaccatccgtcacaatccacgagctcccaccgcatgacaggaccaccggagctggtggttgcttgccgtggaggacccgcaagagatgggcaaggacatctgtgcagggagctacgagatccaaggttgaatcgggtgcagggctgtggttggtcctgagtcttgcatgcacagggtctggcggcgagggggcagaggctgtccagtgtagagtggagtttggaaagacgatgggaatgacgcagctgccagcacccgagctggtgacagagagcaagcactaccctgactgctaggctgacggtgcaatccccctaggcctcgactccacccttgccccatggagatgtgtcacacctctcagttggcaattggccccccgcatacttcccggcctcacagctatccgggagatgtttgccgaagtggcagacaagctgggaaagagcctggcagaccttgcagcaatgcagcaggcacggggccgcaagccagcctcgccccttcccctcctgtctggcatcgtggacatggtggccgccgtgggtcgcgacgcgtccggcctcaagtgcgctgcggtgtggctgtggggtacgaggaaagagcgggagggggtgccttgctgtcgcgagcttttctgaaggcgtgccttggacgacatggaggaggcagggctcatgctgatctgtctgtctgcttgccacagcgcaaccctcggcgtcgtcacaggccaggtgatgcttggttctttgcgctatccagcaccctgtgttcaacactgttgcagggcacggcaggcgctggaggcacagcaggccgccaagagcgctgcagtgaagaggcttcgctcccagacgccgcaccgcccgtattaccgcccattcttccgggagaggtcctggggggagagatcctggtggaagaggcgtgagcggtacaaggagggattgctatcctcggatgaggagtggtctgaggatgagtggtaaaggtcccacggcgtttaatcgtcctaccagcccaaaagctccaccagaacccctctcttgcccggttgtgcgctcaaaacttaagcaacgtccaagtcaaaggtcgtccccatgccaagagccgcacctatgctaagagccgcccccatgccaaaagcttcgcctaagcccaatccacctggcacagacgagggcacgaagcggacacggggttgtgggggcgcagtggaacaagaagaaggggtattttctagagagcagatgcatgtgcggcgctcaagtggatctgggggtcaaggagattcccaaggtcgaggccatgaaagctcatacatcctcagaaccccttttggaaagccttgggagccggcggatttgcacctcgtttgtccctgaaacgatgaagagcagctgcaatccctgtcaatgggacgctcgaagtacaagaaggaacatcaccccaccatggcccatcgtccccaagcagctctggcatcagcactgctgctgcacctggcaacgattcctggagcttgtgcaggcaacgagagtctgtgaggacgactgattcacccgctcagctgaaggccaaggcaggtgtggccaagaaagcgcggcgtgggggcgtcgtcaaggacttccagaggatccaggggaaggtgcagtgctagaggcttgtcataggcgaggatatgtccagagacaatggatgtcaacgaacgaggagcaccaatgtccccttgcaatccctgatcctgacctcagctgctaggctgccttgccagctgccaatgaagctctagccatgtccgtagccgcattcgcactccattttcatgggccatgctggcatgcgatgtccctttcccagcacctctggtttgcattatggaccgatacagctgcagctgctgttgtagtcatgttagtcatccccttcaccatgtcgatgcagtaattgtgatgcaatctggcaggcagcctgcaggaccatccttctctcattcatgccagtcctccagtatctcagacgttgggcaagcatgcagatgtcgagcgtcaccctccatgccacggccccggcaggtgagctggggtgttgacgtgtgcggggcactccggcgggccgcagggagcccctgggcgcccaaccccatgtatgcacgctggatcctggtttcatctcattttacatgtcctcgtaggcgcgatgtccggccagaagctgcacagtcccggcgcaaaggccatgttcactgcacgggcattcagggcgcccaagctgccaaccatgcctcatgtccgcgcggcggcgacccaggccgtcgatgcccccgccaagaccgctcagcaaggtgcgatgtgctccaggatcatgtgcatcggactgggatggcttcagcacaggtggatgtcccatccatgcccatggcctggcaggtcactgccacccctgcctccctttccccctcgccggcacagaactggagggtggcgtgacggtggtcaccggctcctcccgcggcatcggccgcgccatcgcgctacgacttggtgccgcgggtgggcgcgtggtggtcaactatgccgcctccagcgccgcggcggaggatgtggcgcaccagatcgagggtctaggcgggtcggccattgtggtcaagggcgacctcgccaaggtgtgtcgccggtgcaatgcgctgagagtatgggaggggtggggaggaggttggcttggctggggagcagacctggaacctgggccgggctggtccagggagcctgggaaacattccatcccaggactctcttacagccacctttgttcgggcttgagaagggattaaactcgcgctcatgatgcccgcatcgtgtcggtcgggggcatcctcctcgctcacctcttccctctctcaacctcctcatctcccccccctcccccttccccaggcggctgacgcgcaggccctgatccaggccgccgtatcggagtggggcaccatcgatgcgctggtcaacaacgcgggcatcacaagggacacgctgatgctgcgcatgaagccggagcagtggcaggcggtgatcgacgtgaacctgtcgggcgtgttctacgccacgcaggccgccacgaaggtcatggccaagaagcggaagggcaggatcgtcaacatctcctctgtggtggggctgactgggaacgcggggcaggtgaactacgccgccgccaaggcgggcctcatcggcatgacgcgctccgtggcccgggagtttgcggggcggggtctgctggtcaacgccatcgcgcccgggttcatcgagtcggagatgacgggcgtgctgtcctccgaggttgaggccgccatcctcgccaagatccccctgggtgcgctggtggtttggtgggcggtgtgcggttgggcggggtgtgttaagaagaggaggggagtggggagtgcagacgttggagccgccccatggggtctcacatgtgagaaccctcacatgcagagctgcgcctacatgcatgcacacagaccctctcgccaccatgcaataggcacgtacggcaagcccgaggaggtggctggtctggtcaagttcttgctgacagaccccgctgcaggctacatcactggccaggtcatcagcatcgatggcggcatgagcatgcaatgaggtgctttgataggagtgcagtgagtgacgggggaaccctcctgcctgccacctgtacggacttgcgacggcggttgcaacagacatcgcttgcaagggggatcaagacgatgcacagcatgctttagatgcagggtatatacagcccgacaaatccggattcagcgttaggaatggcaatacgtcccaggtgcggccaactcctcaagcccactcgatgccatttgccagctcccactctggcagtggcttgacccagagcgcgatgccgccgcccctcccgcgtgccacaataaccgagtcgtcggcgtagacgcaaaggaagaagggactcttgggatctggggagaaagtcctgtaggggtcgggcgggagagcggtgagaagagagctcaggacccaaggcctcgaccaggctcaggctattcttggctggtccaaactacagtacatcactgtgaactgcaatggccactggtgctattgccaccatgcgctttcccatccccaagacaccaaagtcaaacctcagacgcacgtgtagtcttggagcccgggcctcttcagctggatggaaaaggcaaaagggcccagccgaaggcgcaccttttcgacgtcaaaggatattttcttctgcagtcagtgttgggccacgcctagttgatgaaggtgtacaatggcgactacgatactgtccaggtgcaaaacaaccccgctgaatgactttacccagatccgagatggctctgtctcaataaatgctgggtaaaaacaaatcacccactcaccccctttgtggcgtaggggccaacgaaaacgagcgacaggatcctgccgaagaacactccattctggaaggtgcgggacgcgggcgtccagctttgaacagccgtgatggggaagtactgcattgcattgcaggaattgaatagatcagtcatggagaatcggcattctggcagccttcaagggagtcgacaaggtaaagcatttgcaactgaaacattcctccatccacccatgcatatcattaacaaaagcaaggctgagagctcctccgcacaccattactcacgttccctccgcctgtccccgtcttgcgagccttctcgaggtctttggaggtggaggcaaagacgaggcgccaggtgtgccgcacagtctcgtccccttcgttcagttgccgctcccaatcgctagtctggggcggtaggaagcggaggttttgagagtttctgcgcacagcaaggtccctggagtattatcaataccttcgctgattcagtttgccgcagacgactgtgtccaagcagtaaagcttgccagataatcaccctgacatcttactgattgcttggacttctcaagctccatcatggccgagaacacttcggcaggaggcacactcgcgtcactggatgccagcttcagtgactccagctgccgatcaacgtctggtgtggttgcagggctcgagggtgctgctgaagccctgctcgagatggaatgaatgtatcgcatggactacttgcacagcttgctagcatgaaactataccaagcagactaaagcgccgacttgacacgcatggagccgccgaatgccccttcttctcctcacattgccgatagacggatcgaattatatctggctcttccccgtcctgtaatgcttgatggacttccatggcagactggccggtgaagaccggtgcaggcaatcagagccgtcatagccgaattatccaacttcaatctctataatgagaagaaataacctattaatagtagaacgagggcccggggtggaggcagacctcccatcaggtgcggggaggccgtgactggagaatcagttgcacatgaagatccgtgcgcacgtgcttttccgatgtgtgggtttgtatggatccaccccacatgcaaaccacgactacccaaatcattttcagagactctgcaccaaattggggcctttacgccctctaagtgcagctttgaagtctgtgttggtgccttgacctgtgttgagggctaatttgtgtatgtaagtcgaagctgcagctcgtgccaaaacatattattgaatgatgcccatacatggaatcagctctttcatgaacagcagtgtattgtgactgttctgcaggggcatctctggcacccactataccataacaccctggttagggttgagccccgggtttctcctcccccggggtttccggaattcgaaatcgtcagtgtacctgacgcgacgaattgattaccggataaggtggtttgcaacatgtcctcaaacataaaattcacagttaatgtctgattgagtgtctcccagaccgctcagaagcaggtggtgttcccaaggcgactccggtgggttatccctctacctctgacgccccaacatattgcgcaatgctggctcccaccgatcaccggccgagcatattgaggaccccccaccgaggggtggctggaacggccaacgtggagaccgcggagcgtgagcatgagcgagctcaagcccggctgaaggctcgccaagagcagctgtccggcatcgaggcacgcctccacaggagcatgtacgccctcccccatgaagcccagcaagcaaggtgcgtcatgctgcctatcacgcccgttcgttccgagatgtcagggacattgatgtcctggatgacattgtggctgctgcgaccagtccccaacacagctcttcaatctcagcccccatcacgcccgccgccatcaggctggagacacgccaggcactcgaggcgcacaccgcctcccgccggaaggaagaggctgctgcagtgaaggccgaggcagagtgggcatcacagccgtccaaagttggaaggccgcccctcacccagcttccctggtccgccagcaccaccacctacaacctcaccccagagatggaggtatggtttgcatccagctcggagaaaggaatgaatgaaaggttgggcggttgatccctgcagatacttcacccatgccttcccaccctggagcccggctccctcctccccttctgcaggcagccatgcgccggatgtacagcaccaggaactccgaggtgaatcgcgccgagtgcctcaggcggacagcccagtcggccaaggcagagcaggaggagaaactcttggcgttggagcactacaaggcagaggtgtggggggctgacgcggggcgcatccataccctggcaatgggtacccagtctggaacttgcctcagagcctgacatgccctaccgcccaaccctctgcgcacctgcgcagcccatgttcccaagccccaacctctcgacaggatgcctactggaaccgcggggccgccagcgagcggtgggtgtcgccggcccagcgcgtgagacaccacggccccgcacccgccgccggcgcggagagcgaggtgcagcgtgcggcgcgtgcggcgcgggaccgcggggccggcatggccgccctgctctgcccccaagacgcccgggctgggtccggggaccccggcacggcggcgaccgcccggaccgcgcgcatgcattcgcccattgtgcacccctgggcgtgaggcacgcgcctcgaatggctcatcgcaggggtgttctgggtcggggctgaggacgcgggcatcgcgtgtgcaactccagggcagcatctgctggtcatgacagtcggacaatgccattgctatcagtgaaggtgtacacacagccagcaaggctccggccagagcacatccaggctcaattcggaaagaagggcccattgcatttgagcagcaggtctgatgccacggcaggctctgggcattggcggagaccgcagctttgaaaattcctgcaccagcacccctggagcccttggaggtcacgcttggcgcaggggacatccccctccacgccacccctcgggcggccctacagccagccgccgccggtcacctccaggctctggcccgtgatgtagctggcgtaggggctggccagcagcagcatggacccggccgcctcctcggggctgcccttgcgccccagggccaccatatcctccaccctggcgcccttcatcaccgcgccggggatgcccagcggcacgcgctcgccgtccaccaggatgctgtcgccgcgctccttggcctgcaccaggcgtgtgttgatgtggccgaaggccagcgcgttgcagcggatgttgaaggtgccccactcgcgcgccaccgtcttggtcagccccaccacgccggccttggcggtggagtagttggcctgccctgcactgccatgcgtgcctgggggggggggggggggggggggnnnnnnnnnnnnnnnnnnnnnnnnnnnnnnnnnnnnnnnnnnctcaaaaaggcaaagaggggattgaagggaaactcggcacaaactctccttccgccctgcggaggacccactgttctggtcttctgcagtcctgggctccctgtggggctgagcacctggtccactgactgccgcattctccctcctgcccacgccatctactcaaatactgaaccaccaccatctcttgtcacctcccccccccccccttccgcggctcaacaaacccaccagacacggaggagacgttgatgatgcaccgcgggcgcgccttgccgctggcctcgatctcgcgcttggcggcatcgcgcatgtgtggcgcggcggcctggatgaggcggaagggcgcggtgcagtgcacgtccagcatggcctgccactgcttggcgcccatgcggtggatcacgccgtcccaggtgaaccccgcattgttgaccaggatgtgcaggccgccaaaggcgcccaccgccgcggccaccacgccggcggggaagtcggggtgggtcacgtcgcccgcgtaggcgatggccacgccgttggagttgcggatgaagtcggcagtggcctgggccttgtcgccctccaggtctgcggcaaccaccttggcgccgtgctgggcgaacaggatggccgccgccttgccaaggccctgccccgccccggtgatgatggccacctgaacgggggatggggctggaatgaatggaaagggaaatgacgccattccggcacatggggagacgggccaatggctgctcctcctcgaagtctctccccacacattgcaaaatccgacacccccgcatcgcgacactgctcccgttccggaaatggtggtagtgtgttcccagtcgcgatgccgcacccgtaccccgattacctggttcatcaacaggcgaccgggctcgtagttgtaacactgggaatggaaggcgtcggcactggtgggggcattgtccacgccctcctgggacgggctctccccctgtagatgggaggcgatgcgccccactcgtcccgcagcggcgtccattcttaagtgaaagatttaatttgtatatgaagattcaagacccgggggttgacccccatggatgcctctcatcatcgcccggtgctgacagggtgaatttataaacaaggcgaccggacccgacgcgcgcgcacggtttcactgcgcccttgacgctccccagggtctctgtcgcggtctgtatctcacaacaagggtcaagcgccgcgccgccgcggctcagtgcgtcaggtagaactcgtcgttagaaagcatgatggcacccgccgcctccagcgcctccagctcggcacgcacctgggccccgctcacgctggcgtcgccctgcgccctcagcagcgccagcacccccgtcacgttgcaggcctccgcggagcgctgacccagttccagaaccgccgcgcgcacggcggacgccagctccctgatttcctcggccaccggcggcgcagtggccgcgccgctcctagaggggccggccggcgcatcctcggcatcgctgatggcctcgtcctctgcttggagaggggggggggggggggggggggggnnnnnnnnnnnnnnnnnnnnnnnnnnnnnnnnnnnnnnnnntgagtgtcattcagaggaagaaggctcgtgcacaagcatacagcgtgacgcctgcatcttgcatggagaagggctccagcgcagagtagccaagttctcgtgcggatggccccagcgcctccttccccacatcttctcaactcccccccaatccctgcccaccctggacgtccatgggctcggcagcccccgcagcgccttcggcccctccctcctcctcctcgtcgctgatgacggcgtcgcgcgtgcgcttggcgccgccggccttggtcctggccgtcttgtgcgcctcctgggccgaggggtcgctcttcaggatgaggtccatgatggcgatcacctcggtcacgtcccggggttccacataggccgacaggcggacctgttgggaagcaaagggtggtgtgagaaggggaaagttggaccgtgaggtggtctgcccgcggacactgtccgcgggtctcggcatttatctgtgttgaaacacatcagtgatcaccgccgctcgctctccaaactccaaccctcctctcgaaccgactgttgtccagaccacagcacgccactctcccccccccccaaccccccgtaacgtcacagaccttggcgtgggcgcaggacaggcggatgagtgtctccagcgtccgcacggtgacggggagcgccttgacctcggggctggtgcgcaggtcggcgtagtactcggcgatggcgtccgaggcctcgggcgtgagctccggcgcggcaaagcgctgcttggcaaaggccacgtactttttcaaaaaggggatggacagcggctcccgcttgccaggctggcgtgggccgtacagtctggcatcgtaccgtacgtacatgggcgtgatgccgcgctcccggtcttcgtcctcctccaggctgggtgcgaggtgggttggggaaggggtgacagcgttggtgcagggtgcatcagagagcgtgggtggggaaggctcgatggtccagaggggcggcagcacgaggggcgcaacagtgaatcggcgaccagggtgacccggctgggaattttgtgtcgaatcgacgagaacacggtgttccacctggtctcaacccaatgcaacacccaaccccccagccgcctcacttctcgacgtagcggtcgtcgccgccgttgcggccgtcatccccgggcgcgcggtaccggtgctgacccagcacgtgctctgcaatctgcgcggggagggtcgatggagatgataagcgtgggtgagctgagacaaggatgccacagagctgcctgccccatgtgctgccgggcagaagcagggaatcactggctgagtgcctgcacatgggaaaagcacggcggacagcagcccctttcccccgcaagtaccacccccccaccgacccgacgcgcctgtctgtcgcgggcggcgtcgttgttgtccaggacgacaaacaggagatcgaaacgggagagcagggagtcgggcagcccaatgttgcgggtgatggagatggagcggtcgtagtgcccatagatggggttggcggcggccaccacgctatgagtttggtggggtgtggaagatgggcaatcggaatgtgggagaagtgggaccgtgcctggggctggcagactgcagcgggcacgcctggccgaggcaaggtcgtgctgctggccccaggcacagcaacagcaccctctgatgctgtgtgcgcctgtccttcaggccagatgttactcctcaccaccctcctctcggaccttgcctgagcctgtaacccttgccgtccccccatcccaaactcctcctcatcacacctgcaccgcgcattcaaagacgtcatgatgcccgccttggcgatggtcaccgtctgctgctccatgacctcgtggatggccacccggtcggcgtcgttcatcttgtcgaactcgtcgatgcagaccacgccgcggtccgccaacaccatcgccccggcctccagccggcgctcacctgcgcgagtgggtggggggttgttgggcgggggttgccagcagaagtgggatcaggaggagaccttcgccgtgggggcacaggggcgccagagccgaggggggtagcaaataccattccagttcctggactgcaggctcgaccgtgcacctgacccctaccagcccctgccaggcctgcccatgcatcccacaaattgaccctggcctccaccccccctgaacacaaccttgatgaaccccccgccccaaaaaagccaatccacaccctcacccgtgtcggcgtcggtggtgacggcggcggtcaggccgacgcccgaggagccgcggcccgtggtggacaccgacagcggcgccagattcatgacggcgcggaggagctgggacttggccaccccggggtcgcccaccagcaggcagttgatgtcgccgcggaggtgggtgccgttgcccagcacgcgctcgcggccgcccaccaggagcaggagcagcgcgcgcttgacccaggagtagccgtagatggagggggccagcgacccggccaggcactccatcagccccgggtcctggctcagcgacacgatgttgtcgtagtcttcgcctgagaaggtgggggaagtcgcgtcggccgccaggcgcgacacgctgttggccatcacaattgccctgggatgtggcgagagggggaaagtgtgtgtgtattgagggggagacaggggggttaaatgggtgggaacgagcacattcacaactactctgcagcctcttgagacccttgaccctcaagtgtatagtaaatccccccctcctcctcacatcaaaacccacctaaacacagcggagctggcgccggcagtggagggcgcgatgggtttgtacacacccacgatcctgacccggtcgccgggcttgcaggcgtcacgcaggtcgtcctccagcaccacctcgactgcggtggggaggcaagggggaaaagaaggtaggggtcaaacaacagaagaagagcgtatgcagggattgcacgtgcatgaggtgggatcggtcgccctcgacaccctgccgcaagggcgctcgggcgccggcccaacacatcgccctggcgcccgatccacccacctgatcgtgggagctggccggggggcgccgtctccggcagctcctggatggtcacggtctggtggtccacgaagctgctcatgccgtactgcagagtgaacggatatgcatcgggagggagagggaccggtggtgtcttgcgtgtgtgtaggttgccggcagcagtgcctggcatcaactggctgtgccggacatctcggaccgagcagccaccaccgggtatgacctcgggttctggccgccacagcaacaaggttcgggcatagagcacagcccgcggtgcagctcaaacccctccacccccacctccccttcccatcccatctcccatccccacctcccccaaaccccctccaaccccccacctgggtcgacagcaggtttccctgctcgtcgcgcgtggggtagacggtgctggtgggcaggccctcgatggagctggcgtcgcgatactcgcggctggtgaaggagttggtggcagcgcaccagtgcacgctcttgaccaccttggggcgaaccagggtgcagcgcgtgacgatgccctgcagcgacaccagcttggacaggaactggagggaggcaagagaggaacgaatgtggtgagaaggggcgtcttcacggtcatgcataaggagggatcatgtggttgtacctgcaccgagagaccaaagtggagtcggacacccaaacagattgcctgcaccccctcgaaacctgggagttcatgtctcggggggagacagcgtggcggccaaattcgccgctgaacccgacgtggaccctctgcccctcctccagcagctgcaacggcggtggagttcagagtgattgatcaggcagttgcacaggctgactcaccacgaggtcctcctcagggtgcctaggacgagtgaaggtgtccagggctatgacactgaacaccgactcctgggcagagcacactgaattagagagacattcctttatcgaacaaacactcttctccattgtctccccacccacacgccacgccccaccttggggctctggttgcggatcatgtcctccagggcctcggcaaagggaggaatgcagtcgcccggggactccaagacacggcggtgcaggtctggattgtactcggagagatctggggcgtggcacggggcaggaagatctctggagcggcgaattctcgagtggagggtcgcaaacaggacggtgccagggaagtacgcttgtaccgacaggccgtgcccagtgccacccttgccctgataccactccccaacggaaggccccaccttgcacatcgacatccaggcgtatggtcttggtggtggggtatttcttcatcatatcctcgatcttcttgacgtacttgccctcgcccgtatcccttccgtaatcgctgtccaggaagtctgcaaagtcgcgcttggcctccagccgagccacattactgtcgtccagcgtcgccatggcacttgggcgatgcgttcacagcagtataggttctctgaacttcaagaaaaatcaccagagtggtaaaggggattgcaactggggctaggcgtgacagggttcgctcctcagccgggaccggtttgaaatttcggacgcgcctgttgccctgaggggaagggtactgaccattgcgtgtggtactgcgcgagcttcaccttcccgttccccctgcattcagagagcggaaagttctaatcagtgcatatatccagacaaccagaacgcaatcttatccctatatcatatcgaccgaaacctcccctgcaaccttgcctggctgccaaaacccatgttgcgcgctgccgggtgccacctgcgtagcgtgctcgctgtccacgaggcggtgggcagcagcagtggcagcagcactgtgtctctagatgggatccggagtgtgacgaccagctcttactggcagaggatcatgacgcctgcctctgtcactccccgaccctcagaaggcgcgtctcggtgtgggagttcatttgatgggatttcctcctgattctttcaccttgaggaccaggcttcatcgcatcctgcacattctatgtcaccgtaggtggcgagaagcctgagcccaagccagaacttgtggaacaggtgaggggggatagtggcacagtgtctagatagactattggcaagtgctcctgtcacctgtgcatcagggtgctgcttgcacatgcgacgactgctcacaggacacttgttttcacacaaatctgctgcagtacctcagcacgagcatgctgcctcggcgtgagcagcaccggctgcagttgcgggaggtgatcaaggagtttcagagattcccaggggatgttggctcctcagaagtgcagggtgagtgccagggctattattcatggtggtcaggaatgtacatgtttacttctacaatggtccaagcgagcaatctcacactcttcggcatcgtaatgctgcgctatgagatcaagtgtgcaaccctccgttcggtttccctcctctccatctcatctcagacaaaagccccagtaccatgattcctaccgcacatattccatcacgcagttgcacggctaacacgcaagatccatgacctggcagagcacctgaaggtgcaccgcaaggaccacagctccaggagaggtctgcagggcttgctgagtcagcgtcgcagtctcctccagtacctgcggcggagcaactttgacacctatgccatgaccatcagcaagctgggcctcaaggacaactacgcacagaatgacaggttcaccgtgcgctacaagcccctggtcagggcaagcgctcacgcctgaatgaatgcctcaaatcctgcactgctcatttgtgtccttgaaagtcctggcaagtctttacagacacttcatattacaacatggctgcagcacgctgtgtgaatggagagcacggtgcagctggcggctgacgggagcaaccgagaactgagacgaatgttgcatgtgctgctgtgccactgagaaaccctcctggacacgaatcattatcaccaattcatcaagccagctcgtaatcttgtgagctttcctaagcccaacatctgaacagtttattgatgcatcctatcatcgtttttcaatgtagggccacctcgagcactccgtaatgtcctggccggatatcctatgcctctggcggctgggttcggcgggctgtgaatttccatgtcgactaattacggctcccaccattttcaacacgatgtggccatgctatctggatgtacattagtaaacaatgataaaatgacccttcaatgattacagtcaggccgttacaaggcctttctgactgtgagaaggtggtggaactcacagccgcggcattcccggaggaggtgctaggctcaggccttacagccggatcctggcgagagctcgagctcgaagacctggtcaagcaggcatggtgttggccaaacataggtgaggtctgggagggtgcggcatcattcttcgctgcaacgcagggtgggtggatggagtcgacctggcaatccacgacaggtgtcttagggtctgctggtgggccgagcccgccccttcttaattgtgcaaagcggctagggtaggtcacactcagcctgatcaacatatgcttacctcgattgcgtgccccgatcattaggtctggcctgtcgggagaatggaagtgtggtgggagccgttgtcctggccttccccggtgatcttgacaccggcatcacgtatgcagacgtccgccatcgggtggggtgcttgcccacgctttggaactgggcgtacgatcaggtcctggaggagagactcaaggtgggctgttgtgcagtctctgccgttcgtgctccatgggtggggttcctgttggccagctccccctggggaacaggggtgggcctggagcccaccaacacatgcccttgccccgccttgcctcccaggactacgagtgcctggtggagttcatcgccgtcacaccgacggcacgcgggcagggcgtcggcaccgccctcctgcgctgggcagaggaggtggccgtggccgggctgttgcagcgctggcccctctccgtgagggccatgggtcacatcaccatgactctgtgggtgcgccgggggaccgatgggaaacacctttccagtgtacagggcagtggtgtgtggaacaccgcgccaacacctcacacagtcaagcacctgccctgctcaaaccctatggtacttggtgccccctcctcctcctttcctcctgatagtctgccgtcgcctcctcctccgcccacacccaggtggcagcagacaacgcgccggccaccagcatgtatgcgcgccaggggtacgccaccacttcgcgcaccgactgcggggtctgcgcctgcctgcacgcccggcttctcaccagcttcctggggcacccagtgtgggcccacatgtcgcgccaggtgcccgtccccccggaggcgctggccgccctgccgccggcggccatggcgcgcggcggggcgtcggcgcgcgaggagctggtggaggtcagcctgcacagctccagcgccggcgccgggaagactgccgcgccgggccccctgctggcggcggccctcaagcgccgccagggctctggcggtcaggagatcgcgctgacggagcaacgcatcggggccctggccggcgtgaggcaggtgtcgggggcggtggggccctcaccctccccctcccgcgcctggaccagcggcagcgaggacctccccgccgcaccactggtgctgtacgggggggagggccgcggcggtggccagtcggagggtggaggcggcaccgcagcgcccgtcacgggctggtccgaggggttgggtgtgccactcgaagacaccccggagcctggtgcgttcccagaccctgtgctggccttgccccgcagtgaacacggctcgtggtgttgacatccgaacgcgatggtgcaagtgagggcaaggtttggggagaggcaattgaatgttgggcaggggaacagggctgcaggaacagctgccacacgcagtccagaatggaaatggggcagctggcaaggtggcccaccgctgccagggacaaggatgttttcatccccggccgacactgcgtctgctggcgaaccaaaagcattatcgacatggcgaggcgggagccccggccaagtcaccaggccccaccgaccgcctggaggacggtggtcgccgcctcttcgacagctgcttccgggatccacagagtgcaggtgcggggcggcaagtccctcccagccgcgtctccttccgcggtgccgggcgccgatgccaccgcagcggcaggcttggaggaggagtccgggctcggctgcacgtccgcgtccgccacgctggcggcggtctccggggctggcgcgccggccgctccgttcgcaccacgcgccccgtcgggcgcggccagggcccgcaggcgcctcaccagctcgtccatccacgcggggtccatcggcgcgggctcggcggcgccgccgggcgcctctgccgctgggccgc

SEQ ID NO: 25376 - DNA, 72 bp, Chlorella protothecoides
tatattccatgatgccccatgcaaggatatcaacaccatgactctgtccccgaacctgcatgctggggtgtg

SEQ ID NO: 25377 - DNA, 64 bp, Chlorella protothecoides
gtacgctgacggaacagccggagcgtacgcggccgatgcggaggcgtacagcgtcgatgcggag

SEQ ID NO: 25378 - DNA, 80 bp, Chlorella protothecoides
gcatccagcaggtcgatgaggcgggtggaatcaaatacgcggctcttgccataaatctgtgacgaggagtggtcgtgagg

SEQ ID NO: 25379 - DNA, 62 bp, Chlorella protothecoides
cctccagctacactgggtatctctgtgaccaacctgttttgtgatgacatccaaagaagaag

SEQ ID NO: 25380 - DNA, 105 bp, Chlorella protothecoides
tcgccaaagttgttctttcccttgttcccgttgccaatgttggcgtccttgtccgcagtgcatgccttctgtctcgccttgaggcattcgagggccaccaggatc

SEQ ID NO: 25381 - DNA, 100 bp, Chlorella protothecoides
agcagccgtcctggtctcctcctcaaggccagatcccattcacaggcaagcaactcgagaaagggaaaaggcagctctggccgaagtgctgttcaaggag

SEQ ID NO: 25382 - DNA, 102 bp, Chlorella protothecoides
caggggaggggtttggcagggggtgcctgtcgtccccgtcgacagcttctgccacggaccgctcagctttgattgcctggacgccctatgataggcttgctg

SEQ ID NO: 25383 - DNA, 61 bp, Chlorella protothecoides
cgtgctgacgaccaaggagtacatgcgcgttgtgtcggagatcaagcccgaatggctggtg

SEQ ID NO: 25384 - DNA, 132 bp, Chlorella protothecoides
cagcggaacccttgtgctgtgcaccactatcgcccttcctgctcaatgcacaggtcttcgaggccaaggcgctgccagctgcgacgctcaccaccagccccgccataaagcccgaggctgggctgcaggcga

SEQ ID NO: 25385 - DNA, 214 bp, Chlorella protothecoides
ggcagcagatcttggaaccccagggctggtggcacggcttggtggagccctgtacaaggttttcagggtcttctgaggcggactgtgcctgcaatgcctcagcactccctgtggggaggcactccagttgcaccagcagagagcaatgcaacggtgggagcatctgccctccagggtgctcaccgagccgcgcttttgcgtcttccagcattta

SEQ ID NO: 25386 - DNA, 77 bp, Chlorella protothecoides
ttgcaaagctgcacaatgcgcagaggtggggagggcacgtggtctcagtcgccgcaggtcatcctgcgattgcggga

SEQ ID NO: 25387 - DNA, 62 bp, Chlorella protothecoides
gtcgccgcaggtcatcctgcgattgcgggagtcccgtcgtcgtgccatgctggtgcaatgag

SEQ ID NO: 25388 - DNA, 30607 bp, Chlorella protothecoides
  modified_base (153)..(204): a, c, t, g, unknown or other
gggcctgcgcgcgcgcgacggcgcgccgccgggcgcggccgccgccgccgcctcggcggaagccgcacagcacttgggccaggccatgctgagcatggctgccgtcgtgccgggggtggcctccatggtggcggccatcacccacctcctccnnnnnnnnnnnnnnnnnnnnnnnnnnnnnnnnnnnnnnnnnnnnnnnnnnnnaggcgagtgtttctgatgcgggtggggtgatggaaaggggaaacagggacacgggggcggcggtaggttggctgtgcatcggggtggaccacgagcatgtctcggggctgatgccgtcgaaattgctgttgccgggggcagcagtcgtcggtgctgtactacgagagaggacagaacccgggctggagcaacacctaacccccaggcttgccgctaccaaacccaaccacccaaacccgtccatatttcccgccaggcaaactccctgcggtgctcctggcgccagagggatcgacaacaccccacccccgcccgtccccaaagcacgagcatgggggtggcgggcaggcgcccgcagccttacaatccagcctgggcgacgtcctgcgcgcgcggctgtccggcctggcgccgcgcggccagcgcttgaccccgggaatggccggtgcgtgggatggggcgaggactgcatgcaggaatttgggtcctttgacgtggcgagggtggataggtcctcagaagctgagcccgcggaacggcgcgtgactggcatggcactgggcggcccatgaattcccagggcctatctgcgatgggcctttccgcaaccccctccaccaccacggcctgctgcaccagggcacggcgtgccaggcggcgcccaggagcaccacgaagggaggagcgaggacaaccccctgtcgttcctggccatggctgcctccatggacgccgtggagtaggcagaccttggcagacagccgcgcttggaaggataccgcagcgtggcagcgggcggggacatgcagggtcagtgcactggagtgaaacggagagcggaagcagccggctgccagcgcaggattgccctctcacaaacgtggaccctcacacctctcatcagcaggcgaggcactcgctatcacaatataaaacctgcaggacttgaaatacagcacctaggtacgttgcccatcgacagtcagccctttatgagacattgtccacaacaactgggcattctcgcctccccagccccttattggggaagagagcagcccatgcgcatgcccaaaggcgctcaagcacccttgccatttactcttggaacatatggaacactgcacctgttaacatgatgttgtggtcaatttggaactctggtggactggtcagtgatctcccggactcagcacgacgagatggccaagaggcgcccagcgaagtcacgacgattccgggcgcgacggagccaaaccccaatcaaacgtgtaccctcctctgggaaaatcagatatcttcatcacctcttccacatctagtgtagtgtggataaaggccaggtggtaccaagagttgtggggacggactttggtgtgtaccccagcgacaacaagagacccgcaacgcgttcgacatctcgatcagcatacccagcaaactctagaaatcccttgcaccactccctgagtgggagtctgccggtacaccgtgcccatggctgaccaggcaacaccggagggttccctcatagccctcatcgcagaccaggatacggcaacgggcctgttgctcactggaatcgggcatgtagactatcgtaagaactccaacttcctcattgtggacgagagtgagtgggaatagggaatggacggttagaagtgctggtgttgctgcctccaggtgcagttgatgcttcaaggggactccaaatccctcccaccccaccatccctccacagaaacaccacaagggaagatagaggatgccttccgtgagtttacaacccgagacgacgttgcagtggtgctaatcaaccagtctgtgagtgcctgattgatcttggccattggggaaggagtccttctctgccttgtcagaatgactataacctcatctctctcacttctatgtcttcattgttgcatggggtggtatcgccctgcgtgtgatgccccatgtttgtttgatactggcagaattggaccaatgcccacacccatctttcctctgaataccacaacaggtggccgggaccatccggcacctgctcaacaactacacgaagcccatccctgctgtgctcgagattcccagcaaggacactccctatgatcccagccaggattctgtgctttcaagggtcaagtttatgtttggcgactcctgaccttgtcatccctcttggccctgtatagtatgcgcttcctcgactcggactcggcgcgggcaggtttcacaggcttgaatttcagaggctgaatcgcagggacggcacatgcaggcgacaagattggtcaaccagcaaggattctttcagattcatagtttggtgttttggggtggttcattgcggctggcgagttgagacgctcagcagctgctccgaggagagcagcatgaagtgcacacggaaactcgtcctcgtgaagaagagcgcagcatcccccgggacagcccctcgcctgctcacttcagcgtctcgatggcgtgacggacgacatggaaacccctgcaattattgggttggggggttgccgggtcaacatcaagctgggcgtaagcgattgcaacatcagcatattgaactccctcgcgttcaccaacatctggaacaggaaggcgagattgctaaccctcaagtgggcaggcttgcgtttgacttccaaaggatgtggctggtacacaagaggggtaatcgcaaggtccagccttggctcacacaagggtttgaagatgtcctgcagtcctgcgattcccacacatcaccagcagtcctcccgcccccccccagcatgtcccggcccccgacctgatgacttcctcctcgggagcgcccttatcctcatccagcggctcccaggtccagccatcgttggacacggtccctgcgacaatgggcccttgccctgctacttcgacagcaccccgctccagagtcaaagactccaggctggtgttgggttcagatacgatcagcactgtgtcctgtcccaggctgatggcagagggctttggcagtcgtgcctgcacgggaagcgggtgtggttgcaatgctgccaggcatcttctgcgcagacctgaggttgcagggtctgtgcccatcatccttcccccccaaggacgatgatgatctatcaagaaggagcatggacttccctccctctcccctctgtgcaccccgtcagtgccaggtccccacaaaaggggtccaccccattcttcaaaatcatcacaccttcagctggtcgaatccgatggcccaagcaggtggccagacgacgcggggccagaagtccagatcctcgagaccgttgaaggaggcgctggaagggccggcgatgcacgctcccacatgctccaacatctgccgcatgaggttgaggtggagtaggatgaggacattgagaggctcaagctggcggcatgggcttaggcgatactgtcagcactggtactccacaccagctttgaaaagacagtacctgcacgtataaacagcaccacgacgagtttatgatggtgcaacgtccaactcaccctagcaagtacctcagcgactcactgaacgttgcatgggcataaaactcccctcaagtatacacactcacacccctgtctccccaaccaccttgcagttcgccttgtagtaatccagctctccggtcgtggcggagtgcgaggggttgccccccgccgccttggctgccgcatccgctggcgagttcttgacgggggagtaggcggcccagacctggttgatggaggtgtaccccaccctggcagtggaggggaggtccttagggaagtcctgcatcatgcactccaggcgcgtgctgctcttgaagctggtgcggccggcatcggcgtacttggggttgacaaactccccgatcacgccgcccttcttctgcagctcctcgcagtacgagtccaggctcacaatgagctggttgatgttgcctgcgtcgagtatttgggggagtaggggtgcgctcagatagactgcactgacttgggtgctttgggatgaattggtaagttcagtgtggaggcattcaacaggctgagtccctggggaaggggcggcatgttcccacaggacagccatgatcctgcagagcttgggctggcacagcagctgcacctcatgcgtctggatgctgagccccagtcacctgggaagggcgagaacccggtgtcatcattggtgtccccctccgggtcatacgccgcgcgcagcagcgggtccagctgcatgtgtgtgaagggagaggaaactggggtatgtaaccgctatggagtaaagcaccattttcaagcgtgtttggtgatctgctgcaactcccgactcccagactcgtatgcacacagatgcaaatcaacctccttcccccctcattcttccccccaacccacctggttgtactcgacgttgagggtccgggaggtgccgtctgggtaggccagcttggtgatggcaccgatggcctccttggcgcggcgcggcacggccagggagttgaagtcaaaggcgcgcgcggcgctgacccccagtgcggcggggatggcgcggaagaccagcgcattggtgtcctgaaagaagaccgcccagcgcaggccggcgtcgcgccagcgcgccgccaggccagaggagtgcagcagcatgtgcacgtcaccgtggccgtgcggcttggtctgcacggcccaggcgtcgcccggggtcagggccaggcgcgcgtcgttgtcggccagacaggccaccttctcctgcttcaccagggtgacctgggcggggtctgcgccgaagaaagcgtgggagcgcagcagggcctcggtgcgggcgtgggtgtcgtcgctggtcatgatggccagaggtagttggcgcctgttgccattcagagccttaattgcgggtgggagggaagggggggcaagggcattggcacttgggtgcattgggaggtggggcattgatagaatgggggtcctggaggtttgtgcagcaggatgttgacgccaaggcagacaccacaaccagcacatctctaggtggagactctcaagaacaagacaggggcgcacagggactgccgaatcgggaggccaaccttggccaagaaagtgctcaccactggccatgcacatcaatccgcacacacacacacacacacacattctcacacacctggagggcaaggatgctctcgatgtacagcttcaggtagcagccccccgtggcgctctcgacgggcagggccagcttgatgccggagtaccccagccgctcaccgaggcccccggccaccagcacgaaggcggtgtctcccgcagcggcaagccctgacgggttgaggaacggtggggtggtaatactgcgaaatacgagcacatttagctggtttctgcccgtatcgcagggcgaggagccatcctgcagctgcccagcacctgggagtgaagtctcgagaaaaaagatccatgctgccaccctgctctgcaggcgagggcccacctgcgttctcgagctcgatgaaggcatcgctgccggaatccagcttctccccttccgggacagaagggacgcagccctcaaaggggttggaccctgggagaagatagggtgtccgtatattgtatcaggcagtgctgagaggcactccctatttccccatgattgccccgctattctcccaggggagcatcaaggtgcatggggtttcctaacccacccatcttggtttgcagcatgcacaggcaacacaccttccttggagtccttcaacagcttcttggcattcgaaatgtacttcaggaggccaccggcatagctggagtccagctgccgcagctgagcgaggagacggcgcttgttgtcgtcgtccttgccaggctccggccaccccgaaaacaggtgctcctgcccggcatccagcagggcgctcaccaagacgcgcgtctatgatcaggagtagcatataaaatatacggaaactatacatgataacgatcgggatcgtgggttttattcaagttagcaaaagggagacccctgctatatcgaaagcgtacctcggcgtccagcagaccctcattcgccttgagtatgtccagcttggaggcaatcgcagcagccatcgatctagaaatgtattttgagataaatatggactagggttgatgggccttggaatgccgcattgtgttgattccgcgctctctgccgagacacctgtgagtggcgcgcccgcatgaggatcatgctgatcggtatcgccgagtacaacagcgggaaggggcaacactcgcagagcgtgtcacatacaacaccgtattgagcaaaaatgacggtttcgggcatgtcgcgggtttccatggtgacggcagaggcaaaaatgcacgcagggcgttgcttctccagcactccccctcgcccagcccacagggcttcgccatgcacgcagcggtacgtgcacgaggatatcgaatctttttcaagctgctactctcgttgcatggatgcatcctcgctgcgtgcgcagtgccttcccggctgcgccatcattgccagggtacacgagtcctagccagaccccatatccccacaccctccctcaggggtcccgcccgcccgtccaagcaccagcgcccgaggtccttctccgtcaacggcacctccaagctgtctgagagggagaccgcgggcagcaccaaggacgccagccccttcaccgtgggccgcctcttcacgctcaccacctggctgctggagcaggagaagcgggaggtgatcgactcggaggtggccatcgtcatctcctccatcgccctggcctgcaagcagatcgcgtccctggtcaaccgggcggggatcagcaacctgacggggctggctggcgctgccaaccagtctggggaggatcagaagaagctggatgtcgtggccaacgatgtttttgcaaactgcctgagatccacgtgagtcgggaacttccgatgagtaatgggcctggggtgcaaggctctcggcgcccttgatggttcaggacgggtgtctacctccagctgggggccgtgcctccagaggcagggcgcccccttgcgtggccccatcctcatgccagcgcatgaatacccacgcatgtgtccaggggccgcatcggaacgctggcatctgaggaggaggatgtgccggtgtcagtggagggctcctactccggggactacatcgtggtgtttgatcctctggacggctcatccaacatcgacgccggtgggtcggtgaggcgtgtctctgcaccggctggagcagccggctcaagcatgtgaacctttgcgactgtgcatcctccatccatgggacaccgcgcccagccccctcgcccctgctccttccaaaccccccagggatttctgtggggtccatctttggcgtttacgaccccagcgaggagtgtcgggtggacgagcttgacgacgccggtgggtgacgcgtgctgagtgcaccggctgatgagagtgtgcgctcggtctgggtccaggcactcgaatccatgtgctgcacctcatgctcatgcaagcgaggtgccggacccacgcatccacccgtccccatgctttcagaggaggtgctgaacaagtgcgtgctgaatgtgtgcaaggcgggctccgagctgctggtggctggctactgcctctactcctccagcaccgtcctggtcctcacagtgggtgagcggcatggtgtggatggacggacatgcatgttgcgcggaagctctgtggccttccggggcatgggcactcgggcacagcacagcgcaggcagcctgcatcaatgtgcacgtaatgcaacgacagcccccctcccccctcccattatgtaggcgacggcgtggtgggcttcacctttgacgccctggtgggcgagttcatcctctcccaccctgacatcaaggtcccagacaaaggcaagatctacgctttcaacgagggcaactacggggtgagttgccggaacgatgggctggccatgggagggcagcggtggctcgcatgggacttttattgaggtgttccctgccccattcaaggtctgcaatgcccgcaggtgccctgcccagcaccccatcatgcacactggctcgtaactccccccgccccccccctttcctctgcacagcgctgggagcaaggcgtgaaggactacatcgactcgctcaaggacgagagcaagtggggcgggacgccttactccgctcgctacatcggctccctggtgggcgacttccaccgaaccctgctctacggtgaggtttggctgtggctaggagacctggaagcgaggaaggcagccgggtggtcatgcatgtgagggctcggtgctgcaggatggtgctgtgtgaaacctgtgcatctagaacgggcagtggaatctgcgcggtggtcactcttgcatccgtgggtccctggaccccgccgtggcacccgtcagtttacccataccgcacctcaacagggggcatctacggctaccccgccgacacaaagaacaagacggggaagctgcggctactgtacgagtgcgcgcccatgagctacctcgctgagcaggtgacttggagggtggtaagatgctgtatcaccgatccctgcacggtggctgagagcctcgatacccagggttactgccggccgcctccgtagatccacagtcggcatggcctacactttcgccgtctcatcagcatcccagtttgccaatgtttgcttcccttcacccctccaccctctgcaggctggcggcctgggctcaactggcacccagcgtgtactggatctggtgcccgagaagatccaccaacgcgtgcctctcttctgcgggtccaagtcggaggtggagtacctggagtccttcttcaagtgattcccagccctcacagtccattctttccagtcactgttgcaactgagccgagaggtgccagtggagaggccgagcagggagggtgggtgaagtgagcggcgcatggctggtcgcaaggggaggcgctgccaagaaatcaaggactctgttggccagtcaggatggcatgcaccttgggggcccctggccccaacggtgcatgcctggcccaagttccagcctgctaggcatcctggttgggctggcgcagcacaaacacccggtccgtctcctccaggatcgcgctggctgcggggttagtcaccacgtagggcaggcggctgctgggggtctccgactgagccagggagggcgtggatgagcggggtgtggggcgccgtgcccacagcgcgacaatcaaccacacaagtacgtaatgcccttttgcgaagcagaggcgcttggcgcctgccccttcccggcaaacactggctcaccttttcacggaggaggccgaggcagatgaggccctgctcggcgaggaggttgtggaacaggaccccgtacggcttcccacggtgctcgggcggcaccggtatctgcagcagcgccgcgccgcccgtgccccccgaggggccatctcccgccagctccgccagggtctcacgcggcaggcccctgcgtggggcggggcagagattctcatggcgcatgttgaacagggcaagcatgtacacaggggcatagggtggattccaagtctcagtgtgcaagaagtgccccccccccttcaccccccacgcaaagtatccacctgttgacaaagttggagcagaggaaggcgtccatcagggcgggcacggtcacgcgcccggcgcagtagtagggattggcctgccactcggtgagccccgccgcgaccgaagcggcctgctgggaggcgcgcagcgcccaggagcggcgtggcacaccccgcacgtcacgtgaccccacgtccccaaagtccacgccgcggagcagcaggccgggctggaggaacctggggcatgggtccagggtgggagggagggggggaaatggaaatggagggtgaccagccaacgggagggggaagggaatgaattagggcagagcaggacaaggcgtgggaagggtgcatgccagcctgtcggtcagtcctgcctccaggcagagactatgcagcccctcctttccggccgacacccactctatcgaggtggtgaagaggagctccaccacggtgtgcgtgagccgtgccccgctttcctccccgaccccgtagcacgccagcagcgcatcggcgtcctccagcaccgcctcgcgtgttgacctcaccagcgctgggctcgaacctgcggtcgaccgatggggtgagattgaggaggcagaacacggctgtgacagcaggcttggtaatctgggagattgggcctttgcaggaagcagaggcaagggggagacttgtgctggacgcaccgcatcgcattgcactgccccgcctcgatgctctgaacctagggcacgctgcaccatgcttccaccttgcccgcccggcgtcggcctgccgccattggtttcagatcgccgcatccccacgcctcccgcccgaaacgcccctatccaccctcagagcgctccgtcgggggtccccctcccctctacacacccgcaacgcacctgtggcctgcgcggacctgacggggcgcgtgtccttggccaggtagaccagcgctcgcgcgcggccggcccccgcggcggacagcgcccagggctccgcggccgagccctgcacccactgcacggggccggcctcctccacgccgccctcacacagctccagggggcgggtggggtgcagcacgacgatgggcgtgtgggggtcgctgcaggcgcggcgcaggtagcgcacaaacgggcagaaggacggctccgaccccgccaggatgatgtgctcggtgagcgcggtgcgcttcaccgcctccaccacgctgcagccctcggggctgctgcactcgttcccagagggggctggggaggggtcggggggcgccggggcgccgcttggggctgcatgcgcagctgcctcgcccggggaggccgctggcgcctgccgaggcttcgccgcgcccatcgcccctcggcccctgggggaggggcgaccaaagtagggtctctgcagcgcctcgcacacctccacctcgctctgtccgattaccagcacctggcagccgcggggaagctgagcgcagccggggttcagccgcaggcggggccacttgccctcttccacgatgcctggggtaacgggaaagggttgggcgtgggagattatgctcacttctgggggcgcttgggtaggtgaggagtgccagtcacgtatccgtggcgcacgcaggcgcatggcctgggatcctgagttgcaggcggcagggagcaaactgatgcctcacgagtctgcccctctgcaccaccgcctttcctcatgcccagccacgccaccctctgaacccaccgatgaggacgaggccggaggtggtgaagagccagctcgccacgtcacggaaggcacggcccgccagatgctccggcagcagggcctcgcagaactggtcggcgcagccgtcgatgtagctgcgcagccacctggcgtgtgtcgggccgaggggcatacgatgacaaatggcaccctcgcaaatgcaaaggtaacattggcagctccaccccttcaataccatgcattgccaaacgctcggtgaccttcccccccatatgtatagagcatacacacgacaaatctcccctttcaatggccaggactggatcctacctgcgcggcgcgggcttgttctccaacactgacagcggctggacgtctgagctccgcaggagattgcctacaagggatgggaagatcggagcgcattcctgggttcagaggcattgggagacgtcgatgcccagatctgagcactcctggtcacaggcactcgcagaaatcatccttgcattgcttccctccatcctattcaattccctccctccacaaacccaggagcgtcgtggccccggggcagacggcggagagggcaagcagtctgtaccgcgtctgctccagggacaccacgatgtcttgactggggtccagaaagggccggatctgggtcactgtgctctggcgcaacgtctgcacatacagtggcacattcgaggtgtaccccttgcaggcccagacctgcgatgtggagtaggctgtcaggggtgatgctggaagtttgaggcccaatcatagtattcatcagagcgagtggctggtgaatctgttgggcaaggctcagtggacgctcagcactatctgctgggccatagcgcctgaaatctcttcagggtatttctcaatctcacaggaggcctgcgagtgctaccttttctccacagtacatattcaccctgaacccaatcccctgctgcacctggaacaggatgctcaggtcttcctggtgagcatctgtggtgaatcgatctgccaggaggaggatggcacgcgccttctcggcatgggcagtcaccaggtcctcggaagagatggccgatccctccagcagcgtgactgagcgttcatgtagctcctgcattgttaatgttcgcatgtgtgcaaaggtgagccgaaatggtggggacatggatggagggccactacctgcacatgcatgctccttgccatatcctcatgcatgcacgcagactctccccgaagtacaacctggaaggcagtaaattcataggtaggtcgattgcagaggaccaccattctcgtggacagggggagcacgctctcctccatcgccgcctggaactcggcaaagaggtcggagaaggcacggatctcgctgagccgggtggacaacaggacgaagggcgtcgcggcatctttgggcaccgtccctggacaagagatggtcgagggaaacggactgggcggttgctgcaacagcgtttggcatcccacactgcctcctcaaagtgggttgctacctcttcaatcatctcagcaagccaatgctgctaggtgactccaaggtgccattactcatgcgacacacagtcaggagccctcgctgtccaagccctaggcatctaaccggcgcccttgcctgcccccccccctcccccccaaagcaacccctcacccacacaagaacacaccctggaccatcctgcgcgaggccagctcgctgtacagctgcgcggcctggactgggatcagcaccacgcccacgcagatcatgaccaggatgacgaggcggccaaggatggtgtaggccacaatgtctgcgggccaagagggatgggtgggttgagaggtcccaccgggaggagcacagcatgtagatgtcagtcaagtggtgcaacttgaccagcagcgcaagggtggttgccacgcctgcactctaccaatgtcccttgtgtgaagcaggcttggccctgatgcagccagggcggtagcatgttcaacggcgctctgtttgcatctactgcacggctccgataggccccttgctgacacgcgcacgcacctccaaacccgacggtggtgagggtagtcaggaccaggtacagcgcttgatcaaaggggattcgttccaccagctggatctgtgagtcagaggaagcaggccggaggggaggtgtcccaaaaaatgcttgttacttggaggctgtagtcttgccttacaggccgctttcctcccaatacctcaacccccgggtccctcctctggtccacccaccacagagctcgtggtgaagagcaggatgaaaatggaggcgatgagctggaacagccgaaagtttgcgcctgcggccagccacgccccgcgcttggtggagagatggagggaggagagctccgatgccagcagcccaatcctcatcactcgcatggacctgaggcggattggtgaggggagtagatgtttgaacagcggtggcaaggggggattgaattcatcactcgatgcatgcaaggcactggagaaatgccggtccctgcatggaggcacgtggaaggagagcctggtggcagcgcaccaggcccatcccctggggccccacccctccaaggcgcagacctgaggaccttgagggcgcgcaggtccagccagcccagcgaaaagccggtgaagggctgtagcaccgcctccaggagtggtggcaggaaggccgcggcatcgcacaggttccaccaggaagtggccattcgcaggcgggaggcgaggctggtgtgcaggacctgtggaatggggggcagtgagttgaggctgagtcatatgaaatgaggaagagactgatgagggggcagtgccagcaccacggcactggagggcggggtcaggctttgcggctggggcctggatgccgcggtatgctcaatacctggctccgcatgcaccccctcaatcttgccgtcagtaaccccccggcccccctgtcacccaccagcagccggtgcaggtactccacggcaaagatggcgcacagtagtatatccatgcgggcgcgcagggagtgtggaactggcggcgaatatgtgctccagacgtacagcaccacaaacaggagggaggcggcaacctggaggtattgcagtcccagggccacggtactttgacggagggcgagcttcagcatggaagtcaattggttgacctgtgtaagggtgagccagggaggtgaggacgatgctggtgaagctgagactgtggcagaggtggtggtggccgaggcatctttccagcatgtatcctacaccacccgttccctgtgaagcgatgtgcctgaccagatgcgacttcgagcagacacaagcacactgcctgcataacctcatgatcaatcagtataccaaattcgtagatcacaccccagtacccacctgctcgaggctcttgccctccctcccacgcttgatggccatggagacaaccccttggcattgggggccatccaacatgccaggcagcaagcctggctgccgcctcttgaaaagggcttgaccatgggaaattgaggtagatgcattcttcctggatctcgcccctgtgagggttctgcctcgcaggccgagaccatggctaggcttgccacctccacatggccggggaatcacccacgagcccagtgccgccattggattctattcagaagctatgcatcaggaatgtatttcgtgtccttctgggacgattggcatagaggaccccatcaattcaacgcgacagaggtcctcccacacgaatcaagtgctcctccaccagcaagccatcccggggcgtgagagggcagtcgaagcgcaaggccttgggagaatggtgatgtggatggcagtatgattgacccggggtggtcgaccgatgcaaacagcgccagcattgaggtgcaatgcccatcaaaacgctagggcgcgaggtccaccgagatcacttcgtcgtcgccagcatggacatcaggccatgcaccctgaggctgccagggagtacccacaacaacaaattcctacagaattttcaggaggctgattttctatcatgagttgagctccatagcacctcgcctccgccgacgatgccgttcggccaggtggtggtgggcccccccgggtcaggcaagtccacgtactgcgcggccttggcccggcacctggcatccagcgggaggagtgttgcggtggtgaatctggacccagcgaacgacgccctggtgtacgaggccgccctggatgtgtcggagctggtgggcctggaggcggtgcaggaggagacggggctgggccctaacgggggcctcatctgggcgatggagtatctggaaaccaacatcgactggctcctggatcggctaagacccctgactcagggtgaggaggggtgcatggactcgtatgggccgccgccgcagtgcacctctctagaggggtcgcggggatgtgctggagcagtgccgctggaatgctccaggacccgctttgcatgtgtttggggacacctgacggtgaattctcacatctagccctcgcactcctctcccacagcgggccactacatcatcctggactgccccgggcaggtggagctcttccagctgcacgccggcttcaagcgcatcctgggcacgctggagcgccagctcagcatgcgcctggtggctgtccagctcatcgacgcccacctgtgcgccgatgcgggcaagtacatggccgccctcctgctggccctgtccaccatgctgcacctggagctcccccaggtcaacgccttctccaagtatgacctgctggaccggcacggcgacctggccatgagccaggagttttacctggaggcccacgggctggagcacctggtggaaagcatgagcgttggctttccccctgcgttccaggatctgagccgggggctgtgcgaggtgtgtgagtggaggggatggggttgggggcatcatgtggcatgagcccctgatggcacgctgcggacgaaagggacacctccgcgcagagagtattgcatgagcagccacgagggaaacttcgctgtgtgcccctctctttcctcaggtggtggaggactttggtctccttagcttcctccccttggaagtggagagtgcagagagcatgaagcgcctggtcgccgtggcagacaaagctaatggctactaccacatcccgcccaccatggcctgaattagagcccactttgggaactgggtggaggcattagcctggcagcctcaacgcatgcccagctaccacctcccatttgggttggcgtgagaacgtggccttcagatgcctaaacatcttcattgctagtaatgattaaaggtttacgaatgtatggctcccctgttctgcaaggcatgggaccaaaaggctgaaggcgcgcaccgcctggtcacacaactcggtattcaaacaggtgcatcgcgaatgggatcccagccggtcacaaagtccgcctccagtccatccagcgtcgccatgtcatcatcaggaatggtgatggagaatacattcaggttgacctcctgccgcgcaggcacagtggactttggcagtgacacaaaccccttttgtatgccccacctggacagggggttggaatggttgagggggagggttggtcctggtagagtgtgcagcaggcaagcccaacgctgtatggcccacagatgatgcacagctatcgttggatgttatttgcccatttcaattctgtgtgttgcgagcctcaacaatactccaaaacaggccccacccgtgactctcaggcctgtgcaagctccaagaagaatctgtctcaccgtatcaggagctgggctggcgtcacattgagcttctgggcgagctgcttcacggttgggtcatccagcttctggccctttgccagcggtgagtatgcctgcatgagggggattgatgatgtgttgcgagtgcgcgtgggtgcactgacgtgtaggcactgaaatcccagcgagaagcaaggtgctgacatgtctgtcctcctatatgacagaaaagtgagcctgggagccgatgagacgtagagaagggcagtgcgggaagcgtacaaactctcccatgaacaggcaaaaggaccccttgctgtctccacttcaaaccttccacgttcccaagaccccacacctccacaatgatgtccttggaccggcagtactgcacgagcctcggccactgcagaaatgggtgcagctcgatctggttgacggcgggggtgacctgcgccgtctgtgccagcttctccagatggaccacgccaaagttggacacgccgatcgaccttagcttcccctgcagaatgggagtttgggacgtgatgtggcagttcataggagctgctcaccaatcaatgtgcccagaagggggctctttcaccctgcatgcagtttgtcctgaacgccccacacctggcgatggtagctctcaagcactgcccaagtctcggctcgggtgtcaggactaccaggggcatgaaggaggaagagatcgatgtagtccagtccaagtttctgcagcagatggatgcgaggaggggggcggatggttgaggctggttctataccatcacatgctccatcaaaaaagaatgccattctccaaatctacttgataaaggcttgataccagggcatttctgatctgtgctgctctcaaaaggcgacaaggatccagcttggattgccatgtccctttcccactcctgaaatccaccccaccttcaggctctcgtcaatcgcagcctgcgcccgactctttccccagttccttatgctaagcttgctggtgacaaagatgtcttttcgtggaatgccggaatcccggacggccctgccgagcagtgagagcacgaatgctgaagagggtgaggtgtcctattgagaaaccagccttcaaaggggggcccacgcaggttcagtcacttcccaaggtcccagacgagggacccaccttccaacatcactctcgttgccgtagacctgggcggtgtcgatgtgcctgtaccccagtcgcagcgcggagaggacagcctcgtaagcctgggctcctggttcgcagaggtagacccccagtccgaccaccgggatggtgtgtcctgcgagaatcgagagtactctggctcgatcatttccacatttaccattcattcaaccactgaattcccttccctagatccctcgcaccggagttcagcttgagcaccgcatgggcggggtccaggacctccgtatcgacgtcgccctcgcccagcacgtgcacgtccatgcaccccagctgctgtgcagaactgacccaggctgctgtaatgcgctggtatgcagcctctagaaggcccgtgcttgcagaggagggttgaggtgtgttctggggctcgacacccatccagcgggggtggcgaggtggtgcctgaccttccggtgttgcacagaagactttccgaaacaccctgccacagtgcccagcaccgcgcaatgagaatagattgtagtgtcggatcatcagcagtctgttgtccccgccgcgatgtctagttgtatgtattacgggctgggccccgtgcaagtatatttgggcgcgatctccccaagctgtaaagttgccgcctcaaaccagggcatcctcgttcggaccacgcatggctgattaatcgccattgctcatgagtcggcttcgatctgtcaccacgactctggtgcagacactgagccggctcgggggatcgacgccgaccccacactccaacctgtcgcgcatgagaggctgccgcacattcatggaggtgagctcgggattcctgcggtcacctaatgatatgcattttggattatggcaggagatgtgatgtgttcacctgccctaccctccaccccggcaggaccaatctttcacgggcaaccccctggtccggggcctgcgccggggggccaccctggagaccgccctgcgcagccccggggcccggttcctgcccgtctccgagcgcagggtgggcgtggaccccgacgggggcctggcctggctgacgccagggagcctggccggcgcgggcctgcggctggacccgggcgcggagcacctggccgcgcagggtgagatcgagctcccgctctacaccctgggcctggaccgcgaggcctggcactttgcggtggatgtctcgagcctgggacctgaagcccccgccctgccccgcctggccgaggtgcgcagcctcatgcccctcctgcccaccgaccagctggcgatcgcggggcaggcggtggcgctggcgcagtggcacgccgcccacgcgttttgtccccggtgcggggcccccacgcgatcggcagagggcggcgcgcggcgccagtgccagggcgacgcggcgcaccgcctctacccgcgcaccgacccggtggtcatcatgctggtggaaagcgcggacggcagtgcggcgctggtggggcgacccctcaactaccgcgcaggcaatatgctgacctgcctgagcgggtttgtggaccaggtaagtggggggttggggggggcggggggtggagggggaatggtgcttggatgctctggggtgtgcagaggagattctggcgcgcctcgacccagcctgccctcgaaacgggcagcgtctccctacattgcccttcgtctgcgaaaacacacagggcgagtccatcgaggaggccgttttgcgcgaggtggctgaggaagccgggctgaagctggcgagggtggagatcctgggatcccagccttggcccataggtgtcttgttgggaaagggtgcggcatacctacttgtcatgtagcagtacgcgagacggttgtgtgtgtgtgtggctgtctgcatgcatctcgcacccagtgtctcctaccaagacactccttccctccacctttcccaggtcgaggcgggtcctgcgagctcatgatcgggtgcgtcgcaaaagccaccagcaacgacatcgacatggacgcagctgagatggctatcgtgcagtggttgccgcgggaaggtgaggcactgaatagatggctggagggtggcatgcagctccccgcaagtgccatgagcgagattccgccggcacccctgcggtgccagcgatgcggcatccttctactgctttcatctcaacctatgggcagagggccgcccctcacagccatcccatgcccccaccaccctcttctcgcagacgtgcgcaaggctctcaaaaacagcggcagcgccgccagccccctgaatggcggcgatggggccggcatgcccttcttcctgccgccaccctatgccatagcccaccacctgctcaagagctgggcagagagggatgggtcctggtttgcagaggcccagactccagcgctcgcccgcatctgaggcagcgcgcccgtggcagcaattgctgggctttggaggctgagaggaggggttgtcctgtttgctcctcgtcgccaaccaccagccgggcttcacgcataccacccccccaacgtagtttttcgcttcatgctgcccatggtcacaccagcgctccaactcgtctagcagtgccagcagcacgttgacaataattggaatctgtacacaacctgccgcaggttaaagttccaaacgaaagtccttctgctaagtacatgtaatatcatgagactgaccattagggaaaatggggaggagtacggaagcatgctaaaataatcaacccttgcagtgcctttgcgaatcaatctttctgaagccacaccctgtcccgaatttgttgcgggctggatccgtgaaactcgtccaccttccggccacgccggaaaatggagagggtcggggtgaaggtcacatgtgaggctgcagactgcatgtaatccacctgagccacggcaaactccatctcctggctctgtgcacggtgcgtgtcatggttgtggatgcgtgtgagagaatgagctttgaacagttggtctggccaccttcaccgatgagggaacaatggaggggtgcaatagcacacaatcctgccacccgggctgcagaaactggcctctcacacacctcgccggccaggcgcagaaagtttgggaacagcgcctgacagtgggtgcaccagctggatccaaaatttaccacagcctgtcaggggatggtggggagggccgcccattcgtcactttacactgtaacattcaccacacctttgtcatgtctgtaccacacacaaaaatctcacaattttgctcttgttcacgttgaggaaggtctccatgtcctcatcggtgcgcaggcccgtcatattggaagtgatcatggtcaggcctccactctggctcgcctcgggatgcattgcctgcgcagcgtctcaatacgcacgacatctagatactgccaaagcagggtaaacgaatatgcacccaacagtatacgctgtatgcaacccctgaactcacaggggacttcccagccaccggcggcatctccttcaccgaggaacactcccctctttatttaggacaaataaaacatatgaagtttctatagatattgatattgataaacgatcaataggacgcccttttcgttctctagatgtgtcctcccatcgtttcgatgaggtcaggtctcgcgcgctgtttctcgcaacgtcaaccccaaacctcgaattcctcgccatgcctacagcaggacagggacacacctgcacaccaggatggaagcaagctgcgccgaaaggaagacaagggttggtgcacagtcccatgcaaggcagagcgggacagccagggcgagtggcagaggcgcaaggggcgacggggccctcagcgtccagaggcacccgcacgtcatcaggatcagcagcggggcattcagcaggagcagggcaggcccgaagacgaggcacagaccggcggtgagtttcggcagcgggatggggccgggtggggcaccggcggcttcacccgcggccagcacccaggcggcggcggcggcagccagaacgcccgcctcaccgatgcgttcggcggagagccgtggcaagcacagcgcgccagccgccccgaggtggcacgccaggtggacgctgagggcgtgcctcagggacagggctgcaaggctgggcaatccaacgaccgtgtgggaactgggattgggatccgcatcctcggaatgccctagctcaagagcgagtgcaacaaggcaggcgattcctgcggcgagaagtgcagctccgtccacgacgtggcgcccgcccgccggccagtacatggagctggcgtggtgcaggcgctcctctaggttgctcagtgcgcgcaggctgccttccatgctgcgcagcgcctggcgcatggcgccccggtccgagggctcgggcagtggccagtccagggtcgcggcgtccgtgcccgcctctaggaagacggcgtgcaggccgtctcccgcccccgccgccgtggcgaggaaggagcgcagggtgggttccaggactgcccacgtgaagatcccggcccggtcgaagcgggcggggccgggggtaagctcggcgaccctcgacagcgtcgcggcgaggtcagcattgggcaggcgcccagacctgccgtggagccgcatgcccagcatggcaggcgtcgaatcctggaccgaggccagggagaagactgcggcgccgtgcaggctcgtgggcgggggaaatgccaactgcgaggccgggccatggggtgggcgactgtgggccgccaggagcgcctatttgggtttgttgaatggagcaggaggggagtgtttgtgtggctggttaagtgggcaataacttggtcctggggcatgcggatggactcccgtccccacaaaaccctgccctgccgccttacctcgagtgcctgccgggctcgcaccacgtccctgccatcgaccagcgccacgcccagaccctttgctagccagtctgcgtccgaaaagtgctcggtcagcacggcaaggagccccgccgcagccgcggccgaggagcaatcatggtactcgaggaccagagccatgccttcaggcccccagtcccgctttggcggcaccatcgtgtgcatgagcacaccctggaccatcagcggaccggggggttgtctgtttactgtatcctcccaggccgcagcaagggcaggcacgccgcagtccgtgagattaccccgggtcaggccatgccccacgacacgctggacctgcagggctcgaacgacctccgcctccctgagggtgtaggccaggtcggagggcgccggtggtcaggagaccgggctcatgggagtagtcatgcgcatgtgtggagcgcgtgcgccctccccacgcagcgacccacctgatgccagaggccgctcctcccaccagcagggccctctcatccagccgcaggggctccgccaacagagcggggaataggatcagtatagctgcagcacatgccaggagtccaacttgcacgtggctcagatgcttccgcagccatcggcaccgtgcatgcgcttcagccattgcagtgaatgggagggtcactctgaccgccaggcccctgcatccgctccagcatctcccagtggactttccctaggtgatctactacattccaatcgcagtacatcagggatccgtacaagaggtataccgtgacatcgacatccgcaggtcagttcgtattccatgcgcgggctctcgggcgcgagaatctgtgcacgcgtgggtcctccaacgctgccgtgtatttgcagcaacatactcgcagtccatgcaacgattgaagacaaaatacgaaacaggagtagcgaggagaatcaatgacgctccacgacgaggtgggcttgccggcggggtccagtgttctgcctgacatccacggtcgttcggtgagggataccccagcctgtcgcacaacaacacatgacccatttacgtagccccataccacatgcatgccatatcaggtggagattgaggatatggactggaacgaagagctgcaggcctttacgtacgagtgtccgtgtggcgacctgttccagatttccatggaggagctggaggccggtgaggaggggagcggcggtgaacctacgggatcggaatttcggagctggtgtcactgaacaaactccgggcattgctccagggggccgggacgagcgagctggtccatctcacacggaaagcactgacctccagcgggcatgcgtgggcctctgacgccggctttccgcacttttctccacaggtgaagagatcgcgcactgtccgtcctgctccctgtacgtgcgagtcatctacgacccagaggactttagccagaaggcctcccttcctggcccggaacccatcctcgtcgcctgagcgagaagggggttccttccagcacgccgtcccacgcaagaagtacatgtcgacgcccaaaatgacctttggtccacccagccttcaactcctcctcctcctctcggcctgctggaccgcatcaccttgcaccggtctggcactcgcacctcgccgcctgcgcctgtcgcgggggcccagcgactcgtcgcccctcactatcacctgggccacggagggcggcctcctgcccgccgccgtctgtgtggagtgggaggctgccttgccggctgctgggaggggcctggaccagccgaggctgggtcctggccctgctccccagcagcgctgtgccagtggtgccagcacgccattccacgaccccggcgtgaatgcaaccacccaggtcgtccacagcatggagctgcggggcgtggatttgcctcccggacaccccttcaggtaccgcgtggcgacggttgacgccgcggcagcagtggtcgtcgccgcggcagcggtgtggtcgccatggcaggcagcccatgtgccggggagcaacgatgaggaggtgggcggggtgaccgacggtggtccgttgttcagtgggcagtccttccatgtccacatccccgcacatctcagtggctccttggtgaagccttctttgctcagcaaccacctcttcgctccttccttctcgaccacagacccgcctcctggtgctgggcgacatggggctgtacaacgtccccgcgctgcctgccctgattcaggatgctgagtcggcggcccaggccggcgcccccttccatgccgccctgcacgtcggcgacctggcctacgacctgcactcctatggagggtcccgcgggtcgcgctttctggaagccgtgcaacccctcgccgcctccctgccctacatggtggctcccgggaaccacgaggccgggccacacaacttcactcactacaggtgtgtgttgcgggcgtgtggggtgtgggaaatggggggaggctcgggactggggttgagaggagcattcgcatgtgactccgaccccaacagtgtggtccgcagggatctgcaccgtttcacactccaacacctctgctgacctgtgaccggcatcagaccgccatccaagcacacaggtcactgttccgcatgccggaccagggggtgacggagaacctgtactactcctttgatgtgggactggtgcatgtcatggtatacaacacaggtgtgtaggctgtttcctggttgtgagcaggaaggggccacacatctgcgttccggcgggagcaagctgttttgagcttttacggcatgcacgtggatggcagcgcacgcttatgcttcctcttgttgacttggacagctgccagccccactggcccatgtcaggctcaactccggatgaagctccagttcccttgcacatgcgcagaggtcttcttctggccagactacttttgggagcctcacatggaggccatgctggcttggatggaagctgacctgcaggtgggcacgctgtggtaatgcagcttgcggacttttcccaagcgcgtaccacacctggccgtgattgtgtacatcctctcttcacaccaaagctttgcctcctccttgtttttgaccctactggctcccctggcgtgctgtgtgcaggctgctcaagcacagcgtgccaagcacccttggatcctggcagtgggccatcgacccatgtactgcgctgccccactgggcagcacaggacgctgccacgaggaaagcgaggcgagcaggaatggagtgccctcccagtgcccacacaacaaccccttggcctgcaagccggagcctggacggcgtgctttcccagttgagcccctcttccaagcatatggagtggaccttgcaggtgctgggccactgtgtgggtgggaaacatttgggtgttgaattcgacaaggcgggactcagtgtggggcgaatggttcagctgaatctgttggtatggcagaagcaatggtgcacagctctgctggaggctcgtgatgtcgattgttcgcttccgcatgcaagggctgcattgggaggtaccaacccacagaacatgctcatgaatgtcgcctgccctgccttcatcaggttgcatgatgtccacatccccacccccaccccacccccggccatttgcagtgtatgggcacatccatgactatgagcgctacctccccgtcctgaactacacggtgagcggcagcgtcgagcgtcgagcagacaatgctaccgtgtatgtgtcgcctggcgccaccgtgcacatcacggcagggggcgccggcaacagcgaaatgcggaagggggagtgccctccaccccagggggcctgcaggtgggtgatacaggggaatgcgggaagcgaggcacgtttgagtgtgtggggcgcaatccagggagtggatacgcatggcgatgcacgtggacatctcatttgtggtgcccagcttcccttccccccctctacctctgatcttccctcctcccaccccacatggctcatggtctcgcagtccccacgccacatggtgcgctttccagtccgggttcgcgccgcggggatgccagggcgcagaccacagctatgggaggctcactgcgctcaactccacacatctccattgggtccagtggagtcacacgtttgaccgcgtggtggatgactggtggatcgtgagccccagccatgggccctttgcgtaaaggccaaggctggccaagatggacctcgctgccagcaaggtccaagtcctttcgctgcctgccccctgcttcaaaccgcccggtgtgctcagcgatctccaggctgtgtaccacgatcctcaataggcactgcattgggttgaggcgtgtcaatgctggtggtggcctgccaagagcccagagtggcagccgtttattgttgaaagcctgcagagcatgaatctgtacaacgattatgttaattctatacggtctggcttttgtatatcaccagcaactttagagtgctgaagggttgtgagctgacggaacagaaatcaatgcacacagtttctgtgggaagcatgcaagggcctctcggatgctggcataattcctgcggacgtgtctctgtaacaccatcctcctccacccgagtccctgtgagcttgacaacttcagcagatttgagcttgccggcagtcaccctcctcccagcagtgcctccagggcggcattctcatctccccctcctgcgagcagcgctgcctctgccgcgccccggtcaaaccccatgtctgtcaatcgccccagcttggccgcatcagctcgtcgctcctgcgcaaagctctccgtccacaaccttgctgttctttggaactctgcagggtctgtgagacactggcgggcgaccacggcatcctgtgggggttggtgagcaagtttgacctggctcaggagggcagaggtcccatgaaagcatcagaagactgtcacgacacattcccaaggcagtcttcctcacacgcgccatgccagggctgcacctgagggtcatctggctgcgggctgctgagcagcgactgcaggctcagcagtgcagtcttgagggtcatggcagggctccactgatccttgaggatgtcgaggcagatggcaccgttggcgctgctcacattggggtgccacacctgcgagggccaggtgcctgcggttgaggaactgcagggcgcaccagccttttccatgtagtagaaagatttgccagtctagagcataccccagtccaacccgcctcgatgcggcgtcaccacaccttgttctgaaacctcatctttgggggtgcgaaggggtgctgctggtctgggagaggagggcacagggggcatgacaagtgagtttggaacgtctggctgcgtcacgctggaagccccgatagatgagagtaatcactctcctttccggtatacacggcccgcgcattgatgcctggacaggatgccatcctcatccccgtaccaagtgtgatggacacatagaagtagccgccagcatatggagtatcaggagggcctgcagtttcatggaggacaccgtgaagtggagggctgcacatcttcttcccacaaggtaatctactgccctttaaaccactccatcatccctggagcaccgcttgcaccaccacccctcacctcccaggctcacctcggaggcagcctacaagttcacgaatgttggcccctgtggggctgatggtcacgccagaggctgtgtcacgccggatgtcggtgatttccttctgcacattccgggggcaggttcaaggtgggtcagggtgatgaaccgtctcatagagtcggcgtagagcctagacaccactccagcgatacgggaggcacttgcctgtaacctattggcatcgaaaggcatggtgaaggaacgtgagtgaagctgtcgctctcgatgatgccgtcctctgtcagaggcccccggccaaggagttcaggacctaacgggcgatttgatgggagctgcggccccgtctcagcatcggatgtgtcctgatatgagattcttttgtgttcaaggtgtttgagatgggaaaagcatcgctcgagggggtgcgggatggaccatcggtaatcttgacgcgcgggcgggccccaaaccttcgcccggtcggtgggtcggaccgtctcgtcagactgcccgcctagggcctgcgggtcctcacctgcctccgtcaccaccaaccttgacattggcctctcctttgatgcaggcacggcattgcacatcattgagcatcatgctgctgcctggggggcagcacgtcaaagggcgcagggacgggcaggtcgctggagctgatgcacatggccttgtaggccacgcccattccttcctcctcttccccttcggcgccctccgtcgggccggggtgccctgcggcgcccgctgcccctccccgcgcctcgcctccgccggcggctgctccagcgtcctcagcctccctgctcatccgcggcccctccacccccaccagccgccggaagccggccaccaggtccctggcttgcccggcgtcggcgccacgcaggagcgcttccagcctggcccccatgcccaggcccaggaggaaggaggcctgggtcaggggcccgtggcacgcgacaccctgccccgcgccccgcgccgcctggcgcagcgccgagaagtcgacgcgtgcggacaggtccgccgacccgggtgcctgcagcaggggccggaagcggtgccgcgcgatggcggccaggctggcctcgtacggcccgtcctggccgtagtcgatgagcagcgcggcgccgccgtgcgccgccacgcgccgcgccagcccctccgcgaccgccatgccctgggggcagacctccagctgcgtcagggtggcggccagggcggggggcaggcccgccagccggcgcgagaccagcaggcgggaggcgggggtggggccggggctgagcaccaggcgcaggtgcaggggggagtcgggcgaggccacgtccacca

SEQ ID NO: 25389 - DNA, 61 bp, Chlorella protothecoides
gttgccaggcctgtgatgtggcgtggcgggtcggggagctgaaacatcatgattgcacccc

SEQ ID NO: 25390 - DNA, 74 bp, Chlorella protothecoides
cggggagctgaaacatcatgattgcacccctcctggtgtgttccccctaccgcgaggctccatggaggaagtga

SEQ ID NO: 25391 - DNA, 159 bp, Chlorella protothecoides
cgcactggactgagccagtgggaccacctcaactgtgtcaggttgggaggtggcatgtgtttctgctcctcctgtggcgtcatggcccttgcgcagcagggaattgcctcgtctggtgaccagctttggaaagagtggcgtatcctttcgttcctcacc

SEQ ID NO: 25392 - DNA, 123 bp, Chlorella protothecoides
tacatcttgcaaggaagggatgcaagtcccggcacatgcatcacgatggagtgtgccaggtcagtaggcccccgagagctcgccttgcactctactgatgtgtgcccctgatccctttcgccc

SEQ ID NO: 25393 - DNA, 114 bp, Chlorella protothecoides
catacagactccttttgccttccttgcgcacaaatacttgagtagcaagtaagacatgccgtttcaatataaaaaccaaatatcttgcaacaggtcacagctttaatcatcagt

SEQ ID NO: 25394 - DNA, 78 bp, Chlorella protothecoides
ttctctcctacaacgataatgcgaacgttgccgatacaagcttttacccttgtatcatcttgttgtgtagctactcta

SEQ ID NO: 25395 - DNA, 84 bp, Chlorella protothecoides
gatcagagcaccttattgaaacaaaatcaaatgcaaaaagcaccggacgttattctgcggggctgggtgagcaaattccaactt

SEQ ID NO: 25396 - DNA, 5187 bp, Chlorella protothecoides
  modified_base (399)..(408): a, c, t, g, unknown or other
  modified_base (949)..(958): a, c, t, g, unknown or other
  modified_base (1274)..(1458): a, c, t, g, unknown or other
  modified_base (1862)..(1871): a, c, t, g, unknown or other
  modified_base (2459)..(2468): a, c, t, g, unknown or other
  modified_base (2607)..(2616): a, c, t, g, unknown or other
  modified_base (3067)..(3076): a, c, t, g, unknown or other
ccgcgcccgcgcgcggcgcgacgggcggggccggccagcgcagctcgccggcctccagcaccagggcgccgcgcaccgcttcgtcggcgtggtcgatgcagaactggcccttgtggccggtgaaggggcccatggacagcaggaactgcggggcagcgtgtgtgcgtgcgtttcggtggtgctgactcatgtgagcggggtgcaccgggggggtggcatgtggtcgcgctggtccctggacagccgtgtgccgaggtcagacagtcgctgggtgagccgggcggtgaggccagtgcccgcccatgcatgagaccggggcatgccagggatcgttgagacccgggaagttctcgcccccatacagcgtaggcgcccgccagcgcacgggtgaggagatgnnnnnnnnnntccgggaagttctcgcccccacacagcgtgggcgcccgccagcgcacgggtgaggaggtggccccgggggctgggcagcatgcatctatggcattcatcccaggaatccacagcacgaagccagcctacacacattgcacaccccacacgcaaagtcccctgtccccccgcaccacccccaccttggagatgttgttggagaagagggtggaggactgggtggggaggcgggaggggaggtcggtgtacccgatgcaggtcacccccccggcctggacgaccttgccggggacggtggtctccacgttgccgccctgctcagccgccagatccactgcgggtgggagggttgacatgggtcggggaaggtatgcaggggggagaatggtgggctctggggcatccagggcagtaaggatttaaacccagcttggatgagatggagggatccaagggccgtggttggctgaaagtgggagtgaagaggatacatctaagcatcactacacaaaaagccctggcccagcgcacccgtgacggnnnnnnnnnntggggaaggtatgcaggggaagaatcgtgggctctggggcatacaaaggcagtgaggatttaaccccagcttggatgagatggaggaatccaagggcggtggttggcagtgagtgggagtgaagaggatacttttaggaatcacgaaacaaaagccctggcccagcgcacccgtgacggagccgggcttcatgctctccaccatgtagttcttgatcagcacgggggcgcgcttccctgggatgagtgcggtggtgatgatgatgtccacgtccttggcctgctccgcaaacagcttcatctgcagtgggacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgccagctccttcccgcagaaccggccctcagcaccgccctggtccttccaacacaccaatcccaaccccctctcacctcggcctcgatgaactccttggacatctccttggcgtagccgccgccaccctccccgctctcctcgatgttcacagtcaggaactcggcgcccagggacttggcctgcgcatgagtcatgatgacagacgaggagggagtggtgcaactcgccaggatgcgggtggtgtttggactctgggcttacagcgggtgcagagcagcacgaatccaagatccctgtgccccgggtgagccccccttgtcgggcccacaaccacgtccacacccttctcagcaggatgaaatgcccaaccaccacgcacctgctccgccacggcggcnnnnnnnnnnggtcatgatgacaaatgaggagggagtggtgcaactcgccagggtgcgggcggtgtttggcctctgggcttacagcgggtgcaaagcagcacgaatccaagatccctgtgccccagatgagccccccctgtcgggcccacaaccacgtgcataccctcctcagcaggatggaacgcccgaccaccacgcacctgctccgccacggcggcgcgggtgtcgaagacgcggaccactgcccccatgttcttggcggtgccgatggcggacagccccgccacgccgccgccgatgacgagcatcttggcgggggggacacgccccgcagcagtgatctggcccgtgaagaagcggccaaagtgatttgcggcctcgatcaccgccctgcaaggggtcgggggggtgagtgtgtgcaaggagtcgaggacgaggggaatgacgggattcggctaggaagccaggctgcacggacacctcatctcgcgccatccgcacctgtatccggcgatgttggccatggaggagagagcgtcaaaggtctgcgcacggctgattgtgcgtgggatgcagtccatggctgcaggggggggnnnnnnnnnngatgggcactttaggcctgggatgaatatgcaatctaggcaaccaaaaccggaaggcaagcagggcgacgcccatccaaaacccactgattcggcgctgaaactttgcgcgacgtcgcccagacaccctgcagacccannnnnnnnnngccccacttgttcggcgctgaaactttgtgcgacgtcgcccagacaccctgcagacccaggggagggcaggaaccgacaccaagatacccccagccgtcctccctccgcaccgagggcagacacgcgcttctgggccagggcatccaccaggcccttgttctgcgcggggtgcaggaaggagatgaggcgtgccccctgctgcagcagtggcacctcagacgcctcgtgcggcggcctgatcttgagcacgatgtccctcccaaatgcgtcgcccgtggagcccatgacggcacccgccgcctcgtagtcggcatcctgtgggagaagggattgggcagcaatgacatgggtggtgtgatgctcctgacccagaagtggtagactcagactcaaaatgcactcccccctgttcagatattagcaatagtccccagtcaccgaccctgcacnnnnnnnnnncgatagactcagactcagaatgcactcccccctgttcaaagatcagcaatagtccccagtcaccgaccctgcaccgtttcactcacggagaagttggcggcagcgcctgccccagactccaccaggacttccttgaagcctgccttcttcagggcagccaccccagccggggtgagcgccacacggcgctcaccctcaaaggactccttgggtacgcctgcagaggagcgaggaggtggtgggaaccgcttggcaatctatatatgagccacaaggcatgcagggcattgggtagggagggcagtgcttcacgtcgtagtttaggcgtcccgatgcggctccaccccagatggagctaggggagtactcatgctgggtattttcgctgatgaggaccaggcacacgcattactcacccacagccagttggtcgtagggcactccctgagtccctgctgcggcaaacgaccgagagagacgcgggaaggagatcccggtggaggagagggccccggcgggtgtccagggattgccatcgaggatggcccgggggttttggggcccactgccgccttcgaacgcacgcagggcgcagtacacgccccttgcgacagtacccctcgccgatgaccatctctgtaacaccagcattggtcaattagcgctctggggcgcggcgggtccactaagcaggtcgacacccctgacgcgatcgtggcctgacggctgaacgcttccctccaggagggcccctgttgtatcgatttgtatcggatgcaagtgcaatggatccgatcttcggatcggtcctgccctgcagatcctgagcccccaggctgcgtatgtagagcgaccgtcccaactctcgtggatgaggatttttgggcggacgatcagaattccgaaaataacccccccgcatccacgtcagcatgctcaaacaccgcacttggtgcgacacccccccgacgagcttctttaaaccaccacccaaccagtcatgtccaccgaaaaccagggctcgccggcccccgggctgccctgctgagctccgcccagaaccctgacccgccccccgcctcgcacctgttggcctgcctagactcgccccggcaccgacccgcctccccaccccccaccctcgtcgccatggaacaaggcagcgtgggagtggcagacctgccggccgcggcggtggagcagatcctgctcctgctcccgccgcacgaccgtgcggcagcgtccgccacctgccgcacctggcgctccatcgaaatctcctcccgcctgctgtacggcgacgtgaccctggacgggcactccctgggccccgcggacggggacggcacggcccggtctctgggctcctggctggcagcccggctggaggccatccagcacttcaagctctggacgccctaccccctggactccctggccgggggggtggtggacctgctggcctccgccaacaagctggccagcctgcagtacgtctcctccgaccagggcctgcccgccgcactgggctccctggccaaactgaccagcctgcgcgcgctgcagatactggtgcccggtgacggcggcgccagcctggccctgcgcgcgcgagacatctccaagctgaagccgctgcgcaacctgcgcgccatgcgcctgagcgtggccgagatccggggcgggctgcccacaccgctgctcaaggcctggtcccggctggagtcgctgcacatcacctcccgcttccgcatggccggggagagcctgcgccacctcacctccctgcgccgcctggagctggacggcgtgacgctgagtccgcccgacgccagcgtggcccagggtctcacgcagctgacgcacctggcgctgacgccggcgcgcgaggacgccgcgcgctggcaggagctggagctctggcccgcgctgcagcgcttgcccagcctggccagccttcacgccaccgtggacctcctgtctttgatgggggaggacggcacgctgggcggcgacgccgtcgagggcggcgtcccagagggcatcctggcttgcgggtgaaggcccgagtggaggttcttttgttgggggtggggtgggggacggacggg

SEQ ID NO: 25397 - DNA, 81 bp, Chlorella protothecoides
ccacctccatccaacccctttcctcctccttccaaccacttcccccccgcagcgcatggtggaggcgctgaagcgggaacg

SEQ ID NO: 25398 - DNA, 61 bp, Chlorella protothecoides
ggcgacgaccagcagcgcgcggaaggcctgtgcgtgcttcaggcgcagcgcccccgggctg

SEQ ID NO: 25399 - DNA, 78 bp, Chlorella protothecoides
ccgtagattttggtgaggagggaggggttcactgtggctgtgtcattggatgctcaacccacatgccacaccttttca

SEQ ID NO: 25400 - DNA, 97 bp, Chlorella protothecoides
gacgtagacacagccccgccattggataaacctccggatcctacaatgctcttatttgagctctatttttattgtgcagacttgatcccgagttggg

SEQ ID NO: 25401 - DNA, 76 bp, Chlorella protothecoides
cgcttcacagcgcctggtgctgcaggcggctgcgagtcgcgactctccgccctaaaactgcttgcccatctccagc

SEQ ID NO: 25402 - DNA, 282 bp, Chlorella protothecoides
cctggtacgacaacgagtggggctactccaaccgcgtcgtggacctcatccggcacatggccgccgtggacgcgcgcgtgtgagggagggagcgcggcgcggattgggtggatggcgcgggcggtggtgcgagcttgggcccctgcctggcgggcggccactccgcccaggtcagctgggaaatgaggagcaggctacacagcctgggagctcaaacacacccactccctgctgccgccatccccgtcagacccagaggaacgaatctcatgatcaagaagg

SEQ ID NO: 25403 - DNA, 61 bp, Chlorella protothecoides
tttgccgccgttcaggcccttgcagtggtgtgtctgtggggcagcgtggggacgaatgtca

SEQ ID NO: 25404 - DNA, 120 bp, Chlorella protothecoides
cgtgccggggccagggccgtgtctgaggacagtttggggggagggaggtgggacgagtaggtgcacatactcacaatgctgtgcagggcacacctgggggccgatccttgcagccagggc

SEQ ID NO: 25405 - DNA, 70 bp, Chlorella protothecoides
gcgtgtgtgtgagtgagtgtgagtgtgagtgtgagtgtgagtgtgtgtggatttggcatgagagaggacg

SEQ ID NO: 25406 - DNA, 140 bp, Chlorella protothecoides
aagatagacgacatcatgagccgcatcaacggcgtcgccgaggatatggacatgcaagaggtacatgccacttggggcaactgggatgtgtgccaagtatgctttctcacgcccctgccattggtgagctgacactcttc

SEQ ID NO: 25407 - DNA, 61 bp, Chlorella protothecoides
aggcttcccggtcaggcctgtggaaggcggtgggggcctacctcccacatcggactatcaa

SEQ ID NO: 25408 - DNA, 77 bp, Chlorella protothecoides
gcattgctactctaaccagccctttgacccctgcgtcgcacacaccctccccctcaatacctcccaggtggagtccc

SEQ ID NO: 25409 - DNA, 61 bp, Chlorella protothecoides
ggccatgcatcaatgcttgagaactgaaattagccctcatcaacaaagacactgccgtggg

SEQ ID NO: 25410 - DNA, 369 bp, Chlorella protothecoides
gaggactcccccagcccatccctggaggaccctcccagcccttctcccgaggcctcccccagcccctccctcgaggactcccccaacgcttctcctgagaccagccccaccccgctccctgcgctctctccaagagttactccaccgcgcagtccctcctttgacagctcaggacaaacacttgatgacaataatggtgtcaaggaggactccagtaattctctcccgacacagacatcgacatccttgcctcagcccagcccattgcccagccctgtctcagtccccagccccagctcgcctcccagcctcagcccctcactcagccccagccccacccctgaggactcccccagcccttctcctgag

SEQ ID NO: 25411 - DNA, 89 bp, Chlorella protothecoides
gcaagacgagacaagtttcttgcagcctttctatccaattctgcccggcattcgagctcttgtcattgcatttctcgcatgtaacggtg

SEQ ID NO: 25412 - DNA, 61 bp, Chlorella protothecoides
ccatcccaatcaatggtgagatgatgggtttggatcatgagtttgtgggagcaggtgtgca

SEQ ID NO: 25413 - DNA, 104 bp, Chlorella protothecoides
tcggtgacggagggcggctcggggacgacgttgaagtggggcaggtagatgagccacaggaggatggcgcccaggaaggcgcccgccagctcactgaaggacag

SEQ ID NO: 25414 - DNA, 74 bp, Chlorella protothecoides
ccggaaggagtactcgctggcacgcacagaggcacggggttggtgtgatcggcatgcgtgcctaccttgctgct

SEQ ID NO: 25415 - DNA, 61 bp, Chlorella protothecoides
aacataccttcttgtggaagacaggcttggtctgaccaccgtaaccggactgcttgcggtc

SEQ ID NO: 25416 - DNA, 71 bp, Chlorella protothecoides
cccatcccagggatgggcacaggtgagatcggagccaatcagctgtgctgccccctgttgggccttgtgtg

SEQ ID NO: 25417 - DNA, 105 bp, Chlorella protothecoides
gggagttggccatgctctgcagacagatcctgcctccggcccgtgttctcagcgctggcctcagtctgcctttgaagaatgcggttcctccctgcccgagtgtcc

SEQ ID NO: 25418 - DNA, 78 bp, Chlorella protothecoides
cgaccccatgtagacagatcccctgtcccacatatgctgctgtgcatgtgttacagtatcctccaagtgtgggttaca

SEQ ID NO: 25419 - DNA, 61 bp, Chlorella protothecoides
cagcccgattgtcgatgagatccgggattgtattgctgtcctcagagacacggtgagcggc

SEQ ID NO: 25420 - DNA, 1857 bp, Chlorella protothecoides
ggcgcggcgccgccgccagcgacatcccaccagggggccaggccggggacggaggacagcacgccctgctgctcgcgccagtcggactgcgagggcgcgcgcatgcagtggtgcagggaggaggagtagaaggggacgtggcgcagggcggggcggagggggttgtcttggggggggatcccagggctctgcgcatgaatggcaggggggaatggcactgaagagggcgggtgaggtgcccgggtgggcgacgcatgagcgagggtggcatggccacacgatggcccctgtgcaagccgggcacatgcagcagaccctgaactctggtcacctggggaggaagcaggggggactcgacgctgtactcgtagaccacgggggcagggccctcccagagcggggaggaggccacgtacgcgctcttctctggttccagggtcaggctctcctccggccccagcgccttccagtcgcagctttgccagttcggggggcgcccaaatggggagtgtggagggggctcgggtgccgaggagctgtgcaggcccgctgccagctcacgcaagcgggtgaggagggaagtggacacagggagcaggtggctcacagaccctgccgtgctccgcgccgccactcgtccgcactgcatggtgctcgatttacaccaaagtaatacgctgggtcactcggcgtgtcgcagtcaaggttgcatgcccagccggctcgcatacaccggctcgggctcacgccgaccacgagtttcgctggggaacggcgcgtgcaaggaactcaggtaatgctagcacgcatctaaagcgcctatcaagtccctaagatcaccgagtgccaagtgctcgaggtgatttcttgccgtgctcggaattgcagggccgttttgagcgcaaagaaaattgcgcgaaatggtctggagacgagcccaggactggacgtcccagtaaggtatctgaacacccagacagctacctcaaactccagcatcacattcacttcaccgatatatccacaatcaaccattgctgccatgaaggtcaccgtcaggaccgtgacgggcaggaccttccagctggattttgctcccgagacacaggtacgcagtgcagatgggaatggcccctggcccccccagccaggaagtcattgcgccttaagccggtctatagtccttggttatcacgccagaccgaggaaatcgtgtgcatacctcgcagatcaaggatgtcaagctagggatcgcggaggcccaacctgaccttccggctgatgcactcaatatcatctaccagggcaaggtgcgactatgtcacctgaaggagaatcggtctgctaatctcccgctgtctcgtgtattggtgcataatagagagtatatggacgaaagtgaggcgctgagcacagcgctcaggcgcaaggtcttcactctgacacgccatgcggccccttcccgatgcatccactgcctcagatcctgaaagacgacgccacgctgacggggagcaatgtctcagagtctggcttcatcgtggtcatggtcatcaaggtgatccagggaggggaggggagtcgtccgggatctgtacgcagtgctgcaaggcgtcccactccatcaccagaatatcaatgtgcctgatcacgaggtggccctgcaaatcttgacgcaagtctgctgctgtgcgaggcttcgcgataccgcctcctgccctgtatgtgagagtacaccctgtgatgtgctctgcaagtaccacaccccaatccgccgagcagaaaaaggcggagcccaagtcggaacctgctgcgcccgcggcagcgccggcacccactcccgccgcgccggccccc

SEQ ID NO: 25421 - DNA, 123 bp, Chlorella protothecoides
gagaaggcgtcctgtgtgaacaggacagatacttttgaaatcccggcttggaatcgggatggtccctggcaccttgcacggcaaaagttccctgcagctgtcttgggtgtgcgtgaagagggt

SEQ ID NO: 25422 - DNA, 61 bp, Chlorella protothecoides
tacatcgcaggttctgctcgcgcgcgcgaagtctcgacacactttcgcccagccaacccac

SEQ ID NO: 25423 - DNA, 77 bp, Chlorella protothecoides
cgattgtgatcaggtagggctgccaccgcaacaggggttttcaaccacagcgcgccttgcgcactgtgtgcccgcac

SEQ ID NO: 25424 - DNA, 61 bp, Chlorella protothecoides
cactcacgttcgcggaacctggccctggcctgctcgtcatcggtgggcgggggctcggggg

SEQ ID NO: 25425 - DNA, 71 bp, Chlorella protothecoides
gtatgcttccgggaggtgttctggcttccctgtttggagctcatgcggctcagctttcgctgcttggtctg

SEQ ID NO: 25426 - DNA, 61 bp, Chlorella protothecoides
tgaggccgccctgagatctgatgtctcgccaccgccagtgaatacaaatctaaaaagatct

SEQ ID NO: 25427 - DNA, 80 bp, Chlorella protothecoides
acagttctgtctggcgtagataacggcgagcggaagggctcactgaatacggtcggccgcacggaggcattgcctcacac

SEQ ID NO: 25428 - DNA, 61 bp, Chlorella protothecoides
gtgcgtgggaatgggtgcatcgggaggtttggcccatcatgcacagcacactggatcagtc

SEQ ID NO: 25429 - DNA, 87 bp, Chlorella protothecoides
aaggtgcagaggctcccggctaggatgccgcgaagctcttgagctcaagaaaaacactcgagatgcaaagatgccgggtcagggcaa

SEQ ID NO: 25430 - DNA, 158 bp, Chlorella protothecoides
aggtgcgcccatctgacgtgggggttgggggttgtgggggaaattctcatgaaccaggcttgagaagagaaggaacccacacagcctgctgccaacatctgggtgtttgaagaggttcactggatgaggtatgtctggcattgtcaactttgtaagcc

SEQ ID NO: 25431 - DNA, 89 bp, Chlorella protothecoides
aagggcaagaacaactttggcacgaagaatgttgggaataacaacattggtgagtgatgagtggagtaattttggtatgcaaggtgtgc

SEQ ID NO: 25432 - DNA, 66 bp, Chlorella protothecoides
tcccccactcaccgtcccacaacttggcgcttgtcactgagagtgacccgcatgcctgcgattttg

SEQ ID NO: 25433 - DNA, 61 bp, Chlorella protothecoides
tcgtacaatcgaaccgatcatacggatgtgaaatcgactggagtaatcgacaaacgaacgc

SEQ ID NO: 25434 - DNA, 188 bp, Chlorella protothecoides
tcgacctgtcactgagggatgataagagggtgggctcgttgggccatgcgactatggtcccgcagtagagaaaatcaagggcgtcggctgggcgacttcctttcctccggctcgccacgtggattctgtgacctcccttttgtgcttccgtctcgtcgtgcctgggggacaagggcaggtgaaacttc

SEQ ID NO: 25435 - DNA, 72 bp, Chlorella protothecoides
gggtgcttcattcattgggtgaaatcccaacgttcagtcgagtcctcctcagcgcgagctttcagagtgcca

SEQ ID NO: 25436 - DNA, 1258 bp, Chlorella protothecoides
  modified_base (112)..(121): a, c, t, g, unknown or other
  modified_base (464)..(473): a, c, t, g, unknown or other
ccggcgcaggtagagccgcggcagcgcggcactgagcgcgacgcgcagccgcgccgccagagcgcccgcatcggccctcaagatggcggcgcagccggcctgcaggctggcnnnnnnnnnngctgagcgcgccgcgcagccgcgccgccagcgcgcccgcgtcggccctcaggatggcggcgcagccggcctgcaggctggcggtggttcgcgagtcggcgatgatgcgcaccaggcgctggctcagccgcgggatgtgggcgtggcggggcaggcgcgacaccaccgccagcggatccactccgccgccggcgtggtccagcagcgcccctggcatgcgtgggtgggtgggggttgcggtgagaaatcgaaggaggaaaggtgtggaggtggtgtgggcgagataaaaaccgtggggtagaggccaagcagtactccagcagtccctcacgccagaccatctnnnnnnnnnngtaaaatccgtggggtagaggccaagtaggactccagcagtccctcacgccagaccatctcgacagacagaatcacgcccagaaagcacggccagcccctccagggccacaggtgctgcacatgcctcttggtcgccccacggccccccacctgtgagctccgggtctgccagcgccagcgtgatgagcaggtcccacagctcgtcatcccgctggttctgcacaaactctacagcctgcagagttgttgatgggtgtgggcgaggagggagaagtggggaacaaggtcacctgccaggtccctgccctgcgtcggagacccaagcatggacccccgggcgccggttccgggaggcacgctgcattgtcgggagacaaacactcagaactgccgcaccacgtccatgcaccggggattccctcctcctccaaccccctcaaaaacaccccccccacccttcctccctctttgacccacccttcccacgtcccgcaggttctccacgatgaggcgtagcgcgcggtccgtggcgcccatgcgccccagcaccagcacctgctcgggcaccattccgcgtgcctcgcaaacgcgcagcgcctcctccagcgggtagtcggaggaggcaaggagcaagccttccagggcggccggatcatactcggcggtcagctccaccgccagcgcggcgtgctccgccgccagcgccggctcgcgggtggagagcgcggccaggtactcgtgcgcgcgccggcgccaggcgtctcgctccgcggggcgcgccgcc

SEQ ID NO: 25437 - DNA, 61 bp, Chlorella protothecoides
gatggcggcgcagccggcctgcaggctggcagtggttcgcgagtcggcgatgatgcgcacc

SEQ ID NO: 25438 - DNA, 163 bp, Chlorella protothecoides
cgacagcttggcaacctctctctgctgcatcccgcctcagcatggaggcatgcctgcctgcttgcacaatcctgctaccatgttacagacaaggagctgcaggcacaagggtgttcaggggatgcaaacagtcggcatggatgctcaggcctcctcttcatcc

SEQ ID NO: 25439 - DNA, 76 bp, Chlorella protothecoides
atccagctttatctcggcagagataatattgcgcttaaggtcgatctagaacggccctcccatccccgcgtgaagc

SEQ ID NO: 25440 - DNA, 72 bp, Chlorella protothecoides
tgctgccaaccctcgccgacccctcctacttctgcatggtgcaggggccgcaagcgctggatcctgagtgtg

SEQ ID NO: 25441 - DNA, 98 bp, Chlorella protothecoides
cctggaaaggtgaggggtgttgacctctgaaaggcaaagagagcatggagaaaagagccccagggtgtgcagcagttgacattgcgtccgggagagtg

SEQ ID NO: 25442 - DNA, 106 bp, Chlorella protothecoides
gggcactcgtcgcggcgctgcgaatcagagtgaggggaaagtcaagacctggggccagagagtctttaaccccatgcgcaaccgcaacgtccagcgagcaaacctc

SEQ ID NO: 25443 - DNA, 108 bp, Chlorella protothecoides
gattcgttgctgtggtatgatgccggcaaatgcgctccaggcgttcctggacatacgagagatcatcctttctgatgtacatgcccatgcctactacatgcattgcaa

SEQ ID NO: 25444 - DNA, 117 bp, Chlorella protothecoides
tccccgcctcgtctgcaagcagttgtaagaagtgggggggggagatcaaatgagagggagattgatggcctcaaagggactgatcggcctttgcaggggcagtttgggaggcatgtt

SEQ ID NO: 25445 - DNA, 550 bp, Chlorella protothecoides
tgcctttcttgtcatacctcctcttgccagccccaacctgagctcgagctcagcagaccatctataggagtgcagcccattcggattgaactaatgtaatgggcactccagtagggccaattgtggcacagcgtgttcgtgagacaccaagtagatcgtgacttccatccaatcactggagaaggccggataccgtccggtcagcagccgggtcgctctgttcaatactcgtgaccggggaagaacaaacatcaatattgtcagcacttccctccattggtcctctgagtctggacaatagcggatttactgccgacgggcagtatcgcgacgtccgagcttagcaggagcccatctggtacgaatgctagcagagtctcaagagctttggaagaccctcatcgcatcttgatggggaggcggacatatagtttagctgtcttagctgttctcatcattctgagtggtgtcataacagtttcggtgaggatacttcgcttcgctgggtgcaagggggaggagcgcataaggaaattcctccaccatacaa

SEQ ID NO: 25446 - DNA, 61 bp, Chlorella protothecoides
cacacccagcgcacagtgagaatggtgtggccgggctgagcaagtgtggaaccaagcgcag

SEQ ID NO: 25447 - DNA, 152 bp, Chlorella protothecoides
ataaggaggctagcaagtagagaactttggggactcacactgcaccgccgctatctgctcccccgcactcaggccggtatccataaaagcaaaaaagtttcccctcccccgcaatgaagacagtcaccttgatcacccagttcagcgtgtgg

SEQ ID NO: 25448 - DNA, 61 bp, Chlorella protothecoides
ggcccacgtgccgtcctgccccattccagtacccccccccctcatcctttggctcacgttc

SEQ ID NO: 25449 - DNA, 61 bp, Chlorella protothecoides
gtttgactagcatcgacaaggtcttggcagccagcaaatattcaagctgtcactgatcccc

SEQ ID NO: 25450 - DNA, 61 bp, Chlorella protothecoides
ctgcggatcccgtcgccactcgcagactgcgtctggcccggggcagtgcagaagcacatgc

SEQ ID NO: 25451 - DNA, 61 bp, Chlorella protothecoides
tgcgcagagggggggctggtctgttctgcgtccttgggggtgtgggcgcgggatggtaccc

SEQ ID NO: 25452 - DNA, 66 bp, Chlorella protothecoides
catatggtgctgccacaaccgacagcactggagcaaaggtatgagccagtggctgcagtagcagcg

SEQ ID NO: 25453 - DNA, 145 bp, Chlorella protothecoides
gccggcaggtgcgggggggagggggacacagagtgcatgaactccccacctgcatccccgtgttctcagtcctcacccttcctcatgtacgaccctgcacagccagcaacgagcaggcgaggacccaagggaggcgttcagaaac

SEQ ID NO: 25454 - DNA, 157 bp, Chlorella protothecoides
taggcaagtaggaatatttgtaggaggctctcagactaccactgtcatcagtgcatgtaggaacccacagaatgttgctgttaactgccagctcggcattcatttacactgcgtctggtgcgcaatttaccggccctgaaatgtgtcaagaaagctt

SEQ ID NO: 25455 - DNA, 61 bp, Chlorella protothecoides
cgggcatatgaatacaggctgctgcttgggtacacggccgcggtcgggcagtcttgttatg

SEQ ID NO: 25456 - DNA, 96 bp, Chlorella protothecoides
atggatgtcaaagaagctgtaggactcgaaatatgccgcatcgacttgggcagaggccggagggctaccagattgggtcttcccctgagctgccgt

SEQ ID NO: 25457 - DNA, 119 bp, Chlorella protothecoides
tgcactcatctgtgactagaatttgcagcaggtgtgcgagggataagcagttcaagttggtgatgctatcagcatacatggagctggcggctcaatgcaacagttgtgggtttgtaaaa

SEQ ID NO: 25458 - DNA, 72 bp, Chlorella protothecoides
caagctgcgcgatactctgccacaactgtcgagactcctgtgcccatctgcagttctcaaacgtacgatccc

SEQ ID NO: 25459 - DNA, 75 bp, Chlorella protothecoides
ggacaaagcaggcttggtatcgcgactcctttcaatgcgtgtcggagatgcgcgcgcgcacagtccgcattccac

SEQ ID NO: 25460 - DNA, 76 bp, Chlorella protothecoides
tcccgcatccttgtactgggttgggaccgcattgtcggctggcagttttgaatgccgccaatgaagcgaagagcgg

SEQ ID NO: 25461 - DNA, 299 bp, Chlorella protothecoides
aggttataccaaggcggggctgattggcttttgcgaccctgcccctggaaccgaaaagaccctgttggtgctcttctcctaccgggtgagatgggtagggcgagtcgcaatcaaagggagactggaggggtgtctagcaaagctgatgtggctgtccggctattgtcccactggctgttatggggtgcacatgcgtggagggctcggtgaccagtcggcaagaccacagctggtgttgcaaggggggcggtgagtctgagatccttgtgggaacacatgctcgctgggcatgagactca

SEQ ID NO: 25462 - DNA, 138 bp, Chlorella protothecoides
ggcgtctctcttaccatcgattggcctgactggtgtcttcaagagcactgccttgttgttttctgtaactagacactgcagagctgagtagaccccccgccctgtgataggcccttcttggcttgcactgattctcaa

SEQ ID NO: 25463 - DNA, 61 bp, Chlorella protothecoides
atgtagtgcacgaggaacatggccatgagggccgcgttcacggggtcggataccctcgccc

SEQ ID NO: 25464 - DNA, 233 bp, Chlorella protothecoides
acattgcgggtccttttagatccattatccggtgaagattgaccaaactggtgcaagaaacaggaacagtccgatggctcatcaagcgagcatcgtcgtggaccatacggctagctgatgataaaggtgaatgcaacaacaaaaggacgccatatctgaccgatggagtcatgtgtcacagacggatgtacgctgaattaccagattcatttactgtccctctcagaggctat

SEQ ID NO: 25465 - DNA, 66 bp, Chlorella protothecoides
gctgatcaaagacgagtggaaacctattttaccacaccagccatattgcctgtctcccaatccgag

SEQ ID NO: 25466 - DNA, 100 bp, Chlorella protothecoides
tgacattgtcggggatggcctgatatcctgccatgctctggtcaggaggtcccaggtcggcaccaaggcgagcacgcatgaaggtaagagcgcagtgagc

SEQ ID NO: 25467 - DNA, 134 bp, Chlorella protothecoides
gccatgcgcagagtcgcgcctcaacaattgcttctgaggacaccaggtcttcttgtttgtctggcaaccatcaagcctatcgagaaagaggcggcttggtgcaagtcagaagcatttgtgctcgtccaggacat

SEQ ID NO: 25468 - DNA, 96 bp, Chlorella protothecoides
acttcgctcgtcttgtcttggatttagctttagaggagccatcgaacgttgcttggtcctgacgctccaggagggccatccccgccctgacctaat

SEQ ID NO: 25469 - DNA, 68 bp, Chlorella protothecoides
tgaaacctcctggtaacttcacatcccgcctcccccccttccaaaccccacctctcgtcacgggtggc

SEQ ID NO: 25470 - DNA, 80 bp, Chlorella protothecoides
gggcagaggcgatgcgccgggaggtggctggaaggcaggtcgcttttgcacggctcgaattggagggcaggttgcgctgc

SEQ ID NO: 25471 - DNA, 61 bp, Chlorella protothecoides
ggcatgggtgacgagagcaggcacactgagtgatcaagtgacaccatcagcagaccagccc

SEQ ID NO: 25472 - DNA, 61 bp, Chlorella protothecoides
cagcttgtatttgcatgcatctcccccctccggcctgcgctgtgtcccgccccacccaggc

SEQ ID NO: 25473 - DNA, 61 bp, Chlorella protothecoides
tacttgagccacggagagattcgctggcttcgaaatttgagcacgatgcttgctcggcgga

SEQ ID NO: 25474 - DNA, 63 bp, Chlorella protothecoides
cgtgcacgacagcagagatctcccagtccccgccgtgcacgacagcagagatctcccagtccc

SEQ ID NO: 25475 - DNA, 77 bp, Chlorella protothecoides
aggtcatcctgccaaggattctgtacctgcctggcacacagagggttctgaagcgcaaagacgatgggagcctggac

SEQ ID NO: 25476 - DNA, 76 bp, Chlorella protothecoides
ggcttcgttgcggcgggagacaagtatgcaggccttcccaccatcaccataccgctcatcagcgagctggtgaggg

SEQ ID NO: 25477 - DNA, 57230 bp, Chlorella protothecoides
  modified_base (306)..(315): a, c, t, g, unknown or other
  modified_base (1872)..(1881): a, c, t, g, unknown or other
  modified_base (4481)..(4490): a, c, t, g, unknown or other
  modified_base (4702)..(4711): a, c, t, g, unknown or other
  modified_base (5185)..(5194): a, c, t, g, unknown or other
  modified_base (5631)..(5640): a, c, t, g, unknown or other
  modified_base (5702)..(5895): a, c, t, g, unknown or other
  modified_base (6160)..(6225): a, c, t, g, unknown or other
  modified_base (7260)..(7269): a, c, t, g, unknown or other
  modified_base (8398)..(8407): a, c, t, g, unknown or other
  modified_base (8882)..(8891): a, c, t, g, unknown or other
  modified_base (8989)..(8998): a, c, t, g, unknown or other
  modified_base (9093)..(9102): a, c, t, g, unknown or other
  modified_base (10029)..(10038): a, c, t, g, unknown or other
  modified_base (10324)..(10333): a, c, t, g, unknown or other
  modified_base (11754)..(11763): a, c, t, g, unknown or other
  modified_base (14147)..(14156): a, c, t, g, unknown or other
  modified_base (14994)..(15003): a, c, t, g, unknown or other
  modified_base (15572)..(15581): a, c, t, g, unknown or other
  modified_base (16281)..(16290): a, c, t, g, unknown or other
  modified_base (16579)..(16588): a, c, t, g, unknown or other
  modified_base (20730)..(20739): a, c, t, g, unknown or other
  modified_base (21106)..(21115): a, c, t, g, unknown or other
  modified_base (24001)..(24010): a, c, t, g, unknown or other
  modified_base (25581)..(25590): a, c, t, g, unknown or other
  modified_base (26884)..(26893): a, c, t, g, unknown or other
  modified_base (26969)..(26978): a, c, t, g, unknown or other
  modified_base (27235)..(27244): a, c, t, g, unknown or other
  modified_base (28439)..(28448): a, c, t, g, unknown or other
  modified_base (28975)..(28984): a, c, t, g, unknown or other
  modified_base (29793)..(29802): a, c, t, g, unknown or other
  modified_base (30581)..(30590): a, c, t, g, unknown or other
  modified_base (31231)..(31240): a, c, t, g, unknown or other
  modified_base (31555)..(31564): a, c, t, g, unknown or other
  modified_base (32531)..(32540): a, c, t, g, unknown or other
  modified_base (32951)..(32960): a, c, t, g, unknown or other
  modified_base (33128)..(33137): a, c, t, g, unknown or other
  modified_base (33207)..(33216): a, c, t, g, unknown or other
  modified_base (33287)..(33296): a, c, t, g, unknown or other
  modified_base (33783)..(33916): a, c, t, g, unknown or other
  modified_base (34090)..(34099): a, c, t, g, unknown or other
  modified_base (34201)..(34210): a, c, t, g, unknown or other
  modified_base (34312)..(34411): a, c, t, g, unknown or other
  modified_base (34784)..(34793): a, c, t, g, unknown or other
  modified_base (34898)..(34907): a, c, t, g, unknown or other
  modified_base (35022)..(35031): a, c, t, g, unknown or other
  modified_base (35305)..(35314): a, c, t, g, unknown or other
  modified_base (35500)..(35509): a, c, t, g, unknown or other
  modified_base (35970)..(35979): a, c, t, g, unknown or other
  modified_base (36393)..(36402): a, c, t, g, unknown or other
  modified_base (36458)..(36467): a, c, t, g, unknown or other
  modified_base (36706)..(36715): a, c, t, g, unknown or other
  modified_base (37124)..(37133): a, c, t, g, unknown or other
  modified_base (37768)..(37777): a, c, t, g, unknown or other
  modified_base (38063)..(38072): a, c, t, g, unknown or other
  modified_base (38431)..(38440): a, c, t, g, unknown or other
  modified_base (39569)..(39578): a, c, t, g, unknown or other
  modified_base (39980)..(39989): a, c, t, g, unknown or other
  modified_base (40851)..(40860): a, c, t, g, unknown or other
  modified_base (41461)..(41470): a, c, t, g, unknown or other
  modified_base (41890)..(41899): a, c, t, g, unknown or other
  modified_base (44275)..(44284): a, c, t, g, unknown or other
  modified_base (44471)..(44480): a, c, t, g, unknown or other
  modified_base (48112)..(48166): a, c, t, g, unknown or other
  modified_base (48327)..(48336): a, c, t, g, unknown or other
  modified_base (48532)..(48541): a, c, t, g, unknown or other
  modified_base (48954)..(48963): a, c, t, g, unknown or other
  modified_base (50114)..(50123): a, c, t, g, unknown or other
  modified_base (50498)..(50507): a, c, t, g, unknown or other
  modified_base (50589)..(50598): a, c, t, g, unknown or other
  modified_base (51528)..(51537): a, c, t, g, unknown or other
  modified_base (51601)..(51647): a, c, t, g, unknown or other
  modified_base (51807)..(51816): a, c, t, g, unknown or other
  modified_base (52840)..(52849): a, c, t, g, unknown or other
  modified_base (53383)..(53392): a, c, t, g, unknown or other
  modified_base (53844)..(53853): a, c, t, g, unknown or other
  modified_base (54336)..(54345): a, c, t, g, unknown or other
  modified_base (55791)..(55800): a, c, t, g, unknown or other
  modified_base (56037)..(56046): a, c, t, g, unknown or other
gaggcgccggcagaggcggccgcgccggtgcccgcgccgtcgccggccggggcaggggtgaaggcgccgtgcgcgcgccagtcgcgctcgtccgcggagtcggcggccacgcgctggagcagctgctgctgggcaaggcgggtggggtcggagggatccagcacgatgtccagcgccgagctgcgcagctccgaggggggctccgtgaattgctgcgcggggtgtgtgtggcgggggggtgggctgtgcagcacttgggggcgaggaaggcaggaaaccgagggcatcagccacgtggggggacannnnnnnnnnggtgtgtggcagggaggtgggcggtgcagcacttgggggcgaggaaggcagggaaccgagggcatcagccacgtggggggacaggcggcagccccaccccaccccaccgacaccaacacccacagaggcaaaggtcatgaggaagtcccgggagtaggtgatgacctccccgcggggcttacgcttctccgccacagagggaacatggaaggtctgcgagggggcgatggggaaagagggtggtggtcatttgggcgccggagtcggcactggctcgcatcccctgccacaccccgctgccagcgccctcggtcaccccggcaaacgggggcggaccctgctcccgatgaaagcccactcacgttcagcttcagacccactccagcgcctttggcaaagccggcaaagggattggtgcccccgcccggccgcaaagacagagggcgcaggctgatggtgtcgccgccctgcgtcgccatggctgcacggagcgcccacgtatggtgaagggggtgtatgggcgaatgtgaaaggggcaaggggtcgcgaggacagtcgtgatggccatcgccggcacaccctgcgcccctggcggaagcagattgtgctcgccgcgcatgcacagcatggatccttgtccgtcgagatgtgcagaaagaccacgacgattaagatgctcagtccaggctttgatgatgaatcatttctcatttgtatgaagaatctgtcctcctcccgttgaagcccttgagaacacctcagacaatggccaataagacatactacattctaggtagtgcaagcctgcaacacactgcattgcctatgcttttcaagacggtcagtgtatcctggggtgttgattgcgtgctgacccgccaagtcaatccaagcttccctctactgtttgggtgaagagtctgaactgcttgagacaggcttgacaagctcgactccagatgatctccagagtgcctcatactgttggaagattagatatagttcctcagacgttgtatgtggaaggatacacctgttgtatcctctgattaccaacatgcacagcagaggcatggacacatgctcctcccatcccaagaacctcgtactcacagccttctggttctggtagtaggctccacccgccccaaaaccggcaccgaaggccagagaagctacacgtgccgtctttccacctgttagagagcagaatgatggtgggagagtccgggtgagggctgcacacatgctggagggaagactgacgacagtcctgctgtgcagaaaacagcagtgactcacgcaggaggacgagacctcccacagctccgatcaggctcccgtagaagacgctgcgcatggtgatgtcgatggcattgtcccacttctcgtcgatgtagtaatggaccttgctcgcctcgctcccggacattttgagacaaccctgtgcgcgcagcgagggattgttccttctacgaactccaagggtacaaaaggcaatcgaacaagtctcaggtcgatcactgtgcagcagcgtccgcgaatcaggctacccannnnnnnnnnatacaaaaggcaatcgaacaagtcccagatcgatcactttgcagcagcgtccgcgaatcaggctacccaggccagccggggcggtgcaatcccccattgcctctcgcgccccctagtcgctccgggcgcgcggatttatctccctgcgtgaatgtgtcgccagtccctccagcacctcgtcaggcatgcgcccgatacctctgtcacagcagtatccattgatctccatgtcataagctaagggaggcgtggtcgttggaggtggcaccccactccccgtcacacagccccgcatgctgggttgcaaccgtctcctccccggtcctttcgccctcttttccccccgcattggttccagaccccgactgaatccactgtattcccgtcccatggggtcgcactcccactttaatccccccgaggaggttccccaggcagagggggcctgggagtggttccgtggcatgggcagcccccagttctgggtggcgcctatggttgaccagtcggagctggccttccgcatgctgtgccggcgctacggctgcaccgccgcctacacccccatgcttcacgcccgcctgttcctggaggggcgcgcgtatcgcgcggagcacttcaccacctgcgacgccgaccgcccgctgctggcccagttctgcgccaacgatcccgacaccctgctccacgctgcgcggctggtggaggaccaggtggacgccgtggacctgaaccttgggtgcccgcagcgcatcgcgcggcgcgggcgctatggcgccttcctcatggacgacctgcccctggtggagtcgctggtgcgggcgctggcgggcggtctgacgcgcgcccgcgtcacggtcaagattcgacgcttcgacgaagtggggcgcacggtggcctacgccgccgcgctggagcgcgcgggggccagcctggtggcggtgcacgcgcgcacgcgggagcagaagacggcggccgccgtgcgcgccgactgggcgcacatcgccgcggtcaaggccgcgctgcgcgtgcccgtgctggccaacggcaacgtgcgcagcctggcggacgcgcgggcctgcatgcacgacaccggcgccgacggcgtgctcagcgcggagccgctgctggccgacccgggcctgttctggggccggcgcggcgagcccggcggcgacggcggccccaccgagggctgccgcctcctgctggagtacctggacctgtgcgacgcctaccccgcccccttccgcatggtcaaggcgcacgccttccgcatgctggggccctggctggccgagcacaccgacgtgcgcgacgagctcaaccgcgggcccgacctgtgcaacgagcgggtgcgggagctcaccatggagctggtggacaggatagaggagtgcgggcgcgacgcacccatccccaagatctccgccaagtgcgttgatttgtgtgtgagggtagtttggaagggggggatgggggtcggagtgtgaggggtcgtcggtcctgggaaataccggaggtggctggtgtgagtttgctgacgggggggttgatcgtgtgtggctttggagtgtagactcgggcacagcagtgtgatgagctgcctcattccaagcgctgctccatgggtcaggctatgcagtgttcagtgtatcctgcttgggctgcatgaggcgaggctggtgccaggtctggaccctgccattgagaggtgcgccttcgggagcaaaggccttccctcatccaccttgcacctgccctgacctttggtgcaggaaactcgcggccatggaggccgaggcagcgcgggcggctgccatagcggagcaggccagggaggcagaagggctcgcggaactcggggttgtgagcgctgcggccgagaccgtccattgacagcttggcagcccagcgttcctgccctaccttccctgaactcggtcatcatgcacctgggcaggcattgcccgtgtaagcttgcagcacatcagcaggagtgcaggcgtctccatatttggcacgtcgcgggccagtgctccctcagtaaacaacagcgccgctcggcactcacgccgccacggcctcctctgcgccatccagcccgacgtcgtccagcgagacctcaccctccaccacgcgggggttcaggtctatgagccgtgtggacagctgcgccagctcagcaatggctattcgtccccgggaggtgatggcttcggccacggcctccagctccccccgcgagatgtagatgaactgcgtatggggtggggcggcgtcggccgggggttccctgcacttaccacaggcccaagcacccctccctcatcacatcaggctcgcgtccccaccctcgccacgcaccttgccccggtcgtccatgatgccggtcagcttctgctcggcttccaggccctggaccttcttgatgacgtccgcgaccttcagcccaaactcggccgctagcgcgtcaagctccaccgtcttccgcgtctggatgtattctataatctgaccctccagggactgcgtggcaggaagtggttgcatgatgggctctgtgcttgccggcgagacgccgagggtgacggtggggnnnnnnnnnngatctgaccctccagggactgcgcggcaggaagtagttgcatgatgggctctgtgctcgccggcgagacgccgagggtgacggtggggttatgaaacctgcaggcaggtcaaaggccccactccctcagccacacaagctccaaggggaaaccaaagaggtgggtccctggctcatcccccagcccctatgaaaggccttcccaactcaacnnnnnnnnnngaggtcaaaggcaccactccctcagccacacaagctccaatggggaaccagagaggtgggtccctggctcatccccaagcccctatgaaaggccttcccaactcaacccactccctccacacctcgccctgctcctgggtcaaagcctcctgccctgtctcctccaccgtgaacatggatcgccacttctccgcctctgccttgtcccgggcctcacgagccgctgcggccgcggcaatctcggcctcctgcgccgcttccagagcctctcgctctgcttcccgctgcgcacgctgcgcatcataggcctgcagggacgatactcatgtgagtgcggaggctccaatatgggcaggaggatagaaaggagaacagagcatggaccaagggataccattgtgaccgtcaatcacactgcaagcattcgaccacacccaatgcctgcctgtcgttttgaggctaccacaggctggnnnnnnnnnnaaagggacaccattgcgaccgtcaatcacactgcaagcactcgaccacacccaatgcttgcctgtcgtttcgaggctaccacaggctggtgctgctcttgctgctcatcctcgccgtcctcaccatatgcctgtgtcgcattgaagcactgagtcttgccctagaatgctgaataccctgtcatccaatctacacccattcctgaggcagcacgcaaatgacatcagtccttcccacctgttcttcatcatcagaggatgcatggcctctggccctcctggccctgcggcgccggagtccggcctgcatccccccgcctgcccctctcctgtcatcctgcgagatggtgcagtggaggctgcctttgttgtttttagcacaaggaccccatcccaggaaagcctgatgcacgaagcgcgtacactacctgctcaggnnnnnnnnnntaaacactgagtcttaccctagaatgctgagtaccctgtcatccaatctacacccattcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtagcacaaggaccccatcccaggaaagccgggtgcacgaagcgcgtacactacctgctcaggagctgccacctcgatgattgctacactagatctcgtcttgatccaccatgctgccgttgcaaggacgatcaccgcgagcagcagtgttaccaaaagcggcaacatggtgtaagaagtgatctcaagggcccgagcgagagttactcagccgtactaccttaattatacccctcgtcttatcacgttttacagtgtttnnnnnnnnnnnnnnnnnnnnnnnnnnnnnnnnnnnnnnnnnnnnnnnnnnnnnnnnnnnnnnnnnnacacaaaccttcaacgcgcgcccagatgagactcgtcctcaaggcgcgctacatagcacagctcggtctcaagggcggagcaggattgcgattgatgacccaggtcatcgaggtcccatgcatgtaacttcacagcggattagagcccacacttcacctcgaggaggccctcgtcatggcggtggcgattgccacagtgttcgaccttccggagaagacttttgcgcggtgcactcccctcgatgcggggccctccacgggagtccagctcactctggagaggctggaggcattggagatagcagatcgccgaacagatgccgacgcctccggcctgacctgcacctcctgtggcctgggcagggcacaggagccggccttcccatctgtggagtcccagcgggagcacttcagaggggactggcaccgcttcaacctgaagcgccgcctggcgtcccttcccgcctgctccgaggccgatttcgaggccctggtggcacagagggacggcgccgaggtgggcagcttgtccggcagcgagagcagtgacgacgaagatcacaatggcggcggggagggcaaggcaccagacagggcggacggagggcccagcgcctccacgtctggagcgcgcgggccctacacctgcttctgggacccgggggaggaagagacgctcggtgtctggcgcagcattgtgggcggggccagggatgcggcccccagcgaggaggcggcctggagcacgctgcgcacgctgcggacaaagggcgccacctgggcagtcatcatgctgcgaggcgggcactttgcggcctcggtgctcaggctggtccccgctcgcatcgccgacaagcggattgcggacaagtttgacgtcgtgggcaacacctcggctcaccgctacgtcacaaggtgggtgctctgactgacgggccagaggagagggaagtggctttcctctaagggggagggagcctggcatgcagatgctgggcatgagctgtgaaggggtgcatgctgcgccaaggcggnnnnnnnnnnctcttagtgggagggagcctggcgtgcagatgctgggctggaggtgtgaaggggtgcatgctgcgccaaggcggcctccgtgtccagcacagctccattcgagatacacattgacacgcagctttgtatctcaaacccccatcacactcttcagggcaaaggcgggcgggaagcagtcgacccaggatgcgacgggcaaatttgccaagtctgccgggtcgaggctgcggcggtacaatgaggccgccctggcagaggacgtgaagagcgccctcacctcctggacggccttgctgggccagtgtgatctcatccatgtgcaagcgccggggtcaaactggaaggacctgatgacggctgcaccggcagtgctgagccccagcgaccccaggctgaggtgagtcatgggaggagaggggtttgggacaattttctttgctccttgtgggccgtgacacagggcagcggactgttgaggaattgagccacgaacacgctcccgggtcaccttttacagaaacgttgccgactacaaaggtcccatcccaccagattgtgttggcatcaccattgatggtacacctccgcccgctcaggaccgtgcctttcaccacccggcggccgacgttctccgagaccaagcgtgtcgccaggatcctcatctcagtctatcgcatgcctgccaccggtcagcccagccagccttcagttgaggcgccggggggggaagcggtgcgaggaaagcagtccgaggctgggcctggatcgcagcccggtgcaccccgccctggagtgtcagctgaggtcatcagtgcagctgaccagggccctgcagaacctgaggcgcccaagggcctgtccaagaaacagaaggcaaaggcgcgggccgcgcgcagtaaagccgcagccaaggagcaggcagcgatggggggtgagtcccaagaagaggagcccgcgcccaaatcctccgagcctgttgcggacgagggtgacgtcctaagccgagcggcggccctggcagccgccaccgccagcgcagcgcgcaaggggtgagattggcgacagctaagacatttttcaaggcctggatgatgcccagggattggcgtgagtcacagtggatggtctnnnnnnnnnnggcgcgcaaggggtgagattggcgacagctatgacatttctcaaggcctggttgatgccctgggattggcgtgagtcacagtggatgggctggcagaattcttcatccgccactcccatcccattgcctgattcctgtgcagggccgccactccggcgcgaagcggccgacctgccacccaggcaaggagggccgatggtgggaagaaaggagggaaggtcagcgcagaggacattgcggctcggcgcgtgcggctggccgccgccgccgaggcacgcatggcggccctggcttccgcttcggctgcacagaagctgtggtgagggctgctggttgagcgctgcatcccctcgtcggctcagaccttgccagccctgctgcatgtccgcaccctcccccccctgcacagggaagtgggcccaggctgaggggtgtggtgatgttggtgggtgcagcactcctggtcagcctcttnnnnnnnnnncactgcccacgttcctttattcagtgtacttgccactgttggctcgtcgtggcactgagtgctcagccaatcaccaatcgccacctcgtcccattccnnnnnnnnnncggctctggcaggaggaggatggaggcctgataaggaatagttgctgacacaggttgaaatattcaatactgaggcagcttctttgtctttgtcnnnnnnnnnntggctctggcaggaggaggatgggggcctgatgaggaatacttgctgacacaggttgaaatatccaatactgaggcagcttctttgtctttgtcatgctttgccaggagcactccataccttcctttcagaatcagcaggggaactgcccacattcctttattcagtgtacttgccagtcttggctcgtcatgccactgagtgctcaatcaatcaccaatcgccacctcgtcccattcctgctgcaacccttgtgagctcctgctggcatcatacctgactgctgtcagagtgtccacatgttttcaactgtctaggcgggaacctctgcgatgaagcactgcacggtcaccacagctggctactgtgcaacatacaagtcccagcacgccagctgcaccgccccggctgccgctcgatccaagagctccaggatgcgcaggcggaaggccacacaggggaagcacgactcggtgggcaggtcaaaggacagcgcactgccgcgctcggggaagcacagcccctccctttcgtccagcgtcacccattctattgtttgtgggacgtggtgggaaaacatctgaggcatgtgtccagcaaacctgcaccggctggccagcagtctcagcagaagccggctccctccccaccgctcggtttccagcctgaggccacagcctggttggcgttcaaacagccgccccgatacagaagtgacccctccatccacctgagctgccgggccgctggccctccagggcaacagccttggggtcccttgccggcgcatcgttcccggcggtcagcacgtagcgcgccacctccacgccagccttccctgccccaccccgcacacggtactcgagccaggggaccgcgccaggggcgccgcccccaaaatccagccacttggtggctgggtccccgnnnnnnnnnnccctcgcacccggtactcgagccaggggaccgcgccgagggcgccgcccccgaaatccagccacttggtggctgggtccccgtcaagcgcccgcacagcggcctccgcctcgccgttctgcccggaggccctgaccgcaccccccgtcagccggccggggaggcgggcggccaccccctcgtccccggccaggcgatatcgcaccaagggcggcccagctgcggctgggccctcgtctgcagcgccagctttgttccccccaccctcgccacgggacgccacccannnnnnnnnnctccccgactgccggcccggcaacctctggcgggtagggactgggtttgggtccctggccgcgtcagccgcgtccctggccgccagctctgcgagttggtcggccgagaggtggctgcgcagctgcgccgtcgtatgagccagatactctttcaaccagtctgtttgaggaggatgtagcaggttttgagacagaggtcggggaagacagaaggacgaccatggacaggggcatgcatggaggctagctgggctctcgtcaagcagcttcccaacccagctgcctcccaggacccctggctgccactctctccggcccacctgcgtccacgagcactcggcgcgccttcatggcctcccagtcgcgcgcatacctgcaggacacatccaccacaccgttctcgtccacagcaatcacgtacgacagccgcttgccccagccagccttgatgtgtgtgtgtggaaggtgtggggttgtagggagggatggatttgataggctgttcccctcggaccgtcgtctcatcgaggtgccaagtcaggacctctgctgcacacacggctgagcccactggcccaggcccacgcctcacatcagacccggccatgctgcaccgccgtccagctcaaaagccgtcccccttcctcccctttccccttttccacctcgtagaggagcggggtgtccatggcggcctcgcaggggtcggcgtgcacccagcgccccggcgcctcccccgcccgcagcggcaggaacacctccgcccacacgtggtcggtccagtccagggcctggcgggcgcggaggcctgcagcggcgcagcacagcgcgaaggcgttggcccactccccacaccgcccgcggcgcgtctccagcagcttcagcgggtcgttgtagcgcgggaagcgggtctccgcgccacaggccgagcaggtgtacacctctggcgtcggtgcggagggcaggctgaggagggtcagtgctgggatgctgggtgtccgactctcgtgcatgaggcctctgggagccacagggcgtggtccagaccaccacgcccatcccacgcggcacatggacaggcaaggaagagccttgcagcctcgcggccagccaggcaaccctccccagtacgcgcacccacgaccgaagccaggtgggctgcctcccgcgaatcgggcgccgccgtccgggccaggcgggtggtgtctttgccatcgcagtacccgcacaccggccggtcggtctgggggaggccagggagatgcgatgcatgggcctgatagacctgcgtcctgtgccatgggatgcagggggcgcgcgcagacatgcaccctccgcggagcagcacgtgcagcgcaacctcccctttccttctcatgccccgccccgcgcagctcctcctagcagcccacccaggtgannnnnnnnnngtccttctcatgccccgccccgtgcagctcctcctagcagcccacccaggtgaagaactcggatttgaaccaggccagcaggccccgcagcagggcctcctctctgacgagcggggggtcctcctccatctccatgctcagggccaccgccgcccctgcctcgccctccagcctgtctaggggcatgaggctggctgccagggcctgggccaggtcgtcctggtagatactggccttgcgcagagcatcctcgatgcgagcgatgaaggcgcccgtgtgcacctccctgcctcccctcagcatgctgtcgacggggggcgaccccggcacccgaagacgacgaggggggcgggggagcgggacggtccgcaaccggtgccgatgagatgctggctggtgatgatgtagttgagagacctttggaccaagtaacccctccagcgctgcggatccgtgtgctcacggcccggtgtggaagtgatctggcccgaccgcgcggccgcccaagtggaaactggtagccccccgtacacaggatccagggcagtcgacctctcaggctgtaccagcggacgaggatcgagcgcaggcgccgctcgatcaccctagcgggagtgccgcgctggatcgcagtcatgagcgggcgtccagtccgctcaccccttcgcgcctcccaaggccaccccccccaagcagtgcaacagtgtacatggcacgtgggatccatacaagaatgcaaccacacatcacgcctcgccccgcgcggcagcggccagctcccccagctcctcccgcgcggcatcgctggccaggaaggcggcgcccaggtgctcgacacccacctccccccccgtggcctccccgatctgggccagggaggccacctggcgcagcttgcgcgccgccttggccgacagcaggggccggagcagggccaggacggcgcgaaggaagcccgcggggcggaccagcacgatgaccttgacgttcttgcggaaggggcgcggcagcgtggtgtaggcgcccatgatccacatgctgggcagcgtcgcgcggcgcgcggtcagcaccagcacgtagtccccgccctccaccagtcgcgcgaggtgtgcggtgacatagcgtgcggccgaggacttcatgcccgccggcacgcggtctgcgtccagcaccaccacggggcggcccagcgagtccacgccgtcggcgtacaccaggccacggaaggtctcctcccaggcgggattgaactcctcgggcagcaccacgggcgacggcggggcgggcgcggccgcggcgccgctgtcgggcccggcctccatggagaaggacgccgcctcgaccttgggaggggcgctggttgaggggaccccacccgcctctccgtgctgtggcacaccgccggcgctctccccgctgcggtagatggtcaggtcctcgatctcctcttcctcctcggcctcggcctcgttgcccggcccctgcgacgcagccgcagccgccggggccggggcgccgccggccgtcgtcagcgacagcatcgcgcggccctgctccgccagggtggcggggctgtccgcgctgggctctgcctgcaggctgtgcttcagtcgcactatcgcagactcgttggccgcatactcgtggctggcctcgctgctgggggatgagtcatcctcggtgagggcggcggcgggcgctggagcggggccgggcgtggctggcggcgcggccccgtcggccccagatgacgcagcatctgcctcttcagcgctgggccctgccgtggtgacccctccagcctcgcgcctggcaccgtccccaccccccgcatcagccctcggggcaggctccccggagcgcgacccctcgcccgccctgctgctcccctgcacatccacctccgcgcccgcctccgggggagggacctcctccgcgtcctgcagcgagccggcttgcgcctgcgtgtccgcgcgctcagcctccagctcggccgcctcgccggacaggtcgccgcccggctcgtcggcgcgcagcaccgactcgcggagtctggaggcgccacgggggctggcggggccagtgccaacgctggccgcgtcatccgtgccgtcctccgcctcgccgcgggcggggaggcccgagatggaggacccgggggagagcacgacctgctcctcctccatcacgctgggctcggtggccagcagggtggcgccctggaggaaagcgcaagcgcgtgagcgagtggatgaggggtgggggatgggtctcccgtgagtgctccctgtagacccaccccgtgaacgccctcgagttgtggtgagatccgccgccaaaaaggcctcaacagccagggtcgcaacacgtcgtacctgcccaannnnnnnnnntcgtgagtgctccctgcagacccaccccgtgaacgccctcgagttgggtgagacccgccgccaaaaaggcctcaacaaccagggtcgcaacacgtcgtacctgcccaaggcccaggtcgtcctcggcagcctgtgcaatcttggtgtcctcgtcacgggcctcagagtcgagctcatctgcagtcagcagtgccagggggtgggtcacagatgaacggtgccaccaagacgcgttgagagtccgctgcaggagacagggcccctggcgacctcccatacccctgctcacactcttgattgtcatacaccgacagcgcgtccttctcggctgccatgctgctggcaatcgacctcgtgtctccgtcacggggtccccgcctcacccccgcccagtgatgggtatccagacccggtgcaccggcatccaccacttgtggaagatcgacggggcgcttgccctccctcccagacccgacgctggagaccttgggggaggtcgtcccctccgatcccgtgcccgcgccactgcgtagctcgatgactggctcctccaccgtcatcgaaatattcaacgtcttttttaagattccagagggtacttggatcaaagagtctcggagcttggtggacaagtgcccgattctcgtacacaaactcgaatctaagggatcggttccctggggaatcacccccctgacgaggccagcaaggagggcagcttcccttggaaagcgaggctgacgcatggtgcaccagactcagaccaactcgcgaacacgagggaatgcctggatgtaggatgccttggctgagtcccccggagtccacaacaatcctnnnnnnnnnntgcgaacacgagggaatgcctagatgtaggatgcatccttcgctgagtcccccggagtccacaacaatcctccacccagagcacctgtctctcccaccctagctcccagctactagatattgtctctgcgcggccttgcaaccatgctcctccaccaactgtttggataacggggcgttacatgggccaggaggtggtcagctgcaaggctcacttcttcttcctgccacccttgccggcgctctccttcttgacggcagcggcctccttggccttctgcagcttcagcaccttcttcacgatcttctgctcctccaccaggaaggcgcgaatgatgcgctccctcacgacgccagcggccaggtgaccgccgtaagcacgctgcacggtcttcttgctcttgttcaggcgagaaagctcacgagggcgcacggcaggcagctgcagggatgagggcagtggagtgtttaagactcgacacgtgggttgtatgctgcagaaatgcctcgcatgtccgatgaatgcttaagcatgacgtccccgttcttgtcgtccaagctcctacccannnnnnnnnncgcagaaatgcctcgcatgtccgaagaatgcttaagcaggacgaccccgttcttgtcgtccaagctcctacccagaccttgcacccgcgaaaaccagtggtgccggcgaataccgcctaccctcctcgcgcaccccgtccgcctcaagcttaccccgttcaggcgctggccggagatggggcagaccgggaaggaagcgggcttcacctggcgctgatagacgagcttgccgcctacgagataggtggagaagggaatggtgttcgaactcggacccctcacaacgccccgtccattgagggatacctatagagctttaaactcaccgggcgtcttcacgatgcgctgacggttgctcttggtgtggtaggagtgcctccgccggtaggtaagacgctgcaccatcgtgacaggctactcggcgctgctccctacgcctatctgtttccactgtcaaagagggtttcgcgtgtggaggacgcgcaccttgacgggaggcgcacagagacgcccgtcgagagccgcctgcctggcacccccaataagaaagcgcgggaatcgggctgggccccttgagtgctcctcacagtgctgctggatcatccaccgatgaaagcgaccaggtgaaagtctcgacatcaattgaactcgaggtttcacgtgcatcaagcaaggtaaggtgcttctgttctcggcattnnnnnnnnnnctgctgctggatcatccaccgataaaagcgaccaggtgaaagtctcgaaatcaattgaactcgaggtttcaagtgcatctgcaaggtaaggtgcttctgttctcggcattcctcaaataacattagctgctgtcctctgaagatatgtgtgtcatccttcagacttggaaatgctgtgctcactgtcattgtagatgtgaacacagcaaatttgaaagtcttcacgactgttgcggcttgattcaagacaaaactcatgggctgtgaatacaacttgaatgggctgctnnnnnnnnnnccaaatttgaaagtcttcacgactgttgcgtctcgattcaagacaaaattcacgggctgtgaatacaacttgaatgggctgctaggattaggtgtcacaagtattatgcttgttccacaatcgatcagctgaaccaccctgagatttccatgatattgttcttctgcacattctcccctcgagttgaagattacaggggatgtataaaatcttctggtccatcctaacacgttcagcttggctccccgttccgacaaagactctgcccgtttcaaaatcaaggcgtcaccacgaattcacaaatatctcacccgtcttgctgcccattctattcaagattcctaaattcagttaccttaacacgtagaggcgggtcgcctcctggaaggtcctcgtcgccgaccaggtgctgctgtgcctccttccaggtgtggctcgaatggtagagcccggcatgctactcgtacaccaataataagggccattgtttgctcgtgctaactccttcgcccgggcgttccccgtgcagtccttgacctactgctgcacgggatggtcccggcacccttcctggcgacctccggcgcgtgcttggacggcatgagccacgcctcccacctgcggggtgccgtttccgcctttgcggctgccgcgagcttgtcccatgacagtccgccgatggccctcagcgtgaccgcagccctggccccccctccccgcacccatgcccgcacggactacggcatggctcgcctgaccatccccgccacctgcctggcagcggccaagcctcgtcggcggagaggggatgggggcggtggccctggggatggcggcagcggctggggcgggggcgggggtgacgacgacgacggtcaggctgcatggcaggacgactcccggccctggtccatgaacctcgccatgctctggacgctgctctgcgcgtacgccgtggcgcactccaccctgtacctgacgtccacctgcgcgagcgccctggtccagctcaacgacagatggaaggtagagcgccagctggcgaggagcgcggggctggtatgaaccaggccccactcgccccttcttcccaagacctgcccggccaagcctgtgtccggagatttctcccgaccgtgcacggtcccagcgacacacagctgggcagggtgtggtagccatggaccaaatgctcctggctcgcgtcctgctctccggagcccctttcatgtaggataactgcgctgagaaccaccccactgcctgtacactgtgaccttttctggaccatgtatcatcacccttccccccccccccggaacattttcctcccaagtgggctgtgtatcagagagattttgtgtattgtgaaagcacaccatggcacatgtgaaggaatagatgagcacaagaagggtttcttgtgggacacacgcagctcaagagcagagtcacctccgctccttggcgccgaccttcttcgcgggcttcgagccctgcgtggctggcttgccgccgccgttggccgccgccgctgcgccttcagcagacttggccttctttgctgcctgctgctccttcgctgccccctccctcgccttctgcgcctcccgctcctgttgcagctccgccctggcgcgcttcacgattccccgctccttcttaggggtcggcaccgcgggctccgccccgtcgacctccggctctgcggccgcgccggcccgcctcctcgccggcgaggccttgggcctgcgggccggtcctggctgctgctttgctcgaggccccttgtcagccggcgatggcggctgcctcgcgggctgggtctgatgctccaggggcgcaggttgcacgggctcctcctctgacccctcgccgtctgaaccctcctcagcctcctcgtcgtttccagagccatgctttgcgttggaaaccttcttcagcttgcacacgaagaaacctgcggtgtgattgggaggggggagggaggatcccatcaggtttgggggaactcaatacaggatgctcctggctccccccccagcattatcttggcggtggtggccaggaggcagcatccaagctgcctccagcatggccccccttgccagtcaggccctgcatgagccagtgtgagcctaccatcccagcccatccattctcaaggtaatcagggaggcatgccccagcctcaccatccagattgtgcgcatgggggtagaagcggcgggcgttggacagggaggggtggaaccgaaactcccgatacttgacgaagccgggccgtccaaactcgaggccggtgggcaccacctgcgaggagggggcgagagggatgagtcagcaaacttactggtgggatggatggctctgtctgagcaggaggattgttgacattgatcgaccatactgctgtgccctcgtgcgaggcaggctgctctgggcctgcaggcaccgggcgactggcaagcgccccttctctagccagccccaacaaccctcccagacaaaacacatgtaactccgcttccgcctggctgctgaaactaacgaattcccactcctcgctcgcgcccttcttggctccccccaccaccacacatacacaccttgacgttgcgcttcttcaaagcgtaattgatcacgttctcgttctcctccaccatcatggagcaggtggagtagaccacgtagccacctgtcttggaccccgcgtccgccaggtcgatggccgcgaggaggagctgcttctgcaggaaggcgcacttccagatctcggcctggttcttggaggacttgaccgtggggtcttttgagatgaccccggtgccggagcagggggcgtccagcagcacgcggtccatggagcgctcgcccagaaccttgggcagctcgcgcccgtcgtagttgcacaccactgcagatggagcggtgatggtgggtcagtgggggaaggagggatggagcgtggggatgctgggaatgaagcaggggctgcggaagcaggggcatggggcgtggagcaccggccaccaagcccgcagcacgctacagggagaggggaggctctttcgcgagcagcacagccgccacgccgcacctgtgttgaggacgcccatgcgctgcaggttggcggtcagggacttgaggcggtccttgttgatctcgttggcaaagaccatgcctgtgttccgcagcagggcgctgatgtacgtggtcttgccgcctgggcaaggggggtccgggggttgaggtcagcagcagggagaggggggtgggggcagtatgaaagggggtcccgtggaagatggggcaattgggaaacacgctagggggcaacaacagggaagggccaagatgcatgcaatgcggagaataaagtcgagatgtggccgtcccaaacacaagtgaggggtctggaggggcggggagagggaagaggcaccggggtgcctcttccccttcccacgccacgaccgcaggggttgacccctcgctcgcgcagagggtcggctcggtgaggtcgctctttgggaggagaacagccggtggcatcaggcggactgcgtccatctgccgtagcgaaaatctcccaattttgcagcaagcaggggcgaggagcagacaaggagaggtggtctgctcccttgaggcaaagaatacgtcctccatgagtttgtaaccccggccagcacagcagcaccactcctgctgtccctcctcaccaggtgcggcagcgacgtcaacaatgcgctcgccctcctgcggggccaaggccatgacgggaagaaaggaggaggcgccctgcagcatgtagtgccccgccatgtactctggtgtggcgcccaccggcacctgcgactcgtacacgaccaggcccacctgttcaacagggtgaatagacttggtaagaaggctgggcatgtgtaatcctcgtgggccctaagcctggcgcagcaccttgcaagcttgcagcaggggtcgtcaaggattgaggtggaggagggggcgccccggtgcccagcaccccccacccaggcaccctgcattggagcaaacaaggctcacctaccctggactgcactccccaccctcctcccaaccaccccctctgaccttggaccagggcccgatggggtccnnnnnnnnnngacctaccctggactgcacttcccaccaacaccaccccctgaccttggaccagggcccgatggggtccaggttcacgccgcggttgatcagagcggctgccagctcccgccgccgcgtccgcagcgtgttcacgcgcagcgtcaccggccgcgggttctgtgaggggaagaaagcatggcatggtgtcaggcaacgtgatgccggggcacggcgagcagctgcccgtgcgcatcgacactgggcactgcaagcacagcctctgaagactgtccagccgctgcgtcgggccactgctgccccccctcatcccctgaagacccccttcccccttgattccaccacccacctcgcaggactcgatgagcnnnnnnnnnngcgctgcgtcgggccactgccgccccccctaatcccctggagacccccttcccccttgatcccaccacccacctcgcaggactcgatgagctccacggcctcgctggccgaaaacaggttgaacagcgcgtcgatcatgaagtcgttgtaggagtagtaggtgacgaggtcccgcttgagctggtccgtgtactcggcccgggtgtgcaccccgtcgcgccgcgcggcaaaagcatccagcgtgcgcacgatgtccttgatgcggcggcgcacgcccggcaggtctgggtgaatggcctcctcggcgcgcgccgcctcatcgggcagcaccagcccctcgccggcgccgccctcgcccgccagctcggcagtctccgcctcggcggccgcgcggcggccggcggcggcgcggtccaggcgcgccgaggcgcgctccatgtccccgtcggcgtcggagcccccggactcgtcgtagtcggaaccttcggagccggaggcgctggtggcctcgtcatcgtcctcctcctcctcctcagacccctcgccagccctgtcgccgctggcctcgtcaccgctggcagaggcctcgccgtcgaactcgtcgtcgaggacgctggaggcatcggagccctccatgtcgctgaacagctccatcttgtctgctgtcacagaagattggtgtgttctgaatgctgcaccgtaccgtgttgatgctccacatgtgtggcagagccttgccgcagcagggcagcacctccttcccccacccataccacctgcaatccatgcatacccaccgttcagctcgctctcgctgggatcgtcgtcctcgctgacatccggggttggaagtttgggagggggggcagacctgttgagggggaagctcggcaaaagtgtcagcacggtgaccgccatgcagaaggcatgctgcgccacgacttcgcacaccacgcacctcttgccaccagacactgcatttttggtcgccgccttcttaacctcctttgtccgggccatggcctcgcctccttcctcccctctgggctcgttctggtgtgcggaggcaggcctgctgcaagtcgtcgcctagacacccgaccagaatagcgtggtgattgagcagtatatctgtatgtcgaattagtacgaggaactagattcagtcacgttgcagcgagagtcggcacctcggtatggaatacgtgcagcgagggcaccccccctcctcgacaatggacattggctgccccccggcatgctttcccgccagagcccgatctccagcagcggggcgcggtccgcggtttcggtgtcccggtcggccgctgtcaccaagcaatgccccaagcctccaatcctttcacaagggggtaataagcttgttctgggacaccagcgcctgcagcccagcccacctcgtttcaggtcgggccctgtggcgatgagggctttcctgtgcctggccgtgctggccaccctgtgcctcgcatgcgcggccaagaagcatgacaaacaccactcccctcccgtctggcccgcacaatacaaggtttgtgttgggaatgggggctggtgtcgcatcgagctttcgaaccgggccaccgacatgaattctgttggccctggtgtctcataccctcctcatctccaccaccgcgcaggtctctttcaacctgacggtgccttacatcgacacgtaccagaagggcagattcacgtgggcccctctttgggtttatgaggatggcggggctttttaggcctgtcatggtgatgaccaccctaaaccctaccagcactcctgggggtccctctgctgcatgagcattggacgagagggacgcttgtaccgcaggaacaatgttcaccagaacccctatcattcgtgcgtgctcaaacccatgcccccacccctcaaccccctttacccccccacacatccactcaggtatgtgtacgacgtgtggcaagacatcaaggagatccggcagaaggtggtgcgcaacggcgtcgagaccgtgctctccattggctcggaggacaagcgctacaacatctacccccaccgcgaccgctggggctgctggagctccagcctggacggtggcggcgcaggccccacgctgcagggcgcggaggtggacagcgtgcccctcaagggcgcggcgcagagtacgctgcgcgcgctggggcaggagcagggcgcgaagctggtgcacggggagcgtgagcgcctgatcaaggccctcacctttgtgctccccgacctggccgagtcgcggtgggcgtaccgcggcaaggcccgcctggccggcgccgaggccgatctgtacgtctgggcaatgcacgaggagagcatggccatggagtaccgcatgtacgtcgaccccgccacctcggcgcccctccagctgcaccagctgggcaccaacctgctcaccggcgggcacaaggacgagtacgtgctggattattatgattatgcccccggcgccgtcgccgacgccgacttcaacctgcccgccgactcccactgcgacacgcccgactttgccgtcgcgcccaacggcggcgacctggcggcgcgctgggcggcccacctcccctcccagcactggggcgagccggcctacgacgcctttgcccaccgccacggccgccgccacgcacacgccgaggagtacgctgcgcgcgccgccgagttctccgccaaccgcgcgttcgtcgcgcgctggaacgcagaccccaaccgcacgcacgacgtggcgctcaaccgctttgcggactggtcgcgcgcggagtacgaggccgtggtcctgccgcgcgctacggcgggcgccgccccgcgcacactgttcagccaggcgcccggggtcgcgcgcnnnnnnnnnngcagcgggcgcggccccgcgcacgctgttcagccaggcgcccggggtcgcgcgccacgtgcccaccacccccgcacacatggtcccggcctcgctgtcctgggtgggcacaccggccgactccccggtcaaggaccaggcggcctgcggctcctgctggaccttcagcaccgtggcgcccttcgaggcggcgctgttccgcgagacgggggtgcagaccctgctctccgagcagaacctcctggactgcaactggatggagaccaaccacggctgctttggtgaggcggggggtaggagggggtgatgttggggggatggagggggggcgagaggatgcagaaggcttccttggaggtcttgtgcgtgaccttgcagccctggatgtgtgtggagggcagggacgagtgggtggctgctcacttgaacatgagcaccggccccataggcctagaactgaacatacctcttcaacccccgacacatcctttcaccctttcttaccttgcgctccgaccgccaggcgggcagcaagtggccgccatggactggatctttgccaacggcgggctggccgcgcaagcggactacccctatgtgggcgtgaacgactggtgcaagaaggacgtgcccaagaaggccttcacgggcaaggcggtgctggtggaggggggcgaggaggctctgaaggaggcgctctacacccagggcccgctcaccgtgtcggtggacgcctcggccgactctttccgcttctactccggcggtgtgtaccgcaacgaggactgcaagaccaaggccgctgacctggaccatgccgtcatcttgagcgggtacgggaccaccgaggagggcgtggactactggctgatcaagaacatgtggagcacctactggggtgagcaggggtacatgaagatcccacgccaccccaacgactgcggcatcgccgccgagcccgtctacgtggacctcaaggtcgagggctgagcggtggagagcgtggaggggtggggagcgacacgcctgtgtcgaggatggtgggaacctttctgtcgaggcgcgtagcatgccggcaggcctcatgagcctctcgcccagggcggctgccgtgagtgcggcccggcagtggtgctcgtgcgcagagctagtctatgaagagccatgccagcgcttgggcacagagccagaactgagattttgaaccctgtcatcgatgtgagaacttgcgtgcctagaccctgtcagtgtgacaccatgctcagggaatactttccagattcccgattgggagactgcatccaaggccaggcaccagcacatgcaggggacggcgtgcatgcgacaaaaagcaagcaattcagcgagtcaccctgtcaggaggtcgtagtggttgccgttgctgtacagcagcttgacaggttttcgctttttccagtccttgcccgctttggcaaacttctccccgaccttgtacagtggcgagtaccctgccccaaacctaggagcgggggaggaggagttcagggagtgtatgaggacaggtaatgagtgagtcggactctgcccatnnnnnnnnnngcaaacctaggagcgggggaggaggagttcaagggcaggtaatgagtgagtcggactctgcccattctctgagtgtgaggctcgcatccagtggtgcaattgtgctggcaagggatccttgctccattaatctctccaatcatatggcactaactggcctcgagacagagatactccacacccgattgtacacgacccattctcacccctgctcctttgtatatacatagatgggtaccctgagcatcttcgagagcacaagcagctccggctcccctccccagaagcttgggttttgcagccggcgacagtaactatcccatgggtgacagacgtaggtggagtgcgttggtttgtctgttctctgaaagagcggtccgcacacatcagctcagacagtcacaacacgattgcattgtcatatatcgtggactttcaagcttgccagacgcccacccgtcatcccaagcttccctcccatcccacgcgatcctcgcgcacttgtcaaggctgtcctcggtctggatggaaacgagcgcctccttgaagtccgcccggcgcttcttggagcgacacaggccttcggtcacagcaccccgcagctggtctgcttcctggacctccacttcaggtcctaggaagatgcccttgttcctggccagcccctgcgcctgagacaatttccagggggtggggtgggggaagtgagcttacaagggatgcccaaaaggcactcagccaggcgtggcaagtcagcacctagagccagtccaggtgcggcttggggtgcaagctaggcaatcaaatctctggtcccaccccaccacaactcacgatggctcggaacatgcatcgaccatcaccctggatcttcaccaccttgagcttctctgtgaaagggacctgtgtcgctctgcgggtcatggcggcaccagactacgtcagtgaggactaagggtgcacagcaccgcttagagtcaccagaccacgtcctaagtgccctgccgcccacatacttggctaaatcgaacaagggtgtcggcgcacagaatccaagcgatgcgaagggcaaatatccggctactggcatgtttgatgggcagtgcagctcgaagcagagtgaagcgccatctggaagcgaggagggaggagtaggtcggtgatttaacagggtgcagctgcacaaaggcagtcaaccatcattgtatgcgctgggcctgatgccagcatactcgaatctggataatattactggagccatgcatgcgagccatgtccattgcgcaccgacgcnnnnnnnnnngcagggtgcagctgcaagaaggcagtcaatcatcattgtatgcgatgggcctgatgccagcatactcgaatctggnnnnnnnnnntacctccatctcggtgcagggttctctacgacagcgatccggctgtgggtgctctcccaactccgctcgctgggcaacatggccccttcacgtgcggctacgactcaggatctcaaatagacatctacacaaaaattggtccagatgggacctgaagttcaataatggcgcacctcactccgtgcgcccggccctgccgtcaatcgacgtctcggagtgaggccctgtggcatccaggcagttctgcatggtgaacnnnnnnnnnnttaatttaagtatagcaacattctatattccggatttcgtattactcgctgtagctatcaatgtaccattcggcatttatgaccggcactatccgagcagggcgcgcgtgatcgcgatacgtgcatcaactttgtgtatgatgtctttgacggaggttcacgaggtccatggctctcgattgatgtctaacctcatgcatattccatgagatgactggtcagcccctgtcgaggcacacctccatctcggtgcagaattctctacgacagcgatccggccgtgggtgctctccctactccgctcgctgggcaacatggcccctgcacgtgcggctacgactcaggatctcaattagacatctacaaaaaaattggtccagatgggacctcaagttcaataatggcgcacctcattccgtgcgccaggccctgccgtcaaccgacgtgtcagagtgaggcccagtggcatccaggcagttctgcatggtgaacggttggcaggcagccctgagcgacattgggtgccgcttccgtcctacatcacgtccttgcccaattgattatccaacgcaggagggaccctgatgacctggcagtgcgactgggcatttccccccgctttgtcgagctgatcctggagctgcccggcaccaagtcagcagaggacattgccacccgtctcgctgcatttggagccctgcaacaggcgctcacagcgtgaggagtgggtgtggtgctccgggtgttggggtagatatgctgcgacatgcttgccagctgcatgctgctctcgcagcgacggttggtatggactccaactaagtcagccctccaggcagacatccgtgtgcttccgagcggctgccatagcatctcggctccctcctttctatgcagggggacgctgcccgagcctggtgagctgcaatggcccagggagcccctgtgttcctcctttctcgagaccgcctcccgcctccagctgccgcgcttcacataccagtaccccgaggtcctcctgaccctgctcaagcacttcctggccatggtccatgtgagtgctgctgggggtttagtgtgctggctccctgctgagggatcggccgggctgtagctgctgctgacagggtaagccttcctcgcgccacacgccaggaggggcataaccgaggcgatcatgagcactgtaggctgnnnnnnnnnntggccgggctgtagctgctgctgacagggccagccttcctcgagccacacgccaggcggggcaaaaccgaggcgatcatgagcactgtaggctgtgggctgatccgcacagggaccagaaggctcccatgccctgcgccttcacacgtccctccccacccttgcttgtgcaggagtttgaggagcagctcccacccacagaggacgatcagccgcagcagtccgaggggtccgacccggacgccaagcccgagccagaggactggtggaacaccaagcccgagtccggcgccgccgagctggcagactccctgatggatgcatttgagaaggagtgggagccggccatggagaatctggaggccgcacagcaggttttttgggtggtggctcttgactcgcgcactccccttgtcatgaggtgcgtcgtctgcgcacatgcctgctcatgtctgtgctccccatacatcgtcccgtgctccccaaccccccctctcatcaaaggcgtttgaggacctggagcccttnnnnnnnnnngggtggtggtggcacttgactcgcgcactccccttgccatgaggtgcgcctcctgcgcacatgcctgctcatgtctgcgctccccatacctcgtcccgtgctcctcaaccccccctcttatcaaaggcgtttgaggacctggagcccttgatggacagtgaggaaggcttcacgcccgagggcgccgtctggcagaagtctgggtggcgcgaggtcgccgagctctcgcggcgtctggccaggctgcggccgctgcagcgcctcattgcggagctgggaagggggggcggcatgggtgccatgcgccgagctccggcccaggcatgtgttgggggagaaaggaaggccaggaacgaatggaggtgtcttccgtatgtttccagacctggaagctcgcgccggtctgaagaatgcgccacatcttgctccggtgccactgccgctcatgggtacacatgcagagatggcgctcggcaggcgagtgccccgccctcctcacccccttcccccacaccgctcacccccagatctatgcgccccgctccccgctgggggtggtggagagcgaggcctcgccctcccagacaaagggcctgacccggtccggggagctgtcacgcaccctgccctccgagctccacctgctggccaggggcggcgcactggggcgcggtgggaaggatggcatggccgcgtcgacaccggtgggcagggatgacacaggtatggcgggaccaggagtggacagcggcgctgccaattcgtcagcaggcaccccccctcgccccgggtcgaccgaccccgctcgnnnnnnnnnnagtgggaaggatggcatggccgcgtcgacagcggtggacagggatgacacggggatggcgggaccaggagcggacagcggcgctgccacctcgtcagcaggcacccaccctcgccccgggtcgaccgaccccgctcgcctgctcttcatggcgcgccggctggagcgcacgctgctgtcctacgagcgctgcggctgggctgacgacctgcccacgcgggtgctgacgcggcaggagctgcgccccgcggcggagcaagggcccatcctgctctgcctggatacctcggggtccatgcagggcgaaccggaaagcgtggccaaggccctggcgctggaggccacgcgcgccgcgctgcgccagcgccgccgctgcctcctttacgccttcaggtgaagcgtgctggggcagagcggacccggggcgagcaacatcgacacgtcatgctaacccacccatcgcacccccctcctctccttccacagcggcctgcaggatgtcaaggagctggagctggggctgaacacggcgggggtgacccagctgctggacttcctggcgcactccttcaacggcggcaccgaactcgacgagcccctgcgccggtgcatggcccgcgtcacgctggaagagtggaagctggtgagcgggtgggcggaggagagccgggaatggtgtggcttccctggatggaactgcgcctctgccagcctcctagcaaaagaaatctatgctttcctcccaggctgatattctcattgtgacggacggccagctgnnnnnnnnnngctcgacgagcccctgcgccgatgcatggcccgcgtcacgctcgaagagtggaagctggtgggcgggtgggcggaggagaaccgggaatggtggggcttccccggatggcactgcccctctgccagcctccttgcaaaagaaatctacgctttcctcccaggccgatattctcattgtgacggacggccagctggcggcgcctgcgcccctgatctgtgagcagctggcgcatgccagggagcacctgggcctgcgcacgcatggattggtgatcggagaccgagtgtcagaggccatgacggcattctgcagccagacccacctgttcaggggcggggtgctcacgtcctcgcccatgcgatgactggctgcaaagctcaggctcagagctgtttcagtgaggtgtggaattacacaacgattctcaaccaggaaagggggcttgcagggtgtctcagcaagacgaggatttatttgttggaagattaatcagatgtgcaatgagctagcaagctgcaggggtccttgagtatcgtgagggatgaacagggggctaggttgtgaacgatgaacgggggatggaatatctgaaatgaaatggtcacgcagatgcataggaaggggtcatggaaatgggtannnnnnnnnnagtgtctcagcaagacaaggatttatttgttggaagatcaatcagatatgcactgagctagcaagctgcaggggtccttgagtattgtgaggaatgaacagggggctaggtagtgaacgatgagatgggggatggaatatctgaaatcaaatggtcacgcaaatgcataggaaggggtcatggaaatgggtatcacattggatggtgcaagcgatgcctgtgcaaacgatatgggcctgaatcttcatgtgcatttgctacagtcaggggtctacgtggaggcgcgcatgggacccatgcagaagagggagcgcnnnnnnnnnngaaacgatatgggcctgaagcttcatgtgcattcgctacagtcaggggtctacgtggaggcacgcatgggacccatgcagaagagggagcgccagctcgcccgctttgctgcggctggcttgcgctgcgggtgcggggctggaacagccttctccgcagcctggcgcaagaagctgaacttctgcgcatgagggaggagcaggacgtttggacaggtatgtaggtggctgggtcagcacggcacagagactgggttgcctgatgcagcactgctcaagtgaggtacccacgcaaccccccagggcaataccttgaggttgaagggatccttggtcgggccagccttgatggagaaggagccgttcttgtcaacctccacgactccgcgcacctctgccagggcctgggaagctgcctgggcctcagccagctgtgcgcgcagcaccgctgtctccgcaacagcgtgcgccagagtgcgcgcctccctggcaatgacctcggccttgaacctcacaaatttggcatccgtctgcacgagaggaggggcaggcaccttcaggtttgggcttgggagcgcgccgacaaattgagcacacagaagggcatacaccaagaccctgcaggctggcccgcccaacagccccgattctgcccacctcggcctggcggtgggcggcccgccggagcatggcattcaggaaggccctttcctcagcgagtgcctcggcgtgctccgtgtagctggggaagagtggggggtgagggcgaccggtcacccagccctgctagggggtgaacatcgtgtgagcatgggatgaggcctgctgaggtgaattcctgctcataaaagtctcagctgcaccttggcaaccgatctcaaagactcgactcctgcctgctttgggagggagcaggccttcttcaatggggcagcagtggtgtccatggaggcgttggcttcggccannnnnnnnnnagtggatccctgctcataaaagtttcagctgcaccttggcaaccgatctcaaagactcgactcctgcatactttgggagggagcaggccttcttcaatagggcagcattggtgtccatggaggcgttggcttcggccagatcgctgcgcagcacaggctcagcgtcggaatcagcaatttgagggtcgatcttggtgtggacctcagtctcgccggtgatctgggagtcaccttctccgtggggcagtggggctcgtgcgtcagttggaccgtcggtggatgccttcatcgcgggaatgacagcgatggtaagcgtattggcctccatcaagctggtctccagaagctcacaccgcgcttcgatgctggcgtattcctagttcagacgctcaacggcggactgcatatcgnnnnnnnnnnccagtggggctcgtgcgttagttggaccgtcggtggacgccttcatcgcgggaatgacagcgatggtcacagtgttggcctccattaagctggtctccaggagctcacaccgcgcttcgatgctggtgtattcctatttcagacgctcaacggcggactgcatatcgnnnnnnnnnngtgtgcagacccaatcgggagtccctaccgggctgatgtggcctcaaggatcggttcgaatgtggtggcnnnnnnnnnntaccttcctacatttcatcaccataaattatcctatcaagaccttccccgtctcgcgattaatagttggannnnnnnnnnggtgaaaggattcgcaagtggtggtcggggcagaaatgacggaaatggtcgactcaacataaccggtcataaaaacctgggatacaacttgtgagagaagacctggtctttggtacgttttactcccgtatttctcgtgtgtctgtgtagacccaatcgggagtccccaccgggctgatatgggcctcaaggatcggttcgaatgtggtggccaacccggaagtggtactacggctccggaaggttagttgcttagcaagccagtccgatctacaaaccaccttcctacattttatcaccataagttatcctatcaacaccttccccgtctcgcgattaatagttggaaggccgcgattctgcgcccgacagccgtgtgtatgaagcactctccgacagttggccctgccttcgagaggtccatcggtgggaacatggcttcaaaggttgctgccaagaccacacgccacataagccgtgaagctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgccaccatcatggcgtactcggaggcggaagcaaccccagtacctgtcgtgatgctgtcgaagaccggtgccgagaaggaggccatgatcgttgatcctcccgcagccgccaagatggccatcccggttaccaagggtgtcggcaagactcccagcaaggccaaggtannnnnnnnnnttcaggtgaggactgctgcgttgccctggtgccaaagcccgcgattctgttgagagggatctctgctcagaacctcacccgagacgcacaggagcccgagcnnnnnnnnnnctcaggtaaggactgctgcgttgccctggtgccaaaccccgcgattctgttgggagggatctctgctcaggacctcacccgagacgcacaggagcccgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagaaggaggccatggtcgttgatcctcccgcagccgccgagatggccatcccggttaccaagggcgtcggcaagactcccagcaaggccaaggtattgtaggaatccacgcgcctttgaacctcggaaatcgtgctatcaggtgttcttgagcaccactgtgtcctagggacgtctaccatctggcctcatccgcccctcatcatccccatcctcctgaagtcctccctctcgaagaggaagagggctgccacagcttctgccgctcgctccccaaagaagaaagaggtcaagaaggtggccagctggaggttcacatctcgtatcaagaaggtaaaggcgtcatgtgtcggtgcttgtcctggaggacnnnnnnnnnnccatctccatcctcctgaagtcctccctctcgaggaggaagagggctgccacatcttctgccgctcgctcccccaagaagaaagaggtcaagaaggtggccagcnnnnnnnnnngggctttgtccacaggcttttgctgggctgaacaaggccttcaggggctcccaccggacctaccctgtgaagaagcctcgcgatctgaagacccgctccttctcccttgcctccnnnnnnnnnntggctttgtccacaggcttttgatgggctgaacaaggccttcaagggctcccaccggacctcccctgtgaagaagcctcgcgacctgaagacccgctccttctcccttgcctccgtgacctcctacctgagcacttcaatcggtggtctgatccacttcaggtccaaggctatctgaaggcgcctttgtcagatactcttgtgacaagctctgattttggcccctcgtgcattgtgcccaggaaagtgcatatccctccacctccctggtcatnnnnnnnnnnaatgcctcctccaatgtaccccaacttgaccgctgaaatgcccagtgcaggcacgtgattcccttcagcaatgtacgaccaccataaccttgaacatacaaccaaccacatgttgctgtgaaacttccttcccttgcacaaggaaatagtaagccccacatgcccatcccctgtcccctgctgctnnnnnnnnnncatgccacctctaatgtgccctaacttgaccgctgaaatgcccagtgcaggcacgtgattcccttcagcaatttacgaccacctcaaacatacaaccaaccaaatgttgctgtgaaactttgttcccttgcacaagaaagtagtgtgctccacatgcccatcccctgtcccctgctgctggatgccagctaaacaaccagtgcatgtctgtaagtgacaattccatccaagagcacccctgacatgcttcctgatccagtatgccctcaggaatatccattcaagatgaggaaggtcgatgttggccttggaacgggtactgcatgtaggggcacctcaactcaagacgagaatcacttatcatctgtgtagcacccctgcctgcaacagtttgttattgcctttcatcctcgtctccattgtaaccaacagtggcatcccgacgagcgcctgccacggtnnnnnnnnnnctgtgtagcacccctgcctgcaacagttagttattgcctttccatccttgtctccattgtaaccatgagtggcatcccgacgagcgcctgccacggtatccaaacgctacctcgcgcgcgcgcgctgagctgtgaggtttcgtatttgcaaaatgggtcgtgagaatgcgatcaaagcctatactgtcacattaaacaggaacattaggtagctcaaacattacatgtatgtagaagaggagctcgagccgctcacgagtatgtgcggcaggatgcacacctagtacaccccaccctccatctgccggcatggatgatgctctgctgcgagaggagtacttgtaagttctttgtgattgaggcatcgcagttaattgttcttggattaccctcctgcatcgcgtcatgctgccnnnnnnnnnngtgcaacaatcgtgtgcatacactgcgacttgtaccatcagtctcagcctcgcccnnnnnnnnnnaattgaggcatcgcaattaatcgttcttgattaccctcctgcatcgcgtcatgctgcctgtgcccctcatccgtgcacaggcacctggtcttcagcctgtatcccaaatggaagggcgaggcagagcagcgctgtgatctgcagtgtttctggcccaggatacagaaaggtgatgcgcttggcattggtgataggccctgtcggagttagactcagctcaagtgcagaggatggctgcnnnnnnnnnntgcaccgccctcagcagatgctgtagccttggtgccctccctgatgtctaacctgcgcaagcttcaggctggtggcaaggtgcgggggctttgtgcagcagctgcacgcatggttgagcatgctgctggtgcactgctcagatctgcagcgccatcacaagcacccctaccccctctgcaagatgcaggtcgacatggacagcggaatcgaccttgattcagagcctcactggctcatgtggctggagcacctcaatgccctggaggctgcggtgggtgggtgggggggggaggaggtgcatggcccgggcttgccctcgccaatgaggcccctgccttccaacttgcaagcggcacccgcttgccgcctctagggttgattgcagctggagatgcgctgtccagcccnnnnnnnnnngggatgggtgtaggaggaggagcatggcccgggcttgccctcgcccatgaggcccctgccttccaacatgcgagcggcacccgcttgccgcctctagggtcgattgcagctggagatgcgctgtccagcccgctcactgccccttgatctgcaggccaggctccacacatcagcggccaggcttgccaagcgggcgaggatgagtgggggaccacctcctgcagcgtccagcaccccccagcaagaggctgatgttgcggctggcggcagtgaatccagcggcgacgaggctgactcctcttcctcccagtccagcgactcgcccgccccgccggccacacaggaggagcaggaggcggtgtgcaaggtcattgcctgcagccggctggcacaggtgtgtagcgcatgacggcagacgttgaccctgcttggtgcaggcctggggctgtggtatgtgggtgttcaaacagggatccaagggcactttcgctgagcagcgctcctactctcatacccacacaggcacacgaccgcttggagtctgtttgcttgcgtctgacagaggaactggtggctggctctaggctccaacagccacgcgaggtcctgcagcaggagcccatgctcgagcagcnnnnnnnnnngaggctccaaaagcctcgcgagatcctgcagcaggagcccatgctcgagcagcccgccagccctcgccatggcgccagcatgcaggcggggagcaccggttgcggcgccagcgtgcaggcagggagctccagccgcggtgccagcgtgcagacaggaagcccaggcctcagcgtctgcaaagtagagcccgggagcccgccctccatattcgaggatcgccaggccagccccctgcaggacagcctgcagggtgccagccagacgtcgctcctggcagttgcctgnnnnnnnnnnccaggcctcagcgtctgcaaaatagagcccgggagcccgccctccatgtccgaggattgccaggccagccccctgccggacagcctgcagggtgtcagccagacgtcgctcctggcagttgcctgccgctttggggctgggccagagggagcgatcgacatgcacgccttcctagacatcctccgacggccaggtgatgcctgggccctggagtcgccggggttatggacctcggcgacctaccggcagaatggattatgtagccgtgtgtgttccttgagcagggagtgagatggacagggttcggactggtaaggttttgtatgggtgaggggcggcaaaggcttctgcatgcagcnnnnnnnnnnaacggccaggtgatgccagggccctggagttctgaggtttatggaccccgacgacagacctgcagaaaggattctgtagccgtgtgtgtttcttgagcagggagtgagaggggcagggtttggactggtaaggttctgtatggatgaggggcggcaaaggcttctgcatgcagcatctgtttgtgcatccacgattttgggccccaccccaccccctgcactgcacaggcatgtggaggggcactgccccacccccccgccccatcctgctgatgctctgggcactgcgcagccacgggtggacggcccgggccctcgcgcgcttgctggcactgctccagtccccaggtgtggcggagtcggcagtggtcggtcgatggatgtgctccaccttccagcggcccagagatcttggtgttactgatgcgtgtggagagatccgctgcacgggtgctcccctcactcctccggcccacacatttgagtcctcgcgtcccacctgcatcccccgcagggcgcctgagtggggcaatgtgctgcgagcccctcgccagcgaggcggagcgagcggcgctgctcgatgcggccatgcatggggcgtggtcggagctcccccgcgggccaggctcggtggctcaggcctcggagacggagacggagggcgaggcgtctctgaccccagacattctccagtctcccggcgaggccatggatgtcgacccgccccagacccagacggcagagagcggtggggaaccgatgtatgtgcagcgtgaggccgagcctgagtgcggcccgggcacgtttgccagccaagcagcgagtgctgaggcagaggcagccgccgtcgctgccgacgaggcacctgcagtaccggcaaccgatgctgagagggatgcgtgtctcttgagtgcgtcccgggccctgctgctgaccgcatgggctgttttgggtgagcgaatctggcgctgtgggctccaagatgaagcgcttgacgagcaggcagggcacaaggccaggctccgctccaatgccacctgcaggtgaaggatttttacctgctgggacacccattgccgtcctgaatccgctcattcacctcacaaacaagcagacaaggtgctggagnnnnnnnnnngatgcgacttgcaggtgaaggattttaacttgctgggacacccattaccgtcctgaatccgctcattctcctcacaaacaagcagacaaggtgctggagggcgcggctcgcgatgagcccctgcggcggaccttcaggcacttcctgcaaccacccaggtatggagttgagaatctttggactggtgtgcgtggaatcacaaatagagcacacataaagcaagtgcctcagcggattgccaattgacgggcccctcccacccttcgttgccaggccggcctggggaggtctgccccccctgccgccccccttcacggccttcgaccatacagaggagcgggcagaggaggtgcgtgcggccgtggacccctcccgcgcccaccctctggcggagctggcggnnnnnnnnnngaggggaggtgcgtgccgccgtcgaccccgcccgcgcccaccctctggcggagctggcgggctggagggacgaggccctgaccgtgcagtggcgctggcagtaccagcggtacaaggacctgctgaggaagcgcgcacgcacggcccacgagccgcggctcagggtcgtggcccacctgctgcacgactcagcgcgggcgagcatgcggcgcgcgctggcggcaatgccccgcctgcccggcacaccccccgccgacctcctgctcctggccgacgcggtgaccaccttcaaggcccccaccagagccacctggctgcggcgctacgcggtgcgggctgcggcggccatccaacgggcggggggggaggcggcggccggcgaggaggagaggctgacgtggcggctggctcagctgccacccgacgtcgccgccgtctttgaggcggggcgcgcggcggggctgagattggcggtgctgcagagggcgctggcgcggtaccaggccgcccatccccctggctaatttgggctggagggacgagggtgacaaataggccctgcctgcttctgtttacagccggactttcactttggcacactatgatacagtgtctgtcgatgcattacaattggacccaggagtcattcgcagtattctttgccagtggagggtagagtcacgtacaggaggatggggctgggtgaggggaaggtgatggccgccttggcaggatcatgagagctgttatttgtactgcttcagcaataagtcagtctgggaagagataatgccctgctgagagggatggcagcacctaaaaatccatgaacctcaagcggcggccagggcgggtgccgtgnnnnnnnnnnagaggacggggcttggtgaggggaaggtgattgccgccttggcaggattatgagagctgttgtttatactgcttcagcaatgagtcggtctgggaagggataatgccctgctgaaagggatggcagcacctaagagtccacgagcctcaagcggcggccagggcgggtgccgtgcagcagggctcggacggctccgcctccgccgccccccggcccggcccccgctcctcaccatcctcgaagagccatggcagcgcagcgggcatgtcgtgtatggacgccagctgcacgtccgcccccgcgccctccaccccgatccgccccaccagcacggtgaacatgcccagccgcttccccgccgccacgttgcgcgtgctgtcgtcgaaccaggcggtgcgcgcggggtgaaggcctgtggcctccagcgccagcaggtaggcctggtgctcgggcttgcagaccacggggcggccgtgtcgcgcccagcctcgcgccgcggcggccgcctgcacgtcctcaaacgcgaccacgccctggaagcagtcggcgacgcccagcaagtccaggcagatgcgggcatgcttgcggtcggcgttggtgnnnnnnnnnntacgtcctcgaacgcgaccacgccccggaagcagtcggcgacgcccagcaggtccaggcaaatgcgggcatgcttgcggtcggcgttggtgaaaatgtacctgggggagaggtttttcattggggggagggggttgaagagggcatcaggtggagagagaaacgcatgctgatttgagagagatttagaggatgattaactgagttccacctccagatttgccagcaggtgtgcctcggagtttctgtaatgcgagcaccagctatcagataatgcacaagacaacgccgtccaggcattcctggggacgcaagtgtgacgaatcgtcacactctcccacaggcgatgctcaacaaaggtcaaaatcctccccatccaaccatctcacatcggaaggggaatgcgctgcagcatggagcnnnnnnnnnngcaaagatcaacatcctccccttccgaccatctcacttcggaaggggaatgcgctgcagcatggagcgcagcttcgcgtcccgccgcaggtactgctcgtatgggaggctgtggtggacctccgcatgccagtggtctgcatctattttgtagccctgtgcctgagcaagaaaacgggggagtgacccttgagctgagtgagaaagcgccaggtgattctgctcgttacagatgttgccccctgctgcgcacccaattacagcccaacccatgctcaccacaagtccagccatggtggtgccatactgcatatagcaccttcaggaggtggagggtgaactcctgtgattgcactgctaggtagacccaatgcgttgaccaaatgctcttgcaccaactcggcaacccacaccccacctaacatcagcatgtacccagcccacgcacttgaagcagagatcgtacacttcttcctgaggtacacccaggtacttgaccatgtaggcctggatgttggccgcgacctgggccttcatggcaggaacatcgtagagggtgtcgtccaaatcaaggagcagcgcgtctactggcggtggggcagggttgaccgtcatgattcccagtatatatttattgttgaatgtatcagaatatgttgtgagcgcacgaaagcgatgcttggaagctatgagacgagtcggtcgtgccctgacaaagttgaacgataagagtccaattcctcaagggcactgggcatcgagtggaatttccttcggcaaaatttgtactgtgatgacttcattgacgagaagccagtacgcttcccacaaattctgccaccctgagtaccacgtggagggggagccctcggaaaaaaagataaggatctgagtgaggggcgacacgccgtgcctgaatggtgtggaccacatgggcatgacaccctcgtcgtcgtaactttgaatcgcaaagcacatgcactagattagtccagaggcctcgacagcatgcgatcggtgtgcgattgcaggtgccaagtgcgagcaccggcccaaggtcgtgaacaggcatgcacgccggtgtcgcgccacgcaggcggtgccgcgacacacatccgaccgatcggtcgtagtccagggcttgcatcgttcctcacaggggctgtagcggcgggcatccttgccgtggcaccccccagccaggccgtcgcgccattcctccagtcgcaaggtacttcctacctgggtgcatgctgcatgcttggaataacaagggggtacgtccatcggcggtgatgcataggtaaatgatctgttccgagggtggctgggaatccagcacccctctccctggcatgagcatgggatttcctgcaatgacatgcaacctccccccttccccccgaggcaaggctctcactcttttctgcacgggtgccctgcaccccgcggcaccctccccacacgtgcggtcagttccccccattctcactccctctctcctcttgctgcgcaggcgggcagggcccgctggtggaggaggaggcccgcctctttcgcatgcgcgagcagtacgagggcgaggcggcggagagcctggccaaggcgcgcagcgcactggaggaggagacgcgcacgcagcagcgctcctcctccctcctctgcgccacgccctttggcgtggacgtggtgggcatcaccgaggcggtggccatcacaggcgcgctggtgggcggcgtctccgcgcggcggcgtaagctggagctcgagaagctgaacgagcgcctgcgcaccatcaaccaacagctgcggcagcaggcgcgagcgggggtaatgtatgcgccggggctcacctatgccccccccgccggcggccggaccgacaacggggcgggggctgcgcagggggccgtggcgctgcccggcgcgagcaacttgaccctggtgccccccatgcccgtgcccatgccgggcacggcggagggggcggacccgccgggtgactggggcggggtgtcgggcggcgggggaagccccgccctgggtggcatgggcctctccgtcctgtccatggacgacgaggaggggcccagccccgagtcggtgcactgccagcaggtagaattgttgttgttgttagttcctgggaggggaacatgcaaatgtatctgcatcctgcattgcaaggccaggccggggagctctgtgggggtgatgtggacatggtgcagacgacagcctgtacgacgaacctgttgcccctccttggtcgagccgcattgcggtcttgaatgcagcgccacgcgtattaggtcaacaagtagatgggccccctgcctcacacacatcacttcccatcgaaccttatccccccccnnnnnnnnnntgggtgatgtggacatggtgcagacggcagtctgtatgacgaagctgttgcccctccttggtcgagccgcatggcggtcttgaatgcagcgccacgtgtattaggtcaacaagttgatgggccccctgcctcacacacatcacttgccatcgacccttataaccccccccccaccccaccccacccnnnnnnnnnnccccaccccacacattaactatggcaatcccccccttcctaactatggcaatcccccccttcccgagcaggcactgaaggagggcaagcgcctgctcaaaaacgggtcggccggcgctgccatggtgcgcttcgagaaggcgcacatgctggcgcgcagcctgggcgaccgcgtgaaggagaggcgcgcggtgcgtggcctggcggcggcctcgcgcctggcgggccagccgcggcaagccgtcaagcacctcctgcgggtgctggagatctcgcgcgacatgggcgactttgtgggcgacgccgacgcctacggcaccatcgccgacatctacaccgacattggcgagttcgagcacgcggccgagtactacgacaagtacatcgcgcgcatggacaacaccggcagccctgtgtgatgcctggtggcactcctcgcgcactgttctgacaggcatctgtcggcatgtacctttgtattccagggcgagggcccacttttctagcacgcaccctccatcgcatggaattcgagcgatcaggcgggaggaagtgggaatcggaagggtgttggagcaacccatgcatgtccctgggaatgcaagcaaggcattgctgctgcacggtggcggacaagtgcaaaaccagggtcctgctgttaagcagtcccaaacaccccgacccctgcgtctcccttcccaacccacttccatgctctgtcatttttctctccacaaagggttacacagcgtgtgacttgcttttcagggcaagcgccccagcccagtgacggaggctgggactcccaacgtggcccgttggcgcgcttggaggggcgcgcggggcggcaggggcacaggagggatggacttccgtccctcctctggaatccccgtcgccccgcgcagccccggcaccagccggcccttggtgtaggttgcctggcccggcgccgattcgatcagtacaggcgcacgggcttgcccatggtggacttgatgtacagcgtcttgacgttctgccagttcttcttgagcagggacaccaggaaattgatggacatctggatgttgatgtacagctcgcggtccgtctggttgatgttgcccacggcaacgcccaggcacagcaccttcttcagctggtacttgacggaggacttgagctccgtcaccttggtctccaggttgtcgttgtgggtgatgagggtggggaacttgcccgccttgttcaggccgggaccaagcaggcgcgggatctgcttgatcagcgagtcggaggccaggaaggcggcgtacttcttcgccagcttcttcaccagcttcttgttcttgttcagcttcttcaggtcgtccacggtcatggcgtccacgcccagggcggcggcctcctcgcaatgcttgtggtcacccagcacgcacaccttcagggaggggcgggggcagtagggcagcttcacggacccgctgaaacgcttgtccttctggggatcgtagttcttcagcccgatctggagctccacggtctccgtgaacttgcggggcttgtccttggcgccctggagcacggctgtaaaggcggggcgagggaggggggggagggaggtcgagtcaaccgcggtgagggcctaaggtggacgcgtttacatggcccatcagaacgtcgatcgtatccaccacgataaccgggcggcatccgtcactccgccacctctgcccggctgcgcaccattgataccctcgcggagggcctcgccggaaactttcgacatgatgtcactaacactgctggtaacccaagggtgagaggagagagggaggaacaggttgcaggccagactgtatgggccatccgccgctcgtgggggacacgggggtggaaagcgaggtgcccatttcccgccatctggacagcaaggctcgtcagggcgcgatgccaggtaaaataccatcccctggcctggcagcatccagtgctgcgggacagatgacggaaacttgcaccccaggacagcgcctgggtcttgtggtgagccgtggtgggctcgtgctgtggtaatcgtacttgggagcagcgctgcccatgctcgagtcccacactctgtcacaagctccccgcctcccgcaccgcagaccgagttcgagccaggcgcgggaacctacgtcgcaggaagctttgtgtgcgcgtccctggtcggcatccagcgcaccgtgcccgtcgaggagacagctgacaaggtgctgagggtgctggttgtgtgagggacaccgatgcctgcagtcccggctgctgcaatgagatccggtgactaacagacccttaccattcgccaaccccttgctcagcagcgcctgccccgcctcgaggtctcccgctccacccgccccgaccccgtgccatcccccggggacgtggtgaccgcccgcatcacgcgcctgacgccccgcctcgccctcgccgacatcctgtgcgtgggtgaacacccctgcgcccagcgctacagcggcgtggtccgcatccaggacgtgcgtgccaccgagatcgactccgtgcgcctgcccgccgccttccgcccaggggacctggtccgggccgaggtactgtccctgggcgacgcccgctcctacttcctcaccactgccaagaacgagctgggcgtggtctacgccaagagcatcgcaggtgcgagtgtgtgtgtgtttgcgggggagtgagcgacagtgtcttggggttctcttcctgcctgcctcgctgtggttgtagtaaggcgatcgagcttggcacccggtgcccgggatggagaggagtctggctgtgcaccgcaagccacaggatcatgttcattgacccctgaatcccaccccccaaatccctcgccggccttttggcagccggagtgcccatggtcccgctgagctggcaggagatgcagtgcccgaccacccaatccgtcgagtcccgcaaggtcgcccgcgtctaggccgacgctgattagataggccctctgtgccctccaggcacacgccgccaggcacagcaggccgacgccgggccactgtgcctctgaccccatggcggatcaggagcgcagagtgttcctcactgtgggcaccacccgcttcgacgcactggtggaggcagtggacagcacggccgtcgcggccgtgctgcgccggcgcgggtacacccacctgaccatgcagatcggggccgcggccttccagggctcgcgcctgctgccggcgggcacgacgcgcggcgtccttcccgacggcctcgtcgtggagtggtttgactacagcccatccctggccgcgcatgtcgccggcgcggcgctggtggtcagtcatgccggggcgggcagtgtgttcgaggccctggtagcgggggtgcccgtcgtcgccgtgcccaacccgcagctcatggacgaccaccaggcggaacttgccaggaagttggaaggcgcgggcgtgctggtggcggcgacgctgggcaccctggagcatgtgctggccaccgcggacttccaggggctcgaatcttacgtcccgggcgaccccgggggcatggtggcggccgtggactggctcatgggagtggggagcgcggctgggaagaagtaggctgttttgnnnnnnnnnnnnnnnnnnnnnnnnnnnnnnnnnnnnnnnnnnnnnnnnnnnnnnntatgccttccacctcccttgagatatcatgtgcctggtattctgcttaataagtccaggatcctgtaagcaacgtgcagatatcgaaaggatgcccttgtgggggtgcgcattgaagagaggcaggacaggttgccttcccgccaacccgggagtcttgcnnnnnnnnnnccgaaaggatgcccttgtgggggtgcgcactgaagagaggcaggaccagttgccttcccgccaacccgggagtcttgcgccttcgtgcccactacgacacgaccgctgggcctcggtgggccctctattcatccagctcgtcccctcgtcgcagccaccggcgggccatcgaggcgaaggagctcgacaccgcatnnnnnnnnnnccggtaggccctctattcatccagctcgtgccctcgtcgcagccatcggcggaccatcgaggcgaaggagctcgacaccgcatcgccatggagtctctgagtcgggaagatgtcgagaggtacgtccaggggcaggccatgcaggagcgctcacgcaacggtgcttggcgtggggcagcaatgcaatctctcacgccctcaatgcaggctcatgttcttcgatcagactcgcgaggctgcggagcgggagcacaaggccaaccccaaggacgccctggtacgcgtggctcccggggccgatgtctccaccactcgacgtcgggatgtggtatagcacttcacgccactttctcacggcagttccagtgttgatgcaccgaaatttgcccatgtgcaggtcttgaccaagtggnnnnnnnnnntacgccactttctcaaggcaattccagtgtttatgcaccgaactttgcccatgtgcaggtcttgaccaagtggggcggtgccctgctcgagctggcgcacttccgccagggctccgacgcctactccatgatcgaggaggcgatcgagaagtttcaaaaggccctgggcctcgacgccgggcggcacgacgccctgtggtgcctggggaacgcctacaccagccagggcttcctctcgcccgatgcggcggcggccaacgccttcttcgcccaggccaacgaatcgttccgcaaggccgtggacgcgcagcccgccaacgagtcctacaaacgggccctggagatgacctccaaggcacccgcgctctacctggagctccagcgacagctggcggccgcggggcacagcacggggggcgagagcgccagcacatctgccgggcccgggaccgtgcaggtgaggggtgaggtgttgcaaggagatattccataggactttcatgtggttgatgtaggatgtgatggatgaagaagtcgtcgtctttgggatacaagggctgccctgttgttgccattgcggagctgtctgaggccagcacagacggttcacattgccaactcactccatgggcatcgcctgcctccttttctttcccagaagcaggtaggcggcatcagcgacttctggtacgacgtcgccggctgggtgaccctggtcgccctagggttcggcatcgccacgctctctcgcggccccacggccctgccccccgccccggcgcgctagggggctacccttccccggcccatcggagggctacctgggtgtgacagtgccttgcctgtcctgccttcatccagacacctgcccgccgtctctgccctgcgctccttgctagctggggcttggctgcttgtgtggtattgccggcccctgcatggccgcaggcacacccgctgacgatatttcctgtacaccccacttgcacgagatcaagctttgcacgcacatccgtcacgatcaaggtctcaggttctcgtgatgggctggatgcccaaagactatcattacgatcaggtagtatcagcatgcacatggatgcgctttgggaattccaaactctgctctcgcttgcctccatcaaccaggnnnnnnnnnnctcaggtagtatcagcacgcgcatggatgcgctgtgggaatcccaagctctgctctcgcttgcctccatcaaccaggagcgtcagccatgcagcctgtccaaacctcgaagcgtatgcacgtactcaaactgcagtgcctgctcgtctcgtcaccgcagcgaccgtgggtctgggagcttgacgccgagcagggccgccaggtttgaccccgggccggccgtgccctcctgcattcccaccgaggccagcaggttgcgcaccagctcagcatccaggtctggggcggccaggggggcggtggcggggccacccgcctccccgcccggtccgccggcatcggcctctgccggcgcggcgctggccgccagctcagnnnnnnnnnnggcagaccgcagctcggcgaggaaggcgtgggcccccagctctggcgcactgggcccaggactggccccttcctggcgccgnnnnnnnnnnagggggcggtggcggggccgcccgcctccccgcccgatccgccaggatcgcccgctgccggcgcggcgctggccgccagctcagcctgcagcgccgcatcatacgccccctcgaagtcgtcgctgtcggtgtcggtgtcgacggcgtgcgcgccccagcccgctgggccctggtccccctcgcactcatcgctggcagagccctcgtagaaggaggacgcctccgaggaggatgtcgaacgtccctggccggcgcccgtgccggcctccatccccagagcagaccgcagctctgcgaggaaggcgtgggcccccagctcgggcgcacggggcccaggactggccccttcctggcgccggggcgggggtatctcggcgccttccagcccggccccgcccgtcacgaagtcgttgagtcgtgcggccaggagtgaggggtcccaatcacagtcagcttgtcgcgaggagcctggcgcagggatgatgtttggggaatcaatgtgtgaccagggcctagcagcggcattgcctgctggcctgttcggttctgcggcgacggtttggagaagtcaacccaattccaggccctggctcctccacctgcgagctctgcctggcgagcggcgaggcgagcctccagctctgcctccccggccttcagccaggtcaaggaaccctcggagggcagctcagtgtttgcctgggaggacggttcggggtcctcctccagcttctggtgctgtgtgagcgcgtccgccgccagtccggggtctctgagagcctacgtgcaatggcgatcggaaggctgatcagcactgaggctccacaggcatcatgggaagggtagtgcaggctttgagtggtgctcgtccaagaatatcccacatcgatctgcacctcctcacctcgttgacagcaaggtagcctgctnnnnnnnnnnatcctccagcttctgatgctgtgtgagcgcatacgccgccagtccggggtctctgagagcctannnnnnnnnnnnnnnnnnnnnnnnnnnnnnnnnnnnnnnnnnnnnnntgtccaggaatatcccaaattgatctgcaccttctcacctcgttgacagcaaggtagcctgctggtgaggagtcgtcccatgtcgccaccagtgagcagccggtgtcagacatgctactggaggcgcatgcatcattagcatgctgagcacgctgggccnnnnnnnnnntcgacgtcagacatgctactggaggcgcacgcatcattagcatgctgagcacgctgggccacgagcatctccagccctgctgccagcttggcgccaaggctcgctgcaggaaactggggaagggggggagggcacacagtggtgaggcatggcggtttgataattgagtgagaacagccgtcagggcctgacagcgtcatcagactgtgcacctacgggttagggcccctcactcatgcagttacacagtcttgtttacagcaggacggggactgcgaggagaccttgcatgcgagccatggccttcccaaggccccatcccggtcagctgcagcaacccaccttggggtcggagggcagcggaacctcaaaccctgccatcccagggaactcctggagggccagctgggcatacaagcacctgctgaaggtgacggcggtggtccgtaggtccctgggcgggaagtgcaccgggcgccccgccgcctgcaaggcagggagagaacggctggggtctgggctggaggacatcatcctgccgaggggacgacctccttcaactgcacccctgtcgatcccaaaccttgcactcacccactcacacccatgatccaggccctcccaccttggcatcgtccagatcgcggtagtagaaggcctcgactgcggcggggaggagctggggggcggtttggaggagacgcaccgctgcgagagggagcacagcatgtgcgacgtgacgctggacggcgaggaaacgtggaaaggcgtccaggcgctgttcaagcgcggcagccacgccggcaggcgccgctgtgggcaccgagggtgagtgcagggcctgcagaccctgttccagatttatgctgccggggaggaggtgggtcggcacgatgtggaacctgcccccgctgatccacacctggcgtgggtgaggtaaggtgtcgtgggtagggcatcgagaaatgatccgggatttgaaggcacaggagggccaaagctgcctcaggcggggtgctcaatnnnnnnnnnnaggaggaggtgggtcggcacgatgtggaatctccccccgctgatccacacctggcgtgagtgaggtaaggggtcgtgattcggacagcgagaaatgatccgggacttgaaggcacaggagagccaaagctgcctcaggcggggtgctcaatctgctctcagagtccaacagcaaactgccacctagatcaggccccctcacaaccacatcccaggaggggccatctcagatgatcgcagtgcagcgcactctgttatctgcgatctccggcttgagtcctcgtggcagactgtgcgccgcctcgatcagcaggaactcgccgtcattatcccacaccctgtggtttggcaggttggagactgcgttgcagcgacattgtccagctggcacccagcagcacatacacagcgcatttacccatcagaatggcaagacggcgggtgtgaacacccctgctccctacgtacccatgctgagccggtgcgtgtgaacacggttcaccacatcaaccctgcatttgacccagtgcgtacnnnnnnnnnntgtacccatgctgagccggtgggtgtgaacacggttccagcatcaaccctgcatttgacccagtgcgtacctcacgtccagagggaaggattgtgtgagctgcgtcagcagccaaaccacacaccactcgtcctccacattgtcagcaaagcacactgaaccccagagactgagccggggaggatcgagagctggggtggatttcgatccctttctttggttcttctggcgccacggaaccgctcgctcggcggaggactggatgtcgaagcggccccgctgccagatgtgctgggagagccaggggaggagggactccaggcaggaggtcttcagagctctcagctggggagcgtccacatctgtgcacgaaaggggagctttagatgctattgaagttactatgaggctatagacgaccgatccgcgcacatcaaaggcgtgaggcgtgnnnnnnnnnnactttagattctattgaagttactaggaggctatagacgactgatccgcgcacatcaaaggcgtgaggcgtgcctgtgtgtgggaagagctcgtagtggactgtgttctcctccggtgccaccgagtcgaggcccagcgcacgccgcagatccattgcagctggagtatcttgttattcagctcatcatccgatatcctgtcactttttgatgggactgtccccttacgatctccatatagccatgcatgagctacgtccgcgccctggatacagcgctgcgcgcccgctgtgtgggcgccagtgctgcatcctgaaggggagatctgaggacttgggccaacaaacacacccgcctcctgcccaaacaggatacccagagtaagtgccctcctctaggctcggatgtcacatgtcctgggcgtctagtcctaaaagccctgcctccaaagatgtattttacagacttcaaaagtccttgtgnnnnnnnnnncagatcctgaaggggagatctgaggactcgggcccacaaacacacccgcctctgcccaaacaggatacccagagtaagtgccctcctccaggcttggatcccacatgtcctgggcgtcaagtcataaaagccctgcctccaaaggtgtattttacagacttcaaaagtccttgtgcaggggacctgagcccatacgatacggttcatgcaagaagccattgcacgcagaaaccgattcctttactgataccggactcgggaaaggtgacaccaggtacaatggttggaatcgcggagtatgtatgcggtaggtccagtgggcaggcaacatccgcgaaatacggccatggactcagcgcttcaggaagttgaccctgctgagcaggatgactgaggcggttcggaagaagatgcagtatgccaagaggatgagcgcacaccaccagatgaagccatactcccagccaaagtattcctccacaaatgccgaaaccgtggtttcctgccctgccagatcggccatgggcacatcctgatcgcacagctgactgcatgtgagcccatacagcgaccaggtggaggggctgtgggggtgcagaggagggatggggatgggcttgcgtgtgagttgatggggcaggggcacatgggggaatatgaaagcatgggcaggttcacaggggagacaaggcaaggctgagaatcacagatcctctgtgagtgagaggatggagccctcgcactgtcctgcacgacgcttggctgtcatgtgcgagccgccatccctccaaacagcagcccctccctacctgattctgttcatccacttccaaccctggccgatggacgggtatggcatcaggaaaccactgacaggaggaggggaggaatgtgttggagggcgagaaaggaggcgggggctagctttcagtaactcaccagctaacctgcatcccgcacaactcagacagtggggtgccagagcaaagggcatgccgccggaagcgtgccccgacaggcttgaaagcactgccagctcccctctcaaacccctccctttcccagcacccatcagctcacttgaagatggcccagagctgattgaaggcggcggcgaggagcattgccagcagctgatttggcgtgaggtagatgaggaactgcccaaacagcgtgtacatggtctgtggaggtccgagagtgtgcgtgtggaagtggggagagaacatgcctggcaaagagcaggggctaagcaggggacaagtcagccctgcagctgcagctgcgtgtgcagtcgcgaagcacgctgccatgccacttggtggctgccacgcaccctgtcccagccccagggcatgcgatgagcctccctggcatcgatcaaggctgttcctgtaccctcagaccacccattgccctgctcagccctgtatgatcccctatctnnnnnnnnnnaaagcacgctgccatgccacttcgtggctgccacgccccctgtccaagccccagggcatgcgatgagcctccccggcatcgatcaaggccgttcctgtaccctcagaccacccatttccctgctcagccctgtatgatcccctatctcttcccccctgcaccccctccccacttccctcttcccacccaccaggctgagcccaaacatgagcaggaagtagaagaacttccaggccnnnnnnnnnnacacccctccccacttccctctccccacccaccaggctgagcccaaatatgagcaggaagtagaagaacttccaggccacagggtcgaagccccccatccagtaggagatggccgccatgatgacggtctggatgaggaggtaggggatctcagcaatggaggtggccagcgtgtagggcccaggcgcatacatggcggcggcccgctcccggtagaacacggtgcgctcggcggagatgaagggcatgatggacatgcagttgaacatgcccaggaacatggacatggagaagatgagccccgacacgttttgcacgcgtgccacgttcagcgagccgtcagtcgggatgcggccctggccgaagtaggtggcgccgtagaccagggagataacgacggtcagcatgatgcgggtcatgtctgcatgcggtgtgggagcgtgtggcgttgcttggggcttggggaaatggagtgcgggggggggaggaggtgctgggggacaatctgggggttgagcacaatgccaacggggtgcagaaacaggctgaacgacgagaggggtggccattggggtcggagccagcaagccacacgctttggggtatcaccgggcacagcatgcgtgcacgagcctgcccaggcccccctcgcccccggcccgccactgccccacaccaccagcctggccactcactgtactcgggcaggtaccagtacatcttgcagaacttgcggatgagccagcggcgctgcatggcgtgggacacagcgaactgggagctcaggctcagggggcggtgcgtctccgcccccaccgccatcacgtgcgcggcatgcgtctcgtttgcctggtacagcgagctcgcctgcgtgggtttgttcatgctgaggcgggttggggggtgggaaggatgtatcacgcttcatggcagcctcatgtgagagggattcccagtggcaagcgagcgacaggcccacagcaggctgtgcagaggtcagcacgctctgctgccgctgccggggcgcaggcttctggactccacccacattccacaggtctcgacgaatgctcccctaccatcctttccatccccaatcaaccagccgacccagggccaccttgtagagggtggggaagtcctgcccagcgtccttgaacgtggtgctcatggacccaccagtc

SEQ ID NO: 25478 - DNA, 61 bp, Chlorella protothecoides
agtactactgtaggtctgcggggggtcccctcccgccaccgccccctctgccaccattggg

SEQ ID NO: 25479 - DNA, 61 bp, Chlorella protothecoides
tgctgcctcggccaatggatccggcgggcgaccctgccaatgtgcagcaggggcacgagcc

SEQ ID NO: 25480 - DNA, 75 bp, Chlorella protothecoides
attcttatttttggtgcgctccccctgttgtaagcataccctctgcaagtagttgtccagcccaggggggggggg

SEQ ID NO: 25481 - DNA, 6901 bp, Chlorella protothecoides
  modified_base (794)..(803): a, c, t, g, unknown or other
  modified_base (4502)..(4511): a, c, t, g, unknown or other
  modified_base (4725)..(4734): a, c, t, g, unknown or other
  modified_base (5262)..(5271): a, c, t, g, unknown or other
  modified_base (5890)..(5899): a, c, t, g, unknown or other
  modified_base (6206)..(6215): a, c, t, g, unknown or other
gccccgcgccgccggcggcgcgggggcccggcgagccggcgcccagctgcgcggccaccgcccccgccgcgtgctccttggagccgcggaagacgtagacctttgggcactcggcgtggcccagctcgtgcacgtgcacgtgggtgccaaaggtgatgagccccacctgggcgtggtcggggatgagggacagcgcctgctgcagcgccgacttggccgccgccagctcgtcctcgggcaccgaggtgtccagcaggatcaggtaggtgggcggcgtggggggggcgtggcgcgccgtggcatactccacggtggtggcactggggaagagctccgcgggcagcaccgtctcggagatgccagcgtagtggggcgggaaggggctgcgcgtcaggcagaaggggcagccccactgccggctggcaaagtccaccgccgcataggggttgagcaccgcgccgcacccccggcactgcaccgggtcgtactcgatggcctgtgtgggaggggttggggtgtgggtgtgggtgggatgagcagccagtcggggtgtgggtgggggttgaaagcctgaccacgacgcagcgtccctgcatccccgcgccggcagcactgcctgccatcccgtggctgtgctcgagagccaccgaaacagggcccccgaccggcagctccccaacccagacagtgcactgctgcccaggcatgcctccagaggcctggcacgtctcaggattcccctcggggacccagggcacgagtgccaggtgtcacggcgccagcacctgcccccnnnnnnnnnntggggaccctgggcacgagcaccaggtgtcacggcgccagcacctgcccccaaacccacaccatacgccccaggcgccgcacctgcaggcctcgagtcgccttggcaggggtgtacatcacgccaaagggaatgacgcacttggcagcctccagccggctgtgcggccacacgttccacaccatccgcacggcatcgatctcctccatctccacgaactccgccatggtgaggcctcacacgccgcggacaggcggcggaagcagagcgaggaggtggatcaagcggaagatcggggggaaggctaggcgggcatcccgtgcgcgcacaggcaggggacgaggggcgggtcagcccaggcacgaggcaggcccctggagatctcgcagtcgcagggtcttgatctgggtgaaaaccacacccaggcgaaggtgtgtggaagagggcgaggctccaggccaagagggagggggttgggtgggaggggcgacgggcgtactgtgcagggcatcgagctcccgcatgagcgaggccagggcagggtgcattcgaccccgcgcacattcgagtttccccaggcacagtttcagagctgccccaccaagagatggcttgaagaacgaaaactccccagatatcatcagccacccattctgcatacatcaccgctgcttggaacgttgagttcaaggatgtgttccaactgtttgcatgctctgttcctggagttctcccctgcaccatgctgcactaattcccaactactgtatgggtacattgtgattcagtgagatgctcagaacttctgattacagtaataatcactgctgtcagctgctgcaaaccttgtcatcctaagattggatccaggatacagtctgtgctgtaatggcattaatcgctgaggcactactcctcttggacgtcctcttgaagcagaactctttctggtgtgatccggaagacaaattcaggcaagaatttgacgcaagctttgcgaatacggagggtagtcctgcagtaaggatcactggatgtgccagatgatttctttgcaaaaaggtgggactgtggcgattcttgcctggatgttacctaccaatttcccacaatcaattcacacgagacaaactggacactgcatcttcagagtcgcgtatgcaagcctgcacccgctttgcagagccagctggcaagtgcttgcaaccacccctctggatgaacagcatttgttgtttaagattgtcccgggacgaacaatgtgcgcgccctcctcgtctcgatgctcgcgcacagcgcccatcaccctgccagtcccactcctcctgccagctccgatccccttattttgttctctgcgggagtgccggacagcctcgacgtgggctttgttccctcgcgaccgccctggtgtgtcgtggcccgctgctgcacagcgagggtcaaagcgcggagcgaaggactccagcacggaccagcaatgaaacgtggaagggaggatagcgatcctggtccttccgggaaaaaagctgccgggtgaggtggatggccggagggggataggggaggacctggctgttgcctcatggcagagcatgtcttcgtccgcgacttgccggcgggggtcgcaatgaggacgctatttcctttatgtacaagtgataacaaggctgtatacctatgagtcccgaaacctgggatccttcctcctggtccagggatgtgtcgagcgaggagaggcgggagcgtctcaccacgcacgatgtaagcggaccgaggttttgccccacattcgtgtgttcatgactccagtgtgtcctccgggggatgcggtggctcgcaagcccccttggagctggtcgagaactacttcgcatacctcccccccctgccatatcgcgcaggcactgtcctacctccgggaggtcaagaaccggttctcaaacaatcgcagggtgtatgacaggtgaaaatgcggagcatgcagcctcgtgatcgggtgtttgcgttgtcggcccttcccctgtagtgcctgcttttgcggcccgtcaacgagtgcatctaccctcaccgccgcccccccccccgcccgatcgcagtttcctggagatcatgaagcagttcaaggcgcagaggtgaggcggggtttcccggcatgggtcggttcctggcctgtcccggccggttgttgtggggattggcgacatagccccatgtgtttcggttcacgcgttcgcgccggatcgcgccgggggatcacatgggcggtaggtggcggaccctcagtcaggccaatcatccctgccccatccccaatgaattctcacagaattgacacggcaggcgtcatcctgaaggtcaaagaactgtttaaaggccactctgagctcattctgggcttcaacaccttcctccccaaagtgtgcagctggtggattgagcgcaccctgttgcacttggcggtaaatcttgcgtgtatccggcacccacgcagggaaagcacagtgctcctcctctaaagtcctgccgtgacactgtccttgtcatgtaggggtacgagatcagactggatgacgacccgatccccgccaagcagtgggccgaacctgcccgggccgccccccaggctccggcccagcgcacagaccgcgaggtgaggtgcaggcctgcatggaggctgcctgagatcgaggtcccgcatgtgcacatgccgctattttcgcggatggcgcagtgggccaccaccctgcgcatgctcgcatgcctcccccaacacccggccctggcgctccattgaccccggctgcccgcctcctcgcagcccaaggcccctgtcgagtttgaccaggccatcagctacgtcaacaagatcaagcagcgcttctccacggacgagcgggtgtacaaggccttcctggagatcctcaacatgtaccgcaagggccagaagtccatcggcagcgtgtatgaggaggtgtgtgtgtgtgtgtgtgttgggagtgtgtgcattgggagcttgacctggttgtgggagccaagtgtgaatcctttaggggaggctggtgtttgggcgggtgcggtgggtgcagggacgccaggggcgtgtgagggcctccttctgcatgaggaacctgccgtgcggagcacgggagcgctgtcaaagcagtaccctcccaacctttgctctccccaggtggcgctgctcttccgcaaccacgacgacctgctgagggagttcacctacttcctgcccgacaacaccccgccggtgaggacctgggggtggaacgagggggccagtgcctggtgagacctgacatgcacggtgatcgggcagccgtgcagcccgagatgtttcccgcggaggaagtatcacatacgcgcgcgagggcgtgtgaatccctgaataccgaccatcgaccctctgccaacaaccctgcaggcgcccggccagcgtcgcccggccgtcttcgggaaaaaggtcacggggtatggcgccggggcctccggccccgccaagcaccagcgcaaggccccgcccgcgctgcgcaagggtgggtcgtgggcgggcatgcggtggggcctgggcgggcatgcggtggggcccgggcctcacacggcggcagcgcctgggtgcagtgggagagcgctgggtgcggcgttgagtgagaagccgttggccgtgcatcccctggtttcnnnnnnnnnnaagggcgggagcacctcgatgcagtgggagagcgctgggtgcggcgctgtgtgtgaagccgttggccgtgcatcccctggtttccacagatacaccaccactgttgaggccaagcacggcgtcgtcctgttcccgcctctttccctgaccattctctcccccccaacccaccgccgctcagatgaccccaaggttcagcgcgagctggctttcnnnnnnnnnncttccctgaccattccctcccccccaacccaccgccgctcagacgaccccaaggttcagcgcgagctggctttcttcgagcgcgtgcacagccgcctgcgctctcgcgacggctacgccgacttcctcaagtgcctgaacctgtttgccgaggatgtcatctccaaggccgagctggtcagcctggtgcatgacatcatcggcaagcactcagacctgctggccgggttcaacgagttcctcatgcgctgcgagctggggccagaggacccctactcgcgcacctacgcccgcggcgagcgctccagggtgagtctgttgttctttgagggggttaaaattccaaccttcttttgtgtctggggaaccttgggggtccggggcccggcgagatggggcagggcttgtgggtgggtggatggaggttgtgtggatggcgcaagagtgacaggcggcgacaccccgggcaaatcgctcgcctgactcccctccgctccgtcacccctgcccagtcctagatccactcccnnnnnnnnnngggggttggggcccggcgagctggggcagggcttgtgggtgggtggatggaggtagtgtggatggcgcaagagtgagaggcggcgacaccccgggcaaatccctcgcctgactcccctccgctccttcacccctgcccagtcctagatccactccccccacccccaaccacccaccattcctctcgtagcacacgagcacggtggagaagtatatccgcatgtccatcagcgagctggacgtgagcacctgggagcggtgcacgccgtcctacgtggcgctgccggtgaactacccgcgcctggcggccacggggcgcgacacggcggggcaggctctgctcaacgacggctgggtgtcggtgacgagtgggtcggaggactactccttcaagcactaccgcaagaaccagtatgaggaggcgctgttccgcgccgaggacgaccacttcgagctggacatggtgatgagccagaactcgtccaccatcaaggcgcttgaggtgtggtgggtgggctggtgggcggggtccgggggttgggagggggagtggtttgaagggaggaaaggaggccgggagggggagtggaggctgctgggtagggagcgttgagggaggnnnnnnnnnntcgctgggtggggtccggggtttgggagggggagtggtctgaagggggaaaaggagatcgggagggggagtgcaggctgctgggtagggagcgttgagggaggggtcccagccacgcttgctgccaacaatttctccctttggggcaagggcctggcatgccacgcctcttctcctccagatgctgtatcgcgctggagatgcttgcccgcgcaaacccaccctcccttcttccctcctgcccatattacccaacccaatgcatggcccctgaactccctcgtggaaaaatccctcgctatctcctnnnnnnnnnnggctgccaacagtttcttcctttggggcaggggcccgggatgccacgcctcttctcctccagatgctgttccgcgctggagatgcttgcccgcgcacacccaccctcccttcttccctcctgcccacgttacccaacccaatgcatggcccctgaaccccctcgtggaaaaatccctcgctatctcctcccaactcccttccccccctccccccccccacaaatatagccggtggcgctggagctggagggcctgagcgaggaagagcgcgcggcgtacacgctcccctcccgcgcgctgcgctccttccactaccgcgccatccagcgcatctacggcgaccagggcggcgccatgctgtccctgctgggccagaacccgggcgtggcggtgcccgtcatcctggcgcgcctggtgcagaaggacggcgagtggcgcgaggcgcgcgccgggctcatgcccgtctggtcggccatcttccgcgacaacttctacaagtcgctggaccaccgctccttctacttcaagcagggcgagaagaaggcgctgaacaccaagggcatggtggcggaggtgcgcgaggcggcggagcggcgccgcggcgaccgcgccgcggtcctggccgccgtctccggcgcggggctgggcggcgaggcacgcggcgcgccgcacgccgcgttcgacgc

SEQ ID NO: 25482 - DNA, 168 bp, Chlorella protothecoides
gggcgcgggcgggcccgcgcccgtgccttcctctgtcccgcgggtcaactcttccagggagcacacgcggcgcagcccccaggcctctgcaaacccgcgcaggcggtcggagtccggaaccaccacgctgcgctgccttgccccgggaggcccaggcggcttgccgct

SEQ ID NO: 25483 - DNA, 61 bp, Chlorella protothecoides
caagaagcgtatccaaggcccaggcggagtaccccgcatgatgcccccccggtcctgggcc

SEQ ID NO: 25484 - DNA, 101 bp, Chlorella protothecoides
tctgacacataccgggtctcggagctcggcctcattgatggccagcttgggcaggaggctggtccctgacgcgggatgcacaagaaccgtgctgttgtgct

SEQ ID NO: 25485 - DNA, 61 bp, Chlorella protothecoides
atggcatggcagtgttggccgcagcggcggtcacacctgatttggtggaagattggaacac

SEQ ID NO: 25486 - DNA, 61 bp, Chlorella protothecoides
gggcgtggcggcggggggcggcggtgggaacttggtcccctggctgccgctgaccgtggag

SEQ ID NO: 25487 - DNA, 93 bp, Chlorella protothecoides
cgggtttgcaggcgccaggtgggtgtcgctgaagaatgctgcgcaggactcatggagtacaaagacactaccagcacagccgctcctgcgctc

SEQ ID NO: 25488 - DNA, 61 bp, Chlorella protothecoides
tgtgcaggacctgcatgatggacaggcaggggtccagtccgatgaagtcggccagggccag

SEQ ID NO: 25489 - DNA, 91 bp, Chlorella protothecoides
gagaggagggagagggcaggaagtgggagtgagttgcatgggagtcgaggggggcgacgacctggccggcagctcagcagtcggagtggca

SEQ ID NO: 25490 - DNA, 75 bp, Chlorella protothecoides
aagaaaccggggtcggaatgcttggaggggggtaacagggcgtcgggtggaggcggtgaagggtagggcgccaaa

SEQ ID NO: 25491 - DNA, 98 bp, Chlorella protothecoides
ggactcgccatggaaggtgagaccccacttccctttgtttggggatgctctaggggatgcactcgatacgctgatacataccagtctccttccaattg

SEQ ID NO: 25492 - DNA, 97 bp, Chlorella protothecoides
ctgaaacattcccagaatgaaggcacatcctcgattccattgacacagtggccgacaaatgcagttctcccctccacccagccagtttgtaaagtga

SEQ ID NO: 25493 - DNA, 76 bp, Chlorella protothecoides
ggaacagtgtgcaagcgcgatgtcgagcgccgtagagaacctaccatttacatggggtatccattcgaccccggag

SEQ ID NO: 25494 - DNA, 78 bp, Chlorella protothecoides
gcactgcaggccacaccggtcccatcctcttcatgttacaagatcctcccccccctgtgcagagcctggtcaacaagg

SEQ ID NO: 25495 - DNA, 84 bp, Chlorella protothecoides
gtttatgcactctggcaacggcatggccatggaggctctatccacggggggctgcgtgctctgcacaggggggcaccgtgaagg

SEQ ID NO: 25496 - DNA, 61 bp, Chlorella protothecoides
ggtccagaaagcaaaactccatacgttcgattccttccagattcaaccgtacactatccct

SEQ ID NO: 25497 - DNA, 209 bp, Chlorella protothecoides
gagggagccggcgatgggggggggagaaggagggaacgagggggttggaggagagggggttggtgatgaggggaaaggaaaagggagcggctatggggggtggaggagaaggagggggagaagcaggaggggtggtggaggaggagaagtagcaggctgcgatgggaaggaggagaagaagcaggaggtgatgggaaggaggagaagga

SEQ ID NO: 25498 - DNA, 76 bp, Chlorella protothecoides
cgtcgcgctcagtctccactgggatggctttcatgagtcatccaatgacctggcttcccagtcgaaacccgcacct

SEQ ID NO: 25499 - DNA, 63 bp, Chlorella protothecoides
ccgccactcgtccaccgtggcgtcgttctgcgcctgttgttccctcttctccgcatcgtccag

SEQ ID NO: 25500 - DNA, 61 bp, Chlorella protothecoides
ctcaccgctgcagccaggcgaccaggctcaaaccatgggttccccgaccatcggaggtgcg

SEQ ID NO: 25501 - DNA, 77 bp, Chlorella protothecoides
tgcctgtggccgtcacattctgctccttcccccgggtgcatgctacacccccactcccaccatgcatacctatgcct

SEQ ID NO: 25502 - DNA, 7228 bp, Chlorella protothecoides
  modified_base (751)..(760): a, c, t, g, unknown or other
  modified_base (2018)..(2027): a, c, t, g, unknown or other
  modified_base (3335)..(3344): a, c, t, g, unknown or other
  modified_base (3739)..(3748): a, c, t, g, unknown or other
  modified_base (4475)..(4484): a, c, t, g, unknown or other
  modified_base (4570)..(4621): a, c, t, g, unknown or other
  modified_base (4714)..(4723): a, c, t, g, unknown or other
  modified_base (5223)..(5232): a, c, t, g, unknown or other
  modified_base (5352)..(5361): a, c, t, g, unknown or other
cctcggaatcaggcgcaagcagtcccattggagagagcatatgtctgacccctgtactgacaattgtagcttctagtaggggtcaaggggtttggtgaacagcaggcaattgtaagggacgtatgctcatttccatgggttcctcgacagcagcagtgtcgcaacagggcatccttgacaagcactggacagagtttagatcgcttgttgatgtcgaggggtcacacactctcgtatgaatcgcacatacactgcattcaaactccagcagcggcagcatttcaagatccccaacgaattaagattcgcattctacaccatttttcatgcgtaaagctcaccgtgagatctctccctaatttttgcctctgcaaaggcagagatcctggaaggtctcaaagactgggtcacacttgggcttgcgtcttttgctctcaaccatctgacagagtgatacatacatgcaccccacgcgcttgccaggctgcaatgctaggcagcagtgctttgctgtggggatgtcagtccaggatgtgtgcacatctatgattctgccactttccagcatctctttgcattatacacccccgcacaagagacgttgccttgaacgcaaaactatacaggccgagtggttcgatctgcaatctgcttccaaccccccctatggcctgttgtgcaccggatgggctcgaccccaacacacaggtccccatctcaagatcaagattcaagaaagcgcggattgggnnnnnnnnnntaaaccctcctatggcctgttgtccaccggatgggctcgatcccaacacacaggtcgccatctccagatcaagattcaagaaagcgcggattgggacagcaaacctgtgctatggaatggaatgcattgcgcacgcagcctcacgactggtcatcctgctccctcactcagcacgcgtgattgaggaggtataaaacaccagcagatcgacgccgtgcccgacgcaactcattcctaaagcggacaagtccggatcccccatactttgaacccgctgacatgctcggggtctagattgtcgacttgacatggagctgcggtggaaattgtgctgctccctcgccgtcttgctggcgttggggcagtgtgtcgctggagacgagagcacccaccgggtgcgtcgggtgggcctatgcagcccggccagcatccgccttgctggttccaggcacaggacgaggtggacgtcatgcgcggactccttcagaggccctatctgatcttgtcaattgatcacgctcgcccctgctcgtgggttgccccgggactcaccccgatctccccacccccgcagtatgaggtgggcgaccccatcaccctgtgggtgaacaaagtgggaccctacaacaacccccaagaaacatgtgagctggcacttggtgcaggggcgctggagagggaggggagatgggatgcagggggttgcagcatgcttgctgccaggagtctgggctgtctgtgtgtgtgaatggacagaagccctggcacgtgtgggaagcagtggggttccaacccgccccttgccctgcatttgcccatgcattctccagccccttcagcccctctctcccctgaaccaaacctcccccgcgccgcacagacaactactacctgctgcccttctgcaagcccaagccaggggagaccccgcgccacaagtggggtggtctgggcgaggtgctgcagggcaacgagctgatcgactcgcaggtggacatggccttccgccgcgacacggcgcgcgccacgctgtgctcggtccacctggacgacgccaagaccggcgacttcatcgaggcggtgcgccgccactactggtacgagttcttcctggacgacctgcccatctggggctttgttgggcccccccccgaggccgcgcgcgacggcgaggccacctacatctacacccacaagacgctggacatcgcttacaacggggaccgtgtgatccacgtcaacctgaccagcgaggcgnnnnnnnnnnttacacccacaagacgctggacgtcgcgtacaacggggaccgcgtgatccacgtcaacctgaccagcgaggcgcccgtggcgctgacctccggcaccaccctcgacttctccctctccctggcctggcatgcggtggccacgccccacgcccgccgcttcgagcgctacctggactactccttcttcgagcaccagatccactggttctccatcttcaactccttcatgatggtcatcttcctcaccggcctggtggccatgatcatgctgcgcacgctgcggcgcgactacgcgcgctacacgcgcggcgacgccggcgacgaccttgagtcgctggagcgggacgtgggcgaggagtccggctggaagctcgtgcacggcgacgtcttccggccccccgcccgcctcgacctgctggccgcgctgacggggacgggggtgcagctggcgctgctggtcgccgccgtcatcctcatcaccatcgcgggcacgctcttcgtcgagcgcggcaccatcgtcaccgtcttcatcgtctgctacgccctcacctccttcgtgggcgggtgagggaacgccgtgtgtgggggggtgggaggggcggggggggagcaactcttggtggaggagctgagcgtggatggttggtggaaaccggtgtgcgggggcccctccagcgagcgggggcacggcaacagctgcgcctcccggcgcgcgtggcgctgggtgggacggcgcccgggcccaggattcccatgctgcactgccctcccaccgctgcccctgaacggcaagcattcttccggccgtttgctcgctgggcccaatcccacgccaacaacccccttcccccccaacttccccccctccacatccaaggtacgtctccggcggcttctacgcgcgcaacgacggcaagctgtggatcaggacgatgctgctcaccgccaccgtcttccccctcacatgcttctccatcgcggcggtgctcaacaccatcgccatcttctactcctccctggcggccgtgccctttgggtccatcgtcgtggtcctcctgatctggatgttcctctccttccccctctgcctcttcggcaccgtggtgggccgcaactggaacggcgcgcccgactacccctgcaggtgcagcagtggatgtgatcctggggaaggaagggatggagtgagggagggggcacaggggatcaatcagggccaagccttgggagcgaaaacacccgtcccccccgccacctggggccccctcaccccgtcgctgcccgtgacgccgccatggccttgccgannnnnnnnnngggcacaggggatcaatcaaggccaagcctagggagtgaaaacacacatcacctccgccacctggggcccctcaccctgtcactgcccgtgacgccgccatggccttgccgacgccctccatcctcaccccactcccttctccaatctccccccaggatcaagcgcatcccgtcccccgtgccggagaagaagtggtacctgaggcccctggtcattgccctggtgggaggcctgcttccctttggctccatcttcatcgagatgtactttgtgttcaccagcttctggaactacaaggtgggcagggggggtcccagcggatgggtaggcccgaactgactgccgtcgtgcgctgtggggacgaggcacaggcgggactgcgggagtgggtgcnnnnnnnnnntagcggatgggcaggcccgaactgactgctgtcgtgcgccgtggggacaaggcacaggcgggactgcgggagtgggtgcacacggataccctggctgggctcaccctgcatccacactgcacccaccccccctcccacgctcaatcacctcctcccgcccaggtatactatgtctatgggttcttcctgctggtgttcctcatcctgatcatcgtcaccatctgcgtgaccatcgtggcctcctacttcctgctcaacgcggagaactaccactggcactggacctcctttggggcgggggcatccacatgtgcgcggggagtggggtggtggccttccttctttcggagcgggggaagggaggaaggggctgcgtgggcgtttgtaatggagctgtaggtcccctgctggagcgagctgcctggatgcatgcaggcctgggatggaggcttgagttgctcagcagcagcaacatcatggcttgactgctctttcactcgtgtgctaccctccaacccttgccctgcagcactgtacgtgttcctctacagcgtacactatttcttctggaaggtgggtggtctgctggaggcacgcatgcaggggcggatggggttggttcggggactgagattgctgcacttcacggcatggagggcattttcagaggaaggtcctgcacctcggtacagccagacccagctttccttccgcaccataccttgcnnnnnnnnnntttcacggcatgcagggcgtttccagaggaatgtcctgcacctcggtacagccaaacccagctttccttccgcaccataccttgcnnnnnnnnnnnnnnnnnnnnnnnnnnnnnnnnnnnnnnnnnnnnnnnnnnnncaggctgcgacttgtgctttgcctccctgattgacccttgcaggggaggcatcctggacactctagcggctccggggccagtccttcccaccnnnnnnnnnntgcagaccaagatgaccggcttcttccagaccgccttctactttggttacacgctcatgttctgcgtcggtgagtttagtgaggggcacgtgccagggcccgaggctgcgacttgtgctttgcctcctcgattgaaccttgcaggggaggcatcctggacaccctagcggctccggggccagtccttcccaccattcttccacacaccccaccctctgcaggcctgagcgtgatgtgcggggcggtggggtacctgggagcaggtgtgttcgtgaggcgcatctaccgcaacatcaagtgcgattgaaacgagcacgacctgcgctctccagcgccacgccatgccagcccatcctgacgcaaacccagtgccgctgctttccttcgctcctgctacaagatttgcatgaaaaacgaaaagaagatggggctgtggggtcgtcgggagggcgacaaccgcagcgccagcaagacatcaattggcactttgaacgcgcagnnnnnnnnnnaggagggcgacaattgcagcgccattaagacatcaattggcactttgaacgcgcagcatgtgcggggagggtcggacggtttcaagctccacctgtacatgcctgtcgcatgctcagggnnnnnnnnnnctctgcggggaggggcggacggtttcaagctacacctgtacatgcctgtcgcatgctcagggacagattcgctgttgcaccaccgaaactgcaattgtgagacttgttctcgcgcctgcagcccgctcgtgttggcatcgggccgtgcgctgcggttcttagacacccttcctcaaccctggccggcccaagatggagtccaatcaggtggccgaggtcgtcatagtcgccttgtgcggcacagttctattgatctacaacatgcagtatttcttgataggaaagaaggggatcttcaggcggcacgtctccatgtggagcgtgggggtggagtgccggaaggagtgggcgatccgcatgatgtcaggtggggaattccggcaggatgaatccagagtgctggcggttggggcatgccttcatgaatgtcccgaattgaccccttgctcgcgggattgacgagacttgagaccgggagggagattgctgagggtgtgagcttattggtatatgccaatgtgcaaactgggactcgcctccaacacccgtggcctccccaaatccacagatccaaaggagggcatcactgccatccaggggctgaggaatggctccctgggggcaaccatccttggcacagcagctgcccagctggcctcgcgaacgctggccatcatgaccaatccggagcagctgcggcaagtagccatgtttggcaatgatgaccccatcacaggaggtgagtgggtctggtgtgactgcatgaagctggatgtctgctgtctgagtcatgtatgaccggcaggaggggctcctcgcgcagatgcccaaagaagaaaacgcatgtgggtttcaccgtggtgcgcccgtgagcaaggctcgggcattcgcacccagcatcatccactctccgcatgcctgccccacccgctcacaccccacctttgcagacggacagtccatcgccagcccccagttcaagctggccttggcgctgggcaccctactcctgtctgtcatgtgcctggcccagtttgtgaggttttccctgcacctggtgagccttcttgggtgctttcatctgcgtggggatggggagctaccagtccctgaactgaccgttgcccccaggttgcctgcctgaattcatcttctggacgcctcggccgcctcgtagagtggtgtgccctgcgtcccttgggacgtggcgagccaaatcatcatgtcgatgaacaccgcaataccccaagtacctcatcaaccccactgctgcagatgtttgtcatccaggtggtggcggggaacccaatcaagtactcccacctcctcaaactcacgcgcgtcttcatcaagcgctcctccatgtacttttcgctgggcctgcgcttcctcttcctcttccttccggccatcatgtggtgaggctggggttctcgtgctgctggcccggctagtccctgtggcgtgtgcagacctggacaccctgtcgcagcgcacgcaagactgtctgagcctgggagacccagtccagcggtgcacggctgcgcccatccgcctgggcgagcagatctgaagagggatacccttgtcccgcaaccactattcccagaacgtcaccccctcctccacgccccaaccccgacgcacaggatcctgggggtgactgcgctgctcatcaccaccgtgatcgaggtggggatcatgctggccatggacatcgtgcccgtggatggcagctggctggtggagcatgaggcgctacgggccgccgacgaggccgagctgctggcctccacccacctcctgcccaagagcaccccaccgacgccgggccaggcgccggcgcaggccgcggggggggccgccg

SEQ ID NO: 25503 - DNA, 79 bp, Chlorella protothecoides
ccctctcctcgtcccaggtgctcctgctcagtgcatgggcatgggggggtgagagtggaggtgtggtgatggtgcgggg

SEQ ID NO: 25504 - DNA, 181 bp, Chlorella protothecoides
ggggaattggatgccaggaggaagctggggaaaatgcgtttgtctcaagggggaggactatgccggcgtgccttgtccagcgtggcatgggggagagacatttcacagtacctgtacatgcattcgagaccacaaagagactgatgggccgccccatctgtttcactggattcccataatc

SEQ ID NO: 25505 - DNA, 80 bp, Chlorella protothecoides
gaggggcggcgatgcgggaatccacacatgcttcctgctgacagggagcattctagtgcctggccactcagcctggcagg

SEQ ID NO: 25506 - DNA, 61 bp, Chlorella protothecoides
caatggagggggaaggggcgacatgacctcactcccgcctcccacgtaccccctccatggg

SEQ ID NO: 25507 - DNA, 102 bp, Chlorella protothecoides
cggcgctgcacccgaccgccgctgcagccccctgctggctcgtcacgggtctcctgccggccaaacaccctgtcgcacacggcgcgctcccatccactgcca

SEQ ID NO: 25508 - DNA, 77 bp, Chlorella protothecoides
aactcatgacaaagtccatccatgatgaccaacagtatgtgcacagccctgcagccagctgaactcagcagtcttcc

SEQ ID NO: 25509 - DNA, 61 bp, Chlorella protothecoides
ccatggcatgcaagcattgcagggttagctgtcatacgtaccaactttattccgcttgctc

SEQ ID NO: 25510 - DNA, 75 bp, Chlorella protothecoides
ggtcgagccgtgcctgatgcacctgttccccgagagaaattttgccgtgtgatcctacttgcacgctcgtttttg

SEQ ID NO: 25511 - DNA, 754 bp, Chlorella protothecoides
ccccccctcccaaacaaccaaccgaaactcacgccggcttgaggtcgcgatgcaggatgccgcgggcgtggaggtgggcgagcccagcggccacgctgtgcaccatgtccagcagcttgcccgcgtcccagggccgtcgcgcggtgtggtgcagcagcacgtccagcgtgccgcgcgggcagtattccagcaccaggtgcagcgcgccggcgtggcggcacagcccccgcaggcccacgatgttgtcgtgcgcgcccgcggccaggtacatctgcacctctgccagcgcgtcggaggccacggggaaggacttgaccgccaccgcggcgccgcgcaggcgagccgcgtgcacccgagcctcgctgcccacgcccagcagccggccccaggccaggtcgccgtactccaccacgtccacgggcagcgtgggcggcggcagcgaggccggcggcggcagcgaggggggggggctgcgcggcgaggcgccgcgcggcggaatgcgcgaaaggctgcttgggacggggtcgaaagcccaggtcaccgaagtgcgggacgaggtggtggccgccgactcatccagcttcccgctgggctgccgggtcagcgccggcagctccgcagtcaggccccccgccgcgatggccgccaggtaccgcgccgccacctcctcgtcgcgggcgggcagggggggctgtggtggcgcagggagcggggggccggcgccgcccgcgctcgaggggggcgcgccggcgcc

SEQ ID NO: 25512 - DNA, 110 bp, Chlorella protothecoides
ggagggggacatctgaggcctaccccttcaccagcctattagaaaagaaaagattgggctgaggcggggggggaggggtatgcaccccgccccaaaataattgcagtgtg

SEQ ID NO: 25513 - DNA, 61 bp, Chlorella protothecoides
gccgcggcaccctcgaccgtggcgcccggcttcacggcgcagctcctgtcccccggcttcc

SEQ ID NO: 25514 - DNA, 61 bp, Chlorella protothecoides
ctttcatctcagtcagcaaatcctgtaaccgttgatgtttgatacccgacgttggcataca

SEQ ID NO: 25515 - DNA, 123 bp, Chlorella protothecoides
ctggatcacaagggaagggggtggcaaaaaactttctacgggcagggccaggtggggaagcgacctcggaaagggtatgaggccaccatcatacacaacgcccctgccacccaggggcgccgt

SEQ ID NO: 25516 - DNA, 62 bp, Chlorella protothecoides
atggaacaaatgaagtaagacttgccttccaatggcatctgtggtcgtctaggatgattaag

SEQ ID NO: 25517 - DNA, 68 bp, Chlorella protothecoides
aagagggtcatgtgcggttgatacaaccactgcgagcatgagaagtgattcacctcatgccggcaaag

SEQ ID NO: 25518 - DNA, 73 bp, Chlorella protothecoides
ttcacccctcaagcatacatatccacaacacccgcgccggcccacctggcgcagggcgtcaaactcggcgtcg

SEQ ID NO: 25519 - DNA, 61 bp, Chlorella protothecoides
caatgacgctgtcatcgcggctaagggaggtggcgcaaggctagatgtagacgtctccgcg

SEQ ID NO: 25520 - DNA, 157 bp, Chlorella protothecoides
cacgccgcctgcgcctggcctgcgcggccaacgccattcacccctcgtccagaatacgccccggacgtgaccggccatccaggcaggcactcccccgggccaaggccccagcccccaccctcttgccccccacctgttctgggtcaggatgacgacg

SEQ ID NO: 25521 - DNA, 1923 bp, Chlorella protothecoides
  modified_base (542)..(603): a, c, t, g, unknown or other
cgccgtggggcgagggggcgtcgggcgccgagcacgagcgtgccggtggggcgcagagtgccccgctggtacggtgccgggtcccgtgggcggtgcccctgcagtgcgccctccaagctcggcccccggcgctgcaggtggggctgggggagatgcgcatcctcatcgtctggctggtgctgcagctgcgcatcgtcgaccgcgagcaggtgagggggtgcgctgctggccgatgggcgcaggcctcgtgcgcagaccggcaaaggggcgagtgcggcctgcctcgtacctgggcccccttgctgagcgtcgtttgggcctcgcagggcaagcacagccccgagcatccccctgcatgtgcgactcgcagtccgacgtgctgctggacttcaagcctctggagggggccctggacttggagcagcgcaccgcacggcgctcggccgtggcggcactaggcgagctgctcaagctgctcaagaccgtgatggtgagggttggagggggtgagggttttttttttggggggggggggggggggnnnnnnnnnnnnnnnnnnnnnnnnnnnnnnnnnnnnnnnnnnnnnnnnnnnnnnnnnnnnnnagcggtccaggcaggcgaaggaagggggctgaaggagtgccactgagtgacggcgaaagggcagacgggtacatgacagagaatcctgccgcatgccctcctggcccgctggcgtggaacgatgccggccgccctcgtgtcaccccgccgcatccacgctcccaggccaaggccccggatgacgccgcgctgcgcacgcgctgggaagcctcccagaagatgcatggctgcctggtcaagctggccgccgccctgcgcatcgaaatcaaggtttgtgtgaagcggagggcagtggccaggggatcgtgggtggggtgctgagccgtggcgtggccggggggggtgtggggttgccaggttggatggtcaggcgtagctgacatgcgtgccagtgctgtggtgcgcaccacatgcccctgggaatgggggttgggggtccagggtgggaggaagggagtacacgtccctcctggaggtgcccttcgccctcggagccaggcctttgtggatgtggcttctccggagctctgccacccgagctggcggcgttcagtgtcggctggcctgcatcccgccccgccccatgcccctccctcgccaccggcctggaccccccgaactcacacaggccgtcctgcgcgtgcactcccgctccgcgcgcgggcccgacgagaaggactcgagccggcgcacgcacagcgcggcggtggccctggaccgcgcgctggacgcgttgtcggcgggcctgctggacttctggcgctggtgcgagttcgtgggcgaggccgcgggcctggccgcgatgcacgccgacgcccccgactccgccgcgcggcgctgtgtggccgcggtggcgcgccagctggagcgcatgctggacacgagcgccaagggcgcgcagccgcggggcgacgaggcgctgcgcgtgctgacggggttcatgagcagcctgcgcaacccgacgctggcgcggccgccggcggtggaggacatgctgagctggaacgtgctgaccccgcactacgaggaggacgtgatgtacgcgctcaacgcggccagcgtcgcgcgccacttcgacctccagccctccgccgccacgggcatggcggacctggtgcgcgagaacgaggacgggctgtcggtgatgcagtggctcaagtcggcctacgcgcgcgagtgggaccacctgctggagcgcctggggcccgcgctgaatggcctggagcccaggtgtgtgggggggtgctttggggcggagggtcgaagggggggtgaggaggggggggagaacagggcgtggaggggtgtggtgtgtgtggg

SEQ ID NO: 25522 - DNA, 104 bp, Chlorella protothecoides
tattaggcatggcagatcacctgagaccgcaaaaatcaagggcgacgcatttcgtgcacaagtttcctgacaacttcatcctttctttccctgcacagggcctg

SEQ ID NO: 25523 - DNA, 640 bp, Chlorella protothecoides
  modified_base (289)..(443): a, c, t, g, unknown or other
ggaccgacaatacatcgatctaatcgctgggcggagcatcgttggaaggagaatgtcgcccgaattcgaggatgattccagcctgaggttggcccatagaaaccgcggccctctgtgggtagttatacttgctcgaagcgtgtatctctcatttaaaccgtgtatgcttatccacgaccgtgcacagaagtattcggcgcgtgtccgaccgtgcccgcgcctcatgctcctacggtctttgtacctgcagtcacggaaagggtgcgaaggaagcacaggaacgaatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtaggttgggggggcggggtcccgtgagtaaacctcactgcgactatgggctatcgcttggtggctcttgtgcaggcgcaaagtatgtactctctgtacctttatgcagagctcctacggaccacctgatccaaatggaaatgaggaggactgttccccaaggagctttttcaggatcatggcttcactcggcct

SEQ ID NO: 25524 - DNA, 61 bp, Chlorella protothecoides
cacgcctgtcggagctccagtcacaattctaacacccatggcgacattcaagcgcatcgta

SEQ ID NO: 25525 - DNA, 61 bp, Chlorella protothecoides
gagctggcgcaggaagtgctcattggtattcgtgcagatgtttgggtggtgtgagctgggt

SEQ ID NO: 25526 - DNA, 62 bp, Chlorella protothecoides
aggtggcacagtcagcacgcagccgcatggacgggctggacacgactcctccccacccccac

SEQ ID NO: 25527 - DNA, 77 bp, Chlorella protothecoides
gcatagaatagcagccagcagcgccctgactctcccaatccagcaccattctgtgcagtatccgatgcacctcccca

SEQ ID NO: 25528 - DNA, 276 bp, Chlorella protothecoides
gctgacgaagaagaggccgctggaggccaccgccagctggttcacgcccctgggaacggtttttgggggggtgggggtggggagggggtattatagggagaggaggggcaagatctcggcaatcggaaggagaatacatgatcggagggcggcccgtacaggactaccacatgcagcaatggtgttgctccgagtcccaaactctgcatgcgtcattcaactccccacccctgtctgagatcctggctgatgcaggcctggaactccacccgccac

SEQ ID NO: 25529 - DNA, 90 bp, Chlorella protothecoides
tgctgtgtcatcttggtgcacaggacagccaggccctgccccctctaggcccatctgccacctcacctcgtgtgggctcctcggtccgaa

SEQ ID NO: 25530 - DNA, 73 bp, Chlorella protothecoides
aaaatgtggatgttacgaataatttgattctggaacagattccccggacacgtccctttctctgctggacact

SEQ ID NO: 25531 - DNA, 74 bp, Chlorella protothecoides
ccggccccggatggtgagtatctcagaggaagggataaagtcatttctagcagggttcttgggatccacagcct

SEQ ID NO: 25532 - DNA, 127 bp, Chlorella protothecoides
ctggcgtacgctttggcagtggcctgagtgcgggagaaggaagagcagtgagggcttctagtcgatcctcgtgtatcgtttggatcattaatagcatttcagttgcatgcagcacagcaggcaagac

SEQ ID NO: 25533 - DNA, 75 bp, Chlorella protothecoides
tacgtcttggaacaaaagccccttctcgtcgaggggggaatgtaggggtacgagtcgtattgcgacacgctttgg

SEQ ID NO: 25534 - DNA, 175 bp, Chlorella protothecoides
atttcatgctcgtgatgtaagcgttgctacgatttccccccctaaagtgctctgcagttgctccatgctgctgctggcttcgatgtgggcaccagcgcctggcaaagtcagtcgtatgcagactgctggccaatgcacctcgcgtccttttcacagtcctgctgcattttatggg

SEQ ID NO: 25535 - DNA, 85 bp, Chlorella protothecoides
gcacggccttcaagtccacaatcgacagcccttccaggcctgggaactcccccaaattaacttctagaaggagaataattacatg

SEQ ID NO: 25536 - DNA, 61 bp, Chlorella protothecoides
gcaggatgcgaaacaaacaccacagggggcacctgccactcacgcccaacgcttggcattc

SEQ ID NO: 25537 - DNA, 61 bp, Chlorella protothecoides
tctgggtttgagcacagcacctcacccgcagccaaaactgctatgtcccaataaatcactt

SEQ ID NO: 25538 - DNA, 61 bp, Chlorella protothecoides
gtttgccagggcgttgaggcgggagctgacacgactggcggccgagacgggggcggaggtg

SEQ ID NO: 25539 - DNA, 72 bp, Chlorella protothecoides
cccacccgctctcacgctcaaaggctcgctagagggctcggtgcgggccggcaggtttgtgccccgtgggca

SEQ ID NO: 25540 - DNA, 102 bp, Chlorella protothecoides
ggaacgagtaacttcaccaatccgatctcaaactcgtctgcgacagcatgctcagcaattcgcctctcgaagtgtctcggtgcattacctgtattacagaat

SEQ ID NO: 25541 - DNA, 80 bp, Chlorella protothecoides
atgcatccacaccactcacactctccccccgccccctccaaaaacgcacgctcacaggcctgctggcctggctgcaccag

SEQ ID NO: 25542 - DNA, 79 bp, Chlorella protothecoides
gggtggaaggggggagtgtggaggagcccaccgaaagcgtcgccccattatgtgggagctcaaaatgtgagccagaagc

SEQ ID NO: 25543 - DNA, 79 bp, Chlorella protothecoides
attcatcgcgatccccagtgcaatgtgagatgttgaacgtgttcatcccggggtgatgtgagctgcattgcgatgtccc

SEQ ID NO: 25544 - DNA, 330 bp, Chlorella protothecoides
cctctcccccacccccaccttcaccccccccacctccctatctaccagttcccaccctcgccatcgctaaaaataacgaccttacgtatacattcactgtcacgtcaggtcgtttattccagtatgtcaatattttcaaggatgataaaaccacatacacttatgacgtgatcccccctgccacgaagaagagcagggctccaggggacacccacacaggcgcgaccccaatcaaatggtattgcatagtgacctacacagacaacctggattcccctgcttcaaatgtcctcataacaataggttgatgcctgaatgcacgcttttgtg

SEQ ID NO: 25545 - DNA, 78 bp, Chlorella protothecoides
gatcttctgactgtgctggtcatgcatgtcatggagcgccacaacgacgggactcgacgcaactgagaaagacaagtc

SEQ ID NO: 25546 - DNA, 69 bp, Chlorella protothecoides
ggggcagtcatatcggtcgcggccgagcttcatgccatcgcctcatgctcagcatgacgagtcttaggc

SEQ ID NO: 25547 - DNA, 128 bp, Chlorella protothecoides
aagacgaactcgtagggcacaggatcggctgtgaagatgttgatggcagctcactgtctgttgaagctcatctctgagacgatgctcagtgcaaaccctgccaacaggaggtgcaagcaatatgaaaa

SEQ ID NO: 25548 - DNA, 93 bp, Chlorella protothecoides
tgtcagtgtccgtgtatcgtttggcctacacacacggagcgatacgccatgcggaaacggagttctgccacgtcgtcactcagatcacttctg

SEQ ID NO: 25549 - DNA, 61 bp, Chlorella protothecoides
acggattgtacccagcacgcttgcatgaacttgctgtggtcgcaggcttgtaatgacgaat

SEQ ID NO: 25550 - DNA, 70 bp, Chlorella protothecoides
aatcaccagtcccaccccggcgatccggggaccgcacggcgatccacctccgacaaccccggtacggcat

SEQ ID NO: 25551 - DNA, 101 bp, Chlorella protothecoides
gccatgcagcaggctgcggccagcggggacgattcctctgggcatgaacatcccagaaccaagccctgtcgagagcctcggaaagactaatcatgcccctc

SEQ ID NO: 25552 - DNA, 66 bp, Chlorella protothecoides
cgtgcccatggttgtgcccatggtcgtgcccgtgcccgtgcccatggttgtgcccatggtcgtgcc

SEQ ID NO: 25553 - DNA, 65 bp, Chlorella protothecoides
accagctcgccttggaatggtcgcagcagctgcaacagcactgcgtctgtgtatggcgagggcag

SEQ ID NO: 25554 - DNA, 191 bp, Chlorella protothecoides
tgcaggagtggacagaacaacgagggagggttgatggccagggggaggggatggcgaccaaagagggagccacaggcacccctgcagctttcaacacgtcccccgagcactgccagccaagggttgaagggcaatcctggttcaacccaatcacggtaatacaggtatgcatggcattgctgcatccaggt

SEQ ID NO: 25555 - DNA, 413 bp, Chlorella protothecoides
gtatgatctgtccgcctacttcgctcatgcaaggtcccggcactgcagtagaagcacgataatatcctcgcgttcgaaaaaatcagctttaaatggaaatgttggatctcgatcccatcttcgtgataattttgtgtcatactctcgcaacaaccaagaattttggaataaccctccagcgtactctgtcgctgagaccgggtctgagccgtgtgaggtgccatgcggtggccggacgaacgcccggcatacacgtggatgcgcggtcctttgcaacccgcacgatgccttacagctcgttctttttcaggttgtttttgattattcacagttctaaactgtgtgtcaaggggatttgctgcctttgcacccaccgggcaattgtcctagccggtccgcagatggtgaggtcg

SEQ ID NO: 25556 - DNA, 79 bp, Chlorella protothecoides
agggtcttgccatgaggaggagcaaggtctgtgctcgagactgcgatagctattgcacaccggactcaccccgagcatg

SEQ ID NO: 25557 - DNA, 76 bp, Chlorella protothecoides
cacagccacatatctaggtcaggccgccacattcttgaacgccccccatgcgccagggtcaatgcgcttgaccatg

SEQ ID NO: 25558 - DNA, 115 bp, Chlorella protothecoides
ccggtctagttattgagtttgggtttggcttgacctgacacactcataagggccgtgtgacccaaaaatcagagatctccttcatagcaagcttcatgccactgtttccttgttg

SEQ ID NO: 25559 - DNA, 73 bp, Chlorella protothecoides
ggggctggcggccgcctgtttctggccactcagcgggccctcaatggacgcggcgactgctgggttggtcatc

SEQ ID NO: 25560 - DNA, 73 bp, Chlorella protothecoides
gagtcgccttagttgaatacttactgcccattattgatacaaaatttgagcggtcagcctgaccctggcgacc

SEQ ID NO: 25561 - DNA, 89 bp, Chlorella protothecoides
ggggggggggggggggggggggggggcgccggcgggcaagccctcccctgccccatcttctagaccctggactggacaagcaccctcca

SEQ ID NO: 25562 - DNA, 182 bp, Chlorella protothecoides
ccgctcgcagcgctgacctccacagccctgtcgtgagcctgtgtgcaagcgaatccgagtcacctcccacctcttccctccttgcagcctccaatagcctgggcaccatcgggggcattccctccaaccccgtgaacaaggcctttgagattctgaatgccctgggcgccatcggctttgcc

SEQ ID NO: 25563 - DNA, 5912 bp, Chlorella protothecoides
  modified_base (681)..(775): a, c, t, g, unknown or other
gcgcgcggcgcggcgcgcgcgcgcggcgacgccggcgcctcgctggccgtgcaccgctggctggagcgctgcgcgcggcacccctggtccgacgacgacgcgtccaacggcggggccgccgcctacggcctgccccccgtgcagaaagccgttctggcggcgctgcccgccatcgcgccgcagcccgatgaggaggtgagaggattcttggtgtttggggggtgggaaggatggtggatattcaggggatagcagtggattgacaaggtatttgggtcttggagggcaggggccaccccgtgcccagtgtccatattttttgggagtgccagcgacagtgtccagagggcatggtgctatgacatccagccctacagactgccacgatcgccgagatcgatcaccctacatacccactgaactggacacaggagctgtggatcgatttcttggcgacgctggcccggctgctgcacccgggccagatcctggaagcagcgcgctctgcggctggtggcgagcagcggccggagcaccctgtggttgggcgccaggtgtcggccgcgcgcctgctgacggagggtggggtggaggtccagtctgcgctttcctcctccttcctgctccaggtgaggcgccggcgttcaagaagggggaatgggggggggggggggggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctatcatgatcgatgcactgtcactcgcattcacaatgcagtgccccaacaacaaaatcacaggtgctggaggcgctggtgcggtactacaccccggctcccagtggggtcagggcggcaacgctggcggcgacggtgggctgcctgggcgcctgcatggcggtgagtccctgggtggaggagtttttcttgggaatctcatggcataaatctgcaaaaagcacaatttatcggggtttgtaaggcaggcgcgctaccactgcgccacagcgacggaatgcaatgtcactgctcggggtcgaaccgaggaccgactgcgaacattaccgggatgtcagtgcaattcgtgatttgattgctggcactgtcccggtcgcgcgggaggaaagcgcgagggcgagcttgttttgccacaaggagtatcatttgcataccggtttctgccaatccttcctcctccgcccacctgcaggttcggcacacagtctacgacgaggcgctgtggagggcggccgcaaaggccttcacctccattgtcccgcagggcctgccagccctggttgccgcgaatgacccgaagctggaagccagggcgtgggcggccctggccgacgccctggagctcttcctgctgggtcgaggggtcgagttcccaaccacggagccaacgccagagaacggagctgcacatgcaggtggtgctgggatggaggcggcaacccgtgaccccggctccatccagatgacctctgtgacatccgacatgcatcaggccaggtgcgcaggtgtgggctagcaaaagggaatggggctctatgtagaggctcttggggcgctgttcttgtgggaggactctgggcatggaggatatgtccagtgctggaccccggcttgagatcatcgtcgggaaggcccagccagtgtcagctgttgcttggaagccaggctatcagcgagaactatgtgtagcctcggcagcatctccatcctcctccatgagcctcgatttggaccccctcaaaacccctttacgtgctctcttccccacagcaatcaagacgcagcacagcagcaggcgtccgccgccaccgctgccgtgcagtccgatgaccctgatgccaccgcggcctccgcagccagcgattcggagctggaggcagcggtactggacacgctgaccgacgccatcctggccagcgcgcccagcatgccgccacccaccctggaccgcttcgtggcgatcgtggacggcggcgtctgccggccgccctggctggcgcggcagctgccgcacgcggggctgggcttctcccaggcctgcctcaggaagctgtatgtcgtggccgcgcggtacggggccggcggcgacggatcccggggcggcgggggcgacggactcagaaatggcgagggcgaggagggccagctgcccgcggcggtggcagcgctgagggcgctgctggcgcggtgcgaccacatggtgcaagccgccgtggacgccaagaccctgggggctggggagggggccgctggggcaaggtgcggggagggttggcaacagcagagaggggtggtgacggaggtgctcgcgccgtggtggaccttgatgatgctctcgggtggtggagaggagatgaggggtggccactcatgctttccctctggaccgctgtcgctacacgatcttgaggctctgcctctgcacgccccccgcctcgatgtaggtatggcggacccagcggccagccccgactggacgaggtgctgtgcatgctggaggtcctggcctctttgaccctggacccagcggtggcagacgccctgctggacggcgcggacggccagttgcggcaggtgcaaacaggatttgtgggtatcaagcaaaggcagtggaatgcagtgctgccccttgccatctgatccatgggcaggcctcactttatgaattcagttccaattacctgctgttgcagttggtcggggtggcaagggggtgcgccggcaggcggcgcgagcgggagcggacccacctcctgctcatctaccccgccctcgtccaagccgtggcgctgcaagagccccgccttcgcgagatggtcagggacgtgctacaactggccggcgccgagctagggctgggcgtggcggcctcgccaagagctgaatgagcgctttatgcctccaagctgctctgacccgctcgacgatcgtagagggtcagggaccgaccagcggcagccttgctgccaatttccagcgagagctagatgatgctgctgtgacgtggaaggggtattccgatgcggatggtgcccagttttctaccccatgacggcgcattggtcctggccaggtgcgcagattctccgcaccaccattgggagacggtgctgctgcgctgcaaacagctttgacagcacaggtattaaagccttcggtgcatatatgctgctgcgcacagaaaagatctgggcgcccttgatagaccacatgctgtcgccccaaacgtgcccagtctcttgtcatcgccaggtcgagactgtaactcgtgtgccactccttacaccagtccgggcaagcaagtagaaccctttttggatgctcagccctggagaacgttggccaccaggtcatccacctccgcaatcgaggcgcagctcgccaggatggatcggaaggtggtcaggtcctcccccccggccaccgtggcgttcccattgcctgcgatacggaggggttgggggttgttcaggctattgaaagagagactgacaggctcaagcgagtaaaagggggagccaatatttggaggcctgcttgccaccatggagcgccaattggtgagatcgcatgctctacacagatggtcgcgcctggcataccctgggtacatttcatgcaggcagcgactctgggccaggcacctttcctcatcaacaactcctgcaccccgcgaccccagctcacctctgcggtcgcagtcgttgaggaactcctgcacctcgtcggtggggattccgttggctcccggcccctccgtgtcggcaatcaccagacgggtgagcatgtcgcccgccaccctgcgggagcattgttgcatgctggaagggttgagtggggtcgagcagcaagttctggaccagcaattggtcctgaggtgccaatttttcgatggcaccatttctcggcctgcctcaccatcatgcatcccccctatcaccacttctccccctccatccatccactcacccaaagttgcccgcgcctgcctggaactgggcggcagaccacagcacggccgccgcatcggcgccggtcagagccacggccgccgcatggcgcgcgaggcgggccgccgcggcggggctggcggcacgctccgcggcggccagcagcgcggccgccaccaggcgagccagggtcgcgccgtccagctggccgccgacgcgcagctgcttggcggcttcctcccattccctgcgtctgaatgtcgcgagggcgggggtcgcagcgtggggtgttccccgggcggacgtgggctgccgcggtgggtgagggatccggggcggggtgacctgctgcgcgggggcggccggcacgggcgcgagtgtcgccgcgggcgcgggtgtcggggcgggcgccagcacagcggtcgtgccgccaaacatggcctcaaagtcctcccaccccgccagcaggttgctggcctggcctgggccggcgctggggtgcctggaccctgcgtggagagcggtggaggggtctgagaagatgcgaggagaaggagctttgctggccagccgtgcatcaggtatccccccggcagaggtgcacaggcaccaggcatacaatactaccctgcatcatgctggccaccccgtaagccacaccacagtctcacacctccggcactgggcgcctgcacagggctgggcgtgccctggccctggctgccacccacaccagaccccagggccaggaggccaaaggggtccgaagcggcgccctggccaccggccgccgagctggcggcggagggtgcgcgcgccagcgtggcaaaggggtcgtccgacgcgcccgacaccgagcgctggatggcggggtagcgctgcgccaggggacgaggcaggggaggatcctgagtgtgagtccatgaagattgcaggcatgcacgccaagcaggtgggtcctgggcaagatcaacagcacgcggtccgaggcgcacgcaaggagtgtgagactcggccctgcggctggctacttccttcgcacacccagcccgcacgcatgcctcctcctcaccgccgagcctccggccggagggggtggggccaggggcggcggccccagtctcagcccctgcaggggacgtgtggggatggtggacgggcgatcctcctgtgagtgggtttgcaacccacacagcatgcatgccacacccacattccaaccaccaatggcttgctgcgcgggtgaaactcccctcccaaccccacccacccccaaacaacacacacctgcacagccgccttgagggagggagcggccgcggcgccggccacgttcccctcgccctcacggatgttgaagctgaacctcttgctccccgagtgcgtgctggccagcgaaggcggcgtcctgctgccagttgcgagtaggtcgaccggctcagtgcctgcagcgcccgcggccctgcatgcgggtatggcgaagagagggggatctcgtagggaaggaatggtcgctgtttgtgcgtcgcgcccatgaacattgaaaccgctgatccgagggaaagcgtgagcccgtcccacagccacacccgcccacctggcgggggctgccgccgccgcaacggccgcagcagcggccgcgccgccgggcagggcggcggcgaggaaggcctcgtcgtcgtccgagtcgaaaaaatcgtcgtcgtcatcctcgtccacggccatcggcggctggccggagccgccgttccgcgggtcctgcactcggcccgcgcctgctgtgggcgcacctccgggccccccgctggtggcgctctccgtgccccagtcggaggcgcgggagatcgaggcggcgcctgcgccgcggccgccgtggcggctgccctcctcctcaaacccgcccgcc

SEQ ID NO: 25564 - DNA, 12806 bp, Chlorella protothecoides
cccccccccccccccccccccccctgcttccctggaccccacgatcccccgaccctgggctcaccagtgcattccggcaccgcatcaggcagccgccgacggggcacctccagtccaggatgggctgctgggccagcagcgcgcccttgcaggaaaggaagaacgcctggcccactccgtgcacgcccgcgccggtgccctcctccaggctgaccacggggcagagcaggaaggccgcctccacggtcacctcgggcccgcccgtcgccgcactgcgggagaaggcggcaaaggcgccggaggtgcgcagcaccacgcgggagcgccagagccggagctggccctgcaaccggcccgaggcgccgtctgtgagcgggaagcagccgaacttgacgtccttggtgggcaggatcgagccaaacatgcgcttggcagacatggctgcaaggcggtgtttgatgtgagagggggtcaggggtgagggcaggtgtggagcgccgcgacgaatcccctggtgcccaggggggtgcatgtgagctgcagcctcatggccggagacccagggtgtgcccatggggtggccctgtcgattggaaagattcgacctggcccccggagcaacaccgtgcactgagagtcccacacccacagccaggcgcaggaggcggctggaagcatgctctctactgctgctccagtacagccccccgtcgcgcctccgtttcctcccgcccgcgcgacgcaccgcaggtgacgcgcttggtggtccactgccagccctctggcgtcttgcggcgcagcccaaactccagtttgtcggctgcccgtcgaacccctgggacagttgagggggggggggggtgtcttggaagttgaggtttgtcggtgcgtgagaagatgagggaggggcaccgccagatcattatggcaagcgcacagcatgcatctgcacccaatcgtctccaggtcatggactagctctctggagctacaaaggcggccagctttcgatgctgcatcctccgcctccccatggtgagtcaggcgagaggggcacacccctcacgacgtcgatgacaggaggaccaggctgtgcctgacccaccactcttcccttgcttcccaaatcccaaaacggaatgtacaatgacacccctgcctgccttgatgcagtaccacgcagtacagctgctccaggctgcaccccgccggcaggctgaggggcagcttgaactgggtcctgtgctccgcctggccggcgggcaccagggccaccgccgcatggaggggcacgtacccgtcgtcttcctgggtgtgcaggcagacggcggcgagcaggatggaggagctgcggtgcgtgcagcccaaggcgcccgagccaatgtccagggtgatgaggtgggtggcactgggcggagggggcggggtggggggtggggcttgcaagtgccacgctcaatcattgagggcatgctctagcaacaggaaggagacctgcccttcacgccacaggccagcgaccacggcagaattgttccccaaccatgctcactccagttcagtgcagatgggatccaggctgcgatccctgtacgacaggttccgcctcaggtgggtgggaggctgcatggtgggagtgacaagggcgagatgtgcatcagggtgacctgcgaggcagcctcgtgcggtcagggaatggggccatcctcgctcaggctgggcgccggggcggtgcgtccccctgtgtctgctttcaggacccccgactcccaccttcgtgctctccctttcccgcagctgccgataaaagtgatgtatctgaacatactccgacaagtccactgccacggcctcggcagtgaggccaggcatggaccggagctatggtgggcagaaaacgaagcacatcacttgcgtaagagcatgtcacatacatcgatgcttgcaaactttttttccatgatgttgcgggaggcatatgatcttgacctaactgtggtgaatcgcgcatgcctgccatcgctggcccactgatcagacctgcccacgggggtcccggagtcagacgtgctccgacagtggcgggaggcaaagtgctcatgatccttcacatgagagaggcgacgaagatgtgcagtctgcgaagcactcggacgacaaatttagatcctgccaggactccagggtccctggggagggttggccgggagaacgaagtgatcactcacctgggttcgggcacctccaacccacccaagacttcagtacggttcggtaatatcctttgcaccctcagacatgatgtataggtcacatcccatggccaccggcctactcgtcatgcttgcgacctcgttcctgatccctgtcgctgctgaccaggagtgtgattggactgggcctcgcgtggattgtggtaagtgaaacccttccacctggggcagcataattcccccaaaccagcagcttgccgtcagtttccatctgatgtatcctgcctaatggcctctcttcctcctcctgtcgctcatttctcgctcaggctatgtgggcatcactgagggggaatgcaggaacaagggctgctgctggaatcctgccgacttccaggatttcccttatgtggatgtgccctggtgcttcacccaaaacgcccacccagcggaatatgaggctgccaagatccaggaggacaatggtaagaatgaatgcctggtactgtaccactccagaacccataggggcatgttgcatgggcagtggcatcatggattttcccatgtagccatcctgcccgtccaacacagacaggttcccggtcgtcatgtcctcacgattgcgcacatgtgcggcatgagcctgcacctggcccggtcgcctcgtgcccagcgccaaccctgccctgccgtcccacgcatgccaggcggcggctcctacgctgagctggcgctcgtcaagtcggtgcagccagagctgggcccagacgttaccaaactctccgccagcgtccggcgcgtcggctgcgacacactacgcctgaccctccgcgacgctgacgaggcgcgctgggaggtccccacccacctcttcaagtctgacatcctcgcaggtgtgatgatggccggagatgggactggcggtgtgcagatgggtgtctgattcccaggggcctaggcagggcgggggggggtgtaagacgcgctggcatggtgcctgtgccgtccgagagcagcggtcagagctgtgctttgttgcaggtcagccatgcagcccgcaagcccctgtcgctcgccaacgcccagggtccggccccagcatgaatggagcctgcggagggtcagccactaccctggaatacaacctcctgccgcaccccttctccctgaccgtcacccgatccggggacggcgcccccctgttcaactccacgggccagcgcctggtgttcaaggaccagtacctggagctctccaccggcctgtcgcccggcgccacgctgttcggcgcgggggagcgggtgtcgcgctccctgcacctcgcccggaacggggccccgcgaccgctgtggaaccgcgacatcgggcccgcgctggaggagcagaacagctacggcagccacccctgggtcctgggcctggagccaggcacggcgcgagggggggtgacatgggcgcgaggaatgcatctctcttgagttggtgggctgtgtaccgctggactcctgtcctggccatctcaacgtcacaccccccaaaaccacatcacccctcccccccaacctacactgaacagatgggacggcctggggcatcctcctgctcagcagcaatgccatggacatcatccctagcgaggaaaagctgagctggcgggtgacggggggcatcatcgacatggtgagggaggaaggcgcagagcgtgcttggggcggtgcctcgtagtcaggggaatccctccaccgctcaggactcaggcacgcacgccacaatggctgtgcagtttgtatttggagggcccacgcccctggccgtgatggagcagttcacggcggtcatcggccggccggccctggtgccctactggacgctgggctggcaccagtgcaagtatggcccgtggggggggtggtgtacctgctgcgggtggctgggctggcatggactgagggaagcctcgggagcaggccttcattccatgccctaccagatcctcacaccaaatcctcttgtctgatccgagatgacaccacaactccttaccagagactatcactcttggcaaagtttgtcaaccccttgcatcacaccactcctaaaaccctgcggcaggtatggctacgcgtcggtgtgggaggtaagggaggtcgtggccaactactcagccgcaggactgcccctggaggcgcagtggatcgacatcgaccagagtgagccttggcatgcaatcttgcagagggagactaggagtaggagagggactactgctcatcactacaccccctgctgtctggctttgcgcaaggcccccttgctgtgtgctgccccgtactacatggggtgcaaggtgtgcaccaaggcgatctgctgtctgctctgttggatgtcatcactaatgtgttcctatccccaaacccctgcagtggaccactggatggatttcacctttgacccggtggacttccccgtggaggagatgcaggtatgtggcagactccgatggcaaagtggccaccagggagtcggcatgggtctgagcagggcatgggtgttgggtgctttcaccttgtgcaggcactttgagggtttgcacaacagagatcagggctttagtgctgtgccacttgccaccacctccaaatacacatggcaggccctggtggaggatctgcacgccaatggtcagaagtttgtgccaattctggatcctggcatcaaggtcgagccagggtaccatgcctacgatgaggccctgaagcgagacctgtttgtgagaaatgtagagggcgacccctacctgggctgggtaagggcatcctggggggggctctaaatgctttcagatcgtggataactgggtcggggcatcgactgcatgagacgctggcaaaggaaattggtgggcccataagcagctcagcaaccaggttgattcttgcgcgggcgcctgccccggcccatgttgtcccacgtactcgctttggcagcttgcagatgtttggtcccgcaccataggtctccgtcctgagccctccctcccacttccttttccctcgcataacattcaggtgtggcctggcccttgccacttcctggattacctcctccccaggactgcagcgtactgggaggaggagctggcagcacaccacaacattctcccctgggatgggatctgggtgagtcgctgcacaattggggggggtggaggatgtagtattgatgaagctggtatggtttggcagccttaaaatatggtatggcagttaatttgcccacctagagcagcttgcacatcatttagaggatcccacgagacgagtgccctccctgcaagacaacttcaaccccctctccaactccacctgctgcagatcgacatgaacgagatctccaacttctgcactggcgacctctgccgcttgaagcctgagactgagagcgaggtaccaacccttccaagcagtcgtcaggagggcctgggcaaggacccacagtgggtctgtcacctggagtgctgggaggcccagggtctaaactccacgcaagcgggatgggctcaccccccctacgacatcgccaatggactggcacgctcgcccctgggatacaaggcgggcccctcttgttattcactgtgggagggaggtcggcttgggagccagagctcaccttcattgtctgcttgcctcatggaggaggttgtctgctgttcctcaaagcaggtgacgagtgtgtttcttgctccagtgtcagccacccatttcaatcccatctccatgcgcctgctcaccgggcaggtcatgtcggtgctcaacagccaccacgacggcagcagcgagtacgacgcccaccagctctacagcctggcgcagacgcgcgtcaccgctgcggcggtggagtccatccgccgcaaacgccccttcatcctttccaggcacgagggtgtaggatttgaaggggtgtgcatctcccctgaaatgcccactgtgagaccgcccgagcgacgctggcgcatgaacttggtggcggccccagtactgcgccgctcgtcaggcccgacgaccgtccaggaatgctctcctggcctgtactgctacaacccagactgtgcagtgcccctccacaaactcttcctgcactcggcacggcccctcccacccacgcaggtcctcctacctgggggtgggggcttacgccgcgcactggacaggcgacaacgtcgccacctgggaccagctggcaaagtccatcgccggtgtcctcaacatcggcctgtttggcatcgccatgggtgagcagggttccctcgggtgcacggggagtggcgtcggtgggtctcctttcagagctttccggcttgagtgcagtctgctggccccacgccagaggctggacccaggggctgcctggaagacatggcccctgcccaaggacctggcacccaggcagtattggccctgcacccccccctgggcactccaacccaaacaccaccccgcttcccttgagcagggggcgccgacatctgcggcttccaggggaacaccaccagcgagctctgtgcccgttgggtatcgctgggcgccttctacccctttgcgaggagccactcagacctgcactccacccgccaggtgggcagctggtagttgttggagggaggcttgcacagggacggcggggccccgatcagccaggggcctgcaagttgcagggtcatggcgatgggatggggatagcatggcccgcacagtatgctctccatgcgcgcagcatcagacgcccatgcagcccgcccgtgcccgaacgagcacggccagcagggcgcctcgtccccgcagcgggggtggcgtggacgcccagtgcccccgtcttcctcgccaccccccgccccacccaccgccgcccctccctcctcgcacaggagctgtatctgtggcccgaggtggcggaggcggggcgccaggcgctgagtcagcggtaccgcctgctgccgtacctgtacagcacgatgcgcgccgcgcacgacaccggcgcgccggcgatgcgcccactgtggatgaccttccccgaggacgtggccggccaccgcaacgaccgccagttcatgtttggggacgcgctgctcgtgaccccggtgctgacccagggcgcgcgcagcgtggagggccacttcccacccggcacctggtacagcctgtggaacgccagcgacgtcgtgcatgcgaggtgcgcggcccttgggatccagcggtgtgtgagggtgtgagggcagggggtcgcacgcgtcgggcgccgaggcgctcgtgtggcgcgccgagctgcggcacgacgacttggggatgcgctggcgtgcccctcctcctcagctccttgccatcgaccctgccgccagggcgaacggcaccgacgtgaccctggacgccccgctggagcgcattccctaccacgtgcgcggggggcgcatcatcggcacggcggagccccgccgcaccacccgcgacaccaaggccggggccctcaccctcctcgtcgcgctccctggggagggctctggcgctgagcggagcgctcacggcgtggtgtacaacgacgacggagagagcgtggtccaggcgagtcgtgagtgcatgggagggggccggtgagcgcgggggctgcacatgtgcggcaccccgcagctcggtccctcgagctgccaaacgagggacgtgtcggtggtcatgtgcgcactgatcatcaccgcccagagcgtgagcccgggacgggcacgacccagaggggttggccccccccacggagggggtcacccgtgccggaccccctggatcgccgcccactcatcccgcgccactgttctttggcaattgaggaccttcgtacgtcccttcacattgcggcagtaccattctagcctccgtcacctgccccggactgggtcgctcaggcccctccccaaacccgatcgcaggcccgcgcctcgccatgcagcttcctccacgccaacgtcaccgtgcgtcgggatggccaaggatcgctgtccggtactctgaagatagcttttggatcgtcttgggcctggccgggcggtgcccggtaccccgacgacgccctcggcggggccgagtctgtggccgcggatggcgaccctcccatcccatggccgtccctggctggactcaggatcctgggctgggagggaggagctcccgaagcggtacgtacacgcagcttcaggccttcgggcgaagcttccggcagccagggtcagagtgtcgtggacctgaatctcgcggaggtacgtgaagctttgcatccgaggatacacctcggaccccagtatgagggggctgcgcacatggtgtacggatgtactacccccacgtccgggcaggctctaccaacaaaactcaagttgatcatctccacagggagcgcgcgtcaaagattcaacgctgctcctgtccatggagtcggtggagcttccactcgactgccccggatctcttgaaattgaatgggggcctcggaagaccgcgcagtactcggacgtctagggcttcgagcgggaatcgaggcgatgagcaccgccatgcgcacaaacccccgaagtgcttacgcatgctggctcatcgcaccgtcatggcaatcccatggaaggaagagcgcgttcatgtcactcagggatgggggccgaacctccgaaaggcatgctccagccagtcggacccaccaagatgcctcaacatgagcgtctgcgaggcatgcaggtcattcaaagggaattaattacttgtcgaaagctgttgaaggacctgcatcaggccccatgcatacctcatgtgggcatgggagatcgagaatggccacgtacgccctcaaattgtcgacccggggcaattccttggcccgcccaagccacagatttgattctgcccgccactccctttccatggctctaatttaaaacacggatacccgcagtggcatgtacctgccattcgcttcatcaacctccatatctacctctttattcgcagtattgattcgtactctggatcatgaccaatctcttcaatcagctctttgcaccgctattgcctgcgaagaagcgggagcgggacgggcagacctccggccctcggagtgcaatgcccaagtctgtcaaacccagtcccaaagactctccaattgctgtactggatagggaggggtctatggactcctgccaagacctgttcgcctcgaaacgccttcgccggtccggcggcatcctcacccagaccgaccacgatggcttcgagcaggtacgagcgggtctcgttgggcaatctcgaatccctcctgccatttcccggggtgctggcacctgccatcatccaatcatgggtgatcgcagccctcgatacccttcgtcatgtaccttcacccacccttcccgccaccgttcaggacgagggttccccgagggtcttctctgccacctcctcccaatcctcgcttggcgcctacatgggctgtgagagcacaggggatgccagcggatcgaccccctactcggagcagtatgacgaggacagggcggggccgcgtacgccatgcgccagctcggacgaggatcttgtggccgctttcctctcgacctcccaggtctaccccgtcctgtgcgccttggtccgacgtcagcagctggcggtcacaagcccgaggcgtcacgccaacggggattgccggcagaccctggcaggtaccggtcgcttccgtcgtgccatgtgcggggaaggctcatgggccctggtatggggccagagggggttgcgaccgcccccccttacctgacctgccgccccacactcctctagaccatagcctgtgacaccatctcagccgtggatgatctctaccaacccccctccctcgctcttcatgtgcagagctcctggctctggtgcgacggggtgagtactcaccttcagaggtgacccccgagctgctcatgacgatgctctggatcatggactcatggtgcgcacctggaaacggtggggttggcagctgcatggggcctgttgctgatgcatggggtgatgcatggtcatcacgcgacgttggctcgaggatacccaccgccctgtcccgacccgagccacctggctgggctgctccccgtgcggccggatccatcatgcctgacggggccgccctacccatcaaccctggcactcacaggcactcacagtacaagtcgcgcgccgacgtctgcctgcaaatctacctggccctgcatcccgcaccacagcccatgttccactacttcaaggcccacatgctggccatgcagcctggggtgagtgcgggcattctgtactctgtgggctcgctggcgggggactggcgcctgcatgttgcgatgtggttcaagctcttgggggatccgcatgctgaagtgtgggccacgaactcctctctggattcaggtccctaccggaggtctgcctctggctcacgcctcctgcgcagcggcacgcaagaaagcaaaccctctcccctccttcgatccccccagattctgcaaagctgcggctggaatgcacgggtggacagcgagctgcctgcctgcgacgatttgctggcacagcacccggtgcatgccgccatccttaactttgtacaggatgaggttgtcaggtgggctgggggtcaaaggggtgtgggatgggggtcagaacacctcacgcctcgccctgaaggaatggctgaggcgctgtgggcatgggcggcaaggatggtcatgaccaaacgcccatgaggttgccaggcaaagcaggcattgcccatggcctggagggagccctgggccccaccccatgtcgctcatcccctgggccccaccccatgtcgttcatcccctccttcactcactcaattccacaggcgctgcagcggcatgtgcgttgcgcaaaaccacgatcagatacagcaggcgcggtttgttgccgccttgcccatggcctttgacaaggttgtttctgtgttttgagtggaggcaagggcgtgggcaggggagcatctgctgcttccactccccccccgcgccaccatccccatgtgtagtttatttttgatagccctgtgggcgatcacggagtagcctttttgccatgtacctagctagaacccctgcctccagcctttccaactgcgacggaacagattcctgaacaccatgcatggttccgcttccgcatacaatttgctcttatcccttttctgtcacactgattgcgattgctgggctctctgggactcccccctgcatccctccctgacaccacatgcctcggctgggcctgaccggtctcccccccaagggaccgcctgcccaggcccccggcagcaggggtctgttgttcctctcccacacgctggctctcccatcagaaccgagcttccaccctccgatgcccctccccccacacccgcacccctacacacgacactgagaataccgaggtgaagctcattccacaccttcctttcgctcagtgtattctatatctgtccaaatccacccgatataacccttgatgtttgattatggggagctccatggatcccacacccttctgcaccaccccccccccagtcacttgggaggggtgccactccctccccatcggcacagcaagggagtgccccaggccctcctgctttctgtaaaaggggggcctggctgtccatctgatgcagggaatcctcccccccctctgtccctgtagtgtctctgccatctgcccaggctgacacccgccccaagtccgccggcctggttccggcagcttcccctgcctgtctgatgtcacctcccttccctctacccaatcacgctcacccagcccccccaaccccaaaccccacccccggggtctgacagggcaacagttttctcgctgcacgcagcaatgccctgtgcaagccaatgcatggatgtagtgttggacggcaccctcagcgcctggccggcactccagaggggagagggggtggtgcttgagcccagcagacattcgagcacagatcagggtcaggttcttcacgatcatgggcgggggatcgggggcgagtgccacccgggatcagaaactgcgtgcgcgtcctgcctccagctcacatggccagtgcatgtctggcccaacaccatggagagccctgcagccgaggtccgaaagtggaccagcatgcccaacctccggtgcccctggcctggcagcattgagcgctcagggggcccaggcttcgggtcggcatgcccgcggcccgcggcccgcgcgccgccgctcaggccggcgtggaggcgcccacgcccgccagcccggggatggcgtcgttggggtcgtggtcccgccagctggccgtcacggtcttggtgcgcgtgaagaactgcgcgcccatcttgcccatcatctgcaggtcgccacggaaggacccgcgccagcctgtgacggtgggggatgaggagaggacagagtgtggtttcctcatgagggggtggggtggggtgggagggcgtgcgggttgcggtgggag

SEQ ID NO: 25565 - DNA, 119 bp, Chlorella protothecoides
tcggtgcgaatgcaacgagtggtggccctgcgggagcacctgtcccggccagtaatggcaagggtggcggggccaggccaggcggctacgtgacggaggcacctcccgggaatgcgtcc

SEQ ID NO: 25566 - DNA, 67 bp, Chlorella protothecoides
cccgtggtcccaaacaggctgcccgcagtgcccgcaccctcgccacccatcacatggcacggcctct

SEQ ID NO: 25567 - DNA, 75 bp, Chlorella protothecoides
gcaattctgagtgcgagacaccccacatcacccaagcaagagtcaaaccctatcgttgatctggaccaccaccat

SEQ ID NO: 25568 - DNA, 110 bp, Chlorella protothecoides
cctgccatcagctgcctccctgctctacggagcaccctgctccctgctccctcccccttccctcagcctcaccaatctttccgcctcccacagacggcggagatgccggg

SEQ ID NO: 25569 - DNA, 99 bp, Chlorella protothecoides
ctgggtccagcaaggcaggctgtggggaattgtggaggaattgcacataggtttgagggggtgatgtatgaagaagggccattgctcccttgttccagc

SEQ ID NO: 25570 - DNA, 1523 bp, Chlorella protothecoides
  modified_base (397)..(406): a, c, t, g, unknown or other
  modified_base (751)..(760): a, c, t, g, unknown or other
  modified_base (1136)..(1145): a, c, t, g, unknown or other
cggccagcgtgggctcccggcacagcgcgcccagcgtgggcgccagaaaggtcgcgccggccggcacgggggccctgccgttcgccggtggggcgggcccctggcgctcgtcctcctcgcggagcaggaggggcagcagcgcctcggcagccgcggcacgccacgtcagctccgccaccgccgccgcctcctgggcctgcgactgccgctgtgggattcgaggtggaaagggggaggtgaaaggacggacgtgagtgtgcctgcagcatggagctggattccagtgcgccgtgtgggtatccacccaaacaaagccgaataccctcgagcgctgcagcatgggcagccgcggtctccggctccccattcaaactcaccccgccccccgccatcagcnnnnnnnnnnggcctgcggcatggagctgcattccagtgcgccgtgtgggtgtccacccacacgaagtcgaataccctcgagcgctgccgcatgggcagccgcggtctccggctccccgttcaaactcaccccgccccccgccatcagctccaccagcgcgtcggcggcctgcgtgtccagggccggcgcccacagcatgatgtctggcctcgccagcgtccccaacgcgcccagcatgatgtacgccgcctccctctcgcagcactgcgcggggccctgtgccgggcaggggccgaacgggggtcgggtgatgtttgggtatggcgtggaggtaagaaggggaatattgtgggnnnnnnnnnngacgtgggtcgggtgatgtttgggtattgcgtggaggtaagaaggggaatattgtgggggaagtaaacgtggacggtatggaccgtggttctggacatgggaagaaggttgtgccaaaagagcacagagcgccggtacacgagagccagcatttccaaggcaccgcaggggggcagcctcccgcggtgggccaccccagcctgaaaaggtccaaaccagggtcgttacccctccccattcccagctctccacccgcaccctcccccgaggcactcgctcactcacagcggggcagcggggaaagagcgcgagctcgtgcgccagatcggcgacttcccgcgccaactcgcccggcaggcccatggcgaggcgcgtnnnnnnnnnnaaaggttgtgccaaaagagcacaaagcgccgggacacgagagttagtatttccaaggcaccgcacggggccagcctcccgcggtgggccaccccagcctgaaaaggtccaaaccagggtcgttacccctccccattccaagctctccacccgcaccctcccccgaggtactcgctcactcacagcggggcagcgggggaagagcgcgagctcgtgcgccaggtcggcgacctcccgcgccagctcgcccggcaggcccatggcgaggcgcgtggatgccgccagcagggccgcgcagcccagcgccgcgccgtgcaggcggcagtccggtccctccaaccgcaccgcgccgcccgcagccgccagcgcgtccctggcg

SEQ ID NO: 25571 - DNA, 226 bp, Chlorella protothecoides
caggctgtggaacgtacctgttaatgttctgtgcatgcttggtagctctgaaacccattaagattgttcatatacacaccttcagcaacatcgaccaaagagggcaatggccaatataggactgacaaaccggatatcaagagcatgaggcttattatataaggggatacacagactctgcagtgctggattccaatgggtggattcattctagcaggaataaggc

SEQ ID NO: 25572 - DNA, 69 bp, Chlorella protothecoides
gcacagccttacctttgagaagacatccagtagcgcctgtccaccccatctctgcttcacggagcagct

SEQ ID NO: 25573 - DNA, 422 bp, Chlorella protothecoides
atgcatccagtactagtatggcccgggggatccgtatacgtttctaatttgtagttaacggttggataccactttgaggcatgtaatatggtactgagcttcggcacagggctcaaattgcatcattaaatgtctccgatgtggctatatgtcatggataaaggcagccccctatatctttttttgtggcagcatgggtccatcaaagcaattattcagggtcttaatgacctccacagctctaaacgtaattcatctggctttgcctgtacttacttcctccatgaaaaaaagtgttgataatgctcataatgctgcccagcaatttcctcccttctcaagactattctggcttcctgggtacttaaaaacagggcttagagtatggctgctgacaaaattgcactctaaacgctagctta

SEQ ID NO: 25574 - DNA, 75 bp, Chlorella protothecoides
agagggcgcccgcaaagccctcatcttgcatccactccagcgtcgccctcccaactcccaggcactcaccctgca

SEQ ID NO: 25575 - DNA, 80 bp, Chlorella protothecoides
gcagccttgcttgggaagcagcccagacggtattttcaaacaatactgcaagggtcccccagccacctgtcaagacttcg

SEQ ID NO: 25576 - DNA, 238 bp, Chlorella protothecoides
catttgccattgtaggctaaccaagactaaacaatcagttattggagtggctgcaggaagagatgtcgacgtggatccacagagggagttcacaagagaaaactctgagcgccagcaagtcttaatgcacaactgcgcaagccgttttgcggagaagttttgattcacgattagatacaagcgatcatcttagaaatggagatgcgtattgatcggtggacctcccgtcccggcgcag

SEQ ID NO: 25577 - DNA, 79 bp, Chlorella protothecoides
gcattggctatggagcgtgggcgacacagcacgcatgcaatcttgctgcggggatggttctgggggcatcgacgccgct

SEQ ID NO: 25578 - DNA, 69 bp, Chlorella protothecoides
gggcaatggggctgagagtcgtgatccagtagcctggaagctcttggtgcatgtcgtaggccacccgct

SEQ ID NO: 25579 - DNA, 79 bp, Chlorella protothecoides
agaagcagcatcaggcatttccaagtgcattaaataccgcatccgagggtcgtcgtcacggcaaacgagctcgggcagc

SEQ ID NO: 25580 - DNA, 92 bp, Chlorella protothecoides
gggactccctcgccgcgccacggctgaggccgcccgggaggttgggccgggtggctggcgtgctcgacctcccgccgctcctcggcctcgtc

SEQ ID NO: 25581 - DNA, 68 bp, Chlorella protothecoides
ctcaggtgcaatctatacgtgcgtgactgaggcagcaggtctgtcggccctagagagagctgcatagg

SEQ ID NO: 25582 - DNA, 76 bp, Chlorella protothecoides
gggtcatctgcaggtttgttgttgtgtgtggggcggtgtgtgtccatgaggagaggggatggggttcctgagagtg

SEQ ID NO: 25583 - DNA, 135 bp, Chlorella protothecoides
accagggcatcctcgatcagactgtgaatatagtatccaaaggcaagcagccaatcctcccaagaaacctggcccaaaaggtttggagagggcccggcgccaaaagacatgccgccaccatgccaataatgcact

SEQ ID NO: 25584 - DNA, 80 bp, Chlorella protothecoides
tgacggggtgacactggacgtaggcatggggggcagtccacgcaacagagactccatgcatatcgcaggctcacctttat

SEQ ID NO: 25585 - DNA, 95 bp, Chlorella protothecoides
cccaatgggttactgctggtgacggccgcggcgtaaaagacaggctcgaccatcgaacacctatgattaatcaattggttgctctcctctcagga

SEQ ID NO: 25586 - DNA, 81 bp, Chlorella protothecoides
gaggtaggacctgtctgtgggacattgagtgtaaacattgttcggtccttccatcagaaagtcgaagaccgtgtttcgggt

SEQ ID NO: 25587 - DNA, 132 bp, Chlorella protothecoides
ctgattcctgaacatcctgcaggtctaaaaaatcctcagagatcctaaagtgaagtaagacaggagtcgggccccgtcctgcggaggacccactccgatcacaagcaggagcctggcaggccttcccaaatg

SEQ ID NO: 25588 - DNA, 71 bp, Chlorella protothecoides
gacctgcccagcgccgggaagctggtggaggtggagtacgcggagatcggggaccgcagggcgcgcggcgc

SEQ ID NO: 25589 - DNA, 80 bp, Chlorella protothecoides
gcacaatccaatgagggctccagagtaaaggacgtctgagatccaccacgtctgcatgtacgagggacacaatatcaggg

SEQ ID NO: 25590 - DNA, 149 bp, Chlorella protothecoides
aacgacctgggccatgcagagtttcagtcgtaatgtgcagtattctgtaactagaatatgctgattaaatgtatattcctcccctcgcggtttcgatatgatgcaagaccaccgagtacgtgggtctcctcgaagcttcagccgaatcc

SEQ ID NO: 25591 - DNA, 80 bp, Chlorella protothecoides
agggtgctggcggccggcgccgacaccgacgctgcgcaaggcgcatgcgctgaggcaaacggagctgcgccgggtccggc

SEQ ID NO: 25592 - DNA, 130 bp, Chlorella protothecoides
cccgggggggtgctacctacccccctcgcaccctccttttgtgacaggagcagtgggggtatgactagaagcgacttcgatgtacagtttcctgacccagttcccataagttctcaagctcctagaatat

SEQ ID NO: 25593 - DNA, 62 bp, Chlorella protothecoides
gggggcctgaccacgcaaggatggccggcggggcaaaggcgatgcgccagaggacccccccc

SEQ ID NO: 25594 - DNA, 97 bp, Chlorella protothecoides
tgcatgccgactgaggcagctgcacacgagggtgtccaaagcaggcgtgttcggcgtggcgactcgccagcggagcgaagctcggcatgctccgcgc

SEQ ID NO: 25595 - DNA, 201 bp, Chlorella protothecoides
ggttttcttcattgcattcagatggatacatctgtcaacgccgctaatcaggttgtttctgttggtgctgatattgcttttgatgccgaccctaaattttttgcctgtttggttcgctttgagtcttcttcggttccgactaccctcccgactgcctatgatgtttatcctttggatggtcgccatgatggtggttattat

SEQ ID NO: 25596 - DNA, 77 bp, Chlorella protothecoides
tccagcttgtcatgattggcctgctgggtgggttgaagctgaggggttgaatgtcccgggctgatggcaggctgtga

SEQ ID NO: 25597 - DNA, 70 bp, Chlorella protothecoides
gcgcggtacgaccggctctgtgggcagggggaggaggggggagtgggcgtgagcgcgcacggcaacctcc

SEQ ID NO: 25598 - DNA, 254 bp, Chlorella protothecoides
ttctggagaccgccaatccaggcgtgacacacagtcacccaagaggcaggaagtagaagagaatataaagacaatggtgccgttgcatcttgctcgcaacggataatttgctacataaacagccaaccaaacacgttttgttctctattttactcttctcctcttacagtggtcatcaaactttcagacataagtggaacaaggtactacgtcgagcaatacaatgcttaatagacttacaaaaccggcacgtc

SEQ ID NO: 25599 - DNA, 67 bp, Chlorella protothecoides
cgcacggttgttgaagggtacaccgcagcaggttttgccaccagggttcatcctcaacctcacaggt

SEQ ID NO: 25600 - DNA, 79 bp, Chlorella protothecoides
cggagcgcaggaggagcgcgaggcaccctgcaagtaccttgtggaaggtaatgcacctgtgctgcctgcttggtcggct

SEQ ID NO: 25601 - DNA, 80 bp, Chlorella protothecoides
aatgcacctgtgctgcctgcttggtcggcttagaccattccctacgagctgcacgtcaattgcaaagcatgtcgcatccg

SEQ ID NO: 25602 - DNA, 61 bp, Chlorella protothecoides
tcctcggctgggacttgatagtggggggggtggcgctgagtgatgggcggccgccgatgtt

SEQ ID NO: 25603 - DNA, 1168 bp, Chlorella protothecoides
  modified_base (97)..(106): a, c, t, g, unknown or other
  modified_base (786)..(795): a, c, t, g, unknown or other
cgcggcgccggcgccactggcgccgggatcggccccgacgggccctctctgggccccggcgcgcgcaaggccggcgcggcgggggacaaggcggcgnnnnnnnnnngccccgacgggccccccctgggccccggcgcgcggaaggccggcgcggcgggggacaaggcggcgcgctcgtcccagttccggggcgtgaccaagcaccggcggagcggccgcttcgaggcccacatctgggtcaaggaccttgggcgccaggtgtacctggggggctacgagtgcgaggagcacgccgcggaggcgtacgacatcgcggcgctcaagtgcaagggccggcgcgggtgcaagaccaacttcgacctcaccaagtacgccgacctgctgggctgcatcaaccgcatgaccatggaggagctggtcatggcggtgcggcgccagagccagggcttcagccgcggcacctcctccttccgcggcgtgacccaccacccctcgggccggtgggaggcgcgcattggggtgccggggtcaaagcacatctatctgggcctgttcatcgaggagcgggaggcggcaaaggcctacgaccgcgccctggtccggctcaggggcaggggcgcggccaccaactttgcactgggaggtgagagggagagagagtgtgtgtggtttgttttggggggggccagattcgtggctgggagttggggcttggaatgtgggtgtgcacacccgcggacgagtgccggtccgagatcagagatcgtgtgtctgtctcaaccggcnnnnnnnnnntttgggggggggcagattcgtggctgggaggtggggcttggaatgtgtgtgtgcacattcgcggacgactgccggtccgaaatcagagatcgtgtgtctgtctcaaccggcgttgccgccctcattcccccagcaccaaccccaccctctttcaccctcccgcttcaaacagactacaaggtggagatggcagactaccacaagatgcaggcccgcatcctgggggcggacgcccactttgcggagatctccagcaacccgggcctgtttgagcgctgggtgaagggcggctgcgaggcgttcccggagctggggtccaacccatcctcgcacacgcacgtgcagaacattgaaggtgggggggggaaggggg

SEQ ID NO: 25604 - DNA, 73 bp, Chlorella protothecoides
ttcaacaccttcctccccaaagtgtgcagcgggtggatggagtgcaccctgttgcacttggcggtaaatcttg

SEQ ID NO: 25605 - DNA, 61 bp, Chlorella protothecoides
cgggtcctctgtcggcgccagaggggttgctaagctgacggacagcactgcgcgggcgcag

SEQ ID NO: 25606 - DNA, 93 bp, Chlorella protothecoides
tcatttggcgacctcgcgaggcagccagcacaaatgcgggcgccggcgcaagggcggcgttcacgccactggccgagtccgtcgccctcttcc

SEQ ID NO: 25607 - DNA, 61 bp, Chlorella protothecoides
acatgcccatggcaatgtttcccccatgcccagcgtgcaccttcttcttctcggcctcgcc

SEQ ID NO: 25608 - DNA, 62 bp, Chlorella protothecoides
cattcctcttgcacctgcggggacggagagcaacggcaggggtcgggtactttccaacagga

SEQ ID NO: 25609 - DNA, 67 bp, Chlorella protothecoides
tgtctaagcaagtaataaacagccatccatccctcttcttccctgaaatgtcaggccactgcgattg

SEQ ID NO: 25610 - DNA, 211 bp, Chlorella protothecoides
ggaatcagcacgcttctgcgctggtccagagaaatgaagggggctgggcagtgtccttgctttcttttgcctccaggcgcgtcctgctactacttgtggggctgcctcagccccatcagactcaacccatatcccctgccgcacaatcatccaggtacgtcacccaggagaatgcgctggcgcccaagtggggggtcactgcggcgcctgc

SEQ ID NO: 25611 - DNA, 108 bp, Chlorella protothecoides
acaggcgtcacagggcagggaggtgtcggagttccctcgcgaagagacatgcaccccttccttccagcgagccatcaccatgagatgcagtgcatgtctcgcacaccc

SEQ ID NO: 25612 - DNA, 61 bp, Chlorella protothecoides
gatgccgtgatgagatgcaacaggatccgacgcaaaggttaaagtgccagaggccagcctt

SEQ ID NO: 25613 - DNA, 130 bp, Chlorella protothecoides
atgccgcatcactcaccactccttggtgtggctgcccagagcggagaggtgctggacgccgtacacttcctcgcggatgttttctgggacagtggggtgaatgggctcgtgaagaccggcggaaggtgtg

SEQ ID NO: 25614 - DNA, 117 bp, Chlorella protothecoides
cggcatggctgccacctgttcgaaaagggggagaggaaatgatggtcatagagtatatgaaaaactgctgcttcgtcaatgtccagagtgatacagaatcacacagctacttgcttt

SEQ ID NO: 25615 - DNA, 80 bp, Chlorella protothecoides
tttggtggctggcgcagggtcgccatggcacgcgtctggtcctcaaatttaaactcatcgacctcactgcttccaggatt

SEQ ID NO: 25616 - DNA, 61 bp, Chlorella protothecoides
atgtggcgtgggtgcgcagatgctgtgtatttgtgtgcaagtgctgccccaggcattcttt

SEQ ID NO: 25617 - DNA, 13296 bp, Chlorella protothecoides
  modified_base (11455)..(11464): a, c, t, g, unknown or other
  modified_base (11596)..(11605): a, c, t, g, unknown or other
cacccacccccctctggctcccccccctcctttctccccacagatgttcaagctgtggtacatggccgacgccgacatgctgcacccctccaactactaccgcctgcagaacacgggccagggtttgcagcgcgtgcaggcagcgcccggcgtcggccgcgccatgcacgccatcctggcgcggtgccagcgccggctgggcggctgggtgggctcctcggtggtgcacctgggcgaccacaacgtgcccaacgccctcctcttcatcgacaagtacacccaggtgccgcgcatcctggggcccctcgtgctggtgctggaggcgctgcccacgctgtgccgcgaccgcgcggtccgcgcctacgtggaggccgtgcacgggtcggtggcggggtgccgcggggcggtgctcctcgacttcttccgccacgcgtttgacgggtctggggccgacaacttcttcgacgccggctcctgcatcgacggccggctgaccagcgcctggaactggtgtagcaagctggaaaagaaggaatacgcccacgtctttgcgctggcggggttcacctccttcgacggcgacttcaagtgaccgcagtcggggggttgggtagcgaggggcggcgtggtggcccccacagcctccctcctgactcccagggtgccaagccctgcccttaccatggccaccccaccacacacacacaacgacaggaggtgccacgtcatcaacccagttcctggctcccatgccctcactgacacacccagctgccctgttgaatcccatagaatctgttgcaactctcggaagcacacggcaggcagaacaaaggccgtcacaaggggaggggaggggctacgctactggcaagggggacaagtttttagaaagcaggcgcaagttgcgcaggcaggctcccggacgccgaacacggcggcggcgcgacgtcgcatcggagtatgatgtcgtcgcatggggtggggccggatcccctcggtcgtatcgatcaggttcagcgtggtggtgtgcctttgcgtgcggagcatgtgcaagggtgcctacaagtctgcgacggcaaggccgcgctcagacctggccctcgccgagcagcggctcgtactcataggcagtggcgggcggggaggcgctgaggcccaggatggaggccagcaggaccaggacccagtgcccgaacaggacgggcagcagccagcggccctggaaaagggggaatggtgagggtgggggattgcggttgaagacactaacaagccactgattactacaggatgcagacgtcagcggggcatgcaggacaaggaggtgatattcccacgatgagatacagcgcttcccagccctcgcatgacccaagcagtgttcatgagcaggcaccacaatcactgcatccccccacacccgaccctaagcacccaccgcaatggggctgttgaagatgagggtgccaaagtccaggatgaagaagagggaggccaccaggaggccgacgttcagaaccttgggcacagtggtgtgcaggcggccgaccacagagcgctccgtcagagtgtaggtgatggcggagaagaggaagaagaaggcggcgcccacccactgccacaggaaggacgggttcttgccggcgtggtagccgtaggtccagtccagggtgcgcctgggtggatggggttgaggagttgtttgagtgggtgacgcacagggggtcctccgaagagaatgaggaggggcagtttgagcgggcattagaacgcatgagagcgggagacgcagcgcagcgccttctcagcacgcatggcccacgactacagacgctaaccactctacgctagcaggcgtcccacaattcggccccctcctagacacaccctcacacccgaagaaaagtcactcacttgggcaggatgacaatgaggaagccgacgacggtgaaggcgacggtgagcagggtgtagaggaagccagccacagagaagctgcgtgggtggaccaggttgcccagtccagtccggaagccgtggatggtggcagccaggccgaagccgccgctgaggctgaggtggaccacggggaggaggagggtgggtgccaccacggcggcgcccagcagcaggccccaccatgtcagggtcttgatgaagaggaggtagaccaggtgcaggacgagggccaccagcgcaaaccacacgaatccgagctgcaggcgctgggtgaggggctccgccagaagctggcggtcggaggtcacctgttattgtcgtggggtgggttgcttcgagagtggatggttggggggttggcggggccaagggaggaggggagacatggatgcaccaacacatcacttctggggagagccgcctgctagatttctgggggcaaacactgatgcctccctcagccagtcatgccagacccagggagcctccagacccacggccaccaacatcatgccatgcatgcacaaagttagaggcgaagtggggatccctgtactgaccttcagggcgtaggcggtggcggcgccagcgaaaagcactcctgccaggagcctccacagctcctcgtacaggagatcgggggcgatgatgtggtgcttgaagaagatgtcagtcagctgcacgcacaaagaggggaggggattcgagacaggttcaggggtaggcaactgggagggggcgtgcatggtgtgccttggacactgcagcccacagaatccgtgtacatgtgtcctcaccctgtagggagcgatgagggccgcgatgcccgccaccagctgcagcaggctcagcagggtgtacagggtgctggagcctgggatgtgcagcccggcgatggtgcgatcatcctggtccgccgcggggccggacccggcgaaggagctggtggtcacgcctgcacgggggcggaacgtggcatgcgaggacgtcgatggaaggacacggggtaacagggcgtgctgcacggaccttccttggggcgcgggggagcagggacttgaggggccggcacacctgtggagacctgagccatttcgggccagttatccctgtagggttgggggggtaaggttgctcggaacggcgactctagatgaaaatcccgggcacccgatctttgaagcgggacaggcacgtttttgcatctgatggcattgtgctcgcaaatattcctcccccgccccgtgcagcgtggaccggtcacgcatggatgactgacctagcgaatagggaaagtgggtcggactttggagtggtttttctcgtccaaaatttatgtagcactaaatgtggtcaagcggggcatatcagggcacgcggggcccgtgggcggccagggtgggaagaggcaggtaccgggcaggtcgcaggctacggaaccgtctatgggtagctgtcgcgaagccggacctctcgagtccctttcacccgccattgtgcggcctcaggcggcgaggtattcagcctcgtcagagaagccatgctgcgcggaataggaggcgggcgaggtgcaatgtgggaaatgtcgagcttgcatggtcatgccgggagtccgtcagcgggaacaacaagttgtggcagggtttgacgagccttgcccagggctctcccgcccaatattcagcctcccaaccttccccatgaacacgtgcacatgcaaggcaggccagacccaaactgcaccacgctgcacacaagcgcgtacctccttgaacaagttcgtcacttgggtgtccattccctggaacttcttccggagccagtcgtgcagggcgtggaggttgtcaatccatcggtttgccgagtcgatggccacgggggtggcttgctctgcggtgaacatgaagtgatcatggggtcattggtacaccgggtcgatgactcaggcctgtacacctgggagttgatgagcatacggtaacaacagtgcacagtgcatggctgccatcgcgcccccctcccgtgtctccgccaaacaccaagccatcttctcactcagggcctcgtatcgttcagggtcgctggctgcatattgtctgagctctgctgagctagcagccagcttctcatccagctcagccagccggcgcaccagacaggatctctcctcctgcacctactttgcgggaggggaggcttggttgctttgacaacgacactatgagcaatcgagcagaaacagtgaggcagccggcaagcatcttctcatgcaagatgttccagggtgtcccacccattctctgcaggaacctgttattccttcaacactcttctcaccgtatcggtgtttccaaccttcttgctttccagctgtgcacccaggctttttgcctcctggcttcgctcctcaagctgtgtctccagtttggttatttcgacttgcagcttgactgccgcctcgctgggaaatgacctgcagcattttcgaggaggagcgcagtggggttcatgattcaggacgcgggcggtgcacgcatgatccttgtgcaatctggtgaacggccaaactgttgtctggatgtcctgtacgacttgatagctgctacactccatgttggtatagcataccagggtactagggtcctttcaaaaactaatccaggtatcagatgctcaccagaagtagtttgaggatccgattttctccatgtggaccaggtcatcatctacgagtgtctgtggaagtgaggcagagctgcgtgtagcctgtggccggactgcatggattttattggtagaaacgatccctgctccctcacctgcagcacatccttgatgctttgcaggaccacccctcgtttcgctccaattttctccacatcctacggtctcgcgatgggggtgggatcctctccaattctgatactatacataagatttattcctgaattactttgtcgacgtaatacatcgcaggcaagcccacacccaccttcagtacgaagacgtccttggtctcgtgaaatatggcgagcagtgtcttgcgcttatcctctgcgctcatcccccgcttgggagccattttaatgcacgctcggtgttatgagtatcaagcaagtgagagactgtgcacagtaggacctgccaatgtccgtctggcgctttgtattgtcttgaagcgagcgcgggaaacatagcgcgtcatgcaaagcatgaggtgaacctctccttcgtttttgcttcgctgcaccgcacgcgtctctcagcatcgtggtccgcctctggctctctattgagtatgcaccgagaacaccagtcatgatggtcattggagaaagaacacgtagccctgaatcggaggtaaacttgccctagctaggtgtacttgagcgccgtcgtgatactttaccctcgcggtttcagtagactggtcctcgactgggcatatcagggtcattgagaggtccgttaaagagctacagggcagagcgccttggtgcgccacccccgcgaacccgccctccctctacaacctcggtggtcgagaggagcaaggcgtctcaagcagagagttcattgttccaccaccgtcttgcaggaccagttccccgtctagcatcactagatatccaactgaaaaagaaatgttaggaggcagtaaactcgatgaaacgcggtttttgagcgagttaggctgcccttctgggcagtacttctggcatggggaagctacgaggagcccaattcgctgccggtccccagcactggcaatatctgtgacgtaaaatacaatgacaatttaaatttgctgctacgcatgtgcatgttccgcttcgtggcttcgacgagaactgcgtatattttctccgcgcgagagtggttgttcacccctgatggtcatgatgcgaggaggcttctgtgcaggcaatggagcatcacatcgaggatttcaatgccccagcttcctaagaactcaaagacgatctaataagcgcagggtacggggactctctgggtagcttattcgattatccaattttttgaatgaggggttttccggagacctggtcgccggtgcgccgcgcccggaggcgggacgcggggttagctggtggaaatttccgatgtcattcagtcctcagcagacagttccagtgcacatcagcatgcgatggaaggatccattagacagatagatgagggtggggttaagcggctgcggctgcgtcacatgtttctgaaaatctattggcgatcaggttggaaccgaacgatgggaaagcacaacactcgatgtacgcttttcaacaaatcgggccctctttgcgatgtattgaatggtaatacgaaagccctaatggttgaaggctcggacaatgagttgcatgtgagaaacccgatgggggcgcgaactccggcacgaggggtagtcgggcaagggcccgcgggcatctgcagatgcacctctcatcctgacaaggggcttgatgaaggattcacatatgatacccagaatctagcgtaaactccacggatgtatcaacagattgttcccattatcataaggaacacgattttcacatcttgatggagcattatgcaccgatgcaagagtttcacaagcacgacagcagtgccaatagttgcacttccagtccagtgcttgctgagcacaagcatttcgaggcttgcggacgcactgagtccagctttacctagtacttttcacccaaaggctgattgaccacacattaggctggtgaccccctcttttgccggactgggaagatggcggtcctccggtcaatgcaccttcctccgaggagctgggccggaaacagataaaaattcactggctggatataagcggggcgaggcacacattgcccaaacattatctaactggaccactttataaacatacaacctccattttgttaccacagcactctcccgcacaccaactgccggcacattctcctgaacccttaacctcgcgatgcgtacttacgcgcgggccgcctcgttggtccttgccttcgccattgctgcatgcctgctgcagcatgcggaggcccacggctatcttgccgtgccagcctcgaggaatgccctgcataacaccgactactgtccgcagtgcctcaatgctggaggtgagggttgcgcgccccggacatgaatgaccgtgttaagagaccgggctctcatcctttcccaaccctttacacctgagcaggaccggcggcagtcagcgctggaaatactttgcaatggccgctttctcaccacggaatgtgcggggactcttacactggggagcggaagcacgagtacggtggcgtctcagccaccgggaccatcaccgggacctacaccgaaggccaggtcgtcaacctgacgaccgtgatcaccgcaagccacaaggggaggttcacctacagggtgtgcgtcatcgaggatccagcctcagagctcgcggagctcactgaggagtgcctggacaagcacgtcctggtgagtggggtatccgcggcgcggggacatccccctcaccacctctccttcccttgggtgacacgccagcagggagtgaatctgctcgtttcctgaggccagtgatcttctcgaggcacttctgcatctcgccaatggcgtcctgagacctgatcagcacctcacaccgacgccagccctcctgggagccctcaaccccttctaatcccacacctggaccctgcctccccaggtgcaagccgacgtggccggagctcagaaccctggcagcccctactggtacgatcggggaaccggttcctacaccatgtcctaccagctgccccagggtctcacctgcgacggtgtcaacgcgcgctgcgtgatgcagtggtactatctcactggtgagggctgcgctgggcggtggaaggcgatggggctttgagtgtcttgcattcccaggagtgggaaggggcattgcagtgcgccacatcagtggcactacaatgacatgcaccggccacaggactcccacaggccttctcctcctcgcaacgcctctgctctgtaggcaactcttgcgagccccctaacaccgaccccaagtacgccagcccacagctgccgagctgcggatccaacaacgcgtaccccgaggaggtgagacccatgatggccgagcgtgcttgaccgttgttgagcgatgtaaaccctcagcaaggaagggttgttgccatgccctgcccaaaacaccaaccccccaatgctcttgccatcctgctacgctcacagctttctccatccctcaccaccgttgactcgctcctgatgctgcagttctggaactgtgccgacattgccatcatgcccgcctcccacggcacctcgcccaccggcaccagcccaccaccctccacagatgcgcccaccccttacccatcccctgcctcctctcctgcctcctcccctccaccgccagagccttcgccaaatgcttccccctccccctccccctcccccgtggcttcgccgccacctgccgcaaagtccccacacccaccctccaggaagatgagccccccgcccgccaagaagttgcctccccccgctcccaagaagtctcccccacccaccaagaagtcaccgcctcccatgtcaagaaagtctccccctcctcccccggcatgtgccgccaaggacgccacgtgcggctgctctggaggaaagtctggcctctttgccgacgtcgccggcggctgcaagggcttcttcaactgcggctccagcggcagctactacatggcctgccccatcaccacgctcttcaatccggccaccaagaactgcgactggccgtctgcagtaacctgcaaggcctgaggggcagcctacacctcgccaccacaggaccaggtttcgcgccaaaatcgacgacgcaggcctggtatcgagactgggagctctgctgacgtagagtgccatggggcgttgcgcatcctgggcccaacctactttcggtccggacttgctgcaggaggcatcctgtccttgcctttattccactgcactggagccttgtgatttgaatttgctgccttcccacggcacctctcaacatgagacgcgcgtatttgcttgccatccatgcaccatgggactcctgctcgtctggatacagtactcatttgatgtcgatgtaaggacctttatttttgagctcaagtgtcacggtgcatgttgacagaggaaggctcctcgagaactctgaatgaagaagtcaagaattacctcctgaacttgcttcttctcctgccccagcggccaccccgtcgcagcccgcgcaacggaaggttgcctgtcatgcacagcaccctgccattggcatagccgtcagcgctggatcatcctccccttgccaatgtgatacaagatgcaatggaacatcagcgtaaggaccttacctcgattaatgtgtagtttacgtcgcacattgcagaaccaggtcacgcagtttaccacagacccattgggctcagtgccctgatccttcaactgacaagcagtactcggtcccgtcacagcccgcgcaagagaattggcctgcctccgacaatgcagcacattggactcggcaccccatacaaagacgcaaaactacaacagggcagaaagaagtatggatgtttcattgacctcgaatggatgccgggtcacatggacaagcaggctgcccttcttagcggagctcagccgtcatcgcgctccagctcagaacggcttcgaaagtatgccatacaccgtgcacagggagcgatctccttcctattcttagaatcatggaaacctattggcgataatttcacagatcactgcgtcatcagacccaaaggccatcgcgttgtgtcccttaaagggtgctgccctcagaacccagccggcgcatcgatcactgacgtctggtcaattcccttttgatcgatattatttgccactgcaatgactttgctaaagtgtacgcaccatctaagaggaggcttgggtgccgatgtgttgagagtctcagactttttcccatcatgccacactatcgagggcacgatgcaccctgcgcggaatctcaattcactgtctgggaacgaagagccaatacctagccgagaggcttccttggacattcatctatccgcacgattcacttttactcacatcaggatttcccttgtagaccatacacactgacagcgccccgccaatgttgaacagagttgccagaggcgcttgacctggagacctgtggcagttggagctgtaatgccagggtgagcctccccaaaacttagatccctatggtgttgactaagaccaaccctgttgggcctgtcaccctgcccgcgcctgtcccctcttccatccctagcgtgtccttgcctggacaccctcgaggcacaccagcctacaccacccgtctcctacaggaggttcgaggacagatgtaggagtttgtttctggtgatagcagttctgttcacgttgccggtggcatatagcctgccctgcaacagacgatcaagatcatcacaaccacttcctctggagatggcggacggtcgaagacttacagctctaaatgcagcatgagcagctatttcattccatgcatcacaggctcctcacgcaaactttgtcggacaactgggaaggccagcccatggtgtcatacacattgcaagagaaacaatatacctgcccagcgacaaaaccagtgtctagactggcggtgaagatgtcggatttgtagtcttcacgataccatgtacaccgctcctggccattttcccagatattgatcattcgtggaaagtaggaatatgttatcacagtgaacatcattatgctgcccttgagggctgcaacctgcaaaaatggggcaggcagaattggtgggggggcaggaggtgagggaggaggtgagggagggggaggggagggaggaggggaaggagggggaggggagggaggaggtggagagggagacgaaggggggggctgaggagagggtagctgcgggggaggtggggatctgtcttctggtggagggggggacttctttcctggtgcaggaggaggtatcttcttatggggaggaggaggcatcctgttggggaaggggggaggtatcttcttgtggggcggcagagaggccttcttcgggggtgggggtgacattttcttgggaggtgggggggagaccttctttgggggtgaaggcggcggttggttgtagttcctgagcacagtctcgcgaagttccttaacattgcagaagttgagaatggtcgtccgttttccgactgcattgttgcaccggaggtttgtgcccttgttgttgagaccccagttgaggtatcccgtgttagagttccctgcgcatcagcgagtcgaaccattgtcatggcaatggtcctgcacagcacatacttcatctcagcaagtnnnnnnnnnnacgagtcgaactattgtcatggcaatagttctgcacagcacatacttcatctcagcaagtgcagcacttgcacctccagcaccaccaaatcactccccacatcctgctcaccaatattgttgttgcccacannnnnnnnnngtgtatctccagcaccactgaatcactccctacgtcctgctcaccaatattgttgttgcccacattgttgtcgccaaagttgttcttccccttgttcccgttgccaatgttggcgtccttgtccgcagtgcatgccttctgtctcgccttgaggcattcgagggccaccaggatcctggtggaccgctccttgatgacctcaaagggagtcatcctgatggcgctggcagaaacgccgagggtgtgaagggtgctctccctgacaaaacccgccttgctgtagcccatccatctgtgaagattgagaatagaagagttggtactctcacatcaagaacattcatcatcaaggaggattctctcccagacaagttcatctggccacaaatccacaagggccgagtacacacttgcaaatgttatccgcgctgctagcctcccacatgtagacctgtggtccatatctgttggagaggatggcggggatgagggtgaggtgtaggaagacagagtccggatgccggcagccgcgtccttccaaaccccatagcgttgcgaagtccgggcttctatagtgaatcgcatactcgattgaagcaggccaggacgacaagagtacaattccgccagctaacaactcacatggctgtcgggagagggaagaacttcgtcgagcaagcgccctgtttgatgggatggagggtcggcggacgtcagcatcctcaagtggtcagtgaaggacaacacccacttggacaacagttatattccaacaacgtccaattgacctaccctcgcgagcacaccgaagctcaggacgagaagcgtcacgctcaccagcggagcgcgtcaaggcggcgccatttttggcagtcccccaaacctgaaagcctaccgggaagtgctccaatataccttgggagctcaaaggcattgaatcagaatacaagtaatgcgcacatcaagattccttatgcgactacccccttctccccctccctggccggacacgtgggcatagtggaacgtacctgttccggaggcgatacccccgcagagtctgcttcctaagggcgtcatccacgaataaggcagtagacaaaacctcactgacgtcgcttttttggggtgtggacccggagtgatttagaattctcgcagaggctccattagggataaattatatatcgtcgcggcttcatcgatgtcgcagcagtgccagctcgcacccttttcgagtaggcttgaacagcgcgatttttcccgagaacgagctttatctttcgcttgatatcgccgctagagttaataaggtccaggactaactcaattgaggcttgtcacacgcgcaacggaacattgcgggttacgcacagcaaccgccccttccttggccgttcaatccactatcttggaagctccctgctgccccagcagctgcgcttttgtgctgtggccttgtccggctctctttggatttatccaggacaccgattccattattcggtggtgagcggacatttggccttgcaaaattaaaaaaactcgtagaaacagtgtctgttacaaaatgctattgcgtttcctacagaatcgcacgcagcgctttagttcctacccatacccgcttgtatgctgtctctatgctgcagatgacgtcatccaccgaatacgtcccaaagggggggggg

SEQ ID NO: 25618 - DNA, 61 bp, Chlorella protothecoides
acgcagatacctggtatggtcatgaaaggcactccttggcatggaagagggcttcactcgg

SEQ ID NO: 25619 - DNA, 271 bp, Chlorella protothecoides
  modified_base (103)..(112): a, c, t, g, unknown or other
ttaccttgctcgcgcatggtccttatcccgttcaagttcttgcatgccctgcttcccatcacagaattcaagcaaagctcactcagactatgaacaatcctgnnnnnnnnnngacattactcattccttgcttccaatcacagaattcgatcaaagctcactcagactatgaacaatcctgctatgtggagcgttatgagcaatacgttcaaggtgagcctttggaaaaagaaattgttacctggcttgcgacatcacttggcatgcgctc

SEQ ID NO: 25620 - DNA, 75 bp, Chlorella protothecoides
gtatagcgtccattaagaaacgcccattgggcaaaacaatgaattatcataatcgcaagacattgggactgcttg

SEQ ID NO: 25621 - DNA, 93 bp, Chlorella protothecoides
tctcgtccaatgctcatgcagcagagggacatccaggagtgctggtagggttcagggtggtcttcaccatgacaggcctaaaaagccccgcca

SEQ ID NO: 25622 - DNA, 62 bp, Chlorella protothecoides
aaggcggccatgtaccgccccgcctgccgcatcagccagaccggggtcctctccccacctgg

SEQ ID NO: 25623 - DNA, 75 bp, Chlorella protothecoides
gtggatgctgaatggaattcgagtccctgcgtgcaacggtcctgatgtgatggtgaaggacagggatacagccac

SEQ ID NO: 25624 - DNA, 61 bp, Chlorella protothecoides
cctaaccctaaccctaaccctaaccctaactctaaccctaaccctaaccctaaccctaacc

SEQ ID NO: 25625 - DNA, 101 bp, Chlorella protothecoides
gctgcacatcttgcactgggaaaagaggggttgaagggtgcaggggtcgggtccaagataggttctgtgtcagtggacacctgagggtcctcgtaccaaga

SEQ ID NO: 25626 - DNA, 63 bp, Chlorella protothecoides
cctgggtggaaactggagcgaccacgtccctgcagcctggaaggacaacggtacgacttcatg

SEQ ID NO: 25627 - DNA, 61 bp, Chlorella protothecoides
cttccccctcgtcaaaggcccaccggctgctgggccgcatgctgacgccaggcggctccag

SEQ ID NO: 25628 - DNA, 140 bp, Chlorella protothecoides
gcagattttgttccatttcattttcctctgctccttctggcacccacgaggagcagttggatactctggccaggctgacgattggaatctcccctggggttcagcttacatgataccaaaacttacataccctacagatc

SEQ ID NO: 25629 - DNA, 63 bp, Chlorella protothecoides
agttggtggtggtgacggtaaagatggtgatggagagggacttgtggttgggggagttggtgg

SEQ ID NO: 25630 - DNA, 61 bp, Chlorella protothecoides
gactctttgtaccttctgtgtggctgtgtagactatgagtcgcccagtgaaagtttgcctg

SEQ ID NO: 25631 - DNA, 1175 bp, Chlorella protothecoides
tccggtccttgagtgtcaggcttcgcagatatggaggccaggtcaggagaggcaccatgtgggggttctgccactggcatcggctccttgccgcgcctcctgccggtgccggccttggatgtcgcgactagccctgtgtcgatgtagatgatcaatttactcataaccttggtgtaggtcggtagcattggagtgcctctatgacaccggggatgcaagctcggatggcactctgctggaacagcaacaccatgcacatcccgcagctcacctctgtttgctgcagccgccatgttctcctgcacagctgccagcatgtggtcgagccaccatacatggatcccatcttcgaccccaggaagcagatcaggttgtggtcggcaaggtctggatacatcatgtgccagaccttgatgctgtccttgcagggtttatcagcacgagaatccgagcaggagcagccgtctaccttgctggggtccacctgataaagctcgaactctgggtgggactgggaccgcacttgccacaagggcgagccaggttgccaggaggggtgacctccctgtcgaggattccagcggacgacttgcagcgagccgtaacgtcctcctttgccttgtcgttcttcagcgagccagttgcggctttgagagtccgccctgcatccagagtggtcagcccacggaggatgtagaggaccaggcccatgcgtcgcccttgaagcttcttgatcctccctttgagcacccgttctatcctgctattatacacctcaactggcaatgtggtgtagtgccgcagcgtctcatgcgtccacaagccctgcatccatgtggctgagcacaccaaaggggaacagtggcgaggcgctccttagggaagagggcacagggtgcagagcatcatcaatgtagtgtggggactctgggaaagccatcgcccccgttatgcaaccgtccccattgcactggtactcacacagagggaactcgtccacccactgcccacgaaagtagtcaggtagccccggcggcaaagagggatctgccggcatcgcctccatgcgggcctttttgctggaaaacatagctgcgtccttggcagcctggctcgaatccttcctatgtccaagccatgatgctctgttgtgggggcgggttagaccctacaac

SEQ ID NO: 25632 - DNA, 105 bp, Chlorella protothecoides
ttgtctgaagtacggcttccaacctgtcgagtcgaggaatgattccaagcagttgctgtaacaggaatttcgctgccccgttcctattccatcgccgcctacgct

SEQ ID NO: 25633 - DNA, 73 bp, Chlorella protothecoides
catgatcgcctccgtgtctacgtcctccaagataatcgtggagaagtccacggtgcccgtgaagacagccgag

SEQ ID NO: 25634 - DNA, 1334 bp, Chlorella protothecoides
  modified_base (384)..(393): a, c, t, g, unknown or other
cccccccctcacaccacagaccaccaacggtctcctcggcaaacggcaacccacagtacgctcggtaactcaccatatcgccgacgtcagagggttagatgtcgctcccccgtcctccgcagaaggatcttgccaagctccaacgattgcctggtctcaaatctatctgctgcaaagtggacagaacaatggagggcgtcagaggattgatgtcatggtcgcgttgcgagtaaggcatcgcttacctatgcaataaaagcaaaggaacagtccgccccctgtcacccccatactcacctttgacacgttgacgactcaatttcttggcagcctggttcgagtccttccgtaggccaaaggacatggcttgcagctccttgaagnnnnnnnnnnccgcctccacgcgggcctttgctgtctccaaagctacatccttggcagcctggctcgagtccttccgtaatccaaaggacatggcttgcagctccttgaaggccaaaacaaaatgttgtccgtggcccttcccgaggcggctggcattggatgccacagccttggactggtgcaggctgcaaatgtggacgggcatccagtaaggaaaagccgacctgtgcatggggagggatcgtgtggtgtcctcacgggccattgatcatatcaaacatgcggctgttcgcacaatcaaagcgtgctcccacctgatggcgctgtactctgccgcactcgcgtcgatgaacacacaggaaagcatccagtcttggcccatcttgttgaagatcactctcagccacttctggatgccctccactccctcatgccgccgcagcgccgcagacccattgtgcacccgattccccgagtccattgcgatcaggaggaaggctttgatctgtacggagggagggggggggcgtctgtgaggacagcctcccctctgacacagaggcatccagagcccaggccatacactgcatggctacccatcccaccacttcctcacattcacatcattggtgccatgcgtgctgccgatccacacagggcggccatgcgcacagtcgcgcaggacacgctggtgattatcgttgagctcgacgagttcaatcagcccctcattgtcacgctcaacgacggcaaagtctgaacgccgagcctggaccgccttcatcaggcttgtggttgcgtctgggtccagcatccatggattggacttcttggaccggtgaatgtcctgcgatggagagcgcatacatgtgggactacagtggggcaccaaggtgcagatgattggcaccaaggtgccggtgattggcaccatggtgctggtgattggc

SEQ ID NO: 25635 - DNA, 123 bp, Chlorella protothecoides
ggcatccactagtgatctggctggaccggaatacatggcaacccatggcatgagcgacccacgtgtacgacaaaaccctcaagctccagcaacatccatctcgcaccctgtgcttctcaatgc

SEQ ID NO: 25636 - DNA, 113 bp, Chlorella protothecoides
ttcaacaagactgggaaccggaaggtcattaacgactgcagcctgcttgagttccgcaagtatgcatgggtccttgatgcccgaccacctccctccaagaaggcctgacaccc

SEQ ID NO: 25637 - DNA, 61 bp, Chlorella protothecoides
cacgcccattggcgcatggcccgtcccactcgccaagaccgtgcaaagggtcaatctggat

SEQ ID NO: 25638 - DNA, 86 bp, Chlorella protothecoides
gaccggaagcatgccgcattcctctacagacaggatttaaggcacgcaatgcaccccggcagatatggcttaaacattatggctcc

SEQ ID NO: 25639 - DNA, 123 bp, Chlorella protothecoides
tatgatgttgtagcttgtaatgccgccacggtccgtcgtggtgatttcgtcgatgtggcgccagcgccttactttggtccgggaagcgcttggtcaagggtctggttcgcgagaagtgcacaa

SEQ ID NO: 25640 - DNA, 77 bp, Chlorella protothecoides
ggctggcctgagttggggctggcatgggagagcgttgaaacgcttcccccccccctcatggaagcactacccctcga

SEQ ID NO: 25641 - DNA, 167 bp, Chlorella protothecoides
cttgcacttaaatagaccaaatattttcctcttcaactttccaggagtagctgcgttggtcccatgtaccctgtcattgctgtcgggcatgaccatgatgatcatgctcaggaaccctcgagggcgcgaagatcgctgcatatctcgagtgccatgcacaggagacg

SEQ ID NO: 25642 - DNA, 93 bp, Chlorella protothecoides
ctagccccacacaggagtcaagaaacggcacatcaggaagcctctgaccttggccctgcaggctcaccttgtcagactgggagacgagagagg

SEQ ID NO: 25643 - DNA, 78 bp, Chlorella protothecoides
gggcgggggcaaatcgacccggtgcccccactggaccgactgctgaagaagacaatggcttgccacgcctacgggcag

SEQ ID NO: 25644 - DNA, 26324 bp, Chlorella protothecoides
  modified_base (485)..(494): a, c, t, g, unknown or other
  modified_base (734)..(743): a, c, t, g, unknown or other
  modified_base (1140)..(1149): a, c, t, g, unknown or other
  modified_base (1276)..(1285): a, c, t, g, unknown or other
  modified_base (1800)..(1809): a, c, t, g, unknown or other
  modified_base (2018)..(2027): a, c, t, g, unknown or other
  modified_base (2561)..(2570): a, c, t, g, unknown or other
  modified_base (3570)..(3579): a, c, t, g, unknown or other
  modified_base (4208)..(4217): a, c, t, g, unknown or other
  modified_base (4851)..(4860): a, c, t, g, unknown or other
  modified_base (5054)..(5063): a, c, t, g, unknown or other
  modified_base (5246)..(5255): a, c, t, g, unknown or other
  modified_base (5974)..(5983): a, c, t, g, unknown or other
  modified_base (6284)..(6339): a, c, t, g, unknown or other
  modified_base (6774)..(6783): a, c, t, g, unknown or other
  modified_base (8284)..(8293): a, c, t, g, unknown or other
  modified_base (8690)..(8699): a, c, t, g, unknown or other
  modified_base (10011)..(10126): a, c, t, g, unknown or other
  modified_base (10559)..(10568): a, c, t, g, unknown or other
  modified_base (12549)..(12558): a, c, t, g, unknown or other
  modified_base (13258)..(13267): a, c, t, g, unknown or other
  modified_base (13504)..(13513): a, c, t, g, unknown or other
  modified_base (13831)..(13894): a, c, t, g, unknown or other
  modified_base (14121)..(14130): a, c, t, g, unknown or other
  modified_base (14204)..(14213): a, c, t, g, unknown or other
  modified_base (15108)..(15117): a, c, t, g, unknown or other
  modified_base (15520)..(15529): a, c, t, g, unknown or other
  modified_base (16530)..(16539): a, c, t, g, unknown or other
  modified_base (17350)..(17591): a, c, t, g, unknown or other
  modified_base (17662)..(17671): a, c, t, g, unknown or other
  modified_base (20397)..(20406): a, c, t, g, unknown or other
  modified_base (20822)..(20831): a, c, t, g, unknown or other
  modified_base (23213)..(23222): a, c, t, g, unknown or other
gccccccgccctgctgtcgcccgcggcggcctcgcccggcggcgtcctgcgccgcatcagcacctccctgccgcgcaagcccagcgcggagggcggcgaggcggcggccagcggcgccgtcgcgcgcaagcccagcgtcaaagacgacgagtgcggcggcatgcgcggacacgagcaccccgcggacgacggcgacacgcctcgcatccgggcctgggtgtcggccgcgccgcagggcgcggccaagccggcaggggccaagaaggacgactgagcgggggaggcgggcgctggactcgcagctgcgaggccctgccgtcccagcgcacgccatctccccctccctctgacaccctccccctcgaccatgcgcactgcgcaccgggcgccgcgcagtgcgagcatgcatgtccccggagcgtcacccgctcctgggtcggtgcccgacccctttccctggcttgctcttctcactcccccaggcnnnnnnnnnngacgcccggcgcgcagtgcgagaatgcacgtccccggagcgtcacccggtcctgagtcggtgcctgaccccttcccctggcttgctcttctcactcccccaggcagaggcgcgggcacgcgccctgccgtcctcgcccccttgatcccatgcctgcgtcacatgctgttgccagccggaaagacgggtgcaggcgcgacgggaggggagggggccccaaccaagcgcgacctggctcacnnnnnnnnnnagaaagacgggtgcaagcgcgacgggaggggaggggccccaaccaagcgcgacctggctcacaggatcttcttgtaccgcgcgtacaccaggacgccgacgaagcagaagatggcgcccaggccggaggccagcgagatgctgaggaaccagccgtaaggaccctgttgttgttgttttttgggtgggggggatgagagtctggggttggtgctgccagagcgtgcatgcccgggtcaggttggaggcaggcgggtccccagacccacgacggatgcgcatgaatggggcgcgctgcttcggcacaggacagtcccgcgcgggaggtggcccggtgcccagcgcccgcacagagccgccaaacacacacgtagggtccccgcaccccgccgcacctnnnnnnnnnnaggggcgcgccgcttcggcacaggacagtcccgcgcggggcgtggcccggggcccagcgcccgcacagacccgccaaacacacacgcagggtccccgcaccccgccgcacctgccccggccactcgnnnnnnnnnnctcgtcggcgggcttcatttccaagttcatggcgaagagcgaggtgaaggcggtcaccagggcaaccgaggcattgaaagacgtcagcacgagttgcatctgcatgtgtccaagggtggggggatcagctgggggggggcgggggggttgtgagtggacggcggcagcacatgcctgcagagtgccattcctcgacgccgtgtggccgccatgatgcatggtccgctccaccctccaggggcattcgcaccaagccccttgccatgcctcaccctgatgatctgattgcgtttggagtccagttccaggttgatgaaatcctggcaaggtgggagtgcaagcgaccagcaatgaatgatgggcgacgcagggtgtgctatgagcatcgcattcatggcaggccgagcagtgacacagcaccgacgtgccgggcaagggtccagccgaggcatcgctgaccacgccccaacccccctaaccccacgatcccaaggtctcacctccgtgtcgtcgannnnnnnnnncgagcatcgcatccatggcaggccgagcagtgacgcagcaccgacgtgccgggcaagggtccagctgaggcatcgctaatcacgccccaaacccccaaaccccatgatcccaaggtctcacctccgtgtcgtcgatgtactcatacagcgtctgcagcttgttgtaagtgttgtctagctgcatgaagtagggctccagcagcatctcnnnnnnnnnnatggccacgtcctcgtcatcgcccagggacgaatccgaggagctgctgctggagctgctggaggaggcgtcggagtggcggcgggaccgaccgcgcttacccagattccacccggcgctctcggggccggtggcgggggtgggggcgaagctctgagtgggggcagggggttgcgggggttcttacaggagggtatgcagcctgtctgccccaaaaggacatgcagtgactggttaccgggtgtgcaggctggagggcaccaggccccctccccataacccaaaggtgggggtgcagcagcctgaatacccatgcccactcaacaccctcgcgccaatgcgacataccggggacgcaggcacgaactcgtccccgggggtcatggtttggtccagggggacctggcccagccctggcaccggccaggagtctacgttctgcagctgggcctcctgccattccctctcctgtggtgggagattggcattatgtacggattggatacggcaagggaagtgagggtgagtgggaagnnnnnnnnnnctccctctcctgcggtgggaggttggcattatgtacggattggacacggcaagggaagtgagggtgagtgggaagggtgttcggcgccgccttgctccaccaccctgggccggcgttgctggcaagagagggttttgagcctgggcccccacaccatgcttccctaccttggcagtgaggtgaaggtccttcatgtccgagtcgtcgttcaggaacttctccaacacctctcgaagctgttgggatggtggtgaacgtggagggaggggtggaaaggcgagtcatggctgctgtcaccggttggcatggcagtgggacccagggcatccaccgcctcgtcaccaagaacactggagtgcacacctcaaggccactccagccccgcgccccagcactcaccgtctccaccctcgtgttcaggcggaccatgcgactcttgatcctgcgcaccctttccagagcgctggtggtgatctgcgagggcgaccaggtccaggtcagggccagcagagtgtcaatgtgtcctcatcatccaggtgcagccagcctggcctccatcccctggcagggatccattggaaacaacacatcacactcccacatgcccagccacgcgacgcatcagcacaccctccctgcaatgcgaatcgtatgctgtccgagagtccccccaccacgcaccttgctggtcagattgtccagcgcggggtgtgccgcgctttccagctcctctgccagctgctccagatcgccggagacgcactccagcgcaatctccagcaccttgagctcgaaggggagctcctggggcgggggccgcagggccctcttctccccatctgcgtggcgacgaggcacgacgtgggtacagggtctgtacgtttgattgcttcgaggcaccatgattcaaacggggtcccgtggaatgtggccaacgttcgccgccagtgaccactgcatgggctgggcgggctcagcatgcactgtctcatcaacagcnnnnnnnnnngcagggtctgcaagtttgattgctctgaggcaccatgattcaaaggggtcccgtggaatgtggccaacgtttgcccccagtgaccactgcatgggctgggtgggctcagcatgcactgtctcatcaacagcccactgaggtgccctcctgctgagcagcaccgccgccaccctccctacctcctcccagcagcaggtgggagggcgccgcgaccccgccgtccttcaggtccccgccgaacgcctggcgtgcgctgtgcgggccccccgcctccgccccggcctcccgcgccgccagccgctgctgcatgccgtgcacgaactggagggtgagggggctggtcagccccgtcacgtacaccatgtccatggtgatgatgcacttgatgtactccaggttcaggaccagcgcgcggtcgcgcgccaggatggccgaggggtagctgttggccagctgggggtccagcagcctgaggggtgggaaggttgcgggcgggaagggggttgttcccgggtgcacctactcccagggtgtcctgtctcgcctgggccaagggcatgcatcccaaccctccgcccgggtgtgccgccgcacacccgcgcaaccagcccacctgaggtcccgcagcnnnnnnnnnnactgggtgttctgtctcgcctgggccaagggcaggcatcccaaccctctgcccgggtgtgccgccgcacaccagcgcaaccagcccacctgaggtcccgcagctggactcccagctggtgggtgaccttgagcttacccagttccagcagcgcggccgttccgttggggctgacggacagccaggtggtgacggcagcatgcttcactcccaccttcgactttgcgccgagctccagaaccttttgtgtaccattttcaaggagcagagagtgctcctcgagctcgctgacggccagctccgcgccggggagcgggcccgtgcccggcatggctgggtggggaagaagggttcaggacagcagactacattgacgagatggttggcaatcacagtatgatgcagatgggcactgattatagcggttggttcgtggtacgtaggcgctggggataaagtgcaaggtggggccatagatgcccagcttatgtgtcccctccctttttgacttgccgccacgacagctttctcatgaaagattgcaaccctatcatgccaaaacttctctcgcacatcgtataaccttcatcgttattctctccataatgcctccgccactggcatcacggttagtnnnnnnnnnncctctcgcacatcggatacccttcatcgttattctctccacaatgcctccgccactggcatcacggttagttgacgacaaggctctatgttcagtcccaaagcaattatggtaccgatgtcatgctcagaccgtacaggccttggatccgatgacaggcaccgtcaagatacctgggtgtgcaatcatcaaggnnnnnnnnnnacaattatggtaccgatgtcttgctcagaccgtacaggccttggatccgaagacaggcaccttcaagatacctgggtgtgcaatcatcaaggtgctgaccctcttagataccatgtatctcttcgtactcagatagagcgacatatccaaacagtgtccagcagagaaagggacgtgtccggnnnnnnnnnncttgtactcagatagagcgacgtgtccaaatagtgtccagcagagaaagggacgtgtccggggaatctgttccagaatcaaattattcgtaacatccacatttttgttgcctgtgtccttcttctgcccacgttcaaatgtggcttcgtctcggcgacgaggaagtgtccctctcagcttccccagaaatctgcaccccgctttcgaccccggcggcatcatgatttatctccaccagttgcgtgtagactgccgcgttaattcacaccatcgcgcaacccagtcagcttatcacccttgcactactcctagatcaccgcctagataacatgcagacctcagtcagcgccatgcgtggcagcgccctggtggcgaccacccacactgccaggacctccacccgggcaacccgctgcgtggctgccttcgatgctcgtcgctgggccagcgtggcaggagtcggtctggcctccattggcctgactctctccgccaatgctgcgaccgtgaagctcggaaccgattccggtgcgtgtgggatgtggtgggaatctcacaccgtcatcggatcctctgccgacactatgccatgttgtccgggagccggcccttgcccatctacactagagcaatgtcctccgtcatcaaatgtgttctcatgcggttattgctgggatgatgcggaagacatcgttttctgccgggggagcctggggacnnnnnnnnnntgtcaaatgtgttctcatgcggtcattgctgggatgatgcggaaggcatcgttttctgccgggggagcctggggactgcctatcacccagggtgcactcattcatgtgctccattaatgtactgcaccatgcaggcggcctgcagttcgaccccgagacggtgaccatctccaagggcgactccgtcacctggcagaacaacgccggcttcccccacaacatcgtcttcgacgaggatggggtgccggtgagtccttctcagcatgttcaggagacctgcttcgaccatcatgctgcatgnnnnnnnnnnnnnnnnnnnnnnnnnnnnnnnnnnnnnnnnnnnnnnnnnnnnnnnnctcccctcacccatcttatcccctcctccccatccctgtagtctggcgtgaacgtgtcgagcctgaaccatgaggactacctcaacgcccccggccagtctgtgacctccaagtttgatgtggctggcgagtacaactactactgcgagccccaccaaggtgccggcatgcagggcaaggtcatcgtcaactaggggcctgcacaaaccgccctccctgtgccaagcctggcggcctgagatggtttgattctacttgcatgggagaccagagcttgccttggcccgcgtcgacacatcgtgcttgtgcaggactggagtagccacaggctggcaccaggttggaaacacctcgtccccctgcacatgcgccgtcgtgtgcacgaccgttttgcatcctgcttcgattttgagaggaagacgtatattacagggnnnnnnnnnnccgtgtgcacgatcgttttgcatcctgctttgattttgagaggaagacgtatattacaggggacaagggggattgtggcggtcagaagaggggcacgatgccgtcgttgatgcggcccttctggccctgcgccacgcactctgcaatccacataatgttccggatctcttgctccctggtgtgcatgcagcgggtgtggaggggtgttgggtgccatacacaatcggcttgatagtgtcatggcgagccctccaccatgcatgcacccaccccagaccaatcatggggctgctgtgatcaccacctgttcactccaggagccttccacactccccaccagtcaacacaccacgcacctcaggcgcatgtaggagtaaaacacgccgtagtggaactgctgctcaaacgtctgcatggcgcgcttggcctcctcctcatatagcaccttgtccagcatcaccgactcgcccgcgcccagctgtgcaggggttgggaaggcatgagaagcaggtgtcaggcagggcatgaagtgttgtagggtgttattgaatgtgagagtggtgcctgcccacgggtatcaacctgggcaagacaggcctcgtctcctccttcctgaccagcacgaggtccctctcttgcctcgctacccccctgccctcgcagccactggcacccgcacaccttgctgaagatggcctggtacggcgggcacttctccatggcggcccggatctggtcaaagtcctctgccagcgccagctcgttctggcctggaagagggtgaggtgtgtgaaggcatgctcattggctgtggtgtaggtgggagggttactttctgaagcaaacagggtcacgtggccctcaaccaaccaatgaaactccagcaacagtgccgccggagacgcattggttgcgcctcgccccaacacgcaggaacaccctcctccccttccctgccccccacaaaaccctcccaacccagaccctcagtcccaagctaccaccattggggtagaggagcccaaagttggcgtagagccggcgccggtcgtcgcgcgtcagctccgtgccgatggagttgagcgtgatgttcagcgcgcggcgatcggcctcgaaggccagaaggtctcccatgacttggtgcgtggcgccgcccaggcgcccgcacagccccgcaaagtcgtccaggtaggccttgtacagcgtgttgcggagcacctcgatgttcatctcgtcgaggtcctccgaggtcaggtgctctgcgggggggagggggggtgggcgagaaggggtgtcagtgggtgcatgtgtgggtgggtgacagagcgtgtgaagccatcaggcgtattctgtggggatggcggcatccagcgccgagggtgccatgaggggcttgctggaaacctttcgagtcagccgcctggcgtgcgacccacagcttcccgccaaccaccccaccccttcatcaaccgcaccggagaagtagggcgccaggggggtnnnnnnnnnnacgtatcctgtggggatggaggcatccagcgccgagggtgccatgagggtcttgctggaaaccttttgagtcagccgcctggcgtgcaccccacagcttcccgccaagtaccccaccccttcatcaagcgcaccggagaagtagggcgccaggggggtgtccaccaggacgaggcggtacaggtcccgcatgttctgggcgacggccagggtggcgatggcatcgaagacgcccagcgggttgcacttgtccagcagctcctgtgtgcgtgagagagcgagagcaggtttgtgtgcttgtgtgtaaagcatgataggagcaatgcagcacgccaatccccagagcgagtgtgcatcaggcggcggcaccacacagtgcaaggcagcgccgcgggatnnnnnnnnnnaagagagcgagagcaggtttgtgtgtttgtgtgtaaagcatgatgggagcaatgcagcacgccgatccccagagcgagtgtgcatcaggcgccgggaccacacagtgcaaggcagcgccgcgggatctgccaccggcggccaggaggggtcctctacagcgccaatcgttttgcaaggtcccagcatcatgccgccacacccctccactcacctgcacgtcccgctcatgtagtgtgccggtcacaatcaggacgatgttgtcgatcatgtggccaaaggtgcagtagtccaggaaggtgcccagaggctcggaagcctgtgaggaaagagatcagggggacgagaggagtggtgagaggaggacacggtgatcccataacctggccaaccagtcaccggcgtgtaggctggagaactggattctcagcagcgatgctattttgacgggacaatggaccccaaggatatccccctctcttagtgtatatcaagacctcagccctcccaaggcgttccattcctcaaactcaggatcctcacattctgacgcaggtactcccagtcgtccaccagcttccgcgtgcagcactccaccagcgtcgttgtgtgcaggggccccgcctcgttggagacgtactgagcataatctgtcccggtctggtggtggcatgggaggggggagccagagggtgcgtcagaggacgcagcatcgctttacatagcagtgtcctcttcacggcaaacccgctgcagccacgatcgactcaccagatacagcttgatatcttcaagattttcgcactgggacaggttgttgtagtcggcagcggtgagcaagcccagcttgtaccctcggacgacgccctctgcaaggggtaaggagcagtgcgtgaaggcaccatgtcgcgctgacgaaaggtaactggacggattgcttcgtctttggcaatacagtgagggcagcctacctagaaacccgtccttgacgttaaacaagcacatctctgcggtcgacatggtggcaaacaccgcgcccggtaagttttaacggtgcgcctcaagttaggatcctttcgtcgatcccacgattcgcagagactggccaggagagaactgccaagggttacgaggaggacgtggtaggggctggctggctggggccagggaaagtcaggggatgggaaggcgtcgcgaggcctgcccgtaagagcagatcgacaacgaacgagattggtgcaacacagttgctgagctctgatgtgatgccgtgcttccatgctcggtcttcgcggagagatccagcatcggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagttcatgaagagcccatatccattacgagcagccataccagggcaccagagatggataggagctgctgcctccccgatgcaaagggcttagggtgggcaagggtgtgccgggtaccctattccaccctgcagcaagtcattgtccccacagaagtgctgcgggcatcacagcaagcctagagagctggtctgcacatgacagcataaggtgaggcggcattggcgcccgaatgccctcactgcctatgatctgagcggcggtgacaccaagatgacgccatcccctctgaggaagaggtagggcagcattcgtttgttcgtctgcaaggcgttgggagaggggtgcatttctgagactgcgcttgactcaccatttctcattgctaacagtgtatacaatcctccagctgctcaccctgactatctcctcnnnnnnnnnngcccattgctaccagtgtgtacaaccctccagctgctcaccctgactatctcctcaaaggtctcctcatcgatatccacgctggtcaccacctcttccacatccccgaggatcatattgaggtgctgatcatacgcctgggaagcgtggtggaccgagcaggaggttgctgttgcaggaacatgaaactcagagtggcagtccttgagaccccaaccatcaaacgtacgtgcagcttgccgcgcagctctctgtcccccttcagtttcacgtatactcgctcgtccaagctgagcttgatcaggtccagaggctccttcaccgtggcatcggcctcttccgccatccctccaggcagtgatgctcgagtgctgccttgtcaatcaatcagaatgcggcgtcaccgggacaatagcgtacttcgtatattcaagcgttactccggcactcaggacggtgtgaaagcgccgaatcggctcctttctctggacccgctcccaggggccgtgctggcaacctctgctgtggattgaggattgtggatccggggcaccacccaccacgaaactcacaccgcgacaacaccatggttgctcgccattttgccgtaagactgttctttccaccgatccttgtgcttcgatcagtcatctgcagcaggagtcggcgtgcaggagctgcagatgagggttgacgtaagcaggcaggccgtcaccttcagcgcctggtgtccccgtgtactccctcagagagtgccgaagagcgcagcccggccgttcacaacgcgaggccctcctacagtttcacggcaacccacggtaaaactcgcggccatgggcgtacaaacctctcctgtgaacaatggtgggtggcgggggtagggtgtgcatgacctgcagatgccctggggaacgcttgctctttgcagcacggcaacggctctgaggaaggacaaaccatctcctttcgttgtgctcagtcgaacgtgctaccaaggaggatgtgaagagtctgctggacaaggtcaagtgcttcatttttgattgtgacggtgaggcgcgccctaacctgaatgcagctgggttgggagcaagtcctgtggcatgcttgctctcatgacgttgggttcttcatctattgacacaactctggatgtgatttaccacctcaaaggcgtgatctggaggggcgattcggtcatttccggcatccctgagaccctggaccatctccgcagcttggtgagggctggaagaggcgtagaatgcttggaatcttgtggtaaagactgttgagaacacgaaattcacttcttgagatccatgacatccaatgattgttccaaccatcaccctcaatgctgcagggcaagcaactctactttgtgaccaacaacagcaccaagtcgagggcaggctacctctcgaagttcacctccttgggcctcaacatctcagctgtgagtcgcaaggattgtgaaatgttgaactacatctggcggtgctcttgcattttggaaatattggtttcgttctgcagtggcctcctcaaccttgtcctgatagaagcattggcccgtgatgcaccccttccattctgcatgaccatccattcgactggtgcagcctcccccctccccttaactccatctcaagactgccacactccatctaccatcacaggatgagatttactcctccagctacgctgccgcatcctacctggagtccatcaacttccccaaggacaaaaaaatctatgttatcgggcaggagggcatcctggtgaggagacggcaacacactaagcctgtgtgcgcacagactgtgcgccacgctcaaagaggaatgtccttgcttgcagcttggggcttgaagagtcatgggtggtaaatggcatgacacgctcacatctctcactagcctcgcttcctctctttccttcccccttttgcaggaggagctggaactcaagggcttcannnnnnnnnnacgaagaggaatgaccttgcttgcagcttggggcttgaagagtcgtgggtggtaaatggcatgacacgctcacagctctcaccagcctcgcttcctctctttccttccccctgatgcaggaggagctggaactcaagggcttcaaatatctcggtggccccgctgacgcagaccacagggttgagctgaagcctggcttccggctggatcaggaccctgatgtgggtcggatgcttgttttccgaacagtttctggaagggttgtgtgattctgcatgcatgataacgttgggcaatcgggcccttctcttttgtgcggttgcagtcattggccttgcccaagttccatcggcccctgccagaaacccgcctgctcaaagtccaaactggctgctcactctcccttcgactcctcctcttttgcccccggcccaggtgggcgcggtggtggtcggctttgaccgcttcgtcaactactataagatccagattgcgacgctgtgcctgcgagagaacccagggtgcctgttcatagccaccaaccttgacgcggtaactcacctcaccgacgcccaggagtgggcaggggctgggagcatggtgggcgccctcagaggtgggctctgacagtggatgtgatgggagtggtggggttgctgctcatctctggtgggattgcccagtggctggggataggggnnnnnnnnnntcctgcatcaagccaagcgcagacatggcaagtgcaaggtcctgtgcactctcgcaccacccatgctgccttcaaaagtcttctagcaagactcttgatcacatgctgcaacagactcttcactcacagcttttgaaccatacttcgtctacttcaaagctttgatcactctactgccgaactcacgtgcaggctcgaccaagcgcgagccgaccgtggtgggcaagcccgccgacnnnnnnnnnnatcttgatcacatgctgcaacagactctttactcacagctttttaactatacttcgtctgcttcaaagctttgatcactctactgccaaactcacgtgcaggctcgaccaagcgtgagccgaccgtggtgggcaagcccgccgacttcatgctgtcggacattgccacgcatgccggcattgatcggtctgagatctgcatggttggggaccgccttgacaccgacatagcctttggaaaggacggcgggctgtccaccattcttgtcctgtcaggtcggcaggcccggggggcgcggctgcctgggggagggggggnnnnnnnnnnnnnnnnnnnnnnnnnnnnnnnnnnnnnnnnnnnnnnnnnnnnnnnnnnnnnnnngcaacttgttgttcacactgtggtcgggcgctggcaagggctgttgaggggagagggagagtggtgtgagtatgctgcaggtgcccaggtgccttgctctcccaaccgctcactcatatccatctgctctgcacggcatgcaggcgtgacgagcgaggaggagctgctcagtcccgataacaagatacgcccggatgcctacctcgattccctggctgacgtgctgnnnnnnnnnnttaattcccggctcggatgtgtccaacgtcaaggaagaaactcgggctgtcagccttttgcttgtcgcaccacnnnnnnnnnnaagcgaggaggagctgctcagtcccaataacaagatacacccggacgcctacctcgattccctggctgacgtgctgcgcctcagcactgcatagcgtgtaattgccggacccaggcccagtggctcgtgccatgatattgcccgattgatgccatgctggagcgagagcatggttcctcctgtccgtaattcccggctcagatgtgtccaacgtcaaggaagaaagtggggctgtcagccttttgcttgttgcaccacggcacacaggtctcgtgcctttgacagcaccttcatcctgtaataatcacgcgaatcgctaatgtcacaatcttcacagtcagcaaggtagattttcggcatcaccatgggagcgtcggagtcagcggtcaaaggtgatggctttgcgctggttgctctttcccttgggccccttctcgtcaaagctggatgcatccttgcttggcatgcgcaggatcttggtggcctcacccttgaggcccgagccacccttttgacgctctgccagccgccgccgcttcatctcggcctgaagtaagggggatggatttggttattcagagcccctcacattgaggcacacagcacgtaggcgtgccaagacaatgaacagtttgcccacccacccacgagcaccattcctccccatgcgcctcacgtttctcatcttctccagccgcagccccgcctcccgtcgggccgcattgcccagggcatcatcccagtcaaaggtgagcgacctgtccttcttcacgctggcccagtccgcgaactcatgcaccaacacctgcatggagccagggatgtggcgccattgtttccactatatgctctgggatcaggcgtttggacaagctgcaggcctgcaacaagcagnnnnnnnnnngaccaacacctgcatggagcgagggatgtggtgccattgtttccgctatatgctctgggatcaggcggttggacaagctgcaggcctgcaacaagcagcaaagagtgccatggcttccaactgggcatagtgtatacacactcacctcgttcttgccattggggagcgtgtgactgcacaggctgcgcaacaccgcagggtctgccctcttcttctcaggactggatgcagggttgttgagagggagggtgatggtatatgcaattgagtcgttcaactttgtcagcaatcgtggagaacaaaggctgcgaccgactcacacatgcccttgtacctttcttctaacccttcagcaaacaaacagcgactcaattgcccattgccccacacacctgcccaggannnnnnnnnntgactcacacatgcccttgtacctttgttctaacccttcagcaaataatgagcgacttagttgcccattgccccacacacctgcccaggatgagcccatgcactctgagcgacagcttgtccttggcacccgccagtttcctcataatctctacccctggttggcgcagctccccatcagaaacctgtggggggaaaggtgatgcgtcgggttgcacttgtatacaattgacacatgcacctgtttcggtggcaacctgccggcagatcccgaggctagtcccaccccctcctgtccaaagcatcaccagcaagatgtcagagttggcccatttggcatctgtcagcctgctcaggcacagcttgatggggctgttgaagtcagagccgccattgaacgtcttctccaaaaagtccaggaggttatggatgctcttcatatccatgttcagctcaagctctcggacctgcatgaggaagatggggtggaggaggcttggacggagtacagggatcctgactccttcagtcagtatgggaaaggaacaacgcgtgggcgagtacaatgaagatcatcagacacgcatcccgctaccaagctcagaaatgggctgggtatgagtccagccaccagtccctaattcacacaccgactgatgtcacgctgcctcacccccggtgaatacacacctccccaatccccaccatctccacacaacaggcagaatctagcatgctcacctcctggaggcctgcaaacgcaaacacatagcaggccctgtcttgcgccttggctgccctcatacactccagcgccagcgcctttgccaccgtttcccgaggcccacgcatgctgcctgcgagcatgggaggagggtgggctctgggcaagatgattatgggctggaaccttgccaccaagcccacgtgtccatggtacaagtgcctgcatgatgccatcttcaaagttgctcccctgcccaggtgtcttctgacctgagnnnnnnnnnnagtacaagtgcctgcataatgccatcttcaaagtcactcccctgcccaggtgtcttctgacctgaggtatccacacagaggagaattgggcccctctcagcagtgggccgcacctccctcctctctggtacggtgctggtggggaactccgaccagccgtcacgctcgtagcactgcagcgcctgctctgccagcttggcaaagaagagcaggcgcgcctggcgcaccgtcctgccccttgcaagcagggccgcctacgtgccggaggttgcagggaagttggccggcacatctgcattggcaaatcctgcctgtgggggccaatggcagggtacccccagcgatcttgtacacgctcatgagaaaccattcaattcacgatccccagtccctcacctctgagggcagcatgcgcgagaggtcatcccccctggtcaaccccctggtctcctgcgcctccagcaccgtacgcaggaggccgggccgacccctgtcatccaggtattgcgttggggcgcggcgcagtggaccccagccgccacctctgtgggagttgggatcagagttcgagactatcgggaatgccatcccgggagcttgggagcatgtcatggacgcagatgttgaacaggaaccaagatcccttaatcgcagctctgcatctttgaagaaggctgtctgctgcaccggaagaaatttgttgacatgctggtgccatgcccagccacatctagtggcgccaggtgatcaagcaaccaaacgcttcggccctgctcccttccttgccccgtgcgcacctgcccaacgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaagggaggtgtcatcgtttcatgcaccaatgaagccgaccggcttgttgctttcgtcaggcgagcannnnnnnnnntaagcaaccccacgcttcggccctgctccctgccttgccccgtgcgcacctgcccaacgaccgcaccaggtcccgcagctccttcacatcctccagcttctctcgcagggcatccatggccgtccaccctttcctcccccagatgccgccgcccaggtcaaatgcattggggtcgccacgaccgccccccagcagcgcctccatgccctggatagtgaggagacagaggggaactctcattattgggcacgaggagaccaagaggaagtcgagttgacttctgggaattgcaaagaggctcattgcaagagaggtgtcatcatttcatgcaccaatgaagctgaccggcttgttgctttcgtcaggcgagcaagcatcaccattcaatacccgacctcaacaaaagtcccttcctataccaccacagctgatttggctgcctcaacacacctcaaaagcgcgtccagcgcgagacagggtggtgagtggctccctccacatcttcaccagggcagccacaagcttctgggcagcttcctcctcctttgtcttcggctctgtggagtcgggctcctcctcctcgacttcgctgttgcccggctgaggctggcccgggactggcgaccccggcttcccatcagccgccacaacgttggggttgcggatgccctgcttccctccctctgctcgtcgggccgcctcctctgcctgcagctcggcgatggtcttgtacacatttccgctggcatctcgtgcacgcccttcctcctcaatcagcccagagactgggaatgcgagggggttgagggatgtgtaggatggggtgccagcatcatgtttgcctgaatatccaccattaagattcacttttgcagctccagaactcaacaaagtaattctcaagcagtttgtggatgcaattgcgctacctcatgcttctgcttgatccactgtttgcctcctcccactcacccgtcttctggtactgacacaccacttgcaccaggctcttgagcaaggcctgcagcacagcagggtactttttggcaaaccgcccaactccaagcacggtgactccccctgtggtgtgagcatggagtggtgagaaccacgagccggtctgttgaaggctcgaacttggggaagaaaccatgagccggccacactccctgagacacgcatgtgcacctatgaagcacagcctaatccctgatgctatgtaaaccatggatgaacccactggcatctctccaatccctagcggctcactcaggagggcagctcgaaggggttcatcaggccacctcaggtcctccagcttcctgtcgccgccaacaaacccagggttctcagccatggccatcaacgtctcgtcgtcgggcacaagaccctcttgtagtgccgcctgtgtgatgtggtgtgctttgaaaggtgtgggaaaggaagggctccagtttgcagaaatttcaaggtttgtcaagcttacaaaggacaatccagcaaggttactttgcatactgcattgagttttttctactgtaattcattatatctccaaatgcccatgccaccagcaggtccgtgcagcttacctgccagatgagcagaccgcaggctgcgtcctggagggcatcggctgtatcagagcccgagatgctgctgcggatgtggctgaggcgcagcaaccagggcatgaggctggtgggaacacttccaacatagcccagaccattgatgaggtcggtgtgcccagccatgtggggttgaagtgccgcacgttccggcgacgctactgctgtcggagtgcgtggccctgatcgtcgtcccgcatgcgagtgctgacgactgcctcgatcggccgccatgacaggcaagttgaccttgctgccgtatactggatgcgggaagatgcatgcgcatcggtgcggtgtcagattggtggcggcattcatgccaggagtgttcaggttcgacatccttgagaacctcccgatacaaaggccgggcggcaaatgatcttcgagatccaatcacgacatgaaagaattttgcgagggttgatttccatgcaatgcgggagctgtgttggcgactctcctccggcatggaggtcgcagcgcgctaggatcaaaggatatctaaagccagagtggctcagcgcgcgggcgcatgcacccgcaggtgttgcatgcagcgcgaataccagcctacgcatgccactgttctccaataactcggctcaacagatattaaaacctagtattcagtcatagtctaactaaaaccgactgccgccacattactataaaactctgctcccgcatccttgtactgggttgggaccgctttgtcggctagctcgtttgaatgccgccaatgaagcgaagagcggacacacaagatgaggacgagtgcccgtcgaccagtgcacccaagacaattggacagatggtcgagcacattggcaacaagcaggtccggtccaccaggtttcgcgagctgaagcggaaggaggaccgacggaagaaggcagagaggaaaaagcggcaagcagcagccgagaaggcagagaaagcgggtgcagaacccgtaccaaagccggtccccaaggtaagggggcggggttgccaggatggccgtggggcagggagtaagagaagggctgcaaacgcgccaagggcaccttcactgtgtacatgagctcctggcaactcatcagcacagtnnnnnnnnnnagtgtaagtgaagggctgcaaatgcgccaagggcaccttcactgtgtgcatgagctcctggcaactcatcagcacagttagtatgagaatttcaacactggcgcttcctcccatcaccatctcagacaatcgagaacacacgagaactggatgagactattgtcgcgccggatgacgaggaggtagctgcagaggagacacaggatgagtttgcaggtgagaaagggagaattctcaggcgtggcaaagggagagggcgatggcgcctgaacaggggtgccctggttcttgggagagtttttggttggagagtgcagttgagacacaccttgaaccatgatggcaccctctccagggtcccccactacacccgctcaccattcctgggacgtgttctcgcagatcactttaagagnnnnnnnnnntgagagattttggttggagagtgcagttgagatacaccttgaaccatgatggcaccctgtccggcctccccccttccacccgctcaccattccggggacgtgttctcgcagatcactttaagagggtgcgcccgccacatgtgctcatcaccacctgcttcaagccatctgggatcatgtacaagttcatagccgagcttctggaggtgatgatgagcgcgtactcgatgcatcttcatggggtgcaatggcagcatgaggggggcgttgcactcatatcaccgcagggaaggctgcgggatgctgacagtcccccggtaatcagggtctcatcgcctcccacccctttattccatacaggttttccccaatgccacatactacaagcgccagggtttcccgctgaaaaagatcgtgcagtttgcgaagaaccgcgacttctcagacgtggtggtcatcaacgaggacaggaagatgatcaacggcatgctggtgacccacctgccagagggccccaccgcccagttcaggctatcaaatctgaagctgtcgacggagatctcggtatgtggtgcggggcgctcacggggatgaagcaggcatgctttgcatggacgcaagacatgcacagggcatggctgaggccatggatgccttgcacgcatatcccagacactgcctggttgcatgcagatactgtgtgacagtttgtgatttgaggcacagtatgaaccccatcacgtttcagtagccctccaaagccatacccctcccttcccaccttccaccacagaaccacggccgcatctcatcccatcgcccagaggtggtgctgaacaacttctccactcgacttgggcaccgggtgggccgcctctttgcctccctctttcaccaggaccccgccttccggggcaggagggtggtcaccttccacaaccagcgcgacttcatcttcttccggtgcggagcggccagtaggccagacattattaggcgttgagggtggctgacaaggctgtgccagtaggatatgggagaagaattccccatgctcgctggccacatggctggcccttccaacctgtcaccagatcacaaaccccaactctctattccccctctccaggcatcatcgctacatcttcgaggagaaggcggaccggaggacaaaggaggcgcgagtgcaggcgcggctgcaggaactggggccgcgcttcactctgcagctggagtcgctgcagaagggaacctttgactccaagtctggcgagtttgagtggctgaacagcggggagcaggacacctccaggcgccgcttcaagctctgaggcgagacgcacgtcgggaggctgtgtttccttgcgatgactcggatggttgcgctgccctgtaacctgcttcatccgcccggagcagagcaccgagatgcttgcatccgctccacgatgtgggatgtgtggggcctgggtgcttggaagtgccagttcccaccaaggctgggctctctggcaggctggagtgccatggtcagagctcgcggtacctcttgccagagacgtagtgcagtacctggggaagcacctgctggagggaggcggcagcggtcgccaggttctccaggaactcgtcctgcagaggatgatggttctgagtttttacaagagctgattgacgtgggggcaaccatggtacaggaacggattcctggtgcagcgctgatgcggctgggccaggttgttgagcgcatggaccagctcgtaacccaacggaaaaagaaagaaagacctgcctgcgctgggcgcttcccgtccacaatgtcggtgatggccttgacgctgaacatgggcacgccaaataagctcgccgaccaggcaatggctgcagcctccatctcctgtggcgaagaagaggggattgtgggagtggagggctggatgggaagagagtaatgtgcaagctggcactagctaaatggacgtctgcatgaccatggaatgggccaggcgagcagacgccgcagcctgctagaatcccgtctgctcagcacacccgtttggctccacctcctaccccgcccagcctccctttctcccctcccactttgacggaggtgtcatgctcccgcatgatctccatgtcccgctcgacgtagtccagggaatttccagaggacaccagccccgccttcagtcccagtgctgcctggagctgcggcgtgggcagggccgcgtgcagacccagcccatactggtcgaagccctgtggcaagaggatggtaaaagaggaggatggtctgtgtgtgagcgtcacccctaggagcacacccaggcggacaagcatgcgggttggaactggctctgcggtgccctgggcggagannnnnnnnnncaaagaggaggatggtctgtgtgtgagcgtgtcacccctaggagcacacccaggcgcacaagcatgcgggttagaactggctctgcggtgccctgggcggagacaggaatcccttgccagcgcagcgctgcgcacgccggcgacgtttcagtatcttcggacacccgcagagagctctcatgcccctgcacccaccacccaccacccagcgcaccctcttaccgggatcgggatgcggcggtcgtggttgacggtggcggtggagaggaagacgtcgccgatggcggcgccctgggcgccaaacccgccggccgtgcccgtggagatgacgaggtcggggtcaaaggcctgaagcgccaggtaggcggtcagcgcggcggggacggtgcccacattgtccacgccgtgctttccacacttgccgttcacgaccacgtgcacgtgggcgccggcgtgggagccagagaaggagacgcagggggcgggctctgggatgacgcggggtgtgtcctgcaccaaacccagggcctggatcaggggggctgcctcggcctccattgctgggtggttgtgggggtgagagtgtatggggatgagacacgtgagggagggtgtccagcgacacaggacacaagactgtgcagtgctcaattcagaagatggggtgccagttgtaaagtgcatcccggggttcaaatgcaaggccgaggtccatggtaagcatcagccgccctgcgacactcaccaatcaggaccaggatgcgcttgatctgcttatccgtcagtgaggccaggtacgcagcctgggcagcctgcaccttgcctgtcacagtatttaggttgtaacctcaggaaagattgcaggtagcggctgtacgtcactggatcctctcaatgcacagtgagctccagttcccatgtgggcacctgcaggcgtgctgaccagcacgtcggcctcgagaccatgggactgctccgtcatgatgctactcggtgtaactatgaggggacttggacggcaggcgaggttcaggcgtgtgttctgtgctgcttgatcagggcctcgactccaagtgccggcgccacgcacacgcactgccaaccctggagcgacgacggtgaggacccttcagacccttaaaaatgcgaccgatgtcccgatttatgacactgccagacaggtggtggagcacttcgccggaaatctcacctccctaatcactgccgttgtgccaacaaggttggggcgcggaaatcggtcatgggtgacctcccggccgggggatcgccgcacgccatcaccacagagacccatagatggagcagaggttgtgctctttcccaatgccgtgtcgtgcacctcgaatcagctcgccctcatcccagggcagctggcgacggcttgtaactccacccagtgtaggcctcagcatggtcttgaggagtgcagacctatcgatttgggatgtgtgactgcacttcatttccatgagcaccgatctgacgcctgatgaggctagcactggagttttggacaccttgcagtgggtaagatcacttcgctgcgagctgccgtgcaccgcgcacacgcctcccggcctgtgacaccattcctctacgctcgcaccccagcaccccagcaagcgtgttcggcacatcaagggcatcctcgctcgcagactgccgaggggatctgacgctgtctgcgccgccctcttcgtcccatggtctgaagctggcgccaaggatggcagcgatgatgcctccagatgctggaaggccatctacgtcagcgagcgggtgcggttgcttcccacagtactgtatgggctcgttgttatccgtccagctgtgcataaggagtgcatacagtgagcggcctgcccgactgcggcgaggtctgcggcatgttacactccttgcgcaactgaccctccattccaggtgcgagcctcgagcgacccagactgggcacctgtctcttgggttgactcggacctgcccagtgcagttctggcctccaagactgtgctcctgtcgctgtacggatccgccgatgggattgaggtggacccttgtcccctgcccgtcatgcaatccccgaccgacgagtccaaaaacggtgctgaggacgcggctaactgtgggcgacaagaggtggaagaggtgagccgtgcagattcctgcaccccctcgcccagctcgtctgctagagtgccccaggcagagcgcgacgccgatccctcaccagaccaagcctgcaatggagacgcacaggcgcaggccttcagtcctgcggcgccgtccccgctcgcgagcaagcaagggcaatcaaccttgcctgattccaacgagaagcactaccctttgagccggtgtgacacaagtgcagcgccggcacaccccgacaccggcgccccgtctctctgcgcgtggcgactagacctaggttccatggtccgggtcccgcccgacttcgtggaatgggaggccgaaagcgtggccctgcaccttgatagcggctggtacgctttccccaccccgggcctggacccctgccagccgccagcagccgttccagtggtgaggcggatgcgtggtgtgcatgggcgggccaggccggggtcccaccagctgccaggtcctggtcacgctgtggtatgagtctcatgcctgtggcttttgttttgagtatgttcgccatcgccagcccagcatggccccttacacacttccctgatcctcctcttcccacccaccatcaccaccccagcagccctccggcctccagacgcccagcagggcagagagccctgagtacggctccccgcctcgaaggggggccgacacggccggccgcgcgctgccgccggcctcgccctcggacgcggcggcgggcgagcccggcgtgccacgccgcctggccgccctgctcatgtcgcgcctgctgccaagcagtctgagcctggcgggcggctccggcacggccacgcccgccctccccggctcccagcccggttcggaggcgggcgacacggtgccggccccctgccagctgggcctgggccagctggccggcgccgccgcggccttggccgcccg

SEQ ID NO: 25645 - DNA, 102 bp, Chlorella protothecoides
caggagcaggcgtgtggaaggagggtgaccacgcatgaccccgacacagggcccggagggattcaccagcatgagtgtcgccctgcctctcagacgagcagc

SEQ ID NO: 25646 - DNA, 72 bp, Chlorella protothecoides
cacggttggacggccaacccagatcatgaggcaggacctgaaaggctgcctcggtgcatgacgccagggagg

SEQ ID NO: 25647 - DNA, 79 bp, Chlorella protothecoides
acctgcccagcttcctcgaccaccgcaggcacatgcagctccacattcatcgcgcttcccagtgcaatgtgagtcgcgt

SEQ ID NO: 25648 - DNA, 85 bp, Chlorella protothecoides
tgagtgatgcgtggggtcctgtgatgcgtgggattgagggagcaaacaggtagacggaggtgagtcttgctggcgtggcatcggc

SEQ ID NO: 25649 - DNA, 76 bp, Chlorella protothecoides
gaggcagccgccgagcttggcacaacctccgtgtagcgtgcctccggcacgaacaattccgcagtactgctgccgg

SEQ ID NO: 25650 - DNA, 61 bp, Chlorella protothecoides
aaaagctttttacaaatagcgtggctggggtacagaaggctgcaaaaggacgatagacctc

SEQ ID NO: 25651 - DNA, 80 bp, Chlorella protothecoides
gcgggagcggggcgcgcagctgcgttccacacatgccgatcgcggcgcacccggccccgcaatctcgacggtgggttcca

SEQ ID NO: 25652 - DNA, 85 bp, Chlorella protothecoides
ttcatcgaaacctggtcgctctgcatcgcaaagtgtctgggtacctgagttttctgggctggcccccacaacggtggaccgctgt

SEQ ID NO: 25653 - DNA, 67 bp, Chlorella protothecoides
aaacacatcggtgggaaggcctcacatcgacgctcagcgtgcaacaccgccggcggcctccccaccc

SEQ ID NO: 25654 - DNA, 61 bp, Chlorella protothecoides
gaatgcgatgcccctggtcagccggctgaaggggagatcggcactggtagggcgtgggccg

SEQ ID NO: 25655 - DNA, 69 bp, Chlorella protothecoides
acgaccgacacacaatcggtggtggtcagcataggggacggggtgatgtgcgagttttaagtcacgata

SEQ ID NO: 25656 - DNA, 1838 bp, Chlorella protothecoides
  modified_base (455)..(464): a, c, t, g, unknown or other
  modified_base (1536)..(1606): a, c, t, g, unknown or other
cgagcgcttcggcggcggcggcggcggcgcgcccgcgccgcgcgagcgtgccgacccccccgtcgtcgacttcgtgcacgtgccggagctggaggcgcggggtctggccgccgacggcgcggcggtggcctgcctcctctccgcccccgcccccgccgcgccggagaccgaggggtgagccagcgtctaggggtcatggtgggggggatggggatcccgggcggttgcgtggcggagatgtcaccaggggaggacagtgcctggagtacagcagccagaatgcgctctgctttggcatgtccgctcccggctgggttctcctctgtctgcaccgcgctggcgcgcctcccggcactcccacccgtggcctcaggagatctgtcttccatcgcatgccgccccgtatcaataatgcactcccccaccccctcccaccctcccggaaccccccccannnnnnnnnntatctgttttccatcgcatgccgctccgtatcaatgatacactcccccagcccctcccgtcctcccggaaccccccccactcccccccacacacaggctgctgggccccggcgaggtgccggagggcagcaacccgcgggtgaagctggaggtgtcgtacgcgctgctggccgactcgacgcaggcggtggaggtggcgctgagcaactgcctggtctcatggccctactttgacgaccagagcctggtgaacacgttgaccggcctcttcggcgcgccctgggccgagggccgcggcggcgaggctgcagcggcccggccggcgcccgcgtccccctcggcgagcaccaagccggcggctgagccgcggccctggacctacttcaacgctgtgctggcggaggtggaggtgttcctccccgtctacgatgtggagcgggcgcgggagatggcggccgcgctgtgggacgcgggggagcccacctctcgcttccacgccgtgggcgacctggccctggcctcagtgctgctggcctcgctggacgagggcgcggaggccggggcgctgcccctggaggcgcgcggcgtgctgctggcggccggcgcggcgcggctgggccacgccgccggtggcgacggcgagtcctgcctgcgcgccgacctgcgcgacttctccgcgcacgtgcgagacccgtgcgcgcgcgtgcacaccgtgctgctccccttctccggcaccgccacctgcgaccaggtggctccccaggtggcggagcaggaggaggtggaccgcctgcaccgcgccgcggccaccatccaggcgcactggctcgcacaccgggccaggaggcggcgcgacgcgcgcctggccggcgcgttcggctcggggacctccagccccgccgcctcgctgcccacctccttcagcatggagagcgagggcgaggccctgggcttccccccgcctagcccgaggtcgggcgccggcgccggcaaccccgacgccgtcgcggactcgcccgacgccgcggtcacgccctggcacgtggtggacgagctgatcctggacgtggcnnnnnnnnnnnnnnnnnnnnnnnnnnnnnnnnnnnnnnnnnnnnnnnnnnnnnnnnnnnnnnnnnnnnnnntacaagcgcgccagcgcggagcacaaggagatggtgtacctgcagcgcctgcgcaccaccacgctgacggcggtgagcgtggaggcgggcgcgctcaccgtgcgcgccgccttctcccacatccccttctggcgcgccgccgccgccgcgctgcgcctggtcgcgggcggcgcaggcgccgggccgggctccccgggggcaccgtcctcgctggacgcggcgcaggcgagcg

SEQ ID NO: 25657 - DNA, 61 bp, Chlorella protothecoides
cgagggcgaggccctgggcttccccccgcctagcccgaggtcgggcgccggcgccggcaac

SEQ ID NO: 25658 - DNA, 1150 bp, Chlorella protothecoides
  modified_base (506)..(515): a, c, t, g, unknown or other
tccttcttccaagcctggtccttcatgcatgtagctatgacagcctcctgcaaataggagagctcgcgatgcaaaattgggctgcatcacttggaaacgtgtaggcgagcaggtagctgagtgcatgacaagtggtattatacgccggagaccattgcatctccaattagcacaccttgaaagcgtcgctcatgccattccaggcagcaggattcatcacagtctgggtgagctttgcctgaatactatggtcaaagcaaggaacgaggacctttaatctatttgatggtgatggaaaggcaagggaaggccgcataccgacaagggcacggtgggctgcatttggcacatcttctggggacaatagatcttccatgccagcgtttgcagggttgctaattctccttttaagatcccagtaacttacgcattgtccagtgcaatgtcctcttccagttggccaggcggcactcgtaggccgagtgaagccatgatcctgaaaaagnnnnnnnnnnctacgcattgtccagttcaatgttctcttccagttggtcagtcggcactcgcaggccgagtgaagccatgatcctgaaaaagctccttggggaacagtcctcctcatttccatttggatcaggtggtccgtaggagctctgcataaaggtacagagagtacatactttgcgcctgcacaagagccaccaagcgatagcccattgtcgcagtgaggtttactcacaggaacccccccaaaaaaccaacacacacacaaacgcaaagctgtccgggacgcttacgccatggtctacgcgggatgtggctatgacaggagctttacccacgacagcagtgctatgagtgtggattcgttcctgtgcttccttcgcaccctcttcgtgactgcaggtacacagagcgtaggagcatgaggcgcggtcacggtcggacacgcgccgaatactactgtgcacggtcgtggataagtatacacggtttaaatgagagatacacgcttcgagcaagtataactacccacagagggccgcggtttctaggggccaacctcgggctgaaatcatcctcgaactcgggcgacattctccttcaacagatgctccgtccagcgattagatcgatgtattgtcggtcc

SEQ ID NO: 25659 - DNA, 75 bp, Chlorella protothecoides
cccagcgtgcgcagcgcgagcgtggcgtgctccagccaggtcagcagcgcggaccggcgccgccgcgcgcgcggg

SEQ ID NO: 25660 - DNA, 61 bp, Chlorella protothecoides
cttatcagaaaaggtacaaagcgaggacataccgggaggatgggcatcgggcatattactg

SEQ ID NO: 25661 - DNA, 1778 bp, Chlorella protothecoides
  modified_base (822)..(831): a, c, t, g, unknown or other
  modified_base (1319)..(1328): a, c, t, g, unknown or other
ccccccccaaaacccccctccctatccagcaccgaagacgcaccttgaccaggaggcggccgaccaggtctcgcacctcctccgaggcctccacgtcctcgggccaggccaccgccttgcgcacgatgttgtcgaaggtgatgtcgcggcgcggcccccggaacggcgtcgtccccgtcagcatctcgtagatcagcacgcccaggctccaccagtcaacgcccgcgccgtgccccacgcccgcgatgatctcgggggccagatactcctccgtgcccacaaaggagttggcgcggccctgcggctgcgccatgagcaggggcgggggctggccctccgcgaccccggacacgggggtggtgcccgtgaaggccgtctgcagtacaatgggtggggtgggggcggaaggctgaggtgtgtgtgtgggggggggtggaacaggcaatcgatcgaggagtcgagggtcatgcaggggtgcaacagaaggtccatgatattttcaagggtggttaagggaaaatgcgactgccacggagccctggcagtacatcccctgccctgtcgcccccctgcacaagtgagtgtcgcacagcgcgggctccacgtgctcggccccgcccctctgaggcccccaccaccttcaccttgaagcattggaggttgggcgcgcagtggggctggtcgcccgggggggagtcgggcgccggcggcggcgcgacgcctttgcccttccccccacgatcccctccctccatccccgcgaccccggctgggtccagggggtgcaccaagtccacctgggtgcccatggcgcagtgggannnnnnnnnngcggcggcgcgacacctttgcccttccccccacgctcccctccctccgtccccgcgaccccggctgggcccagggggtgcaccaggtccacctgggtgcccatggcgcagtgggacaggtcgaagtcggtcaggcgcaggtgccccgactccagcagcaggatgttctcgggcttgaggtcgcggtacacaaacccctggacgtggaggtactgcagggccagcagcacctcggccgcatacatgcgcgccacgcattcgcccagccgcttgttgggcagcgtggagagcgcggcgtacagctccccgccgccgcagtactccaacaggaagtggacgtgggtgtctgcgggggtggtggagggcgggggtgtttgatggtgccactcctgggagaggaccctgggtgcacaggccgctgccaggccaggcagcctgtcgtcccggtgaggaggaaagggcttcaaaacaactgggaatcccgcagannnnnnnnnngggaccctgggagcacaggccgctgccaggccaggcagccggtcgtctcggtgaggaggatggggcttcaaaacaactgggaatcccgcagagccacgtcaagcccttgcattcccacagataaaaacaatacagtgtcgccccgctccctgaccccaagcatcccgcatacccgtctgcagggtggcgtacaggttgaccaggaaggggtggtccacgctggtcagcaccgccagctccgtgttgacccggcccagctggaagagggaggaggtgcggtgtgggtgatttgaccctgggcggcacgtgaataacagggtagtgggctgcgcaggcgtcgtgcgtgtgccgccccggccccaagcggcggcggcggccacgcccggtgtagaggagcggagatgcagggaccggcgctttcccccgccgctccccccgccttttcccccc

SEQ ID NO: 25662 - DNA, 109 bp, Chlorella protothecoides
catcattggtgagtcgaggggtctgtgcagtgcagggagggcttggcgccgggtccttgctgccgggccaggccgggtgcggcgtggaggttggtatcggctccaggtt

SEQ ID NO: 25663 - DNA, 95 bp, Chlorella protothecoides
tggcatcatggaaggaatgctttggaggccattcaagtagggcacgggaggtgagagccacccagcctccccccttccaccaccctcccaccaac

SEQ ID NO: 25664 - DNA, 79 bp, Chlorella protothecoides
gattggtgttacaggatgtcagggagttaacaggaagtgtgctcctccagggtgctcacaccgcacactcatccgggcg

SEQ ID NO: 25665 - DNA, 24222 bp, Chlorella protothecoides
  modified_base (396)..(405): a, c, t, g, unknown or other
  modified_base (1364)..(1407): a, c, t, g, unknown or other
  modified_base (1554)..(1563): a, c, t, g, unknown or other
  modified_base (2096)..(2105): a, c, t, g, unknown or other
  modified_base (2304)..(2313): a, c, t, g, unknown or other
  modified_base (2392)..(2401): a, c, t, g, unknown or other
  modified_base (3070)..(3079): a, c, t, g, unknown or other
  modified_base (3514)..(3523): a, c, t, g, unknown or other
  modified_base (3952)..(3961): a, c, t, g, unknown or other
  modified_base (4392)..(4401): a, c, t, g, unknown or other
  modified_base (4555)..(4564): a, c, t, g, unknown or other
  modified_base (4629)..(4638): a, c, t, g, unknown or other
  modified_base (5042)..(5051): a, c, t, g, unknown or other
  modified_base (5316)..(5325): a, c, t, g, unknown or other
  modified_base (5666)..(5682): a, c, t, g, unknown or other
  modified_base (5872)..(5881): a, c, t, g, unknown or other
  modified_base (5935)..(5944): a, c, t, g, unknown or other
  modified_base (5998)..(6110): a, c, t, g, unknown or other
  modified_base (6844)..(6853): a, c, t, g, unknown or other
  modified_base (7187)..(7196): a, c, t, g, unknown or other
  modified_base (8126)..(8135): a, c, t, g, unknown or other
  modified_base (8677)..(8691): a, c, t, g, unknown or other
  modified_base (8751)..(8760): a, c, t, g, unknown or other
  modified_base (10575)..(10621): a, c, t, g, unknown or other
  modified_base (10740)..(10749): a, c, t, g, unknown or other
  modified_base (11653)..(11662): a, c, t, g, unknown or other
  modified_base (13066)..(13075): a, c, t, g, unknown or other
  modified_base (13130)..(13273): a, c, t, g, unknown or other
  modified_base (13446)..(13455): a, c, t, g, unknown or other
  modified_base (13786)..(13795): a, c, t, g, unknown or other
  modified_base (14188)..(14197): a, c, t, g, unknown or other
  modified_base (14520)..(14529): a, c, t, g, unknown or other
  modified_base (15423)..(15432): a, c, t, g, unknown or other
  modified_base (15489)..(15498): a, c, t, g, unknown or other
  modified_base (15557)..(15566): a, c, t, g, unknown or other
  modified_base (16603)..(16612): a, c, t, g, unknown or other
  modified_base (16672)..(16681): a, c, t, g, unknown or other
  modified_base (16986)..(16995): a, c, t, g, unknown or other
  modified_base (17360)..(17369): a, c, t, g, unknown or other
  modified_base (18381)..(18390): a, c, t, g, unknown or other
  modified_base (18638)..(18647): a, c, t, g, unknown or other
  modified_base (18744)..(18753): a, c, t, g, unknown or other
  modified_base (19338)..(19347): a, c, t, g, unknown or other
  modified_base (19973)..(19982): a, c, t, g, unknown or other
ccttcctccctcgcctcatccccatctggtgcgccgcgctgtgggaaagcgtgcccagcgtgcgcgagggcgcggcggtggcgctgggcgacgccgccgcggggccgcccgcggtacgcgacgtggtgctgccggccgcgctggcgcggctggaggagagcctgctcatggccgcgcagcagccccgggatgacgccgggacgggcaacgacactagggcggggaacggcgtgggactgaggaagggcgcgggaccgaggaacggagcggaccagggcgacggcacctccagccgtgatggcacggcgcagccccagttcgcgtggggggtgcttgccccggccctggctcgcggggccgactgctgcgtggaccatggctacaccaagtgagccnnnnnnnnnntctcgccccggccctggctcgcggagccgactgttgcgtggaccatggctacaccaagtgagccggcaggcgggtggtggtggggagggcgcgctggcgatgggagtagtggtgggggtgctgggtagatccagcacaccacaaggttacttgcaggggctgggctggacgttacctctgcactccgaccctgcgtcgtattcccccaaaccccttttcccctccctcacccaacccccccgctcccctggacccacagggagatggagccatgggaggccagcgacggggcaatccacctggcgcgggagctggcgcgtaccacccccgaggacatcgccgcgcggctgccggccctggccgagctggctcgcatgcggcactttggcgccagcgcgtccctgcagcagacgctctggcgctcgctgccggccatcggccgcgacgtgggcaaaccggccttcaagcgcgagctgccgcgcttcctggacccgctctttgcggcgctcacctgcgaccagcctcttgtggcggcggcagcgggggggtgcgtctccgccctgcgtgactggctgggacccggcatctgggccgggcggctgacgccagagcagcaggcgctgcagcgggacagcccggacgtactgccccccgccggcaggtttgtggcgaggcccgcgcggccggcgggggctgcttctgtctctgggaccttgagcaccgggctgtcttctctgtccttggcctaggcctgtacacgtggcgccttgagattcaagaacgggatggggcagggcagtcttgaccgccaggcaggagggcatcacgggtgttgcagcatgggcgcaaggatggcgcctcaagcatttcaatgcccttcacgacttctggttccagttgacaaagtcgcgagtgttgccagcctcaagaatctcgatccagtacccatctgggtcggnnnnnnnnnnnnnnnnnnnnnnnnnnnnnnnnnnnnnnnnnnnnatgaaggcaatgttcctgcacagccagaggagtgtgacgggtcggtagatagaacagcagctgctcgaggcggcaggtattatcatactccatagtcatgctcagtgttcaaaatcttggcaccacatgcaagggcatgacttcctnnnnnnnnnncacagcagctgcacgaggcggcaggtataatcatactccttagtcatgctcagtgttcaaaatattggcaccacatgcaagggcatgacttcctggtttgagaaatgagcaaatggacaagccccaaggccctattcgcccaagaacccacttcatgctcccggcatcaggcttcttcttgaatggcactcccagcttctcaaagcgggcgcatgcctcggccacgctgggcaccgagaagccgatgtggccgtagcccttgggctcctcatttccgttgtggtagcccttgaagtcagggtcactctcggtgccctgcgcagagaccagggacggactcggatgtcaatgtccgcctcaataggaaactgctaatgcagaaacccacgaggtgatgaggcctagcgtggaggatctttcagctataacaaggaaatgtcctggtgtgcctatataccccaaggattcctgagcccaaacaacccggtacctcacccagttatgcgtcagttccaggcatgcagggcgcttgnnnnnnnnnnagactcggatgtcaatgtccgcctcaaaaggaaactgctgatgcagaatcccacgaggtgatgtggcctagcgtggtggatctttcagctagaacaaggaaaagtcctggtgtgcctatatactccaaggattcctgagcccaaacaccccgatacctcacccagttgtgcgtcagttccaggcatgcagggcgcttgnnnnnnnnnncccagatctagaggagtggacgccgcaggatcaagcgacggtgtcacggagtcttcggcactgaaaagctctggctgcnnnnnnnnnnaacatccactcgcccctctccacagggtcctcggggacctcctctggatctgccacacctgcgccaggaagcatgcacatgtccagatctagaggagtggatggcgcaggatcaagcgacagtgtcacagagtcttcggcactgaaaagctctggctgcaaggttcccattgctacattcccttaccgactccataattcatgtcctgcacagccctagcctacccaagaagtacagggagaacttcatgtcgttgaagtccagcttcgtcagcagtgtcagccccatgacacgggtgtagaagtccagggataccttgggatccttgatacggtacatggtctgcagaggggcaatcaagaacctacttctaggaattgtcccttgcaaagcttatgttgctgctggaaatgaaagcacgacccttctgaagccattcagtttcagcattccactcatcactcccaacctcatacctgctgaaaaacatagcccttggtctctggaggaggggcagaagtgaccccctgcaaaggcaaattgcccatgtgcatgtgcatgtgagtatgcaaacggtatgcagggctgcctggtgcctcacagccatctttctcttcacatctctcaccggggtgctaaagagctcttgacggctcattgcgcgcactnnnnnnnnnngggtatgcagggctgcctggtgactcacagccatctttctcgtcacatctctcaccggggtgctgaagagctcttgacggctcattgcgcgcactctggaacctgcaacgaaaatcgatctgaataaagtggattgggacaaaagatccccgcggttgacgactcgatttagacatacggcaccttcgcaccttgcgtaaagctccgggacacaaccttaggggtgccgagcaccgacggcttgatcaaagaaatgcttgctctgaccgaatgtagcatggaattgtggtaacgtgtgtgtatgtcattggtctgggtgacaatgatgggcatacactccttagcgagattcacgatcacttccggcgcgcttccggagggtccaatctgggccaccagagaggggaaggtttgttccagatttcaataaccctnnnnnnnnnngggtctaatctgggcccaccagagagtggaaggtttgttccagatttcaataaccctagtgaagggccgcgcccgttttattcatgtccttgcaatcccaagcgcccatccaggtccttcttgatctgcagaaaacgggtactgacgtgctgtcagcagcaagtcatcaaccagttataggacaggcaaagttctgctcctgtaatacaaaggagtgggtcatggtcacagaccatcgaccaatatgtgaaaggtactccatccctcctaccttgctggcgagcgcagctattggactcaggtgatctgccgttagctccacattcagctgcacagaacacggagaaggtgaccgctcagcctccttccgtgcaagggaagatgctatccttggagcctgtgtggcaggctcctcgaccctatgctgcnnnnnnnnnnatccttccgtgcgagggaagatgctatccttggagcctgtgtgtggcaggctcctcgaccctatgctgccacctatgtgcacacattgagaacccagaagcccattctccctcccaccgagacacgccttgctctgcggtgtcgctgcggagatgctccactcagcatctgcatcaaggtcgaccaaggtttctgcaatggtactgggctggcccagcgcctcggagatctccccctcagctcgggtcagcgtggcctgcaggtggtcaagcgctacctttgcagccgggatggagccgccgcgcagagcagcactgactgctgccgcgtcgtgccgcagggctgataacatgcccgagggcgattcactgggtggggcgcggcgcgccgggtctggagggggttgctggactcggtccacggccggggannnnnnnnnnttttgcagccgggatggagccgccgcgcagggcagcactgactgctgccgcgtcgcgccgcagggctgaaaacatgcccgagggcgattcactgggtgtggcgcggcgcggcgggtctggagcgggttgctggactcggtccacggccggggannnnnnnnnnttgagagcctagaagcccattctccctcccaccaagacacgccttgctctgcggtgtcgctgcgnnnnnnnnnncaagggagatgcatcttctcccctcatctgacaggcacgtcgctcctcttgccactcctcctcctcggcagccgttgcctgcccggcgtccttcagcctcctgacctcagctgtcagccgctccacggcctcggcctgggtctgagcagcctgcgccacgcgcgcgtcggcctcccggcgagctgcctgggcctcgctgtgcatcctttcctccagctgcgcgcactttccttccagttccgtgatgcgcagggtggcccgcccgccgtcctcctcggcccgggctcgggccgccgccagcgccgccgccagctcgccgacgcgcattccggaggcatccgcccgcacctgggcggcctgggcggaggcagttgcggtctgcgcccccgccacggcttcacgcnnnnnnnnnnacgcattccggatgcatccgcccgcacctgggcggcctgggaggaggcagccgcggtctgcgcccccgccacggcttcacgcatccttgcttgcagcgccgccagcgcctcatcctggggggccggagggtgtggacgcatgagagggtgtcggattggtgaggcagcatccgggctgtgtccggcaaggaaacccgcctccccccctccaagcaccccacttcaccccccgctccccctcaaaccttggtctggaggagggtcnnnnnnnnnnggagggtgtcggattggtgaggcagcatcggggctgtgtctggcaaggaactccccccttcacccctccgagcaccccttttcaccccccggcccccctcaaaccttggtctggaggagggtcagagccgctcggcagcgcgcctcgcactccgcccgggctttggaggccgccagctccaccatggtggccactgggggcgccgagatctgcagccagcggatctccgcgccctcatacagctccagcttgctctgcagcagcgtcacctgggccctcaagcgcttggcctcgtcctccaggcgggcgtctggtctggaagtcggcgcgctggtgagggnnnnnnnnnnnnnnnnntgtggatcttgggagagtcgggactgtgctcctccctccaaatccaaccctgcacaattatgagcaggtgtaaatgttgtgtgagttgtgaaaatacgatgtacgataagtcttatttcccctcccccttcccagaagagtatcagtgtaccggaagctaggccagcggtctcccagggaaatcgggagnnnnnnnnnngcccggcctgggtcgcatgccgcgaggcagatggtggcagctgaaatgccctgnnnnnnnnnnccccggcctgggtcgcaggctgtgaggcagatggtggcagctgaaatgccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtgaaaatacgatgtaccataagtcttctttcccctcccccttcccagaaaagtaatagtgtaccggaagccaggccagcggtctcccagggaaatcgggaggagggggtggcagatgaggcatggggtgtgtccagcttattccgggcaagtggaaacatcggtgatgtgtgggactgtcaggataccttcaacatcctaaactggaaatgtggtcgatctaatctaatacagggttgaccttgaactccaggacgctctgctttcggaagtctgctgacgacaatgccaggcaactgcttccatacccgtgtcacaaaatccagttgctgcttcccatcaacatcattatttggagagtcctttcacacatcgacaccactgacaacatggcaaagaagcttggtttgaatcccagagtgtcgcgcgcgcaggcatggcgcagatcgcattgtcgtttcaaaaaggagcgatcccagacactcaaactgcgccagccctgcgcatgatgtatcgactggcaccctgcacgcttgagagggtccctgcatgctcgctgagaccaattactccgaccttcattgtctgcctcgttgctctcgcccctctaatccggccgtgcacctctgctgcacatacacaactcgcaacccgacacgcggggtctctccccccagactcgtttccagttcagaatgcccaagccagaaagggattagcttcagccttcnnnnnnnnnnccccgacacgcggggtctctccctccagcctcgtttccagttcagaatgctcaagccagaaagggattagcttcagccttccctgaagagggtggaggagggtggaggatcgacgaacccctccctgcctgcccctgtccgaatccttgggatggcgggccagcaacgcaccctcctcaacttgtgagcggcctcggagcatcccaatggctggatggctgtcacatacttttcatgaatcacacgctgccgtgcacagaccctgagtctggtgagccacgccatgcaaggcccccttatcatgcagcatgggcatcctagcacctccccaccnnnnnnnnnngcttttcatgaatcacacgctgcacgtgcacagcccctgagcctggtgagccacgccatgcaaggcccctcgtcacgcagcatgggcatcctagcacctccccacccctccccctcccaggagcaaggtggtccgcctagacgcctccaccgtctgcttcacccccaccgatatccaggccctgcgcacggtgctactggaccccttccagtccaagcacgacctgctgtgcgcgctgcgcaagctggactgctatcgcctggagctggccgacctgacggcctcgggcatcggcgcggcggtggcgacgctgacggggcaccccaagcccgacgtcgcgcgcttcgcggccgcgctgctctgcaagctgcgggcggtggcggagcgcggcctcttcccccgcctgccctacgaccgcgcggaggccgcggcggcgcctgacggccagccccaaacccccgaggaggccatcgccatcgcggcacaggtcgcgcgcgcggcacgcagggcgcggcgcctggcggccgaggccgacttcctcgatgtcgcctcttccagctccagcgatgaggacgaggggcccggggcgaggggcggcacgtcgaacgacggcgagtggcggcccggcggcaggggctgcgccgtggcagccacgccgccaacggcgcccggcgccggtccggaccccggcggcgtggcccgccacgtcaacgcggcacgctacgcgccggacagcgccttcagaaagacccgcgccgggtccagggtggccccgggcaccgagcagggcgctgacgggcggttgtaccgccaggcgacgctggcgtccgccttctgccggcccgcccagcctgctgctggccatggattggcgccgagcgccaaggcagagctgccgaggacgatggtcgtggaggaggagctggtcgnnnnnnnnnnctgccttggcggcgagcgccaaggcggagctgccggggacgatggtcgtggaggaggagctggtcgtggtgggcgtgcggccggcgggcagccccgagcccatggtgctggagctctaagaggctgcgggggccggtgctgggccgggactgcaacgagcctggtcccccccttcagtgatcatcctggcacccatgctgcgactggcgtcaaacttgtacataccgagagcatcgcaccggaagcagggtgacctgagcaaaggagaatgagcgagagggaagggggtccgtgggaggaagtgtacagtccacacaggaacaaggggcctgcaggacagaatgggagccagtcaacgctcaggaccatgcaggccccagcaggcccttcaggctggcgcgtaggccgtgccgttagaccctggggcgtggcccccgccggccaacgagcccgtacgagcgcgcgcgacggcctcgtccagccggtaccccagcaggtccttccgcgtgacgatgccctgggagagtggaaaggcagggggnnnnnnnnnnnnnnnaaggcttggaccccccatccacccaaggcgcccaccttgacgcagttgtgctcatccacnnnnnnnnnnctgaagctcctcacagggaaagtgaccttactgtcgcctggcctgcctcaccaggcccggcaccccgcctgacagcattgcgaggggcggcccccgtcgttcggcttggaccccctatccacccaacgtgcccaccttgacgcagttgtgctcatccaccaccacgaggtggcgcaagcccatgttgcagaacaggatgtaggagcgctccagggagaaggtctctgtgacctggaggagggcagaggggggaggtatgagggggccaggtagtactcttgggatcttgcgttagactcttatcagctcactagaccctatgtcaggccccacacgcccgacctgcaggtaacaacctgcacccaccttgaaggccgacatgttgatgtagggggtcaggtccagggtctcgtcccacaggctggggtcgtcccggaagttgtccccgggcaggggccggccgtccagcagggccatctgctgctcgctctcccgctccgactccacgctttccatgaactggtggttcaggtctgcgatgatgaaattgggagggagcttgaatcatacaaggaacggaaaggattgacaagagggacgggaagtggggatggggtgcgaagagtcccagggcaccgctccacatcaggatgggaccttccagtcccatgggatgctggcactttgggtgacagccatgaccacaacacccatacgaccagcactcggccttcccacccacccttttcctccacctcaccctccttcagcacatgcactgacccagcccctcaccagagaaggagacctccaggtgctggcaggtgccccgcctgaccgcctccagcaggagcttgagcaagtggtccctcaccagcaggcccacaaagaccgggccgcggttcgtgtcccgcaccacggggaagccctggtactttgtccggcgcagcacctcccgcacgtcccccagccgcatgtgctcctgtgatgcaggggtttcaggaagggggggagtcattggggtgttgactttgccgcatcagagtgacacgcgcccagccagcctcaaactcctcacaccttgggtgatcctgggtcatgctgcaacaccccagtccccggcttacggcccagcctctctccaccagctcaaccaagccacctcaacccctcacgagcccccttcccgccgcctcaccctgagggaggtgacgggccagtgcatgacgtagcggacctcgatgagatccagggacgcggatgagacgggggccttgggcaggaaggggatgcacttcacctccagcaagccgtggtagagcgggtgggagccgaggtcagccacccacttggccaccatgatggcgaccatgaggggcaacaggatgcgcacatcgttggacacctccatcaggatgacggcaagggcgatcgtcatgcgcgtgacgccgcccatgaaggcccccgccccaatcagcgcaaaggcgccggggtcgatgaaggacatggggtggggcgggaggaagaccccgggtggcgccctggggagggggtgagggggggtacagcagatgtggagggggttgaggcagggtttgggggtgcagaccagtagaggccgaggcggggaagggcctgcctgcatctgccacggtcagcggcctcacccccgatgcccacagcatcagcctcccccgccccagcaggccggcaggcgccaggaccgccccagtcacgcacccctcggaccccgccccgttgcgcgccgccatgtccaccatgatgagcccgatgagccggcccacgcacgctccnnnnnnnnnnnnnnnnnnnnnnnnnnnnnnnnnnnnnnnnnnnnnnncccatgcagcttcccggctcctcgcgctgccccccgttggtcaaccctcgccggcgccccacgccgagccccaccagcagccagaggaagccacagcccgaccacccccgcccacccgnnnnnnnnnngccatgcagcttcccggctactcacgccgccacccattggtcgaccctcgccggcgccccacgccaagccccaccagcagccagagagagccacagcccgaccacccccgcccacccgaggcgatcgcagaccctgctgtccaggccgcccccaggaagtaccacaccagcatgaccaccagggccgcatacccaaactcgcggtgtgtgccgcgcgagaagaggtgccggatcgcgtcctcgcctgttggagtggagggaagaggcggatggggggagtaccgtcaggcactgttgcttgtgtaggtggagcacagagtcggcacgaaccgctccgatctgggcagcatgcttccccacatctcagacttgtagcctcgcatggccgtcggtctgtgtgaagatttgattcttgccggacatgaacccgagcatcctccctggcacaggcagtccctccacccaggccccgtccaccgctcccactctctcccctcacccgtgacgctcatgagcgtcgccagctcgttgtaggaggaggggatggtgatgttgcccttcccgccggggccgtcggcgtcgcccgggccgcccccaccatgcacctggctggtatgcgaggtgcgggagcaggtgaacagctccagcgtctcctccaccactcggctgcaaacacaggggggcgggagaggcgggacagcggcatcagcgaggggactgcgcatggtgcggcacgtgagctgctagtttgttgaggatgggcgctcagatgctttgctaccaggcatgagttacctgaccaccccccccccccctcctttgaatacggctactcactggacatattcgggttggccatcggggcagatgggcgtggtctccccctgcagcaccacgcactgannnnnnnnnngtttgctaccgggcattagttacctgaccccctccctcctttgaatagggctactcactggacgtattcgggttggccatcggggcagattggtgtggtctccccctgcagcaccacgcactgaggggccaaggagcagagagatgggtgcctgccattgatatctggtgacacaccgcaaggatgataacgcaccgtgcacgatcaccacaccaaaaacgcccttggcccagttgccattggcgttgccactggggcactgcagcgtctcccctttccgatcttcaggaataggaccccccttcccccaaagatgggtcgtttcccccagcgccccctccctccaaaacaatcctcctcacctgggtaggtgtgcaggggaagaagaggggcaggatcatgcccatggtcacgaagagcatgatgaggatgcagggctctgccatgcgcaggcggcggtcggggttgatgacgctgcccctgaagcggatgaccttcaggttcatgatggtgaaggccacggccaggaggccgcagagcaggccgcagagggcggcggggaccatggccatgacgtggttgttcagctgggtatagacctcaaagaagacggtggaggactcgcggtcgaacaggccaaaggtgccctcctgcagcgccgactcggcgctgcgcaatgtgtcgactgtcagcactgcaatcatgttggcgaagaagatctgccagctgagcgcctgctgccagaaggaggccacctcctcaaacacgtacagcatgccgccgatgggcgcagagaaggcggcggcaatgccgaccgcggcgcccacggtcacaaagtcgcgcttgtctttggggttctggaagcggcggaagaggcccgagtcgcagcccagggtggtggagtggccctggctcatcccggaggctgtgaagggtggtgttgtgaaggggagaggggatatgaccacttgttcctcaaagctgtccatgcgcatgtacatgtgacagtttcatggggccatgctggtggcaatggggggaattgcatgtgccctcaaatgtgccatgtcatcagccaccttgtaactcaatccacaaagcttctgtcccctcgatcccccaaacatcatccctttccacatgcacaaacatcccagacccccttttgtatttgatacccaccaatgatggcccccatgtggaccatgggcccctctggtccgacaggcaggcctgaggcgacagcggtagcagcagacaggaacttgacacccagcgtcttgatgttcagaatctgccggggaggtatgtggtgcgagagtgaggtgcacgcaggcagggatgcatgtggagttgaagactcttctgcactctcaaccctgcagccgacatgaaagcccctgnnnnnnnnnntatccacaatgcttctctccccttgatcccccaaacatcatccctttccacatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcgagagtgaggtgcacgcaggcagggatacatgtagagttgaagactcttctgcactttcaaccctgcagccgacatgaaagcccctgggctatccccttctcctgcgtgtgcacattcaccatcctccctcgtgcgccccccctccatgatctcaccttggggatgttnnnnnnnnnnatttgcacattcaccatcctccttcgtgcgctccccctccatgatctcaccttggggatgttgcatccatttaggtaggccgagacctctgccaccccagccccggctgcctcgggtgcgatgttgaccaccagccaggtggagcagtacaccaagcccagggagtaggaaaggttgaaaatccagctcaagatgacatgggtgtgcgtcagcagccacctggaggggtacgtgggtgggaagggcgggttggagagagggtgcgctgggagacattgcccagctcggtcgcacatcactctactcccatctgctcccgctccagcagccnnnnnnnnnnttgggagacattccccagcttggtcgcacatcaccctactcccatctgctcccgctccagcagcccacacctggtgctcgcgatcttgatcacagccaggatgtggatgaggaggtgcaggaggaagccggtgatgcccaccgcaatgccgatggccgccatcattatccagcgatcccagtaccgctgccatggctgagaggggtgagtgagggaaaggcgcagtgtttgtcgagagaatcacccagagaccgccctcgtgtgcagagcgaggccctcgaggcaaatccaggcatgggatacacatgtgcacacctcccccttatgccattgaaaacccccacttgcgtgcctgggcggagagccattgccggtacacacggctgctggggnnnnnnnnnntccctcgtgtgcagagcgaggccctctaggcaaatccaggcatgagatacacatgtgcacacctccctcttatgccattgaaaccccccacttgcgtgcctgggcggatagccattgccggtacacacggctgctgggggcgaggtagtcgatgctctgcatctgcttcaggcgcgccttctctgctcatgccacgcgtgagcgggtgggaatggttgtgcggcatgcgctgcacgcatccgccagatgggcatggcggcacagcacaactgcctgcttgctccgccagggcgccctctccccccccccccccccgccgggcnnnnnnnnnnctgccgtgctgtacttgtggttcttcccggcgccctccacagtgttgcctcgcgagaacagctgtctcacggtgttccggaacccgctcatgcgccggccctcgaagtcggtgctgctctcctccacgggtgcagaggtgtcgcgcctctccttgtactggtgcaggggggcccgctcgccgtatgtctccccactggatgtgctgggctgatcattctcatgacgcgggttgtcacctgtggtgcgggaaggactggcgtgacgcggtgttgcgctgaccggtctctcccatgcaatgcatggtccggcagggcgcgaggcagttccccttgggcattcatgcgcggagacgacccacctatcctctcttcatctggggtgagagtgaacagaccaggtctcccaacggccattcccggagaccctccagccttggggtgcgatgcgggcctgggatgccgcgtttcgaccgggggtgtgagcggttgcgggcaagtcgtgcaagggagcccaacgggtccggctaaagctcactaccttactcaaacacgtctaaatagatttccaaaacacccgactcccagggaggcacgcccacgtccaatgaaaggggacgacttaaccccactctcggaccaccgcacgctcatcacgcgcgcacaagagaagttcgaacatgggagggcgagggatgagagtgtgcgccatgcctgtggcctcatcgaccactccgctgtaggaaatggcaattgacaaccatcttgacaaagcgacagggactgtgcgcgatggcagagtgaggtcttgagtaggaaggggtattgcgcccttgctcaagacagcatcgggacttactgagccctctgtgcacctgtcgatcttctcgccgcgtnnnnnnnnnnggacagcatcgggacctaccgagccttctgtgcacctgtcgatcttctcgccgcgtnnnnnnnnnnttggtaacaacctcgttgcacacttttattgtgggaaaggtgtttctctttcagcatgnnnnnnnnnnatccagacgcagcaggtaagtggtggtggagctgtcaccccataaccatcaaaagccatgaactgaacttgaggtaggacctccagctccttccgattcccctgcaggaccctcatcgcagccctcgccgtctcaagaacacaccctccgcctgactcctaccgaagcaaggacacttgcgcagaaggtgagcttcctggcatggtgtcaccttactcctgcatgtggtaacaacttcgttgcacactcttcttgtgggaaaggtgtttctctttcagcatgatggtggtgtatgtatacattcacctcatgctgcattctatcttgtcaaccgcagctcaaagaggcagagctgctgggcaatcgcagctgttcaaggactcacatctcccagcaggtaggtaggcatgcgggggctgggactggtaactttgattttgtgttccctgcggaccgcccgcagcctctagaatgatcatcggtcaatttttcaaggttgcctaccactttgccccctatcactggaccagtgcaggaggaagccaacctcgtccaagcagcgctgcgcttcctcctcttccggcacgcctcccgccccggggtccccattccccgttcggagcttggcgcggccctgagcgcagccagggagggcgcccacctgcaccagtccgtcagccagtgagtcgttgggtggcgcctatcgcagggacgggaggctactctgcatgcactggccgccctcccatctccttgctgtggacacctcccctccaagcaccactccctcccaatcaccataggatcgtgccgctcaaagcgcgctggctcttggcctccaggtttggcatcttggcgcgcgaggtggctcggtccaccaagccggtgactctccaaagccaggtggaggacgatgcaccggcctcgcaggcgggcaccaagcagcgctactatgtgctggagagtctcgtgccggcacgactggccgccgccgcccccctggacgcaggggctgggcctcggcgggccctgctcannnnnnnnnnccctcccctccaagtaccattccctcccgatcaccataggatcgtgccgctcaaagcgcnnnnnnnnnngaccaagcagcgctactatgtgctggagagcctcgtgccggcccgactggccgccgccgcccccctggacacaggggctgggcctcggcgggccctgctcatcgccgtgctttccatcctgcacctggccgggggacgtgtggaccagggtgtgctgccgtgggaaggcagctggagggttttggagccatggcaccttgctgtagggtgcagagccgcgtcgtcgaacttctggttgggacagcccatcgctttactcagaccaacggcccgcccccgcctcagatgagctgtggcaccacctnnnnnnnnnncgtggaccagggtgtggtgccgtgggaaggcagctggagggtttttgagccatggcactttgctgtgagctgcagagccgcctcgtcgaacttctggttgggactgcccatctctttactcagaccaacggcccgtccccgcctcagatgagctgtggcaccacctggcggagctgggggtccacaagggggacaggcaccatccggagcttgggagcgtggacgaatgcctggagctcttcgtcgcgcaatggtgcggcggggtggaggagtatggatgcacgtgccaaggctgggtgcagtctgaagagctcccgcctgggttttcctgacacacccacaacaaacaaatgtgctgtccgggnnnnnnnnnnagggtggaggagcatgcatgcacgtgccaaggctgggtgcagtctgaggagctcccgcctgggttttcctgacccacccacaacaaacaaatgtgctgtccgggagcaggtacatcaatgtcaacaaggacaggagtgggtcgggcgaggggatgacctactcaatcggaggtgggtgaggtgcttgggttggggtagctggagctgcgaaatcacaactccagggtccgtggctgagaattgaggcgcacgaatcaatccagcgatcctttccttcctctgcagagcatgcagccagtgcgttcagtggtgctattcccgaatttctgcaaggactgctccaggaagaggaggagcctgaggatgactgtatcatgatcctagatgattagactgccaaacaggatgcaccgtgccaggcaggaccaacctctcaccacttctgaccattggtttgactcgacaaaatcacaagcagcggaagccttcgccaatgttgaccttcgtgagcaacagaaaaaggcacatgatccccctggcgtggaaggataccggatttgaatgatgactacacacacacaggaacgagggcgacgaaacggggaaacaaggcaaaggtccacacgaaggaaagtctcccaatctataaaagcacaaacgacccaattttatggttacgctttcgcaggcgtggtgtagctcgcaacatgtcgctggcagctgcatgggtgaggtcaccgagctggagtgtgacgggcaaccgcccttctgaagacaagagtccctcctagtccctcctactcaatagttccgacccttttgcgtgcagaggcgattggcctatgttgcagggggcgcgtcggcgggcttcttggcatcatacaggcatgacttcaagcagctggagttcgatgtggcagctctgtcaggtacgccaaaattgctgggtcccatcgacactgacctaccctcgagggggtatcaacatgtctcattctgggtgcagggcctnnnnnnnnnngctgtcaggtacgccagaattgctgggtcccatcgacactgaccaaccctcgagggggtgtcaacatgtctcattctgggtgcagggcctgcattgcgattcctggacggcgagacagcgcacaatgtagccatctgggcggcggcacatggcttgctgcccaaggagacccgtccagacccccccagcctcagaacgaccgtgtgggaccgggacttcccaaacccgcttggtgtgtgtgtgtgtgnnnnnnnnnnggcaaagaacaaggctgctcaatggggactgacgaggcttccaggacctgttatttcagtgcatcacatcgcctttgatacctattccataggcctnnnnnnnnnncggtcaggctgggtgctggcgagttgcgtgtgcagctttggtcgccaagccgttgcaaagcacaaggctgctcaagggggactgaggaggcttccagaacctgttatttcagtgcatcgcatcgcctttgatacctattccataggcctggcagctgggttcgacaagagtgcagaggggcctgaggccctcttaaacctagggtttgggtttgtcgagatcggtgagtatcacccaagcaagcaacgacagggggttgtaaggcggctccccatgtttgaggtgttctgaggtgtatactcactgcactttgagccggcctggagctagaggcttggcacgctgctcgcatccatgtccacgttctccggcccacctcccctgcaggctcggtcactccgctccctcagcccggaaatgcaaagcctcgggtcttcaggatagaggaggaggggtaagttgggggtgttgaggggacgtcatggcagctgctgaccatgcatcgcgccagcttgtgtgaaccaggctggagtgttctgtcgtggcccagcgacccggcaggttctgatgacttgcctgcacccnnnnnnnnnnatgttctgtcttggcccagcaagccggcaggttctgatgacttgcctgcaccccaacaaaatctcccactgctgtactgacagggctgtgatcaatcgatatgggttcaacaatgacggcgtggacgccgtccgccagcggctgaagaccttccgcaaccggtgaggcagtctggcggcgagcatctcgtccatcggacccgaggcacatattcatgtcgagggcaggcggaactctgcgcgatgcagagctctccgtcccctgaaaactccatcctttccaccccccctgctcctcttcacacccctcaggcaagatgaccccagcaccagcacccctgcgggcctgctgggcgtcaacctgggcaagaacaaggccaccgaggacgccgccgccgactactgcatcggggtggccaagctggcacgccttgccgactacctggtcatcaacgtgtcgtcgcccaacacacctggtgcgggtggagggtacctgggctactgggtgcacgctgtgacatcctccgtgccagcgacatgcccgctcgctgccggcgattcgtggccccctctacagcgattccggctggccccatgcacaggcctgcgcgccctccagggcaggcnnnnnnnnnngcacgcccgctcgctgccggcgattcgtgcccccctctccagcgattccgcctggccccgcgcacaggcctgcgcgccctccagggcaggcgggagctgcagtccttggtccggcgggtcaaggccgagcgggatgccctggcctggcacggaaaggtgtgttgacgttctccttgacgctgtgttgggtattggcatgatgccccagtgccagacctgcatctttggacattgttggtagttgtcagccatggcagactatggtgccatgcatgctcccggcaggcgtctgccttgtcaaggcagcctgcaagtgccccgtctctctgcaaaggatcgtgtcccaccctttgccacccctcactcccatcaactcatgcagcccgccccgccgctgctcatcaagatcgcgcccgacctcacggcggaggatctgggggacattgccgccgtggcgctgtccgagggcgttgatggcctggtggtctccaacaccaccctggagcgcccgccaggcgtcgcggcgcaccccgccggcgccgaggccggcggattgagcggggcacccctcttcgagcgcagcacggcggtgctggggcagttgtaccgcctcacccatggccgcctgcccctgatcggcgtgggcggcgtgtctacgggggagcaggcctaccgcaagatccgcgcgggggcctccctggtgcagctgtacacgtcgctagcgttgagcgggccggcgctggtgcggcgcgtgaagctggagctggccgcctgcctcgcccgcgacggcttcaagtccgttgctgatgcggtgggcgccgaccatcgcagggacgcgcagggtagaagggcttgagtaatgtaatgggagtggttctgaggactccaggcctgcactgtctgtttgaaaatccaaccctgtcccaaactgtgtgagagtctgtcacaggaatcggcattcacactcgatttgttcctggccagttcctgcgaggctactgctcgtcgccggcggaaaagtcaatccagttctgaggcagggcctcctgcttcatggaggggtcccaccacttggactgctgcacctgcgactgcggggtgtccagtgatagggggctgcgtgaacacactggcgctcgtcatcgagcgtttgtatgccagtgggagacatgcgacggtccttgtgcactgctcggattgcagataatgcaagagggagcattctgatcatccaacgattcaaccacgaacgtcgccgcctccccaccctcaaggctacacccagacaacaccataccttggtctgcttgaggaagcgctcccaggtcttgcgcgcatgctcatccatctccatctcctccagcacacctggaagggagggcgctgaatgttacacagtgcttaagaaagcatgcgctgccccacacagggtcggtctcgtccacactggcctcctcgtgcctgggatggggctgctgctctgcctgatgtcagccctgagactgtccaggtctgcaatcgacgtcaggaaaggattgctttcctccacagcatcgccctgagcgaaattcccacccgcccctggtgtaaaagggttcagagggacgtctgagaccgtggccagtctgtctgtcggtggggacgccggctgcatctcccctgccggacccggcgcagctccgtttgcctcaacgcatgcgccttgcgcagcgtcggtgtcggtgtcggcgccggccgccagcaccctgcctttcctgctgacggcctggaagactgcatgagggggatcgtgggtcctggcaagattcactcaagtgtccttgtgctatgagaaagccatgcgagtccctcatccctgccaacccaccagtggcatccgtggaggcagcggcttggacaggtgacaaaaccctgctcaggcggttgctgagcgctcggaggtctggccgggacgcagccgcactggcggctgctgcagcggccctggcggcggcagagcggcgccgagcagcacgcgcccgcgccagcgccagggaggccgcacacaggagggcggccccgaggcagatggcgggtgtggggacgacgggcgcagggaggcggggcagggcctgggagaccgccgtccatgacccccggaccctcccagccacggcagccgcgcctgtccaaggtatgggggccttggtcccagtcgccgactccttcgcgcgctcaggggcagcggcaacgtagttgcgctgcaaggcgccgcgatgacgccgccggtgccggggccgccggtcagaggggccgtgcatgcggcccccgcgccggggtccgcccagcgtcgcccccttgctctcctcggcatcggactgctgaccaggggaccccaggagggcgtcacgccactcagcctgcacatgcttgatcttgcgcgccaggtcggcggccagcctgttcaggctggcttggagggccttgaaggtctcccgcggcaccgccagccactgcctgagcctggcaggctggaccagccggcccagggcggacagggagtgggccagcaggtccgacacctcctgcagcacgcgagcagctgcacatgcagcctgctgcgcggccctgtgagtgctcgagaagagctggagcgcctgagggtgctgggccaggccccagacctgctgcatggccttttgtgctctgtgggcgatgaggctccaggcctcaaggacagctttgggcacggtgattccagaggccaactcagacactgtcgagctcaaagcccgcaggggcagggcatgtggacctgtgtgtgcagtggtgacattggattggcaggcctgcatggtaaacggcgtccttggacctgtggcagtcccacaaagtctcccctctccaatcagccactcctgcccaccaccactcaagcagcgcaccagtgggatgcatcgaggcgtgtcgcgcagcaacacgcaccattccgcgcagccgtttctgcacggcgagggaatgatcgatactgaagtatcggtgagtccgcagctcgccttgggtgctacacatagtgacctaccacagatatcgcaatccaccaacctcaccctctgcatctcgacacgatgggtcagagacctcccattcgaggtcatcagcatgcttatatcatgtgttgaacgatgggcatggatcagctgacccagagggagggttgccatcggcacagctgccggtggacagagccccacgcgattatgaatgagttgatttgattatgttgtattctggtcgaaacatctctggctgatactttcctggacaccactgtctatgaagtatctgctgactgccagctgctccggcgtattttgagctcggcgcgcgaggatccatgccagccaggccccgtgttgcagatggatcctcggcatgattcgttgccacattcacgaacaagagcttgaaggcatgtgtatatgaccctcgtctactggtatagacatcccagctgcatccacttccaggcctcccagatcacttacgatggtcacccacgagatgcgagtgggtgaccgcatcgtcctccaagggacccatcggggcactattaggtacataggcagtgtacccaatcaggctggggaatggacgggcgtggagtgggacgatgcctcccgaggaaagcatgacggctgtgtggccggtcagagactgttcacatgtcagcggcctgggactccagcgaccttcgtgcgctcccggaagctggtagagtctctcctccccgtgatgagcctcctggagggcctgagggagaggtactgcagggatgaggcccccagcctggacctgccgtcccccggccagcaccccaaagggcggggtgtggtggtcatgggcagggctgacctcctggcggcagcctcggacttgaccatgctagcccacgccagcgttcttggcatgcacgtcgccgccagggtgagctcagggcaggtcgattgctacctcagaggtgattctcgtacaacatccctccaaccacacagagtttgttcccaatacatttcgcaggacccccctgatgacctgtcccaggctctgcccagcctacaggacctggatgccggcgataccctgctcggaagctggcacgcggctgccacggcgctctcgagcctgcccgcgctgcgcacgctgagcctggcggggacacggctggaggcggtccccgccctgccgcccccgccgcccc

SEQ ID NO: 25666 - DNA, 76 bp, Chlorella protothecoides
cgctcgggaacacccactcctgatcctgaaagataaaagctgcacgtcgtacatgtgtcgaacctcatcctctggc

SEQ ID NO: 25667 - DNA, 8767 bp, Chlorella protothecoides
  modified_base (162)..(254): a, c, t, g, unknown or other
  modified_base (797)..(830): a, c, t, g, unknown or other
  modified_base (7380)..(7463): a, c, t, g, unknown or other
gcgtgggtgggtgccttgggtgggggggtgccttgggtgggggggctggacaagggcctccccctcgcacgcctgcacacactcctcacgccgcttccactccccaccactcccaggagctgctgctggcgcggctggagcacgcggcggggacccccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgcggcgcttgcacgggccccgcagcgcagcgcatgtcgcgctacgcctcggcggggccggcgcaggcgaggggggccggcgccccctccccgccggccagggaggaggacgaggcgtcgtgggcgtcgtccggcgcgcgcggcggcagaagcggcgcggagccgccgccgctgtcggtcgcgcgcgccatcctgcgcagcaagcgcggctggcgcgtggtggtgacggggcactcgctgggtgcggcggtggcctgcatgctctcctttcagctgcgcgaccagttccccgacctggagtgctgggccttcaacccgccgggcgggctgctgagctggaacctgtcgcggctcgcgcgccgcttctgcacctccgtcgtggtgggcaaggacgtgatcagccgcctgtccttcagcaacatgaagcgcgtggtggacgagatggtgctgtccctggcgcgctgccggcgccccaagctcaaggtcgtcggcgacctgctgctgaagcggcggggggggggggggggggggccccccccnnnnnnnnnnnnnnnnnnnnnnnnnnnnnnnnnnctcagacttcctgccccgtacacgagctgtcggacgaggtgctgcgccggctggagaagtaccacgccacctcccacctccacgccgccagccagccggagctgtacccccccggccgcctcatcttcctgcgccccttcaagggccagggcgtggctcacacctgggacgcggtgtgggtggacgccgccacgctcatgggcgagggcatcctgctggcgccctccatgctggcgcaccaccgcatgttcaccctcgccgacgcctttgccgaggtgctgcgggaggggcacgaggctgcgctggaggagctgagcaccgaccccgacaccccttgctgagcggagacggggtgaggcgcgcccactcatgatccgtggcgggtcggcctcgcgcgatgcgggcatcgggagcggggcccgtcagacatgggaacaccgtcgccccaacctggcgccggcggcgggcgccctcgaagcgaccacagccctggacccccatcaccctgctgcccctttgtttccacggcgcatccgcacccgccggtctcccgccccacccaccatgtgctcggccgtgatgacattcccccttcctccctcctcccagccgtgatgcgtttgctgaattgtaccctgtatgtgcacgcagtgctccaccgcattgtctgcccctgaaaccctggcaccgtgcgccgcactgaatcaatgtaacagcctgtgggcagcagtcaggggcgagcagggcacccctccccggcccgcgtcaggcgcggagcagccggcgcacgccatccaccacccgctgcacgccggggaggtacaggggctcgcagaccagggggaagggcgtgtcgtagcccgcgatgcgcagcggcggggcctccagggagtagaagcagcggtcggagatggcggcgacgatctccgcgccgaacccggacgtcagcggggcctcgtgactcaccaccagcctgtgtatacgggcgcacgcggggtcctcgtgttggaggaagggggacgtcaggtgactggcccgccggggagtgtcgtggtagccactggcaggtcgtgtttgggggggctgtccccaccgtgatgtgcccactgggcccctcccaagcactgaccacgagccttgccatgcccatcccagcacagactgcaggcgcggacggggccctgcgcggccctcgaccaccccagtgtgcccgtggcctttcaatcacgacttgtgagtgccatggtcccagcacccacctcccggtcttttcgacggaggcagccaccgcttctgcgtcccagggcagcagcgtgcgcaggtcgatcacctcggcctcgatgccgtcggaggccgccagctccttggcctggcacgtgattgggtggggcactgcctcgggaactacgcgcaagccggcgcgctgaccagggacccgtcagacagagggcctggcggtgcacgtgctcgactcacattctccagcccacccagccaacaccaaccccagcgctcacggcttgctccagcaccaggacctgctggccccagccgacgagcgtgacgtcgctgccggcgcgggcaatccgcgcctggcccagcgggatggaatagtcgccggtggggacgtcctccaccgccgtgcggtacagcatcttggcctcgaagaccacgacggggtttgggtcacggatggccgacaggaggaggcctttggaggaagggaggggaaatcggcagaggggaaggtgtgtgcagtggagagccagaagccacacagccctcccggcaggctagtatcagcgacatcctcaggacagtcctcgtttcggaggagtggcaacctgtcgcacagacttgccgcatcatctgcgggtcagcggcaagaggccgcttgaagacacggaccacgacgctgaaccccgcccacctttggtttcgcggggaccagagggcatcaccaccttgattccggggatgtgcgtgaagaaggcctcaggggactgcgagtggtagtggcccccatgccccacagcgcctgcacagattgtggagaggtggacatctgttcttgcggcatgctgaagctgctgttcatacataaaagctggcaggatggccctgcagctgcaagaaaatagtccgcagcacacatatgcggggttggatgcaccaattttagggtcgcacatcgtgccctgcaatttcaacacccactgcatttcctcagaacttcataacccccccctaccgtagggtgtgcggatggtgagaccccccacgttaaactctccgccagaccggaaccgatacttggccgcctcgttggtgatctggcaaggggggcatgcgtgtggacattcactggtctggctagcaaggataccatttccaaggcaagccctcagcgcgtcctttccaacaccctcaagccagctgttacccattcatcaagcctgcacacctggtcaaaagcagggaagatgtagtctgcaaactggatctctactatgggcgagtagccctgagcagcggcgccaatgccaaagccgacaatgccctgaatagtaggcaagcggtgggggggagggcatcagcgtagatgcagcacatgtgcgcatggcttggggcttcgcactcaaagagtcgggggatgatgacgccaaggaaccccctgatctgccctcacctgctcgcagaggggggtgttgaatacacgatgcttcccatgcttctctgcgaggcccacagtgcaccgaaacacgccgccaaagctgacgtcctccccaaatacaagcgtcctacagcagtggaggggccacagaagtggtccaccaactttgctgccagtgcgggtcttgaatctggcaggaagcaacattcaggactcacttgggattctcatccatggcgatgtgcagtgcgtcgttgacggccgagcagagattcatctgcttggcatcgagaccagcggtggccggttccgcctgtcggaccgcggtggccaggccgcgcacggtgccccagactcctcccaagcctggggcccgcagaattgctgccatggctggtaacgacggatctggatgcccaaagatcaaagtgccgggcgttgaactccaggtcaagatggaaatttgcgtcccgtgcgatgcccgcggcctgtttcgagacccaccgtgcaccctgaaccggcgcctcttcgaaggcagtgatgcgattcggttcgatcaccaatgcttggatgattcggaaaagtggcttccaccgatcggtcggatttttagtctcatggaacatgactaggagacgcgggtctccgggactcccggcgcagagctcgcgcgcgacttcgattctacagccccttggagctgggtgatcgcgcctgattatcgacgctgtctttttacgcccctaagcagcatgattgatcttaacaacaccgaaacctagttgcctcaatacgtgtcagtcctggcaacaggtggaggtctctcaccgcgagggggagcaggaaggcccatggagtttgaaggcttccaggatccgcccctaccggtggtaggcctgctcggggatctggagacgcagcaactcctcatcgccctggctgccacggatgaaagccctgcggtgcgcctgatcacggtgccagatgcccagcagagcccggaggtcctaggtgtgcgtcgagttttagcttgccgaagttgacctgttggtatccaatcgcatgcaccgtgaaactcgtttgtctacatgtgtcggaaggcctggacagatggtaagctgaagcatgcgttgcaccctgaaacccatcagcccaacccatcctcactgctgccgcccctctagggcctcgcccacccagcccctcggaacctgtcacgcgaaaatcatactcgcaggtctacaaggtgggttgtcacccgacagtggtatcatgagaggcgctgcgtgcctctcatacccctgggatgggccaaagggcttgcaggccggtcacccacacccgactcgcactctcgccggcacaaatgcagcagcacagctttgaggcgctgatgcggcacacgccaggggcactggctgtgctgctgcgccacggcgacgtgatgggggaccccaaggcatgggcgatgtgctcccaggccgctgccgccgcaaggacggcggcacgcaccctgcaggccaggctgatggttgtggtgaccagccccacggcgccaggccagctggccgaggacaggatcagcatgctctgccgtcaggcggacgtcgacaggaagtgggtgctgagttggtgcatggttttaggcatgctcgggtcctggggtggcagcttgtgaggtagagatggatctggtggaagcgatcaggtcattgcattgcgtggaggcctgcaccggtcccccccgcctcggcgcagacccaaggttattgtgacttgatgagaaagttgagtcttgacctgtcctgtccctcagcatgccacccccctcccccccattgagcaggagcatcctggccttgcacatgagggatcaggtggggatggcgggtgtgctcagcacgctggtgcaagccgcacagaccagctacctggacgcggccgtgcgccatgccagcaagcaccccccaaccacggtggccgggcaggagtgcggccgagttctcggcctgaagctggatgtgagtagggaactcttttgggtcagccgggtgaggctcccgctgtggtgcaggatccagggctggggttggcgaaggtggcactggctgccccgcccatggtcaaagatgctcttgaaagaagagctgggcgtgcacatacagaatcgatcaaccagcggccatcggctgcagatccccactcctccatgctgaaaattacacccaaccccaaccacctcccagctaggtctactgctggagatggggggccgccccgatgaagcaatgacggcgtacgagctggcatcctccttcatacccagggtgcgtcaaggcctacttcgctggggggaggcccagtcgtagcatgctcggcgtcactcgcagggcctgcgccaggagcacccagggcgggagtgctcctgcaggccctctgaactcacccgctccataccatgcaccagatcatgatccagccacccggcctgttccagcgcttcttcgagctgcacctcgtctccgaggccctcaccttcaaggcagggcgcccaggcttttcatggagggcctgggacgcagcctgggttgctgggggttgcccggggatccatagcatgaggagctgggcttctgccagatcgtttgcgccaaatttgggaaccggtctgcggtcgcgatcgccaactcgtcctccctctccccataccatgcagctgatggcgctggtgcccccctcgccgcgccaccaggacatcgtgctgaagcactttaccaggctcacctccctcttcggcaccctgcccagtgcccgcacgccgaagtaagacgcctgccggggtgtagttgtctcgtgacctggggtgggcatgctggtttgtgtgatttggtaggattcgacccagaacccggtgcgccgagggagggtggggacagtattgaatcgcactctcaacgcaatgaatgccgtgcagggccctggcgctggcccacgcgcagcgcctggcgcttcagcacgaggccgtggccggtcacctgataggaaggcctgcgccggtgggttgggacaggggcaggcaccttgcccatgggcttccttcccagacctgtggattgcaatgcccaggagggcggctgccccgcggcccgcggattggaaactcgccgcgcagggcttggcatcggcttgccctctctctgtgctgcctccccatcccccccgcacaccgtcctcgctttcttccccagggccaggagcgtggcctgggcagcgtcgcggcgctgctccatgctgcggccaggcatgcaggggaggcggacgccctctcacggcagccggacgagggtcccagtccagtgatgacggatgaggtgggcgagcgcctgggatgccacgtgttcacgtctgtgggcaagcttcatcctcttcccggcccctgctctatgggggatgcgtggcggggcgtcactctcagcccactccgtggccatcatccccgtcacccaggtggtgcctggccagtacctggggtgctgggagttcaagcacctggaccgtcccctcacagacgacgagtttgccaccgctgtcggggtgagcatggcgaggccggccgtggtgtaggcagatgctgtgtgtggggggcagtggtggagggggtcttttgatgaccggacgagaccctggaagagatcaagcaggccccttgggcctgatgtgcatctcacagccgctcgcacccacagcctgcctcccctcccactccacgcctgcgtgcaggcgagcctggggcgcgcgccccgctgccccgaccccacagacctcctcaggtgcgctgtggatctgctggagagctcgccggcggcgggggggcgnnnnnnnnnnnnnnnnnnnnnnnnnnnnnnnnnnnnnnnnnnnnnnnnnnnnnnnnnnnnnnnnnnnnnnnnnnnnnnnnnnnnccggcaggcacgccgaggcccttgcggtgatgcccggcgtcgcaggtatgggtttgcatgcacaccgctggcagcgtgtgtgtggtgcattgtgaggggacagatggtcgctcgcgggtccgatgccagggcgcaatgggctcagcaggccgatgctcactgctgttaggctcggtcaatttccctccctgtctatccactttcccttggctcgttccgccatgctatccggagccgacttgggcctgcgcttctgcaacctcccgacggacctgggcctcatccccttcccactctgcctcccatcccccagaggagtatcggcgccagggctgggcgtctctgctgctggatgctgtcaagcagtgcgaggcctcggcccggctcagcggcgacgagcaggcaagggtcgtggggggagggggagggtctgaggcggacaggcgccacgctgtgtcggcctgcacagcgctttgatggttctgtgtcccccaaatcccactgactcgatgacatgctccgcctcacccgcaggcccgcgcagcggcgcagctggagctgtgcgccctgcgcggcgcgcccgcggaatcctgcatggaggccatcggtgcggtgctggccaccccgccgggcaccatgtggcaggtggagggcgcgtccagcggctggctctccgtgctgcagatcgccgtcggactgggacctgcagcccgccggggcgggcccgagctgcactgcgcgctgcgctgcgtgctggcctgcccgctgcgcctggaggccgtggccgccctgcccggccggcccgggtccgaggcggtgccgctggtaggccgcgacgccgacggcggcgccgcgccggcaggcgtgctggagctcgccgcgggaagctggaccaggttgaccgcccgcctgcctgtgacttgcgcctccgtggagaggatcctccttaccctggcgggcggcggccagacgctggtcatccaccccgccgcatggacgtcgggggagtgtacgctcgccctcggtcccgccagctcgatcccctcgctcaaccaggcccctctgccgccgtctgtcgccctgctgggcgccgcgaccggcggccctgcgccggtcgggcacgacgacctccccacgctcgcgctgcatgctcctgcctttgggctggtggacgaggggctgacggcgctgctcacgctgcatgccggcgaggcccaggggctgcagggcgccgtgctcacaccaagggtgagccttacttattgtgtgtgtggggggaagggggttggagggggggggggagg

SEQ ID NO: 25668 - DNA, 109 bp, Chlorella protothecoides
aggtgaccccatgaacgccggtgcagatggagcaggggaagggagacgggtgggattggtgagacccagggtgcgtggtgcatgcctggacctgcttacaaagtgtgag

SEQ ID NO: 25669 - DNA, 70 bp, Chlorella protothecoides
agcgtcgggcccacgccggcgcgcagggcgttccctctctcccctacttcccgctttgcatgagtcatga

SEQ ID NO: 25670 - DNA, 79 bp, Chlorella protothecoides
gtgagctgaagatcactcgcatcacacccccctccttagcagaggtggagtctgcaggagatggaagtctctgccgtcc

SEQ ID NO: 25671 - DNA, 156 bp, Chlorella protothecoides
tccaccgcctgttgacagacgccagggggggccaggccgttctggtacgatgcaatggggggtcgggttggtgaaggggggaaatggcggctccttttcgctgtggaacgccttgcagccatcggcgctgccaagtccctgcccctgcgctgcctc

SEQ ID NO: 25672 - DNA, 75 bp, Chlorella protothecoides
cgactgatcgatggctgttgcgcgcgtgtgtgttgggtgagggggtcaggcatgggtggtgggccagcagcacca

SEQ ID NO: 25673 - DNA, 66 bp, Chlorella protothecoides
tcaggcatgggtggtgggccagcagcaccagaggcatgtcttgaagacacgacaggacagcgggcg

SEQ ID NO: 25674 - DNA, 1780 bp, Chlorella protothecoides
  modified_base (363)..(473): a, c, t, g, unknown or other
  modified_base (1279)..(1482): a, c, t, g, unknown or other
agcaagcagtccaggaaggtcaagaatgtattccctacgagagggacatggtccaggtccacgatgacgtctggtcatctgctgtcagtccaaacgacaacgaaataaactgcaataggttgggcgcgcaatgcgatgagagaaggcgcagccacgcaactgtctgagagtaacgcaccatgtcttgctgggtgcatgagcttgtagcatctccaggacattcgtctacaggggctgtgtggggccctcaatattaattcgtaacagccggacagagccgcgattggccggatgccatgtccgggctgtcaggtagattgttttgctgcaactcctgattgacagcaaacatagcagccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgaataaaatcaaagttctgctttgagatggagctgttgtaccatactgacatcaaataaatggcggtgtctgcatagagtagctacacaacaagatgatacaagggtaaaagcttgtatcggcaacgttcgcattatcgttgtaggagagaatcctcaggggaccccaccagaatcacagcacgagcttaatattctgtcccgaatctgcagattcacgacagaaccacaaaactaacagacatgaccatctacaactccctagacacacatcggtatcaaagggtgcagttccagtgttggcacacgtaaaaaacatggttggaccattcctgacgaacagggtgtttcccctcatcagattgaatgggagggtctttgtgtcgtgtgggggcttgattgtcctgttgtgggtgttaaatcttacttactctggataacatgcgtgtatggggaactccatcgcaggaactgatcggagcaaaaacatttgggcgatggctgtagatgcttgcatacaagtgagaaatcgccgtcatccggcatccttcttgccttctcctgggtcagccgtgcaacaccactgtcgattgaccccagtggcgagtcctttattaactgatgacactttggatgttttataacgagcgccacccagaagtccccaaagctaccatccttcgatacacccaaagagctcatgaaacgtgagcgaagaaaagcgaaagatcaatgtcctttcgtgcagtattaacgagctgaagaccggtccctcctgcccctttccaaatatcaccagaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattgcctgtcgcgccgagacaaccttcagtatgatggactaaatcgtctctcttcagttcctcaaatcgctgcaaactcgtacgacccgccttctcatcgtttgaaacttttatctgcggcatgcaaaaccccagcatcagcattcatcgacggcgattatggcgagaaggttcccacccagctcagggccgtcgggattgtccgttctcaaattgcactgcaacatttccctgtcgattccaacttcaaatccatatgaaggataccttccatgtgcacaaggcgaatagcaagg

SEQ ID NO: 25675 - DNA, 217 bp, Chlorella protothecoides
agcctcctgcgcgggcgctagctgtcgtgcgcagggaggggcggcgcggacggccgcattctctgtacctgggaacgcaaagcacacagatcctgtgattgtggcgcctcagccagcaggatgcgcaaggttctgtgctgggccgccgctgcggaagcaatgcctgatcttggtgatgttgagtctaacaccatagcgcggcaatggattggtcttc

SEQ ID NO: 25676 - DNA, 67 bp, Chlorella protothecoides
gtttcgcgaacacatgcatggatgctccaacactccgcgcgcctccaacgctgccccttcgcgcgcg

SEQ ID NO: 25677 - DNA, 61 bp, Chlorella protothecoides
atttctggggcatgagccctgaagctgtgccgttgccagatcaccccgggccggcgtactc

SEQ ID NO: 25678 - DNA, 105 bp, Chlorella protothecoides
agtgccatggcacgacccagatcacttccataattcgaaggattgtaaagtcattgggcaggccgaaacaaaactgccagtggtgctagatatgcgctccacatc

SEQ ID NO: 25679 - DNA, 61 bp, Chlorella protothecoides
gcttggaaattggtattgtcttatcaatcttgaattcagcattgcatcgcattcacatagc

SEQ ID NO: 25680 - DNA, 101 bp, Chlorella protothecoides
cgttcccgggctgttctagtacatgaccacggtggtgcctgtggctcaggactatcacacagctaaaaagtcgtacccacctccaccactggttccaccat

SEQ ID NO: 25681 - DNA, 108 bp, Chlorella protothecoides
gacaggggatgggagcccgcagcctgtgggattgggtatgtgtggaagttgatggactgctgggaggcttgacgggtcacggcccttaatgcaggcggcgctggcact

SEQ ID NO: 25682 - DNA, 71 bp, Chlorella protothecoides
tgctgtgggacgaagtgcattctcaaaaaaacacttgagccacatcaggatgttgaccgccccgttgacgt

SEQ ID NO: 25683 - DNA, 61 bp, Chlorella protothecoides
ggcgtcggcaccctctgcagcatcttgggctctgtcggagtgtgcggcccacagaaaccat

SEQ ID NO: 25684 - DNA, 164 bp, Chlorella protothecoides
gctcctggagatcctctggcaaggctatcgccaggtgacttgggttgggctgcgacttgggaccgggacttccaagtgtgaatgcaaaaacaggacaacaccctggtagcgcatttccctccattcgaacatggccccccaggtcctgcatggatcccgagtcc

SEQ ID NO: 25685 - DNA, 75 bp, Chlorella protothecoides
ggtcgggaacatgcagaggtcttcaaggcacgcgtacagaaaggctagcgatttcccaagcgaatgagtgacccg

SEQ ID NO: 25686 - DNA, 77 bp, Chlorella protothecoides
aggcatgcaacaacggtgccacttatcaacgcggcaggcaagccgaaggatattgtatcatagcagggactggccca

SEQ ID NO: 25687 - DNA, 61 bp, Chlorella protothecoides
gtccaacggtgtaccctctggagaggcaggtccaagagctgaggggcagtctctgcccccc

SEQ ID NO: 25688 - DNA, 69 bp, Chlorella protothecoides
tttacgaccaaaagaaacccattcacaaagcaaaaaggcaatgataccacaacgtgccgtcctagccac

SEQ ID NO: 25689 - DNA, 72 bp, Chlorella protothecoides
tggctgtttcggtggtcgcagtgtcccatgccaccttcctcgcaaacccgtgaacccacccacggccccgcc

SEQ ID NO: 25690 - DNA, 61 bp, Chlorella protothecoides
gggttgcccacacaaagggatgggcatgccctcgaccatttgccaaatcggactcgacacc

SEQ ID NO: 25691 - DNA, 64 bp, Chlorella protothecoides
cccctctctcgcaggctcaacccctctctctcatgctcaccaggctaaggtaccaacagcgcca

SEQ ID NO: 25692 - DNA, 64 bp, Chlorella protothecoides
gtgcgttggagcaccgagtgtttggcattcaactcacagttccggcgcatcacccgccccacct

SEQ ID NO: 25693 - DNA, 61 bp, Chlorella protothecoides
cacagttccggcgcatcacccgccccacctaacgacctctcttctccccacgacagggatg

SEQ ID NO: 25694 - DNA, 61 bp, Chlorella protothecoides
gttctggtacctgcagggcagtgcagcatgcattagtactgaaaccaggagaatggctgcc

SEQ ID NO: 25695 - DNA, 61 bp, Chlorella protothecoides
catatgggcctgggcctgcgcctgctgcgcgtgctgcgcctggaactgctgcgcctgcgcc

SEQ ID NO: 25696 - DNA, 127 bp, Chlorella protothecoides
gccctctcttacacacctttgccccttgaatatgcagcccagctggcatcacctctgcatctcgggctcctgggacttgatgggtccagcagtatttaatcacgcatgtccgctgccctagcgtgcc

SEQ ID NO: 25697 - DNA, 101 bp, Chlorella protothecoides
aatacagagtggggggaaggtgacattggaagggtgtgccctgcagggccttccgaatcgtgttgggtcgttgcgttggatcagtcgacctgccttcgaag

SEQ ID NO: 25698 - DNA, 178 bp, Chlorella protothecoides
acaccctccgcacttgagccccacaaggttgtactgcactgtacatgttgatctgtgggaccaagggggggggggggggtgatctggtcacgacacctgcacactacaacaaccggtcagcggcaggagctgacggcattggtgaacactgcagctagctgcagccagctggcagcat

SEQ ID NO: 25699 - DNA, 65 bp, Chlorella protothecoides
actcagccatctgcccttcctatatcctctggacacaacaagcctgcaacgagtcaggtcgatgg

SEQ ID NO: 25700 - DNA, 71 bp, Chlorella protothecoides
ctccaggtgaggaggagatgcattggggggagaggggttcatcttggccctgcgtgccggtctgccgacgc

SEQ ID NO: 25701 - DNA, 2017 bp, Chlorella protothecoides
  modified_base (645)..(692): a, c, t, g, unknown or other
cccccccccccctcacgcacaacacacacaatccttcgcctgcccaccttcatgacctcgcgcttgacgatgggcccgccctcattgagcatgcgcagcaggatgcccagcagctgtgggaacatgcggtatggctccagcacgcaccccgtgttctccaccacctggcccagggtgttgaccgcgacgaggcgcttggcggcgctgccgtcctcctggatggcggcgatgatgagcggcagcaccttgcccacctcgggttgcaggcgtgagccggcgacgcgcgccagctcgcccagcgtcatcagcacgaagagctcgaagccgtcgtcggggcgcgcgcccttggccgcggcggagccgcccttgggcgggggcagcgcgcgcgcgccggcgccgtgcgtgctgccccgccccgccagcgagtggagggagggggaggagccgaccaggcgcccctcatgccctgccgcgccggggtcatgcccgggcgcgccccggtccgcgcccagctgcgtcaccaggcaggccaggatgggggaggtgtagggcagcaccagcttgggcgccgcaccgatgagcacgcccagcagcttggcactgtctgcgttccagaaaaggtgtgtgtgtggggggggggggggnnnnnnnnnnnnnnnnnnnnnnnnnnnnnnnnnnnnnnnnnnnnnnnntgaggcagattggtaaggaaattgggcgcgaggggggcctgttaaggggcccaagcaaggaacgagcacgtgatagtccacatgccagggtaatattggtgaccaaacgctcacagcagccccttaattcccaccaaaactcaccccccccccgggctcaccctctcgctgccgcgtgtccggcgcacactccatatcggagaggagctggagcaggtggcggcgtagcgcgggcatgacgaaggccgggttcaccgcgcccagcgaacccgccagctgcagcgtcagagagcgcacgccgctggactcgtcattcagcgcgatgaacaggatgcccagcgcctcggactgggccaggctggaggccaggctgcgcgccttgacaaaggcctgcagcaccgccttgcgcacgctgaccgccaggtcggataccgcgctggtcagcagccgctgcacgatctgaacgggattattttggtcagggggttgagtgcaccagaggggttgacctggggttgtgatcggagattgggactggggacgggtccagtggcatgcaggcatactcccacctgccatcacaccggcatcccggcccccagtcaacctcctcccccgaacctaccaccagtgatggcccaccaccacaccccacacccacccaccttgtccacgatgcggagctgggaggagtggatgcgacgcccgtcgcggcgcccgtactccacgtggtcctccacgccgtggcaggccgccagcaccgccgcgcggcggatggacgcctcgccgttgtccaggcagggcaccacatggtcgcggatgaactccagcagcgagtgcggcgcaaaccggaactgggcaaaggtctgcagcgccatgcgcgtcagcgcctggccctgcagctcgcccactgccagcgcggcctgcagcgccgccacggtggcgggcggcgtcagcgcgccgtgcgtgcgccgcgccagcaccagcgacagcaggtccagcagcagctcctgcacacgcgggagcaggtcgggcagagcccgcgtgatctggtgcagcgcgtgcaccagggactctgttggttgagaggggaggggaggggagaaaggagggagcagaggtcgggcgaaggggtggagaaaccgggaggcgtgagattggatcgacgcgctgctagtaaggcgagcttttggggcgccctgctctcctcaggacatccaccccaccccaacccccttgataattgcgacatcctttcaaacccactccaactaattgctttttcttcgcgtgtggtccccccccccacccacccccgccttcac

SEQ ID NO: 25702 - DNA, 140 bp, Chlorella protothecoides
ccttgctcaggcgagggcgccctgcttccaggtgtgtagccaggcaaggaggggctagagacacactgcaagcagaatcacggaatgggtttgcccctggcaacctcatttcaccccccgcgccgtaaaaccaatcgccc

SEQ ID NO: 25703 - DNA, 73 bp, Chlorella protothecoides
ctgagcctccagcagcgcgcgcgtgtccccaccccccgcctcgtgggggtggcgccgctggggccccgccgcc

SEQ ID NO: 25704 - DNA, 95 bp, Chlorella protothecoides
tgaaccccggcacctccacaggattatctcgactcccaacccttgtaacccccactcccgagaaatgatgctcaccctgcatgacgtccatggcc

SEQ ID NO: 25705 - DNA, 187 bp, Chlorella protothecoides
ggggggagggtgcgtgcatgtgacagtacatggaagggggaagcgacagcctgcatgcttatccggtgtgttctggagggaagaggcatttgctttgtgtcaccttccctttcctacctgacccgaccccggtgcccccactttcctccccccctttcccccgcaggtcgaggtcctgctgggcgag

SEQ ID NO: 25706 - DNA, 156 bp, Chlorella protothecoides
tgctttgcaggagcagacaacagaccaggtcgtacggccgcgactgggagccgccgagctagaggatttgaatagaggtcgactgaccagccgccagctggccctgttgctgaccagatgtcaggacaagggcgaggccgaggtggcggccatggc

SEQ ID NO: 25707 - DNA, 70 bp, Chlorella protothecoides
gcaggctgtgtgtggccatcgggagagagaggcgtggtgagacttgggttccacagtaggtatggggtga

SEQ ID NO: 25708 - DNA, 66 bp, Chlorella protothecoides
gcgtatgggtagggtgtcgacgtgtgggtggaggggtctcctgctcaccctgcacgtgtctggcag

SEQ ID NO: 25709 - DNA, 61 bp, Chlorella protothecoides
gtgcagcacctgtggccctggaggggctggtcgtgctttctgggcgtgattctgtctgtcg

SEQ ID NO: 25710 - DNA, 61 bp, Chlorella protothecoides
gccgctcggtgcgcacacatgctggaatctgatctgggagaggacattacgagatggtgca

SEQ ID NO: 25711 - DNA, 80 bp, Chlorella protothecoides
tcgacaccccttcagggctatcctgccaatttttatctcccagtcattctgttacatcacatccagcagaaggtaacgac

SEQ ID NO: 25712 - DNA, 410 bp, Chlorella protothecoides
ggcggcggcggggacggcggggagggtggcggcgagacggggggctggttgtgcggcagggacacggtgaccccggcgaacttcttgccagtggcatcggtgtaccacaccccggctgcggtcagcgctcccaggtggaacatctgggtcctggtgacggacatgctcctcccgctggggatcacgtcccgcgtgtcggccgtggcccggctctccgagaagtagccgatggacagctcgcccgccccctcctcaaagtcgccggagaggaccatggtgcagtccgcgtagtcctgcgggtcgaaggagctgatggagtcgacgcagtacgccgcctcgatcacgatgctgaccggcggcggcggcggcagcggtggcggcggggagggcggtggcgaaggtgggggggg

SEQ ID NO: 25713 - DNA, 107 bp, Chlorella protothecoides
acccacggtcgccggtccgcgcacttaacagggcagaccataatgaaagccctagagaaggcttcattaggcgctcgcaatgccctttgctccccgcccgtctgcat

SEQ ID NO: 25714 - DNA, 77 bp, Chlorella protothecoides
cgactggcacccacagggctctggggagtttacctgacgtactgcaagctcccgagcccagttgtgtgatgcggggg

SEQ ID NO: 25715 - DNA, 74 bp, Chlorella protothecoides
gttccgacctcccaacctcccctcccaaacgcaggcggagccgctgacgtggccggcctaccgcacgcggcggg

SEQ ID NO: 25716 - DNA, 79 bp, Chlorella protothecoides
caccccgccagggtcgccagcagggcctcgtgctgggtgcgggtgatgttcgccagcctctcctcgggcgcgacgcccg

SEQ ID NO: 25717 - DNA, 126 bp, Chlorella protothecoides
agctgccgacgattcttgtctactccaatgagaagactatagtccatcacatcttgatttgccaagaattctgcaatgaattgataaatggatcaaactatatgtgggagggcttgtaatcgtcta

SEQ ID NO: 25718 - DNA, 270 bp, Chlorella protothecoides
cggggcagacctggagggaggtgcgccgagaacgaggggggaggtgggtggctgggggtttgatgccatcgccaagcatgtaggcaagcggagggtattggctaagggggctgggcttgcgggggcacagccttctgaccctgggtgctcatgcctgtcggggctggggggcgcttggctttcaagcacctgcctgaaacattgcatgccaacctcatcctgagcatcgtacacctataacatggcaggtccggcacgaccagacggtga

SEQ ID NO: 25719 - DNA, 193 bp, Chlorella protothecoides
gtcgcagataggcagctctctgctcaaggccgtggccgaggtgagggggatgtgcggcaaagctcgactgggttgatgttcccttcgtgcatctatggaggaggtggagtacccatcaagccgcgtcaaagaccaacgcacaccgctcaacaccaggggacgcctgcttgtcaagcctagcaccttcttcttg

SEQ ID NO: 25720 - DNA, 93 bp, Chlorella protothecoides
tccgccaaaaggcaagctgcccacaacccagtcattggcccccttttggcattatctgaggtagtgataacttcaagctctggcgggctattt

SEQ ID NO: 25721 - DNA, 61 bp, Chlorella protothecoides
gcgcgtgaagggaaaggtaacacaggctggtataaggaatttactactcggtagaactcaa

SEQ ID NO: 25722 - DNA, 66 bp, Chlorella protothecoides
aaagaagtgctcaaggattcgaccccggaataagctcttgccggccgagaggcctagtccgcccag

SEQ ID NO: 25723 - DNA, 118 bp, Chlorella protothecoides
tcgcattagtgctcattgttgaaacttgatggggctctgatggactggattgggcgttgagtatcgtgaccaggatggccgcgccgggactcgtcgaggcgcccaccagattggcggg

SEQ ID NO: 25724 - DNA, 76 bp, Chlorella protothecoides
cacgctctgggcgtttgcaaagctggagacctatcataaggagctatttgacctgggtaagtccacctttgtccat

SEQ ID NO: 25725 - DNA, 171 bp, Chlorella protothecoides
tcgttccgtttgttggtgacgggacgagaaagctagccactctccaaggcaaagtcccaggtcttgtgcgccgggcacctgtatggcgatgcagggtacatcacagcacattacaagttgagttttggaataatttctgaacatgcattggatgagaggcctctctattcg

SEQ ID NO: 25726 - DNA, 68 bp, Chlorella protothecoides
ccaggcggtcgccacccccaagcaagaagttgctgcctccaagcaagaagtcgccgccgccaaaggct

SEQ ID NO: 25727 - DNA, 216 bp, Chlorella protothecoides
ccttcggcatcgacagatatggaagacgaattgtcaccttgtacgcctcagcttctatcacacttgctgggctacttgactgtgctcacacattcagcatcgattgggacagcacgggtgcttgacgatgtcaatgtcctcagcctggacacgtcccagacaaacacttgtacgtccacacagactcagatctgattgagctcccacgattgattg

SEQ ID NO: 25728 - DNA, 73 bp, Chlorella protothecoides
agttggcactgccgaatggtggctctcaatataacatgcaggaacctgtcgtcataagggaagaagacagcag

SEQ ID NO: 25729 - DNA, 61 bp, Chlorella protothecoides
ttcggagccgggcgggttgtaggtctgcgcattgcggaacatgagctgcaggtccacctcc

SEQ ID NO: 25730 - DNA, 645 bp, Chlorella protothecoides
gtggggacggggggggggtcagggctggggcccagcgcgcatgggagatggggttgcgggagtggggaggggcaatcgggtgaagtgcgagggttgccagccgtcgagagcgccgcacagcgtcgagcctgaggcctgatgtacaaccttggctcccatgtggcactgagcgtgtacccccgcccggcctcggcaggcaccaaggtggccaggctctgcaccgacgccagccccccttgtgctcctcccctgccaggcccatgcccaatcccaggctcctaccatgtaatgccatccgaatgcccccctctgcccctgccccaatcattcaccgccccttgaacgccacgcaccccggaagccgcctccagggccgccgcaagactgcgccggcgggcgtggccggcggcgtcgccgtcgccgtcccagcgtggggacccgacgggcgaggtcagcacgtggatgttgatgcagccctcctgtgacaatgtgcagggagggtgaggggggacctgagtgggatggccgggacggaccctggccggaacgttgaacggcggcgaccaggagagtgttccggtggccaagcggggggtggcgcacgatgcacccaccggcaggtgcagcgtggtggcacatcacgtc

SEQ ID NO: 25731 - DNA, 75 bp, Chlorella protothecoides
tattgtagtctcttggtacatgtcatggagatattaagtcagaagagcggatacccaggcacgtgctcggagagg

SEQ ID NO: 25732 - DNA, 71 bp, Chlorella protothecoides
catgcctgcggggtccaccggtgctgctccacctcacaattggttcatgtaggtgccaacaatgtttgcgg

SEQ ID NO: 25733 - DNA, 65 bp, Chlorella protothecoides
gtgcttgtgtgtgtgtgtggggggggggggtcgtcccagtgcaagcaggtcgagtggaggttggg

SEQ ID NO: 25734 - DNA, 64 bp, Chlorella protothecoides
ctctgctaccaacaccatcgttccgctggtacagcagcgcttcctggagctggaccgggacggc

SEQ ID NO: 25735 - DNA, 68 bp, Chlorella protothecoides
gagggcgaagactcgctccgtgtatggtcgacgcatgatcgcaatggcacgggcctggcagcaccggc

SEQ ID NO: 25736 - DNA, 67 bp, Chlorella protothecoides
gggggggagtctgctcccttctacaggctggagcgcggcggcacgaccctgggcctgccggcgtcgg

SEQ ID NO: 25737 - DNA, 61 bp, Chlorella protothecoides
gcggcacgaccctgggcctgccggcgtcggtccctcccttccggctggggaacactgcggg

SEQ ID NO: 25738 - DNA, 75 bp, Chlorella protothecoides
tcctctatagaccctgtaacgccacctcatggctggattttgcctccacgagaaccgcgggggagtcaacacgtg

SEQ ID NO: 25739 - DNA, 61 bp, Chlorella protothecoides
gcgggccctcaagtagtaggccttcttgatctgttcgggagtggcatccaccgaaatctgc

SEQ ID NO: 25740 - DNA, 70 bp, Chlorella protothecoides
tccccctcacacacttttgccatgcaggtctgggagtttggcattcccgtgcaaataaaatacattgccg

SEQ ID NO: 25741 - DNA, 127 bp, Chlorella protothecoides
gccatgctgctggagcagagctggggctggggacggaggtgtctaaccgtcgtgcttgtcttgctggtcctgcgggtggtggggggtggggtgggggttccttgagttagagttggcgaatgggaaa

SEQ ID NO: 25742 - DNA, 103 bp, Chlorella protothecoides
aggcattacagtgtgcacgctgaggtgagcctgggtgtgcagtggggcagagcagcgtgctatgtttgctacgccccatcatgttatctggcatatgctccgc

SEQ ID NO: 25743 - DNA, 131 bp, Chlorella protothecoides
gtgtgcgacgactgcggggagccagagtggagatgtgggaacccgtcagcccacatgcctgagtatccacgtcaatgggcagctggcacgcctccgccttccccccctccgtgccagccccacgcactgct

SEQ ID NO: 25744 - DNA, 77 bp, Chlorella protothecoides
ggaggaagtcggcgccctggagctcgagggtgccgaggaagaggacgactggggggcgggacaggactgggatcagg

SEQ ID NO: 25745 - DNA, 61 bp, Chlorella protothecoides
gaccaaagaaacagcaggtggaggtggtttcttgctgcagtcttgcagcgttcttgctctc

SEQ ID NO: 25746 - DNA, 71 bp, Chlorella protothecoides
cctctctcccatatattgttggagccttggaagcctcatcatgctggacttcttctgttagaccccattct

SEQ ID NO: 25747 - DNA, 74 bp, Chlorella protothecoides
gggtggggggcggggatcgaggagggaggggttggatggccacacgaatgcatcgatcggggggaggaaagtgg

SEQ ID NO: 25748 - DNA, 144 bp, Chlorella protothecoides
gcacggccttcaagtccacaatcgacagcctccccaaacttaacttctagaaggaaactaattgcatggatttattctcgagatgttcgtaatgggttccttgtaggactggttttccaggagagcgtgtggctgtactgtgca

SEQ ID NO: 25749 - DNA, 70 bp, Chlorella protothecoides
gtatttggcctctgaccgccaccaagttgccactgatggagatgtcagcgtgtttttcaagggttctcta

SEQ ID NO: 25750 - DNA, 66 bp, Chlorella protothecoides
aatgacgagaacgagggggtggcagggcttgctgggagtgggtgacctgcacccgggtgttgtgct

SEQ ID NO: 25751 - DNA, 62 bp, Chlorella protothecoides
gtcggcatcgatcggcaccttggagccgtttacgctgggtccgctgggctgcactgcagcag

SEQ ID NO: 25752 - DNA, 22850 bp, Chlorella protothecoides
  modified_base (874)..(883): a, c, t, g, unknown or other
  modified_base (1464)..(1473): a, c, t, g, unknown or other
  modified_base (1744)..(1753): a, c, t, g, unknown or other
  modified_base (2536)..(2545): a, c, t, g, unknown or other
  modified_base (2747)..(2756): a, c, t, g, unknown or other
  modified_base (4488)..(4497): a, c, t, g, unknown or other
  modified_base (5257)..(5266): a, c, t, g, unknown or other
  modified_base (6219)..(6293): a, c, t, g, unknown or other
  modified_base (7469)..(7478): a, c, t, g, unknown or other
  modified_base (8585)..(8594): a, c, t, g, unknown or other
  modified_base (9197)..(9235): a, c, t, g, unknown or other
  modified_base (9322)..(9331): a, c, t, g, unknown or other
  modified_base (9642)..(9651): a, c, t, g, unknown or other
  modified_base (10333)..(10342): a, c, t, g, unknown or other
  modified_base (10599)..(10608): a, c, t, g, unknown or other
  modified_base (11223)..(11232): a, c, t, g, unknown or other
  modified_base (11417)..(11426): a, c, t, g, unknown or other
  modified_base (11478)..(11487): a, c, t, g, unknown or other
  modified_base (11644)..(11653): a, c, t, g, unknown or other
  modified_base (12190)..(12199): a, c, t, g, unknown or other
  modified_base (12776)..(12785): a, c, t, g, unknown or other
  modified_base (17556)..(17565): a, c, t, g, unknown or other
  modified_base (19062)..(19071): a, c, t, g, unknown or other
  modified_base (19305)..(19314): a, c, t, g, unknown or other
  modified_base (19372)..(19381): a, c, t, g, unknown or other
  modified_base (19439)..(19559): a, c, t, g, unknown or other
  modified_base (20941)..(20950): a, c, t, g, unknown or other
  modified_base (21496)..(21505): a, c, t, g, unknown or other
  modified_base (21877)..(21886): a, c, t, g, unknown or other
  modified_base (22017)..(22155): a, c, t, g, unknown or other
ctccgccgccgccggcccccccgccgccgctcccgccgccgcctcccccgcgaccagcccgccccccgacccctttgccctagtgcgtgaggagctgggggtggtgtctgagcgcatgcgccgctccatcgtcaccgacatccccgccctgggctccgcggccgactacttcttccgcctgggcgccgacggcaagcgcctgcgcagcacggtgctcctgctcctggcgacgcggctggcccccgcgccgccagaccccgcgcgactggaggtggacgagtcccccgcgcgcgccccgcccggcgagccgcgccggcgccagcagcgcctggcggagatcacggagctcatccacatcgcctcgctcctgcacgacgacgtgatcgacgaggcggggacgcggcgcggcgtgtcggccgccaacgccgtgttcgggaacaaggtggccatcctggcgggagacttcctgctggcgcgggcttcggtgtcgctggcctcgctgcgcgacacgcgcgtgatcgagctgatgagcgcctgcctggagagcctggtggcgggcgagatcctgcagctgaccgccgacccggagcaggcgctgtgcctggaccactacctgcgcaagacctactgcaagaccgcctcgctcatggccaactccgcgcgctccgtcgcactgctggggccggagcccggccccgatgccgcacaggcggcctgggactacggccgcgcgctgggcctggccttccagctcgtggacgacgtgctggacttcaccgcctccgccgacgagctgggcaagcccgcgctgaacgacctgcgctcaggcctggccaccgcgcccgtgctctacgcggcgcaggccagcgagccnnnnnnnnnngctggcacgccggcgctttgccgcgccgggcgacgtcgacgccgcgctggccatcgtggccgcaggggacggcctggcgcgcgcgcggcgcctggccgcagaccacgccgacctggcggtgcaggcgctgggcaggctgccgccgccggcctgcgaggaggcaggggctgctcacgctgccctgctggagctcaccgcccgcgtgctcagccggcggagctgatgcgcgtgggaggggcaggtgcagggagggaatgccatgtgccaaggctgtatggccgagtgctctggaaatgtgtgcgcgcgaatcgctggacaggcacccgccaccccggtcgtcccgtctcgagcctgaaccacacgctgccgtgtgcagggggaggcacccaccgcagtctcctcgctggcggcgctcccgcatgccactgaatgtatccaatgaatacatgccaaaagagtcagtagggtgtcacagaatggagcagggacaatgtaaacagctggtaaggagtagaagagaacttggtgttaagagtccacccacacagtgtggccacggtcggcatgttcaagcaagcaannnnnnnnnnttcagtaggttgttacagagtggagcagggacaaggtaaacagctggtaaggagtaaaagagaacttggtgttggaaggccacccacacagtatggccacggtcggcatgttcaagcaagcaagccggcagcggcccagggcgacaggcgacgtggtgcgcaggccaaactacaaagatcacagctgcctgcatgagtcgtcatgtgtgaccgccttccgcccagccctcaggtggtgggccgccctgctggacggccagccaggcgcccnnnnnnnnnnacgtcatatgtgaccgccttccgcccagccctcgggtggtggcccgccctgctggacggccagccaggcgcccaggccggcagcttctagcagcagcagccagaggtcccagcgcgccgcgccatgccgcccgaggtcgcgctggagctggagcgctcgcgcctggtcgccgccgccggtcagcggggggacccccgcctgcgccggcacggccgcgctctcgggcgggcccagccagtgcggcgccagctccgggtgcgtcccgcacagcacggcgcgaccggcgcccacagcgcaggccagcgccgccaggggggtccccgccaggtcggcgtagcgcgccagtgcgcggcagcccggcgggagggcgcccgcgtcggggtggaaggccgggccgccgttggagtagtcgcggcactcggtggcgacctcgccggccacagagagggggaccgcggcagccccggcctcggagcggtagtcgaagccgggcaccacgctgccgcgcgccgtgccggggaagaaagccagctcgcgctcccctgccacctccaggggcgagccgggttcgaactcgatgcgggccgaggcgtagtaggcgcccgcgcacaggccgaggtaggcgccgccctgctcggccacgaagcctacgcaatggggtggaaagggtgaatggacgggcggaaagcagcatgcagcacgggtgtatgagagcaggccttggactcagaggcagggtggctccatgttctccagagagagtgtatggcttctctggagcannnnnnnnnntcttggactcggaggcatggtggctccatgttccccagagagagtgtatggcttctctggagcaggcatgtatcagtgcgggagcccctcagatcgatctccatctacgcatgcagctgagacaaccccataaactttctgcgacagcagagaagtattcattccagctatatgccccacctgtgatcagctggttgccgtnnnnnnnnnnaacagccccataaactttctgcgacagcagagaaatactcatcccagctaaatgccccacctgtgatcagctggttgccgtgcccattcaggacctggcagtaaggggtgtcggctccacccggcatcaccagagccaggcagtcctgccgccaccgccctgccagcagctcctgggacgccatgctcctgaccttcagaggcatactcaagaatctggtcacatgcaggctgatttcacagatggatacccctggcgtgttgggatcacaccgtgagctgctcacccaccttgacgctgggtttgagggcaagcctgaggctctccagggcgctgagcaccgatcggggccccgccccagggccctcgtacaccaacacgttcggcatggagtcgttgcggggcgtcagctcctggaagtttggatcgaggtgtcgaggagggagcacgcaggagtgccagtctcagacccactccagcgtctcaacacccacccccttgactctgttcttttcgaatgttgcattaaaatcatgggcatttggatttcagagatacaacggcggcatgcaaaaggcgatgcgacctcagtctggccgatcacgcgcgctcggggagaatccacagtgcttcgaactcgcaagctgtcattccgcacttgttacgagtgcaacaaccatcccaggcccaatgactccttgcaaagatttggcatcagtgacatggaccggggcaagcactggcttattcgcttacacagctcaactcatatccatcctccgtgaaaggcacaagggcctcattgcaggtgcagctgtccggagatgaccaccacagcatcacccgccacaatgacgcggcccgcatcctcccgcacgtccacgtacagctcgcctgtgcgctgggacagctggcgggccctgagctccgtcttgcccagccgagcagcccaatagggcgcggccaccgtgcaggccgacccggtcaccggatcctcatcgatgccggcccaaggcgcaaagaagcggtagaagaagtcgtgctccccctcccctgcaatgatgggcggggttttggggggttcagggactccatgcctggaaatggtcggcaccgtcccctgctgacaagcgccaacacagaggacaacccaaaccctcaccctttgccgtgacgatcacgaggagcttctccggatgggcgtccagcagctcgccaggcctgggtctgatgctcagaagctcctcccgacccccctccagcacgatcagcaagttgttgatgtcagggttgtgcagcacctccctcaccgggatggttccggccacagccctcaccagccgtgagccagcggcagtgcccagggggacgtccgccacggcacgattcaggggaaagtccatggagatgcgaccactgggtccctgcacgactgacagctcgccgctgagcgtctggaagcgcagcctgggggctgtgttgcccaggcctgcagggacgatggacgaggaaatgcacggtacattcttttaagcggcagcgcaggcgcagacaacgctacattcctcagttccgtcaaagatgagccaggtctcccaggggccctgcgcaccagcaaacaaccccagcgcgaggccccacaaagcatattgttcgacccagtccatacaacccaaagcaacccacatcccaagactacaaagggtcgaagctgcaactcacatttccagannnnnnnnnnagggccctgcgcaccagcaaacaaccccagcacgaggccccacaaagcatattgcttgacccagtccatacaacccaaagcaagccagatcccaagcctacagagggtcgaagctgcaactcacatttccagagagcagcagcagaggcgagagtggcgtgcccgcacagcttgacttcggtggtgggggtgaaccacctgaggtcaaagttgtccccagtggtcacatcactgctgggagggatgggtctgatgtaggctgtctcagacagattattctccattgcgatgctttgcagggcggcatcggagggcacgtcctgctccgggagcaagaccaccgcagcagagttgcccttgaaagcggtatccgtgaaggcatccacctgtgcgcatgtgcaggaggtggggagaggtcagatggacagtgatctacatccacgatttgagcccgacaccctttacacctccagcatcgacgctttctcctatctcgctgatgatatgatattgaaaaaataggtaatgggctcccagcaaatcgcacagttcccacgcggacctggaagagtggcaaggtctccatcctgtcagctgtcactcggccgagtctcggatgaagacggcctcttcaacgcaaaactatccgattactgcgcatgcattcacgaccattcaattctggatttgggtaattgcaatcataccagaaaaacgtgttgcgaactgacgtcactcagctaaacccaaggcagggcgnnnnnnnnnntctgttcaacgcaaaactatccgattattgcgcatgcactcacgaccattcagttctggttttgggtaactgcaatcacaccagaaaaacgtgttgcgaactaacgtcactcagctaaacccaaggcagggcgcgggatccgagacccccatcctcccacaatgtaattgtccggtcgtccccatcatgggagcgggatagcgttatagataacgagtatttcgatacgattaggtgcttaaatagactacaagacaaaggagtgtgactgctgacaccccctggcgctcaggatgtcggtgtctgcgacgtcctgccgtgctgtgagccacatgctccggcagggaggacccagaatcgcagcgcccttcaaggcggcccatcgtccatgcagatgccttcacaccagttgcatggcccgcaagggcctcgctgagctcctgcgcctgtcagaacggtgcgtgcagagaaccctgcagcctgaaggggtgattagccctttcaccgatgaagaaagccgggcatctgtagtttctcctccagcaacgcacgactcgaccccacaattcaaaccgcccctccccaccccacccgcctcctgccagcagggatgacggggcaggcctgaagggccgggcgcccctggtcccaggcaccgtcagccccccacgccccgttcccccccacatcgtgcggccgccgtatgtcagtcggtccgggactccggactgggacagccggccccagatccaggatgcagagggcctggtgcggatgagggcggcctgcaacctggcggcaagggtgctgcgcctggcgggctcgctggtggcccccggggtcacaacagatgagattgatgccgcagtgcacgaggccaccattgccgcaggggcgtacccctctccgctcagctacggtgaggaggggcctggaggatgtcattttgggannnnnnnnnnnnnnnnnnnnnnnnnnnnnnnnnnnnnnnnnnnnnnnnnnnnnnnnnnnnnnnnnnnnnnnnnnnactgggcccagggacccccatccatctggctgggccccctcatccacccatcgcgaactcccgccctctgcaccgcaggaacattccccaagagtgtgtgcacatccgtgaacgagtgcatctgccacggcatccccgactcccgacctctgcaagaaggggacatccttaacatcgacgtcaccgtgtacttggatgtgaggatggctgggagggcgtgggagtgtacgaggtggtgtctgaattgtggttctgccctgccgagccagcaagcatcctggcctgcgcctcgcgcccatagttgcggatgtggtgtgatgctctcagccgagcaccgcccacagtctcctcctcgtccccgaccacatccacgacgctcaacccctttccacatccacgacgctcaacccctttccacatccctcctcacctcccagggctaccacggcgacacctccgccatgttcacggtgggagaggttgcgccggaggcccgggcgctgtgcgaggcgacgcacgaggcgctgcacgccgccatcgctttgtgcggtccgggcgtccccttcaaggccttgggtggcgccatccaggcggtggccgacgcgcatgggtttggcgtggtccgcggcttctgcgggcacggcgtgggcaaggtcttccactcctaccccaccatcctgcactacaagtgagtttgtaaaggaggggggggggggttaataagggggaggctgtcctctggtcctgcacgggaaagggtccctgttggggtggtgcatgccctccccagggcaccactgagcatccatccacgacgctctaccacaaccccaaccatcgcaggaaccgggagggcggcaggatggtcccggggatgacattcaccatcgagcccatgctcacccagggcagcgccaaggagcggtactggaaggacggctggacggccgtgaccacggatggcgggctgtcggcgcagtacgagcactcattgcacataacgcacgagggcgtggagatcctgacacagctctgactgtcccacctcggcgtcgctcgtgagggccctgaggccagcgcgttcctcgctttcgtcactgccccatggctgcaactctgttcgcgacggcgctctccaatcggatgagggcctgactgaatggtggtgcggatgcnnnnnnnnnntgccctgaggccggcgcgctcctcgctttcgtcactgccccatggccgcgactctgttcgcgacggcgctctcccatcggacgagggcctgactgaatggtggtgcggatgcatggcatgggcgagtgccagggcgatggccgcgtaaagaacacggcagtgtagactatgtacaatgaagggccctggggtacaactgggtggggatcagtgctgagcagtggatagtgttggggggagcggcgcagcctttggtctcaaaggcgttgtcacccagcccggaccagtggtgtgtcaacccctggtccacgccatccgagcagcgcccatcggtccagcgcaccgcccggcgccacgtcaccaccctcacgcagcgtcagggggtgcgctcccctggcgcggccaggtacgccttccactgcaccgccagcgcgacgctccccgccaggaaggccaccgcgaccgccacgtcctggcgcgccacgccgccgtgcgtctgccacagcgtgcgcagcgtgcgggcgtgccgcacggccctcgccgcctccatgcgcccgcgcaggcgtgcagtccgcgccttctcccccgccgccgccgccttctcctcctgccaggccgccgccgccgccgcggcccgctgggcgtcgctgcggccccgccgcgcggaggcctcggcgctggcgcggtacctgggagggggagggaggggagggcacactggggtcggtggcatcgatagaagagcaaaatcgttgcattggatgcaactctggtggtggatggatcacggcggcaccaagctgggccccggcaccaagctgtgcaccccgtcactccgtcactccatccccgtgtgcaggccacatcaccacccacatcaaaggggcagaccatcgccctgtgatgctcggctgcccaggccccaccagcctccccttgcacggtcaaattgcggaccgcaccccgcctccctaccctcaggtgcataagaacaaccgattgcgcacccgggttgccccatcctgcgcaggatttcctcaaacacgtcgtccagaggttcgcgctgagcggcccgtcccgcaggccggggcggcccctcccagcccnnnnnnnnnnctgccccatcctgcgcaggatgtcctcaaacacgtcgtccaggggttcgcgctgagcggcccgacccgcaggccggggcggcccctcccagccccagggggtggggccagctccgtgggacgcgtgccagggcttccctgcctgcagcgcctccgtggcccgttggaaggcgagcacgcgatcgtactccgcgcgcttggccccgtccctcaggatctggaaggcctccgtggccgccacaaattcgcggtgcccggccttccccgcggaggggttgatgtccgggtgacacttgaaggccagagccttgtaggcggcccggatctcgctgaggctggcggtggcgggcacgccaagtgcatcgtagagggagggcgaatgcatggaggctgcagggggaatatggcagggactctgcgatagccagtctagggtcagcacatcgctttcaaccagtccataagctcaacgcatccaggcgctggcagggggcctcgacaaaggcctgccgggcctctgccgggctgtggctgacgactggggaacgagaagccggaccgacgcggctcacgacgggcccaatggccgagcaaacgcacagannnnnnnnnnnnnnnnnnnnnnnnnnnnnnnnnnnnnnntagaatagacatagcactgcatatcacacttggacacgtcatacctcgcactccccattgacacgtctgcccaccgtgaatggcgannnnnnnnnnagggagcgaggaagtgatctggcgcgagaggggagggcggatagcttccgggcgcgctgctggcttccaagttagctagcatacagcatccactgcgagacagaggctgcaccacgcacgcagaatagacataacactgcatatcacacgtgggcacgtcatacctcgcacccccaattgacacgtctgcccaccgtgaatggcgaccgagacgagccccacaggggtacccgtgtcacagagtgggtgcccaccccatgtaatgcaagcaatctacggcacctacaacaagaaggaagcaaacgaggagnnnnnnnnnnctgtcacagagtgggtgcccaccccatgtcatgcaagcgatctacggtacctacaacaagaaggaagcaaacgaggagtcgctgaggaggtaagggtgctctgatgtgtgcgagggccagtgtcgaccctcacggacttgcacgacccccctcccccgggcccgcgcagatggtgggcggagtatgctgaccgcaagaacgacgagacggacgagtacgtggccaactctctgctctacgaccgaaaccacctgccccgctccgcacccgccccggactgtgtttccaggccgagcgtgcttgcgtcggtcgcggcagacgtcgtcccctccgtggcggccctgccccaacccgtttccgaagtgggtttgcagcagggcagggatttggaaccccagctgccagcttcggcggtagtgctggtcccgagcaagaggaccttggagcagaactgaaaccctggaccatttccgactgcacgccttgcagattctttcaggttatgatttttcttaagcattacttggtatccatgaatgcagtgtgtgagctgtggatccaccatacttcttgtaagttcctcaagctcaaccagctggaagtctgaggctgtgaagggtcgttcgctgcatcattcgcgtttaaaagttgaggactggcacagctccaagggatgaggccnnnnnnnnnngtcgttcgctgcatcattcgcggttaaaaattcaggactggcacagctccaagggatgaggcccaccgaatcacagcctgctggagaaatcattccaccaccctgcgatcacttcgcagaacgaacatgtcgtcgagtatctgccgatgtgcacaggccacttcgagaaactggagttgtgctcccaacaacaagagagcggctggctgtattacatgggtttgcgattcagaggccacgcccagagcttgacatcnnnnnnnnnnccacttcgcagaacgaacatgtcgtcaagtatctgccgatgtgcacaggccacttcgggaagctggagttgtgctcccaacagcaagagagcggctggctgtattatatgggtttgccattcagaggccacgcccagagcttgacatccagcctgttcaagcattggggagagttcggcatgcgatgcaatatccatccagacgtcggcaacctggctgaaagctgtggtgcccattcccacttgtcagcctgagagcctcctgtgcacctgcaagttagattgctgcagtcctcaacatgtgcaagtccaagccttaccactgctccgttcacacttgacaacttcatgtgtctgctgaagcatgtagagatgttgagttgcccttgcgacaatgtaggcaagtgcctacagagtcagggtgtgagcaatttcaacatcaagacagcaaggacccgctagtccaccagcggcaactttattagatcattccagttcatctgagtgatttaatcatcaaccccatcgagtccttttctaaaggcacgtcgtattggaagcatctccgtttgataagcccatccccatgctgcgcatcgtgctgcgacgtagacannnnnnnnnnggtaatttcaacatcaagacagcaaggttagtccaccagcggcaactttattagataattccagttcatctgagtgattcaatcatcaaccccatcgaatccttttcaaaaggcacgtcttattggaagcatcctcgttcgataagcccatccgcatgctgcgcatcgtgctgcgacgtagacannnnnnnnnnctcacacttgacaacttcatatgtctgctgaagcatgtagagatgttgagtnnnnnnnnnngccctggggcaccacgaaggctttcacacaactccgaataaacgcattgcaggcagacacgcaaaaggttccaatcagtcttcgggttcgaggccgagtcgctacatttcggggacgagaagcagacacgaccgcgcaacgaccggaattccaatannnnnnnnnnccccctggggcaccacaaaggctttcacacaattccaaataaacgcattgcagtcagacacgcaaaaggttccaattaatcttcgggttcgaggccgagtcgctgcatttcggggacgagaagcaagcacgaccgcgcaacgaccggaattccaatagaatggtgctcggaggagtgaaggtaggcgggtggctggcccaaggagtacctcatgctatacagactctgtctatcgccccggcatgatcccctcgtttctctcaatgcagtctgctgtgtctcggctcacaccgtctccgggagcagtgcagtcgctggcactttggggcacgacagctggcgtcggggccctttggctcgtccaggtgatataagcataccttggaagtgatgatggtttgcaaggtctagttggtgccttcgcactcgtcttccggtagaggctgtcactacggcttgccatcgcccagcacgtatcacctgctttacattaacacaacccacgttgcccatttgcagccttttgacttcatcaannnnnnnnnnagatgatggtttgcaaggtccagttggtgcctgcgcacacgtcttccggtagaggctgtcaccacggcctgccatctcccagcacgtatcgcctgctttacatcaacacaacccacggtgcccatttgcagccttttgacttcatcaagggtcttctggaggacaagcctgcggaggagtgattgaggagtgtgggtgtgtcctcaatgctcaagactaatcaggacaagtgtttggcagacaggccattgtagaggcttatggtaatctagtccgtgctcagcagcagcaaaataacaaagccacttgtcacgggctcagcgtaggagaacttgggtgagtatgagttggcctggactgtgctgggatggcatgcaagcttctcagcagggaactggcattgacctgggctaaagcatcgtatatttgcccatgggaatctgtactctgccaatacaggcaaagggcactggggtttgaggtgttgcctatggaagtacgaaggagatgaagttgctgctgaaatagttggatagtgtacctagtgtccacacgacagatggacattcgcctttcnnnnnnnnnnttttgaggtgttgcctgtgggagtaggaaggagatgaagctgctgatgaaatagttggatagggtacctagcgtccacacgacagatggacattcgcctttctgatattcttactatataattccatttgaatttcgcttcacatgcgtagaagcacgtcgacggtactggcacgtcgcggcctctcctgtgaggctaaacaatgcagggcaggtcacgtgtggtgttgctcagaagtgtcctcaagacaagcttgtctgcacccactccgccgcagttcaattcgagatacaagtgtcttctcctgaggtgcaaagatcgtgtagcgactctgattgttgggctcctggaaacatgcactgtgcagtgcggaatgtcgcggcggcgggacttcacagagtcgaaacgcgggccaccacatgaagcgacgcgcccgcacttggcggacagccgctaccagatgctcagtcgctccttgatcttcgcggtagggttgtagcgggtaaaaataatatgagattacgctccaaaccaacgtcggtgaggttcacggagctgggttgtgagttgcctcatcaacgctgctggcggcgcaattcacccagcccgcaacaagggtcgtgcagttcgacaactcctgcgctgtaaatacccagaactctgacgatttaagttaggattcggattgtaatccttatgggcaagaagatcgtccctccggatgaccccgcccgcctggcccgcgtcatggacgagaagaggaggctgattggggtgagcctccgaatagtggcccaccccttgaaacagcgcgatcaagtaccatattgcctatgcggtcttagcctcctcataaaatgcaggtggatttagagggcctcgacctacaactccgagagaaacgcgctgcagctcagcatgcccttcaagtcaccaggtgatggtgggcgtgtttccttgagagggcactttatgtgcatggtacggaaagagaaactgagaggagatcagcaggagggtccatggcacactccaaggggtcacagcatggtcaggcccctccctggcaactcacaacgatcccagggcggaggagagcgccctgttgggtgctgccagcaggtctgcggcggcagcgctgaccgcacatgcggcccaggcggcgcgtgaccttcacctcagccaggcctggcagggtcaggcgcggagcagagcagcaagggtgctggaggccgatgcgcagcgcatgcgggaggaaagggaggagctcctggcggccagccagtgccccctgcttacagaggagctgggccaggactccagcccccaggccttcaagggcctgaccgaggcccagagggcggccatacaggcagagagggaggcgcaggcgacagagcgtcggcgccgcgccctccaggctacggctgagaaggggatcgaggagcgggcgctcctcgcagccgactctgaggcggcgctggcggcgcacaaggtggggcagaatgatgggttatcacggtcccatgccagagctgcgtcgcggtggggtacgggtgtgggatgtgtggagcctgccagggtccctatttgacgaccatcacctatgcctcgggtttgtcatgcaccggagatgtcagacaagcccatggcaaaggggtccctttgctacaggtcgaccaggaggagcgggagaagcgctggatgctggcggactgctggcggcgccaggccagcgcgcccctggaaaaccaggagcccatgccgttggggtacgcgtcccggggtctacagttcgggacgagtcatcgctgatgcattgggggacggaggcttgagggggcccatgtcgtgggaaggccagctgggggactggggctgtactgatcctcgagccacgtgtccgtcaccctgccatccgtccctgtgtcttcactcggcacggcgtgtgcatgctacaacatccatggagtagtaattgtacggaaagaaggtgtgtgccaccaggctagtacactttgcaatgcaaatttttgagaaggaagaactgcatcaccacacgggccaaatgagaacaacaaccaaaagaaccgcaggccgatggcgcagggggggttgggacagacgccgtgcagccgaacaaccaaacaggctggtgtccgtcgatccttgtcagaccccaggcggaggcacacttccaacgggtcggttaggagaaaatggaagggcaacggtcgcgcatggggggagaagttcagggggaaagatgccaacagaagatgggatgtttcgggccaggcaaagggctgtggagcagggccacaccttgatacaaatacaggagggtggaatagcatttcgagcagcaatggtggggggcaccaacggatttcccctcaagacggggggttggagtgatgggagcggggtgggtgggaggacaggcaaggggattggaatgggaagagagacgggcatgggccgggacaagtggtttgaagctcagccaccagcaaacagggccggaaaatcgtctgtgatggggtctccaatcgtgccagtggtggagaggatcctggcaaaactccagtccaatctatagcagatctcaagctctgcagtccgcagcttggaggctggaacgcggcagagggcagccatgaggctgcagcaaggggtgtctgtttgagggtggagtggaggggggggatggatgtgacatgtcacgtcaagtagtgttatgcaggccagagcattgggttcaggcatttgcatgcgtgggtccagcttgggaggtggtggtcggcagcaagatgtccacatgccctggccccccttcaccctgccaggagccacccacatggtcgcagggagtcaaccttgcaggccaaccatgtggcggctgcgcagtatagcgtgagagagtgtgtgtctctggccaagatcgtggataagtctggcacagccagggtcagggcgctgatgatcttgagcaccccctccaagacacagtcgtcgatggagatgtgtgggtagtaccctagcagctgcttgcgccactcctgatgatggggtttgtgggtaggggagctgctgatggcatgccaagatttgggcccagcaagaaactgggaaggctttgctggttcccagtctccggctgcgacagcgctgtcgcaccgtagccatgcacgacttcaaagaaacgacccgcccggaccacgcatgagcgggttctccccgtcgtgcacaatcctaccgtcagccatcgccggatccgactatacagggcgctgcccgatcgcgctgtgtgagtgtgcggagtcaaaggtgcgctgggggagtcgggtgggcagcacgtcaacactgtgccgaccggtcgccgtgatggaggggacggcttgcgatcgcgctgcgggtgatgggttgggccgctgggtcgccttctgggtttgcctgtatgcgcaaggacggcgacaggcatttccccgtccagcactcaccatgcgcttggatgcgatgcttgcctcggtgcagtcgatgtcatcggcggcctggcgtttcctgggcgggaccaaggtggcgcacgttgccatcgcgctatactctacgccactctccgcgatccgcggatggtcagtctagtcagggatgtgggagaactgctgttacaacggccagcatgccttgcaatgccgatctggcctgacctatctcatccacaaactggtggtcccgggtctaccgctgtgaatcttcacttcacaactccctcacgtatcccgaccggaccacgaatttggagtgtggacgtacgcgatagcgcgggggttgggacagcaacaaccaagtgttctgcgatatccttgcgtgccatgaatgttttgcgaaacccatctaacgaaaacttctccttggtacctcattggcatccacatgatcctttccatctcgcgcaaggcaccgcttcctccgggggcaacacgccctgaccgatacgacaaccactgcgtgtccgttccctgcctcacatgcgcgagcgtcacatggagttgagggccttttgagtttctgaagccatgttaatgggctggaccgtgctcgagctgctgcagtactcccccgccctgccgcccctcatcagttggaccctgccggacacagctcggggtgcagcatacaaacccagtccaaaatggcgcatatgtgaagagaatgccagtggatttcgggaaagaaggaggatgcctcggagtccttctcaacggctgacaggagcagctcattccgccccacccctggcactgggtggctgtttggcaacctggggggcgatctgacccgctcagatgtcgtcgtagcacacgagcggccgctggggcacaggggcatgcaggttggcctccgccagcgcctcgtcgtcgatggcagacaccacctcctgcgcagccgcacgtgcctccctggggggtttggacgtgggaatgtcgtgtaggaggtcggcctgcacaccattcagcaggctccggccaaggcatggcatctgcatgggcccctctccaccccgcccaccggacgcgcgggtgctccacaggggcgccgcctgggccctgcccctttttccattccggcatggccccccgcgcccagttcacccgcagcacggtgccgtccggcgcgataagtggggagctggaggccacctccatgagcgagcagccgtcctctactcgggcaaacgtcacgaagccgtacccctgcacgcctatcnnnnnnnnnntagcacggtgccgtctggcgcgataagtggggagctggaggccaactccatcagcgagcagccgtcctctactcgggcaaatgtcacgaagccgtacccctgcacgcctatcacccgcgtctccacgacctccgcatgctgggtcaggtatggagttgtggtgccagggtgggaatggggtggcccatgcgtcggatgaccagatgaggcaggggggcccagacggcagcacatttccacaacgcagccctcaggggcgcaaagcttgtcgagcatgtggggcctggttgcggtccgcccccctcgaaccacgtctcagacctgctcgaagaactcgtggaggtgtgcccgcgtccagtgcatggggaggtccccgacaaagagcgtggcgccggactgcgcaggggcatccccagtcccagggcgatccgacgtgtttcgtgagggggggtcctgcccatcggcatgcctggacgacggcccagccagattggggcggttttgagtggaggcagaggagctgcataggagggatgagtgaggatcccacaaatgcatccccatccgcagggctaccaagttgaggatgctgcatcccggcacaactcggacctgcccaggggctcaccgatcgtggtcagcgcggccctggggtccatcgtggaaggatggtaccctgcgtgagggcgggaggggccgtgctgggggctgggcctgagccgccgccctccccgccgtcgcgacgcctgggtaactgcgcggcacgggcgctgccctcggttgggggcgctggccggcggcgtccccggcgccgccatccaaccgcgccagtttcctggcgggggtgggctgtgcagcggctggtgcggcccgctgctgactctggagtgctctcagggcagcatccctccccggatttgatggaggttgggctgaggagtggggtgctcatgtgtgagggtgaagccggcacggagactcttcgtttgagtaccgcatgcacacccagggatctactccgggtattaatacgcggaactcaccctgcggcgcgcctggtgccccagtcgaagcgccaccctgcgaccgggtggggagggcccaatgcggtcagatgggggtgacggcgtcgcactaggagtttcatgacggcccaatgcccgtctccagcaacttggaggcttattcacctgtttcttcaatcgaatggcctcgtatttccgttcgagcgccagctcggcggcagacttgggtggggccatggggacagccccgtctgcacccccacttcgcgccccagacctgacctatgatgctcttcaaccctcaagatcacatgtaacacgccaagatagcacccctgaagtgccggcttgcatactaaagcctttgcgagtggtgtgtcggagcgtgccgggcgtgctgcggcgccaggttcgatcagtgtcacgacaaagttcaacataagcccgccgaagcaggtaatcatggcgatcnnnnnnnnnntctccccggtctccagccggagctatggaggagccttccctcctggacctgcttcaggggctggaggatgtgcaaacaaagaagacagaggtgatggaagattctgcaacttgtctggtcggggggggagggatcgctgatccaatggtcgaattgggacacgcttctgcatggctgattttcccaccgctctatcacacgccgaggacgacactccgcacaggtgcgcctctnnnnnnnnnnacttctatttaatggttagaaacgcagtgcaaatgcaccagcagtagtcttggatatnnnnnnnnnngcttctatttaatggttaaaagcggactgcaaatgcaccagcagtagtcttggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggagggagggatcgctgatccaatggtcaggttgggacacgcttctgcatggctgggttttccatggctctatcacacgctgaggacgacactccgcacaggtgcgcctctctgagcggaacgtcgtggagctggtgaacaagctgaaggggatgggcctgatcggcgacgacctgctccacacctccaacggcagggagtacatcacccgcgatgccctgacgcgcgaggtgctgtcaaccgcccgcgcatctcgccgcgtcccgctggtgagccctcccagtctgcgccttgcctgccgaccttgaccatgtgccctgcacggccctgcgtgatgccctagacccctgtcggcgccagcctttcctgggctgggcacagagaaccgcgcatggcgtcctgggcctcccccgatgcgaatgaccgggtccatcccggcccactcacaggtcgacctgcctgccgctctgggggtggatctgctgcactgccaggaggccgccaggcaggcggctgcgtgcgcaggcgcccaggacattctgctcgcccaggatgagctctttgctcgggagtactttgacgacctcgccgccgaggtggatgaagtcctggaagagcagggcatggcgcccgtcggtgcgtcaagtggtttacccaagggggaggggagggtcaagctggggtgacagctgcctggagcacagctgggccattgagcctggaggggccccgcctggttccgccttgctctgcctgcgcctgcggggccaaagcatcgaccgatgcccccgcccgtcgcaggcgacctggcacagaggtttggcctcgcctcagacctcctcctgacccagcttcgtccgcacctgggtcgcgatgtccgtgcccgcctggaggggggctacctttacacacaagcgctcacagtccgccttaaggtgcgaggctgcgtgaccggggtccgatcatgcgaggcgctcgctggcacgaccatcgcttgcggagaaggcgtcctggcagcgccagagctgccaggggttgcgcaggtcgcctggaagcaggtcgaccccctccgctccaccctcgctcacccccgcccgccctccaggcacagctgcgaggcgcgctgcgggggtccacggtcccgatcggcgtgcccgccctgctttcctctctggacctgggcgggacgccgttcctccagtccctcgtcccgggtctggtggagcagctcgtcgccgagggtgggtgcgacgggggccagtgttggcgaggggccgggtgactcccccgccaagcccagacggggaagggcttctgcggggcgactgagctgcccccaccaccccacgctcaggtgccgtgcacggctcgctggcgnnnnnnnnnngtgactcccccgccaagcccagacgggaagggcttctgcggggcgactgcgcttcccccaccaccccgcgctcaggtgccgtgcacggctcgctggcggggggcgccaccacctggatcccggccgcctttgtggcgacgcaggtgcagcaagcgcgccagtcctttgccgagaacgggttcctcgactggtccacggtgagtgtgcgggtggcttggtcctccagatgctgctgcatggccgggttcctgctggggtgtgcccgagcgcgctctctccgccacagaggaacgacggtccccctgcccgtaccagacggcagtcggtcgcgcccgccgccttcaccagaatccccattgccctgcccccgccggcgctgctgcgctgtgtcctagcactcacccaccccgactgacatccatccacgagaatgcccgcccaccctcgtccaggccaagcgcttcaccacgcaagacccgaagaactgggccgtccgagagctggggggtggggtggccctggagcactcgtacgcctcccaccagnnnnnnnnnncaagaactgggctactcgagagctggggggtggggtagccctggagcactcgtacgcctcccaccagctgctgcaccagctggaggccgccatggaggagacgctggcggagggcagctggtgaggggtgggcctggtggcccggggtacagggcgggtgtgcttggtacgccgacccttcggtccgcctggacagcgtctgagaggagggggcatccccatgctgccgcgcacaggatttcggggacacgatcctctgtcccccgggcgcagtcgacgcgcttccactcgtcatacaccccgtgagcccaccctcccactcaccggagccccccaaccacccccctgccaggctggacgcgcggcccctcnnnnnnnnnnagccatggaggagacgctggcggagggcagttggtgagggatgcgcctggtggcccggggtacagggcgagtgtgcttggtacgccgacccttcggtccacctggacagcgtctgagaggagggggcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgctcttccactcgtcatacaccccgtgaccccaccctcccactcaccggagccccccacccaaccccctgccaggctggacgcgcggcccctcctccctcccgccctccctgaggaggacgcggaggagctggtgctgcgctccacctccaagtttccctcgctgagcgtcgccacgggctgcacggtggtgtcggaggcgctggtcgccgcgctgacggccgaggcggagctggcggggcggcgggcggcggccgagcccgtgccgagggcctcgcagggcgaggcgccgacgcccgcgccgcgcggcggcggtggtgggggagggaagcagggcaagcaagcagcgccgcagcgcgccgactcctccgaggacgaggactggggcacctcggccgccgcgcggcgcaaggggcccaagaagggcaaggccggcgggaagagggccggggggggagccaaggcgaaggaggcgcccgacgcccgggccaaggccagggcggtccctcttcctcccgccgacccaccctcgctctccgaggcggcgttgactgagggcgccgcccgcgcccacccagacctcgtgcacggcgaggggctgctggccgcgctggcgccggcgctccggcgcgcggcgctggccgcgcgcgaagaggcactggcagcgctgcgcgcctcaggcgcggagcgctg

SEQ ID NO: 25753 - DNA, 238 bp, Chlorella protothecoides
aggatgttgtgtgacgcgagcgaatcgccagaccgcgcaccgcctgctctgcaccattgtcctttgattcattgcggcaggagctgtgcaaacaagagctcgccgcgccaagtcatcccttatctggggtggaccccgggcgtggctcgcctgtgagctcaagtaggatggcagcgctgcagggcatttaccgccggcacgagttcaaatcgatgtgcgcaagaccctgcagcggtgg

SEQ ID NO: 25754 - DNA, 75 bp, Chlorella protothecoides
tcctcaggtgggcgggggtggagccacgaggtgtttttttgagaagactgtctgtgtcagcgcatgccaggtcct

SEQ ID NO: 25755 - DNA, 123 bp, Chlorella protothecoides
aggaggaggtgacagtgacgggaatctcgcaccctccttgcacccaccatgggatgttacactcaggctgcgatggaataatggagacgcgctatgcgcaccttccttggtgaccttctgctt

SEQ ID NO: 25756 - DNA, 61 bp, Chlorella protothecoides
tgcaccaagtggacatgcagcgcgagctccaccccccccccttccataaaccaacaacagg

SEQ ID NO: 25757 - DNA, 73 bp, Chlorella protothecoides
aggccttcgcactcagcctgtaatcccactctccgtggtgcttccggcgaagatattctgcgttcatccgtac

SEQ ID NO: 25758 - DNA, 61 bp, Chlorella protothecoides
acgtcgcccgggtgtggaaggttgcatttctgtccatattcaacccagtcctacgtaccga

SEQ ID NO: 25759 - DNA, 72 bp, Chlorella protothecoides
gagggggaggggagcatggggatcattcattccacaatggccgcgagcagccatgccagatctgttgtgtac

SEQ ID NO: 25760 - DNA, 187 bp, Chlorella protothecoides
tgcctcgtgtgagagccagtcttgtgtatcccagtgtcaggcatggatcaggccggcattgctgtgtgtgtggtggggtggggtggggggagaaatgacaagtaatgatactcgagccatatgctttggtatgctgcagccctggtcaactggcttatccaaattgccatctgttggtctcacaagc

SEQ ID NO: 25761 - DNA, 70 bp, Chlorella protothecoides
ccatcctttgtatctttaggaggtcctgttcaggaggcaaacccattgacgatactacacaaacacgtag

SEQ ID NO: 25762 - DNA, 61 bp, Chlorella protothecoides
cacggcgcagaaaggggaacttcacggtggggcccgccagaaagcctccctcgagaagccg

SEQ ID NO: 25763 - DNA, 122 bp, Chlorella protothecoides
tgaggtcctggcctcacacagcaaatgctcgcccaccgtgcaggctcggccagaagaaacccgtgacggtttaccgattcatcaccaaggggacggtggacaagaacatttacaacattgcg

SEQ ID NO: 25764 - DNA, 548 bp, Chlorella protothecoides
cccacacacacacaagactcatcccccctcccccttcccctcccctcacgcctcgcctgctggaagttgtaggtgcggatgcgctccgaccggtcccccgacccgacctgggccttcctgtccgcggcgtgcgcctgctccgcctcccggcgccggctgtcgtacagccgcgcgcgcagcacctgcagcgccttggcccggttcttgtgctggctgcgctcgtcctggatggccaccgccaagcccgtgggcaggtgcgtcacgcgcacggcgctgttggtggtgttgacgtgctgcccgcccgcgccgctggcgcggaagacgtccacgcgcaggtcctcctcgcgcaggtccacctccaccgcggcggcctggggcagcaccgccacgctggcggcgctggtgtgcacgcggcccgaggcctcggttgcgggcacgcgctgcacgcggtgcacgcccgactcgtgcttcaggcggccgtagaccccgggcgcgccggggggcgcggagacggcggctgaggcggcgcggacgccgcccgcctcgcc

SEQ ID NO: 25765 - DNA, 70 bp, Chlorella protothecoides
gctgcagccccgtcagcttctccacgccgctcttgttgcgcttctcatgccgccgcaagagggctcccaa

SEQ ID NO: 25766 - DNA, 73 bp, Chlorella protothecoides
ctcatgccgccgcaagagggctcccaacgttgtcagggtgccagtgatgtgcaccgcctcgaagccctgtctg

SEQ ID NO: 25767 - DNA, 79 bp, Chlorella protothecoides
ccatgcggggccgtgtgggcgcgcatggatcgtgccgctcctttccctgggtcatgatagagctcagagtgtgtccagg

SEQ ID NO: 25768 - DNA, 61 bp, Chlorella protothecoides
ggtccagaaagcaaaactccatacgttcgactccttccagattcaaccgtacactatccct

SEQ ID NO: 25769 - DNA, 72 bp, Chlorella protothecoides
cgaagatgggtcactcgcgaaggggagctgacgtgagatcgacatccaccagggagcaatccaactcaccgc

SEQ ID NO: 25770 - DNA, 73 bp, Chlorella protothecoides
atactcctcagcatgcactgaagcaaggtggtcttccctgaacccatatcctgacacccagggccctacctcc

SEQ ID NO: 25771 - DNA, 78 bp, Chlorella protothecoides
caagctgaaccagtaacacgctgggagaaaatcgtcgctaaaagggggtacttcaagagaacctggtgggtctcggag

SEQ ID NO: 25772 - DNA, 75 bp, Chlorella protothecoides
gaagccagtccccttcagagcccaagcccaccccctcccttccaaatgccccgcgccccaggcaagcgcttcgcc

SEQ ID NO: 25773 - DNA, 61 bp, Chlorella protothecoides
gtgtactctgtgaccatctgccggcagcctacatgcacctgcccagacttcctgaagggaa

SEQ ID NO: 25774 - DNA, 61 bp, Chlorella protothecoides
cgcctcgtccatgcctcactcaggttcccatgtaatgcatgatctgcgaggcacgatcacg

SEQ ID NO: 25775 - DNA, 128 bp, Chlorella protothecoides
ctgggggtggcagttgtacggcagggtatgatgtcttgccatccctgcatgaaaaccgtcgctgcgcagcaggtacttacatcccacagggacagaacagctcctcaacacatcatatgcccccccac

SEQ ID NO: 25776 - DNA, 78 bp, Chlorella protothecoides
cgagccttgtactctgcttgccaggcgatgatgcagggtaagatcaaccccagcacagtgtgcagcgtgtagagcgcc

SEQ ID NO: 25777 - DNA, 79 bp, Chlorella protothecoides
ggggatgtcatgtggcgaaaataccatggttacaccggctttctaaaggtcgaacacgtaaaagacctcaaaatatggc

SEQ ID NO: 25778 - DNA, 61 bp, Chlorella protothecoides
gcatgtaacacatctagccaggacaggaagttcctcagcgtgtgggagacaaatgccctca

SEQ ID NO: 25779 - DNA, 152 bp, Chlorella protothecoides
tgtgtgctggccagaatccagcgcttcgacgcggcgtgatgcgccatggcacgggagggcaccccctcaaacttgccttgttccacggcccaccatgcacagacgtgagcgggacgcagctacccctcaaggccctgcgagtgctgctggaa

SEQ ID NO: 25780 - DNA, 61 bp, Chlorella protothecoides
ccagccacgccacgcctgcgccaagaagtggaagttgggattcgggatcttgggtgtggaa

SEQ ID NO: 25781 - DNA, 80 bp, Chlorella protothecoides
catcccatgcacttgtattctgcaagaattcgagatctagaattaatctcgtaaagcgcgttaccgagccccggggcagc

SEQ ID NO: 25782 - DNA, 73 bp, Chlorella protothecoides
cctccctcctcagtcaccatccgatctgtcatgcacgcgccatgctgaacgacgaggggccagccctgcgtcc

SEQ ID NO: 25783 - DNA, 68 bp, Chlorella protothecoides
ggcccggtcgatcctaccctgtcaccgcctttgttgatccaactccctgatccccacgcaaagtcacc

SEQ ID NO: 25784 - DNA, 80 bp, Chlorella protothecoides
cagtcctgcggaatcttcggaagctgtcctctgactcggcgccttcagcgtgggccatccagggccctgatcccgtcatc

SEQ ID NO: 25785 - DNA, 79 bp, Chlorella protothecoides
cgtcttccaggtcatgagagaggccagcgatcgcacgtcgtcgatgtcgacgtcggggtggaagcgcaggccgcccttg

SEQ ID NO: 25786 - DNA, 61 bp, Chlorella protothecoides
caggagtggatgaggtgaaggcgcggctgggagtatcaccttccgccttcattgtcaaggt

SEQ ID NO: 25787 - DNA, 127 bp, Chlorella protothecoides
ccatgcaaggggggtaggaagagaagagggtctgggctggatgctgagctcaaaaggatgaaacaatgtgtcatgaagaaacatgaagaagcaaagagcccagagcggtcagacaccagcaccatgc

SEQ ID NO: 25788 - DNA, 94 bp, Chlorella protothecoides
gcccagcatgaagccatacagggctccaaacaggcccctggctggctcgggtagggtgttgccgcgagcagccaccaggttggccaccaggagc

SEQ ID NO: 25789 - DNA, 115 bp, Chlorella protothecoides
cgccatcgcccagctagccgttggaagtgggaagttttggagttctctcggcctattattcttacttttgcactggctggagttggctctctgttcaggtccccggacagcttgg

SEQ ID NO: 25790 - DNA, 1050 bp, Chlorella protothecoides
  modified_base (344)..(353): a, c, t, g, unknown or other
  modified_base (484)..(493): a, c, t, g, unknown or other
  modified_base (936)..(945): a, c, t, g, unknown or other
ccctcccccccccattccccgccgcccggacagagctgctcccccgccatcagcatcatttccttgcccatcattgagtaagaccgtgcaaagggaggaaggggccgattatggatgtgtgcaccgtatgaacgtgtgccacgcagcttggagggcctcaacgtaaattgagggaccccccccccttcccccttcccaggttcggggacgcaatctatttggtggcggctgacagccggacggcctactgcgagtgaggaggggtgggcagagcttggcgtaaaccgtgtgccaccgtcctgactgaccaaagtttcatgctgaggcagctctgaggcagtatnnnnnnnnnncaaaccgcgtggcaccgtcctgaccgaccaaattttcatgctgaggcagctctgaggcagtatgcatggcggttcccacaaggatcactgatgaatgcactctgccggctttgcaggctcatgggctatgnnnnnnnnnncccacaaggatcactgataaatgccttctgccggctttgcaggctcatgggctatggacgcaactccctgatgacgatttcggccatgaatggctcgtacccctttccagccttctccatcagcaccatcaacccaagaacctacgagatctgcaaccctcgagaagtgctaaactgcttttttgtcgcgattgctgagtgtgtgccagagggcatgtggtcgtgctacaaggacgcgaatggcaacgccggcaactacaatctgggccatgacaacattggcaaccacaacaggggggacaacaacctgggtaggcgccggtcgtgtgggcgggggtgcagtacacttgtgcgctgccccaaaccatcgcctgacaccacccccacctctgcaggggacgacaatgatggtttcaacaacattggcgaccataacacaggcnnnnnnnnnncggtgcagtacacttgtgcgccgccccaaaccgtcacctgacaccacctccacctctgcaggggacgacaataacggattcaacaacattggcgaccataacaca

SEQ ID NO: 25791 - DNA, 415 bp, Chlorella protothecoides
  modified_base (110)..(286): a, c, t, g, unknown or other
cagctgcacagcagaaaggaccttgtcctcgaataatcaaagagccgacccacgccctccatgcagcactgccaaacctgacacccacctgtatcaatgtcaccgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgacaggatttgaaaatttgggaagctgattgacaggctcattggattccatagaacggcaatccgatgaagcagcgtcggtgacaacagtgaattctataggctacaccacaggacagggcataa

SEQ ID NO: 25792 - DNA, 75 bp, Chlorella protothecoides
gtgcaaggcatggatcaccacacatctcacgaccttgggtgggcctctctggcctgcatggctcgagctcccagg

SEQ ID NO: 25793 - DNA, 77 bp, Chlorella protothecoides
cccgtggattttctcgctatttctgtgtaatgtcaggctatgcgatgcaatgactgaggatatgggccgctctcggc

SEQ ID NO: 25794 - DNA, 61 bp, Chlorella protothecoides
ggtggaaagggtggaaggctccggagagggtgcccccacaacaggaggtgtgcagtgagtg

SEQ ID NO: 25795 - DNA, 74 bp, Chlorella protothecoides
gcccccacaacaggaggtgtgcagtgagtgcttgatgtccacattgccaactgtggtggcaaccaggaatgaag

SEQ ID NO: 25796 - DNA, 112 bp, Chlorella protothecoides
gctcgatacggaccggcaagcgtggcagggacagatacaaagggtgtcactccctgtacaccgcggggggccatgcaggaacgggtcacctgtaggccttgaagcaggccag

SEQ ID NO: 25797 - DNA, 88 bp, Chlorella protothecoides
cgtcatgggccccgtgtccctggagatcattgagcgcgatgccacgcgcaccatctcccgccaggccgccgccgaccagcgcgccgcc

SEQ ID NO: 25798 - DNA, 146 bp, Chlorella protothecoides
accagcagcacccttccctgcagtgctgcaccagtgctgtgcaaggcttctctggcgctctgcattcaggctgggtggtggaagcggctgcacgtgtctgaaaaatcacagaggggcccatgccgtgaagagttcaaacgcatcgt

SEQ ID NO: 25799 - DNA, 61 bp, Chlorella protothecoides
cagaacctttgtgtgtggggagggggggggtgaaagggggatagaggactctgaagcctgg

SEQ ID NO: 25800 - DNA, 179 bp, Chlorella protothecoides
gtcttgcggccgcagatgacgtcctgcgatgggccccgcatgcggcctctcttggtacatgcgcactcatgaaaagactggtaccgcaggagatttgacctcagcgagcgcgacagcaccaagggtgctctggattccctgctcttcggccccccaagccccctgtccaccaaaggcac

SEQ ID NO: 25801 - DNA, 61 bp, Chlorella protothecoides
cacatcgcccaccgtctcctctggcttgccgggcacccggtccttcatcggcttgtagtcc

SEQ ID NO: 25802 - DNA, 83 bp, Chlorella protothecoides
tcctctgcactcgcccaagatgggctgtaccatgtgtcatcttcccatgctcaggcacgccaggtctttcaaccccccccccc

SEQ ID NO: 25803 - DNA, 61 bp, Chlorella protothecoides
ccttgcgccgcacgcgcgcgtcggggtcgttgcgcagcatgcgcaccagcgtctgcgtgcc

SEQ ID NO: 25804 - DNA, 133 bp, Chlorella protothecoides
acacactcgcatgggcattggccttgggtcgtggccccttgcccgagcctgtcaggagtcgcctcagcacgcacccctttccattcagctcctccacctggagaccacctctcactcacccagcgtctcgctc

SEQ ID NO: 25805 - DNA, 79 bp, Chlorella protothecoides
atttgatccagagtctctgtggcaggcctgtggcctgtgtgtggcgcctcagtatgagcgagtggcacacccgctgatg

SEQ ID NO: 25806 - DNA, 61 bp, Chlorella protothecoides
ggatgcaagggcggcccgcacatcggcagggcgagtgatacatgactctgagtcatcagga

SEQ ID NO: 25807 - DNA, 61 bp, Chlorella protothecoides
catgtggtggtcccgtgcctgtaccgtggcacctcctgccccgctcccacctctctctccg

SEQ ID NO: 25808 - DNA, 72 bp, Chlorella protothecoides
tgtgtgtgtgtgtgtgtgtgttttggggggtggcgagcagaagccggcggcgcttgcgcccacacgtccatg

SEQ ID NO: 25809 - DNA, 67 bp, Chlorella protothecoides
ggggcagaggatttggccaaggaggccaagcaggtccaggagaacgaggtctcagatgttgtggagg

SEQ ID NO: 25810 - DNA, 61 bp, Chlorella protothecoides
gtggtgtggggagccattcttgccctcaccactggtgtcccctctcggctattttcttttt

SEQ ID NO: 25811 - DNA, 77 bp, Chlorella protothecoides
gagccgcgcttttgcgtcttccagcatttaatcgaccgccatggcgttcgatgagggactgggtgccgtacttgtag

SEQ ID NO: 25812 - DNA, 64 bp, Chlorella protothecoides
tgggtggcggcgggggagacgccttcttggggggcggcggggatgccttcttgggagggaaagg

SEQ ID NO: 25813 - DNA, 76 bp, Chlorella protothecoides
ggttgtccttgtatggaagggaaccataccagggggtgcaggttcaggctcaaactctaaaatgatgaggatacat

SEQ ID NO: 25814 - DNA, 119 bp, Chlorella protothecoides
aagggagtgagcgtgaaggacggggagccaaccgttgagcccccggaggagccggcgcagggctgaggctcagggggtgttctcctgttcaccgtgcccgactcccttgtgcatggtca

SEQ ID NO: 25815 - DNA, 61 bp, Chlorella protothecoides
gctccttacgcgccgtgtacccgggctagtaccccccccttctagcacccatcaccatccg

SEQ ID NO: 25816 - DNA, 61 bp, Chlorella protothecoides
agggccagccccgcacacaccgcccctggaagaaggtcatcatcgtggtggagggcatcta

SEQ ID NO: 25817 - DNA, 61 bp, Chlorella protothecoides
aaccttgtccaatagcattcgagacaacattccgagccattacaatgcctgaccgcgcacc

SEQ ID NO: 25818 - DNA, 81 bp, Chlorella protothecoides
cctccgtcacaaccatcgtatcgaagtcattgtcggtgaagatcatgaaggaatattctcttggctccgctttggtgtaca

SEQ ID NO: 25819 - DNA, 61 bp, Chlorella protothecoides
catgccggcgcagcaagctcagaggcagggtgggcaaaggactccacaggaacaccgactg

SEQ ID NO: 25820 - DNA, 80 bp, Chlorella protothecoides
gggctcaccctgcatccacactgcacccaccccccctcccacgctcaatcacctcctcccgcccaggtatactatgtcta

SEQ ID NO: 25821 - DNA, 103 bp, Chlorella protothecoides
ggcgctgctggccctgctggcggccaagtaccacgagatcgacgccgccccctgccacgcggccgcccactgcctcatcctcgctcaggcaagggtgtcagaa

SEQ ID NO: 25822 - DNA, 133 bp, Chlorella protothecoides
gggggggggggggggggggggggggggatttgagtggaaaagggttttcctgggagtatgcgggctcttgagaaatggcggggttggtgggcaatgccctgttaagagaaagaccggggcctcctggtggcct

SEQ ID NO: 25823 - DNA, 76 bp, Chlorella protothecoides
tggggggcttgtcggtggcgtccccatcagggccctcctgatgtaccccaccaccactcctggacaggggaccagc

SEQ ID NO: 25824 - DNA, 132 bp, Chlorella protothecoides
ctctgagatgttctcctgcagttggccccttaccacaatccacatcaaggtcacaaggtgtgataccatgcctcgcattcctcatccttgacttgccacgacacacacccttttcacctttgcgacggtaga

SEQ ID NO: 25825 - DNA, 80 bp, Chlorella protothecoides
cggtacggaatgggtccttgcaaggtcagggccgggatgagtgttcctcccctccgcacatcagcccgagaggccttcgc

SEQ ID NO: 25826 - DNA, 80 bp, Chlorella protothecoides
ctgagcaagatgttctatacctcaaaccttgcatgttgaataccgaccatagctgtactcactgcaccaggaatgcctga

SEQ ID NO: 25827 - DNA, 80 bp, Chlorella protothecoides
acatgatcctaaggccctcgttgaatccgggcatttttccaggcggacccccctctcactcacgtcgagcccagcagcga

SEQ ID NO: 25828 - DNA, 88 bp, Chlorella protothecoides
ggctgggcaggtgagctgctggcatggttcacatgcaccaccagataagccgcaagcaatcactgtgcaagctgtgaccaccacatcc

SEQ ID NO: 25829 - DNA, 79 bp, Chlorella protothecoides
gcatgccccccatcatccacccttcaccccttgaaaatacctgcagacacacctggatccagacctcatctttcagcaa

SEQ ID NO: 25830 - DNA, 171 bp, Chlorella protothecoides
tttggcatcgccatcacacgtgaggctgaggatctggcagagctgttctaaggcctggcttgttgcttcttgacatgggttgttgtggtggcagccgttggagtccatgctccccctcaggttgcccaggcccctgcgctggttccatgcccccagcacagcaccattctt

SEQ ID NO: 25831 - DNA, 210 bp, Chlorella protothecoides
agcaggtgctctgcttggagttccgtggaatgagaggacgatgattgttgcacagcgctccttcgactcatcgtccgtcagtctttcatgcctgtgtaggggagcgctgctgggaacactccagcacgtgctacggcaagcttcacgggaaccacgactgggccccagggcatagccacttcagcctggaccgccgaggccaccagtgcg

SEQ ID NO: 25832 - DNA, 79 bp, Chlorella protothecoides
tcaatcatgtttaccttgatgtcacgtgcttggattgcatctgatgttgatgacgttccataaatcatggaggagctcc

SEQ ID NO: 25833 - DNA, 61 bp, Chlorella protothecoides
tattcgcttgaagtgtgtgaccttggacccaacgtagatctccctgattgaggccatactg

SEQ ID NO: 25834 - DNA, 70 bp, Chlorella protothecoides
aaggcagagcaggagcttgctcctgtctcccatgcgcacctgtgatatcgtctacctccacctgactccc

SEQ ID NO: 25835 - DNA, 68 bp, Chlorella protothecoides
cgcagccagtggcagccggtggggaggaaggtcggccccctcccaaaactcacccggaagacgtctgg

SEQ ID NO: 25836 - DNA, 61 bp, Chlorella protothecoides
cctcccaaaactcacccggaagacgtctggtagctccagggagatcaggtcctcatccagc

SEQ ID NO: 25837 - DNA, 78 bp, Chlorella protothecoides
accttgcctcgtgtgggtagcctatggctgttaactcaccatccctcccctctgcgcttggcaagtcacatcgccagc

SEQ ID NO: 25838 - DNA, 111 bp, Chlorella protothecoides
cacgctgccgacgctggtgcccacgccccatggtgtcgcggtcgcgtgacggatgttcttgccctgaagcaacctcctatgtcactcctgctctcgcgcatgtgccggtgc

SEQ ID NO: 25839 - DNA, 63 bp, Chlorella protothecoides
gagcgcccatctttccattatgtgggtggatagttccgaccagtacccattacgtgccagggt

SEQ ID NO: 25840 - DNA, 105 bp, Chlorella protothecoides
gacgagctggccaggagcgcacctcagcattgagtgtaggatcgtttctatttacagagtattttatgtggtgcaagcatcatcagcgcattgtgcatggcaacg

SEQ ID NO: 25841 - DNA, 61 bp, Chlorella protothecoides
ccgacttcgtcgcggtaatgcggtggtgggggtgcagtattacgatcgtgcggtgggatgc

SEQ ID NO: 25842 - DNA, 67 bp, Chlorella protothecoides
ccaaggccctctatgcagggatttgggacagcagattagatactttaagcaacattaactccactca

SEQ ID NO: 25843 - DNA, 677 bp, Chlorella protothecoides
cctccgtcccacccccaccaccccccctacccaccatggagcaggcactgggggcagtggtagtcgcgctggtcctcattgcgtcccttgttgaagaggccgcagacctggtgcacccagcgctcgcagaggtcgcactgcacccagccctcctccacctcctcgtcattgcgccgcttctccaggtcggcgcggcgcacgctccagccgtccatctgaatgacctcggtcttgacctcggcaaagcaggggtggcaccagaagcccttgacctccaccgacccgggggtgtagtagtaggtctggttgcgcttgatgcgctggccgcaggtgaagcagtagagcgagggtggctcgaaggtcagccggttcaggccgcacactttgcacgagttctcgtcctcaaagttcggcatgtcgtccagcgtgaacacgcgccccttacccaccgcctgcgcccccgcccccttcagctgggacaggtgggtgcggatgcccgcctcgccgaagaactccagcaggctcgtcccgtagttctcctggcggtagatgcgcggccgcttgggcacctgggtgtggatgacgggcgaggagtagtccgcgccgccgcccggcggtggcggcagcgacccgctggccgtgcgcgccaccagcgcggcgccgccctcgccaccgtc

SEQ ID NO: 25844 - DNA, 61 bp, Chlorella protothecoides
agcctcgctggacacaccacaacacccgtgtaccttgggtcatgacggtctggaaggctgg

SEQ ID NO: 25845 - DNA, 79 bp, Chlorella protothecoides
accttgggtcatgacggtctggaaggctggcaccgtgaatttgagggtcgcataagcccacagcaaactgttgtggagg

SEQ ID NO: 25846 - DNA, 63 bp, Chlorella protothecoides
accagaatgctcctgccctcgtcctaaattaattcttgcatgacctgcctttctcatgatctt

SEQ ID NO: 25847 - DNA, 105 bp, Chlorella protothecoides
tgtgcactccaggtgcagttgcacccacacttcaatacatccaccaccccactacacacacgctgcccccacacacgcacctgtgcacgtaatcccgcgcaaggt

SEQ ID NO: 25848 - DNA, 112 bp, Chlorella protothecoides
tgtgagaccggagccttttaattctactcactacatggcggtgtgcacactcccgcatgcccagggtgtgcttgtaaggtcagtttgtctgtctggcttggaaagtcatgcg

SEQ ID NO: 25849 - DNA, 67 bp, Chlorella protothecoides
cgaaggcaccgcatgcccctctcatccattccccccctgtattgcaacagtcaccaccaaagcgatt

SEQ ID NO: 25850 - DNA, 121 bp, Chlorella protothecoides
ctttctcgttgttgtacacacagtttgcgtttcctccgatcaagttccctgtgaatcaagcaatcaagaaattgcttcaggggccatgccctggacattgtcttcccattctctgcctcca

SEQ ID NO: 25851 - DNA, 3024 bp, Chlorella protothecoides
  modified_base (1631)..(1887): a, c, t, g, unknown or other
cacaggcgcactcaggcattcggctggtggaattaggggagggctgggaggagagggcggcggtgaatggagtggtggggggttgggagggaaggacggcggcgaagggagtggtggggggctgggaggcggtggtccggggggagggaggcagacagcattgtagaaggtagcctgattcaccactgtagtgcagatgagcagagtgggacagtctggatctgtgcatacaccattggatgcaaacatataccccactggacacgccaaaataccagttggtacggttgtgaggcagacggcagtcgggacaccatttcgtgtgcagatgtacgggtacaggcccgagttgcagtgcaagaagccaaccacaggcgcactcaggcattcggctggtgggatcaggggagggcttggaggagagggcggcggcgaagggagtggtggaggggatgggggagggctgggaggaggagacagtggcggaagaggtggtagaggggatgggggagggctgggaggaggagacggcggcggcggtggggattgggggggaagtgatggagtgctgggagaaggggatggtgttggggggattgttggaggagatggtggagggctgagaggaggaggtgacggtgggggtgatggtggagggaatagtggagggctgggaggaggagacagcggcgggggagatggtgatgggaacggtggagggctgggaggagaggggggcggcgaagggagtggtggaggggatgggggagggctgggaggaggagacagcggcgaggtaaatggtggggggctgggaagccatgtgctgccattttgatggcacactgcccagtatatggtattcgatcggtattcctcaatgcaaacaagcagagtgggataattggaatcagcgcatgtgccagcggatggtgctacaaaaagtcccacacacagcgggacaccttttggtgccattgcaatgcagacggcggtggggacgccatctcgtgtgcagatgtgcggataacgagccccattgcatagccctacgcccgccacaggcgcactcaagcattcatcgggtgggggggttggagggctgggaggaggagttagcggcgggggggatggtggggggctgggaggaggcgacaacggcgagggaaacggtggagggctgggaggaggggatggcggcggaggtggtggtggagggctgggaggcggcgagtcgggacgttggaggcacactgcccagtacactgacgtcgacatggtcgtctggatgcacaccaacagggtgggataagcgaccccagggcatgtacctctgctcggcattgcaatctccccgcccccgcacgccgagacacctgttggagctgttgtgatgcagatggcagtgggaacgccatctcgtgtgcatatgtttgggtaaagccccgcgccgcattccccttgactcaccacaggcgcactcgagcattcaacgactgggatgagtggagggctgggaggtggaggcagtggcggtgggggtggtggaggtgatggtggagggctgggaggaggagatagcggtggggggaatggtggaggagggctggggggttggtggcacatagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattggtagagaggatgatgtagggctggcaggtggggacagtggcggggggaatagtgaggggctgggaggcggcgagacagggggttgcaggcacattgcccagtatgtggtggtcgaaagatacacctcaaagcatatgacgagggtgggaaaagcgggcccaggacatgcaccggcgctcggcaatgtaaatgttattctcccgcatgccgagacacctgctggaactgttgcgaagcaaaccgctgttgggacgccatcttgtacgcagatactcgggtaataaccctcttcgcacagccctgcggtgaccacaggcgcactcgagcaatcatcaagtgggagaggggagggtggcggagaaggtggagaagggaatggcagagacattaaggagtaaagggttgccggcgaggagggtggttgaagattgggaggtgtagtgggaagtgagaagattttgcctggaggtgcggtaggcgtgttcttgggaggagggttggacgctttgggggagagcagcgggatcacctccttgggagacagggggggtggcgccttcttgggggcgggcgaggacgctgatggttggactgaaggcagtgcttgctggtagtcctggcccactgcttggtggagttccttgaggctgcgcatgttcagacccttcccagttccaggtgcattgctgcaccgaacgctgctggccctgtcgtcatactcacagttcagagttccctcaatgaagtttcctgtgattcaaacagtcaggaaattgtgtaagagggcaaggccctggatattgtcttctcattctttgcctccaggtttaagcaatatcatacctccactgtcaccttaccaccgccaatctgctcaccaatggtccagtcgcccacgtgggagtcctcaaacctgttcttcccctgcttcccagctccggtgttgccacccttgtcagccgcgcacgctgtctgtccggtcttcagacactccacactcacaatgatgtctgtggaccgcgcttccaagaccttgaaaggtctcatctgaacggcactgactggaagatccaaggcgtccagagtggtattcctgacagagccggccttgctgtacccttgcgacctgt

SEQ ID NO: 25852 - DNA, 70 bp, Chlorella protothecoides
acgctgctttccccaaaggtagtaattcatacatttttaattcagactgctatgacttacaattgtgacg

SEQ ID NO: 25853 - DNA, 76 bp, Chlorella protothecoides
tgtgttcccttcagagtaccccttcacatccttctccacaaaaccccccacaggactgcctggactttgttcggcg

SEQ ID NO: 25854 - DNA, 175 bp, Chlorella protothecoides
gagatggccagcagcagccagtacgtctgcatgggtgggcatggttgcgatgctgagaaggggagtcgttgacgtgttgtagcggcattcatcgaccaggaaaacacaggccgcggcggaaaagcacagcccaggacacctaactccatgcctgcggcgtccatggcatcgcctt

SEQ ID NO: 25855 - DNA, 61 bp, Chlorella protothecoides
cagggtgagtggggggccgaggcaggcgggtggatgggaatgtgacgtatgcactgcatca

SEQ ID NO: 25856 - DNA, 115 bp, Chlorella protothecoides
ctgatctccggttggtcatgcgtcccctgctgttgcgacatttgtgtctggcgctcagcagcagcgtttcttcgtgtgatgctgtgtgagtcttcagcactggagatgcagctgt

SEQ ID NO: 25857 - DNA, 1945 bp, Chlorella protothecoides
  modified_base (1696)..(1858): a, c, t, g, unknown or other
atgccagtgggcaaacacacgaatgcacacgggtgagctagccgattactccatgttcctgatgttcccacaagtgttgccgcgacgatcgtcctcctcaccaaggctttcaatcattctgtgtaccagtccaagcctcctaattccatatatccggcaatgggttccatgatgaaaggtcgagaaacctgtctcccgtagacatcgtgccagctctacgattcaacacacaatcactgcgagaacttactcgttcaagtcataaagtaagcgaatatccaccgcagccaaggccttctaagaaacgttttggcgtgatttgtacaacatacaattcacctgttaatcgctagcattgaaatgatattgtgcgtgacgaactcatcaagggcattagcagtcgtagtgcttctggtgcccgagtctcacagtactggtataacaaatggagcgcccctccttatcaaacgcagttcttgtggacctggggcatcaaagcaacttactgaaggaccttcctgtgggctccgtctcagtccaagatgtaggataccatataatgggatttaaaggctatcagaggataccactctggcaactttacttgtaatggagctggacgtccttaaacgaagcgatgccatgaataatattcctggcatggaatcatgtctcgctaggaaccgaggatcaaggtgactcggaaggcaacctttatgccaaagctcttctgcctgaaatagctggtagactgttgggtatccagaggcagcaactgttcgaatctcatgaaatagctggttgtggcatggtgagacaggaagtacacagcatagactgacacatctgctgtgcacggaagaaattatgcaagcatggcccattatcaaagatttatttgagatggcacggaccctgtgcttaataagggatgagtagaagtcacgcattcctggtaagctgcgatagatttgccttatagattggctcccaggagcaggtgcatcctgcactcctgtgctcaagtcaacttcttattctccattctttcaagaggtgccagattggcttttcaatgccaaccacattaggttgtaggtgacccagccctcatggacgatggtagcgaagatttatgattccgttcgctatccacattacactgagtgctccgtgctagaaactaacacaaggtacgggtttaaactgtccagagagcgcttgatgtctctagagaggctcatggatacccatgtcaagtgtgcagagaccttcacaatcatgaaaggttgagtctcctttcccacctcttcagcagacgaacgagtctctgcgatctcacagcataagcccccaagcaacccgccatacgcttctggcaatgactgggagaacaggtctgcctgtgcatatggacagaagctgatgcccttgaggtaggcagcgattcgatacaggttccgcacaaaagagcatggtcaattgctattggcatatgtcttgatcttgtatttgcaaccacaggcattcctttatttccgactttattgcatcgctttgggaaatattcggcagatggtcatgagacactctttcagcatgatcctgtacccctatatggaacaggatcatcaaagagacgttcgtgtgccttttctttacaagacatacacgcccctgcttcatctatacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaaacacacttcagaacattattcgcgcggagaagtttcttgttttttaggtttgcgatgtacgccttataataccagagcaacg

SEQ ID NO: 25858 - DNA, 61 bp, Chlorella protothecoides
gctgaggtcaaggcatcaggactgctcgacacagccgataactgctgggacttcttcacta

SEQ ID NO: 25859 - DNA, 61 bp, Chlorella protothecoides
gggaggttggtaatggtctgcataggcggggactgagtgtaaatgggtgaaaatgtgcatc

SEQ ID NO: 25860 - DNA, 72 bp, Chlorella protothecoides
ggggggggggcacgatttcctagcgctcaggcacttggtggagtagcggggagcaccctggacaccccaccc

SEQ ID NO: 25861 - DNA, 76 bp, Chlorella protothecoides
ggaggagctgcctgatggccctgggcagagaaaataaaaatgcaccagcgcagatgtatccattctcatcctcctc

SEQ ID NO: 25862 - DNA, 97 bp, Chlorella protothecoides
agactggcaaccgcgcgatctgcttagcttatccaacctggaactactcgctccaaagtttgagcacttccaccctccctcatccccacctgcaacc

SEQ ID NO: 25863 - DNA, 68 bp, Chlorella protothecoides
gatcgctctggatggggctggggatctggggcagccttgcctgtgcacatgcagtgtgcaccagggag

SEQ ID NO: 25864 - DNA, 546 bp, Chlorella protothecoides
  modified_base (274)..(447): a, c, t, g, unknown or other
cggggcgaccgtcaaggccgcgtcattgtaactgtttttatcatatttgtgacatgcaccatagtccttgctcccatgcaagaacgagatgcgggattgcacattgccggtttcgcggaatctagcgcgccccagattttgcgaacttcttgtgggcgcgccaggatctccgtacctgcagccaacataagcaacgcacacaagcccgcttaaagctcaaggggcccattctgttcctatgaaaatcatgttcaggtgacacgcccccgctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatagtattgatggtgacgacaatgtcggacctgaagttggaactgaaaggaacaggggcttgggcgagtttgggtgctcccattaccgccggcgtgtc

SEQ ID NO: 25865 - DNA, 61 bp, Chlorella protothecoides
caaacagtgctagcgaagctgtgtaagaagatcgaaatattcactcggtcaagatcccggt

SEQ ID NO: 25866 - DNA, 80 bp, Chlorella protothecoides
ccactggcagcgttctggtgattgatgttgcgcacttgcgcgctataacgttactgctcatgggagttatctgtgcagct

SEQ ID NO: 25867 - DNA, 77 bp, Chlorella protothecoides
gccagccttcccccaagccagcccttcccctgcccgccctgtccgcacagtcgtacagcaagaacctgggcctctat

SEQ ID NO: 25868 - DNA, 61 bp, Chlorella protothecoides
ctgatgcaaggacatcagggatgtggagggtggcccccagctcccccgccaatcccgtttt

SEQ ID NO: 25869 - DNA, 84 bp, Chlorella protothecoides
agcagtcccgttgacctcacggcaagactatgagcgtcggcgcctgcacctggccggcacaggatcgggagccggtcatgtgga

SEQ ID NO: 25870 - DNA, 93 bp, Chlorella protothecoides
taccccagaaactccgcgcggtgcgcaagaaaaggcgccgtggccgggggggtcgtggcggcaggggcggcgccaccggcgagatcggtggcg

SEQ ID NO: 25871 - DNA, 152 bp, Chlorella protothecoides
gggccatagaacaagaggtgtgggagctgcaagaaagtgtgtgtagcgggtggagcattgggacatgccatttagagaacatacacggaacggccctccctctgtatgcttccatggtcagaaaaggcttcaaggatcccattcgagatttg

SEQ ID NO: 25872 - DNA, 76 bp, Chlorella protothecoides
ggggcgtgccctctgcgccgccctgcccttgtgcacgtcagtgccatgctcgcagaccagagccacccccccttcc

SEQ ID NO: 25873 - DNA, 116 bp, Chlorella protothecoides
ccgccaggtgggggttgcaagtgggggaaaggggatcgcctgtccacgagtgcgggctgctcccagggtctgcattctgtgtgacctggggcgacctctcagcaaggcccagtgtg

SEQ ID NO: 25874 - DNA, 135 bp, Chlorella protothecoides
gagcgcccacgccgctcccggggcgacacaggctcaaggcgcctccgcctcttcggcataggtgtcagcggggctgctgtgagggtcgacgccccggcccctccctcggacactcgttgagaacctcatgcttgt

SEQ ID NO: 25875 - DNA, 675 bp, Chlorella protothecoides
  modified_base (140)..(328): a, c, t, g, unknown or other
  modified_base (381)..(609): a, c, t, g, unknown or other
ccttcagttgtaggcgagggatgtcgaggctgccaccacaaagctgcgctacactgtcgactcatcttaccccctcccgacccacgcagcagctcacgcctgtgccgaatcacgcagggtccgattcgctggatgcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcccaacaggggaatcgagaggaacccagcgtgccgacacgcggaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaaagggacagcgggacgcactctctggtcaagaatactctctcgaactgcatgatcgtcactgg

SEQ ID NO: 25876 - DNA, 85 bp, Chlorella protothecoides
cttgcatctgcgggccaggtgattgtgttgagtgaactgagttggtttatttgattgatgtgtgacaggcatggctgtggcgggg

SEQ ID NO: 25877 - DNA, 74 bp, Chlorella protothecoides
ttcgccacgccgcctccccacctgcgcccctcaaaccacaggggggcggcatcgagaccacggtgctgaccagc

SEQ ID NO: 25878 - DNA, 136 bp, Chlorella protothecoides
gttgtagacatgagagctgggcagggtggggcatgcaggaatgattgagtggcattgcctcctggcagctgccagtctagaacctgatgtgcacaggatccccccttccctaccagtcgtctcacccgagacggag

SEQ ID NO: 25879 - DNA, 376 bp, Chlorella protothecoides
  modified_base (121)..(290): a, c, t, g, unknown or other
cacccggtctcacagacattgtcgacgagaccaccaggtgaggtgtgagattcataatctcggtgatgccatatgacgttgaaggtctcatttcatctcgagggactgtaacctgttgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggagctggatatggaatacgataggtacgcatgctgcatttgctggtgatgggtttttatctcgatattctaatccaaacacg

SEQ ID NO: 25880 - DNA, 61 bp, Chlorella protothecoides
tgcggccctcgccgtgcaggaagtcatacatgcgctccgtaggaatggttgcctgcgtcaa

SEQ ID NO: 25881 - DNA, 77 bp, Chlorella protothecoides
tcacagcctgccatcagcccgggacattcacccccttggcttcaactcacccagcaggccaatcatgacaagctgga

SEQ ID NO: 25882 - DNA, 391 bp, Chlorella protothecoides
tggtaccgccccatccgccgctaccgcatgttgtgagcagctgggtcactgggctgcatgcatggctcatatgagtggctgctgggccgagtacgtggctgctagattcaggtatttctgtcattctcaacccctcccccctccccccccttcatcacaggttcaaggcccacatccatccctacaactcaggcatgacggccaacgaggccctggtagcacccttcttcggacgctgccaggcctccactgccgcggtggcccccgttgacgtcgagtcggtgttcccaggcgcagtgacggcagactaagggctttgatgcttgcgtttcccagctgatgggaaccccttgaagtagtgtacgtgcctccccttcacattcccggctgc

SEQ ID NO: 25883 - DNA, 79 bp, Chlorella protothecoides
cagcgcctccagctcggcagcccggcccgctgccagctcagccgcctcagcgcgctgacgctgcgcctctgccacgctc

SEQ ID NO: 25884 - DNA, 102 bp, Chlorella protothecoides
actacgagcaaggtgagtggcatcagcctgtatacagtgagcattgctctgcaggctcagcgctgcaaaattacattagatctgtgctcacaagcccgatag

SEQ ID NO: 25885 - DNA, 61 bp, Chlorella protothecoides
cgtggacttcaactaccccgcccgccccgatgtccccgtgctgcacggcttcagcctggag

SEQ ID NO: 25886 - DNA, 61 bp, Chlorella protothecoides
ctcggcgtttggtaatacatcccgaaaccctggaaagcgggaatcacgacgacgatgttag

SEQ ID NO: 25887 - DNA, 129 bp, Chlorella protothecoides
ccacttcgaccacaccaggggccctggcttaggccccaaagctagagtgctgcaatcactatccccccagcctccccattgaatccgcacacataccctcgtagtgtgttctgcgtctagattgatgat

SEQ ID NO: 25888 - DNA, 113 bp, Chlorella protothecoides
tttcagacttggtggacacaccgccgctttggggcccgcaacaccgcacaggaacggccttttcgatgtcagcctcctacctccaggctcttgtaacgcgacatgctgaactt

SEQ ID NO: 25889 - DNA, 61 bp, Chlorella protothecoides
gcttgcccatgcgggccgcacatagtcaacacccccaactgtcaagatgcggacatggtca

SEQ ID NO: 25890 - DNA, 132 bp, Chlorella protothecoides
gcatgggggtgctatggcatagccccccccaggccccaggcgtcgtgtgcagaaccttatggccgccgcagcgggaatgtaggtttgggagcacgggcagagagttgtggcgcactgagcccgatgcagggg

SEQ ID NO: 25891 - DNA, 76 bp, Chlorella protothecoides
catcactgtctcctatgtatgcctgttttttaaggcgatgaagatctgagatcacactcccctgctcgacctggaa

SEQ ID NO: 25892 - DNA, 61 bp, Chlorella protothecoides
agaaggtaccattactgtgcagcaaaggagtttttcatattgcttgcacctcctgttggca

SEQ ID NO: 25893 - DNA, 62 bp, Chlorella protothecoides
aatgcaaggtgaaacagaagatcattgcacattcgtggtggtgatcccttgctgcagatggg

SEQ ID NO: 25894 - DNA, 385 bp, Chlorella protothecoides
  modified_base (140)..(320): a, c, t, g, unknown or other
attcacgttccgtggaggatgctgcccacgcagctggcatgcactgcgagctttgtaccagtccagcggagccaagcatgtctatctggcttttcaaacagacatgggccaaggaagaaaccactcactcttgagcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctagatcgaacttgagccagtgatgcacgctctggattgagtgcgccttgtcacacatcgtcg

SEQ ID NO: 25895 - DNA, 73 bp, Chlorella protothecoides
gcggcccttcgcgaggaactccaggccatcggggccagggagttggccctgcgcgaggaactccaggccatca

SEQ ID NO: 25896 - DNA, 66 bp, Chlorella protothecoides
gagaacaggcaactcccagattcaagaggaacatcacccctgaaccttctgtgaccatggtcttac

SEQ ID NO: 25897 - DNA, 61 bp, Chlorella protothecoides
cccaccgccatcaacgtggggtgctcgcccgcggcataccccacccagcagtacctggcgt

SEQ ID NO: 25898 - DNA, 105 bp, Chlorella protothecoides
ctgtgtttcgccgcccccccctggacccagccctcgtccccaaaaggacactctttgatccgcgcttttcctcctttctcctcacaccccaggggcgacgtggac

SEQ ID NO: 25899 - DNA, 91 bp, Chlorella protothecoides
ttccatgcttaaacgtcatcattgctcaccaagcagtgagagtaacgcccaaacctatgagacgtcatcgcatgcttccgtttaccgtgtg

SEQ ID NO: 25900 - DNA, 89 bp, Chlorella protothecoides
ggaacctgaatctgggcatccaggtcccccatctattcccccgctgagaacgtccatccgaggaagctttctactaagcaccaagcatc

SEQ ID NO: 25901 - DNA, 170 bp, Chlorella protothecoides
ctgcaggagcagggccacctcccttccagggggggttgggtgtgtgaagctcgttcctaatattctgaactgagggaaggctgtatggaagtggtgtcattgggagaaactctaccttgcaccccacaccctcacctgaggcccaggtgcttgggctccgagctggaggt

SEQ ID NO: 25902 - DNA, 61 bp, Chlorella protothecoides
caccttgactatatgagaggagagggtagcgacaggcacggaccgtggtgccgcatcccaa

SEQ ID NO: 25903 - DNA, 64 bp, Chlorella protothecoides
tttagcccctatagattcctcgtgtccatgtaggtgcatgtcagacggtcatcttgcagatgcg

SEQ ID NO: 25904 - DNA, 80 bp, Chlorella protothecoides
ctcgacctcccgtcgcccgtatcctgaacccaactcctcccagcgacaatcatcccctggaccctgttcttccttcgtcg

SEQ ID NO: 25905 - DNA, 1296 bp, Chlorella protothecoides
  modified_base (381)..(390): a, c, t, g, unknown or other
gcgggggccgcagaggcccccgccgacccggacctcctggccgcgcagcgcgccgacgagcgcgccgcgggggcggcgacgctgctggcccagacctttgcgcgcctgggcttcagcctgggcaggctcaagacgggcacgccgccgcgcctggacggtgcgtctgcctgccccgcgcggtgctcgcccgccccgtcggacgccacgccctgtggccgggcgtgggcccagccagaccccacaccccacccacgcccgccaccagctcgtcgccctcacaccaccacacccctcctcccaccgccccgcacaccgcaggccgcaccatcaactatggcgtgtgcgagcctcagccgggcgacgccgcgcccacgcccttcnnnnnnnnnnctcggccgccgtgccctttggccgggcgtgggcccagccagaccccgcacccctgcagtgcccgccaccagcctgtcgccctcacaccaccgcacacacccccctcccaccgccccgaacaccgcaggccgcaccatcgactacggcgtgtgcgagccccagccgggcgacgccgcgcccacgcccttcagcttcctgaacatggaggccggggactgggcgccgcgccagccccaggtgcggtgccacgccacacacaccagcgcggcgaccgaggcgctggtccgcgaggccatggcctcggggcggggcgcggtgtttgcctccggcgcgacggtggcgggggggggttgcgtggagccgcgctactgcccctccctggagaccaagttctcgcgcttccccggccgcgcgcaccacgtgtggctggagccggagggcctgggcacggccgtggtctaccccaacggcatctccaactccatggaggtggccgaccaggcgcgcatgctggccaccataccggggctggagcgcgcggtcatgctgcagcccgcctacgcggtggagtacgactacgtggacccgcgccagctgctgcccagcctggagagccggcgcgcggcggggctgtggctggcgggccagatcaacggcaccacggggtacgaggaggcggcggcccagggcctgctggcgggggccaacgccgccgcgccgggcgacccgctggcgctgtcgcgctccgacagctacctgggcgtgctggccgacgacctggtggggcgcgggaccagcgagccgtaccgcatgctctccgcgcgcgccgagttccggttggcgctgcgcgccgacaacgccgacgcgcggctgacgccgcgcggcgtcgccgcggggctggtgggc

SEQ ID NO: 25906 - DNA, 3084 bp, Chlorella protothecoides
gtggcaggcgatgctggcgtcgcgcgagccggtgctcagcgtgtgcccgttccaagccagcgcgccgacgcgggcggagtgcccggccagcgcgcgcagcgggcggcgccgctccgcgtcccacacctggacggcggaggaggagaggccgaccgccacgtgccgcccgtcggcggcccaggccacgctggagacgtagtcgccctcgccgcagcgcagcagctcctcgcaggcgccggaggaggcggaccagaggtacacgctctggttcagggccaccgccacggtgttggaggagccccagtccagcaggttgaggtagtagtcgtccatcagctcgggcgcgtccaggatgcgctccggctgctgcggcacggcgcgcgccgcgcggcggggcttggcgccgcccgcgccggcggcgtacagcgacgcgcagccggacacgtggccctccgggggtgcaggcgccttctgcttgaaggccagcacgcgcgaggagggctccgtgcccaggctggcggccagctgcttgcggtactcctgcggcggtggaggggaggcgcgggctggagcagtggacggacgggctgggaggcacggtggtcgagcggcaaggagcagcacaccatcatcggcaagggagcacagtcgggttggcgcgaccccgggcgctgtgggagcccgcgaccgggagcggaccaacggacaccctcaccttggcgggggaggccgcgctgtagttctcggcttcacccacggtataggaggcgatgtcgaggttgctggcagtgcggttggggatgaaccggtccaactgcggggaggagggcggggggttcggggctccgcgatgcgctcatggaccaacggtcgccctgcagagaacccgctcatgcaccccacccgccccgccattcccatgactcaccttgccagagttcttggaggtggccgcgaacttggtgggagtcaagttgcggctcggggcgaaggcccgcgagggggagtacgtgaagggagtcaccatggtcgctggctcgagtgctaggcacaagatcctcgcgatatgatagggttgggggatgggggggatgttttcgacaaacttcgagaagtcggaagagaacaagggtttggcagctcgccggagctgcttttcagccgtttgcacgcgggttgccccgcaaccgggatcaaatctcgtgccacgggatcctcagggtttccttcctcgcacgtccgctcccagccagcagctcactcactatctgatcactctgtatccacatgccaacaaagcacatcccatccatatgacgacctccccctgcccaaactccccccatcttcataggtacaccaatgaccctgccaccgagctgagcgtcgcagcgggcgagcagatgaagatcacggagctgcgcctggccaagctggtgggggccgtgccgtcccccgccaacgtggctgcgcgccgaacaggtcagctccaggcccacctggacccaccaggtgacctacattgtcgctgtaattatggcgcttgctgagctctttcctgaggtctcatgtcgacgcttgacatgcagcttttccctccttctctgaggacaccatctcttggtcctcctcttttgctgttgagaagtcaactgcctccaccctcctgcccctatgatccctgtccaagtataccatgcacacctgcaggggagagcctgcgttcccccatcaccacacatgtgctggacaccgccaggggcaagcccgcctccggcgtgagaatcgtgctggagagggccgccccgggttcgagcaacgcgtggcagcatgtgggggcgggcaagaccaacggtgacggccgcgtgccggatctgctgccccccgcagccagcgtcgcgcccggggtctaccgcatcacctttgacaccagcgagtacatgcggcggtgcagggacgaacacccggccttcttccctgccaagcccttttacccgcgcgtctccgtgttcttcgagatcctggagtctcaggtatgttggcggtggatgagctgggagccgggtgcttaatggtggaacagtagggcagcagaagcccgccgtgtaccttaaaggaggcgcaagcattgatgcatgttcaaggtagcagcctgacaccgccgtcatccctctcctcatggcaggtgaatgaccacttccatgttccgctgacatggaacccctacggctactccacctaccgaggcagctagacaggacgattaccaatgcatagaagaggagcagctgttatggagtgttcgtgtggcacacagtactgatgctgcccagttggccagcgcactgtgactgggatcctcccttgccatctgtgtattttttgccaggaggcgcacacattatgccgcctaggatgtacagaccggtggtgaattacgaagcatgacctggaaatggagtactttcctatggccctgtcctagttctcgggtgcaagaaaatggtcatgctgttcatcagcactccatgccggctatctcgcccgggcgcggaaatcgaagtcagctcggaccatcgcatcccgactcccacagagcattctccaccgtcgcctgacagtatccattgcaatcagataaccatggagtgagaacaggatgccgtctggttcgctggaaccggatcatggtgggtggcccggagcctgcagatcacttacgcgtcggtgctacgcctgtcaaatggatgctcaatgttgcgccttgaatattgcgcagacttgtggcattagagtatcacacatctcaatcttgctcaggttcaagggtccatcccctggggtcaccccccctcagcctgcggcggcccgaaggtcttcaggatgatgcagcaccccgctctccccaccagctgtcccccgtgtccagcggggacctgtccgtcgacggacgctccaatcccagtcatgcagcaaggctgcaggcggctgtgaccccccgcaaggtgcatgggatgtttgggttgcaagagaggtgtgtgggggggggggggggcactcttactctcggtagtgggtagggcc

SEQ ID NO: 25907 - DNA, 664 bp, Chlorella protothecoides
gagcagctcggtcagggggtgcgccaggcgcgcgtagtccttgacaaagcggcggtagtaattggtgagcccgagaaagccgcgcagctccctgacgttgcagggcgcgggccagtcccggacggcgcgcaacttgtcttcctccatccggatgccatcagcgctgatgacatgtcccaggaagctgacgctgggctgcgcgaagacacacttcttggggttggcgtagagccgctcccgtcgcagcgcgtccagcaccgcgcgcaggtgtgtctggtgggactccatgtcccgggagtagacaaggatgtcgtcgaggtaggcgacgacgaacttgtcggtgaactcccgcatggcgtcgttgatgacgcgcatgaaggtggcgggggcattgcagaggccgaagggcagcaccgcaaactcgaacaacccatggcgcgtggtgaacgcggtcttggggatgtcctcctcagccacccggacctggtggtagccgctgcgcaggtccagctttgagaagacgcgggcgccggcaagcctgtccatcaggtcatcggcccgcggcagcgggtaccgattcttgatggtggccttgttgagcgcgcggtagtccacgcacatccgctgcgacccgtccttcttgcccaccagcagcaccggcgac

SEQ ID NO: 25908 - DNA, 75 bp, Chlorella protothecoides
ggaggaggaagccagtctgggtgagacgtctgaggaggagtcggaggaggaggagtctgacgaggggtcggagga

SEQ ID NO: 25909 - DNA, 96 bp, Chlorella protothecoides
gaagaggtgaggaaaggtgccagttggaggtacctagccaagcgccccgcagtgtggattgaccacgccaagagcctgagtcactgctttccggtc

SEQ ID NO: 25910 - DNA, 69 bp, Chlorella protothecoides
gtgtgtgtgtgtgtgtgtggtgtggtttggtggggggttcaacctggggtgttgatgctgatgggcgct

SEQ ID NO: 25911 - DNA, 73 bp, Chlorella protothecoides
ggcgcaactgtgacacagaaaggcgaggacagactttgggaagttcccaaacatccttcccacctggctgcag

SEQ ID NO: 25912 - DNA, 76 bp, Chlorella protothecoides
gtcgcttacaaatatgggatccacaccaggagcaaggtcatattgaccgtcatttgcttgctgaagcaggccgccg

SEQ ID NO: 25913 - DNA, 80 bp, Chlorella protothecoides
gggccaagggtacacggaagtagtctgtcgtgtaagacctgacacccaatcccctctctccccgctcacatcggcatctc

SEQ ID NO: 25914 - DNA, 61 bp, Chlorella protothecoides
cccttccatggaaacatatcattggccaggtaaggctgcaagggcattgtcggtgaaaggg

SEQ ID NO: 25915 - DNA, 265 bp, Chlorella protothecoides
cagtcgagcgaagcaagtacacggcgaagcccgtcgtttgccgagaccccgcccacgtcggttcccagacgcgccatggcaccgtgagtacctgaaacgtacagtgggtgctgttgaatgaggattttggtggtgggttgtggtggtcttggccaaggaagcgggtggggttgtgtcctcgtgtgcatggacacgtggcatccggttcgtcgtctgtaccgtctgtcctcctcccgacatgatgactcagcgacgggaacccccc

SEQ ID NO: 25916 - DNA, 62 bp, Chlorella protothecoides
tgccagcgccgccatcatgcttccctgcggaagcggtaaagcgtcccggatctctcggacca

SEQ ID NO: 25917 - DNA, 18862 bp, Chlorella protothecoides
  modified_base (399)..(587): a, c, t, g, unknown or other
  modified_base (973)..(982): a, c, t, g, unknown or other
  modified_base (1111)..(1120): a, c, t, g, unknown or other
  modified_base (1769)..(1778): a, c, t, g, unknown or other
  modified_base (2022)..(2031): a, c, t, g, unknown or other
  modified_base (3360)..(3369): a, c, t, g, unknown or other
ggcagagagggtgatggttggggtgaggacgtggctggcgcaatgccggcgaatttgctgcacccacgacgcctccaggcaggtctggcatgcatctcaagatgttactgactgcctgctccatactgtttcagactcacgtcctcaagaccccggtgacacacaagaagatacaactccgagcctgcaacgcatacctggttgaatagttgctcggctgcagcctttgatcccggcttggacgcacgcacagaatcacgcctgtgtcgccttcccacgccctttttccctgcctcgtcctcatgtgggtcggagctggcgccctcagaccaggaaggccgctggctggggtccatccagtcgatgatatcgtacaagtcagctgtgtcgaggagaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcccaatcagacatggggccatactttccagggcccgggccaccgtttgcagcccagtacccgtgcttgagtccatcaaactgtctcacagccaggcaggtggctgaccagaacctggcttcggcagtgtcggctgcaggccgggaggcctgctgtgagcattcgccccgtagccaggaatcctgtttctcaatcctggagttgttgtggagagacaatgcatgtgtgggtacgaatttgtctttaaagcttgcttcgaaacgcactaagaaaaatcacaccccttcaagctctgatagtgcgggaagggcaccctcatccatcgatagcgatatccgcttcatcaagagaacagactgctgctcaccagcgcatgggttcctnnnnnnnnnntgggggtgggggagtgtcgatgacaacgcctgcctcgggagaatacagaacagcgaagctatccaccttgcccactcccgttgacagcatgcacaccacacctgcgtacacctgctcgctgtcgctgtnnnnnnnnnnagaatttgtcttgatagcttgctccgaaacgcattaagaaaaatcacaccccttcaagctctgatactgcgggaaggacaccctcatccatagatagcgattttcgcttcatcaacagaatagactgctgctcaccagcgcatgggttcctgcacagaggcgttcatgacctccacaaagtaggtgtgcatgttgtgccagttgtctctgatctcctgggccgtcaagtatccctcaaggaatcccgctgtacttcattggaggggggtgggggagggtcgatgacaacgcctgccccggaggaagtagtacagaacagcgaagccatccaccttgcccactcccgttgacatcatgcacaccgcacctgcgtacacctgctcgctgtcgctgtacagcccagaggtcgtgatcgtgagctgcccaaagttggaatctgtgtggcgacctggaatgtaggatccccatgccgctccccctgcgcagagagaagatgtgagcgtcggtggacagaaaacatactcgtactcctaggacatgcactgtttgagcagatactcctactccttgactcagcacggtgtctcaccctgcgggtgtctggagaacgtcaggttcccccccgagaagtccacgctgccgctgctgnnnnnnnnnntaccctgcgggtgtgtagagaatgtcaggtttccccccgagaagtccacgctgccgctgctgaagttttcgcagtcactggcgtttcgctgagtagtggcttcagtcgtccagactggcgcacattgacctagggaagcggctaggaggcccacgagcgcgatgaggaagggaaggaagtggcaccctcgtgcccttcccatttcggcgtgctggtgcgtgcggagatgctcactctcctcccnnnnnnnnnnttaggaggcccacgagcgcgatgaggaggggaaggaagtggcaccctcctgcccttcccatttcggcgtgcaggtgcgtgcggagatgctcactctcctcccactgatatcgacatgagaaccaagttactgccgtgcgagatcctggcggaatgcaccgaggatggggtatgtgctgtgaatgtttcggatgtgctgcgatgcccgcgcacccccccacttcttgccgacaagatcacctccaagtcggggcacccatccctgtggaagtcgagcctctgccccacccgccccttgctctcgctcccgccagacaatcagtctgagaagcatagcccactgggctgctggggccatcacgcccacccacacctgccaagtattcatcgctctgcaacctgggccgcccgcacaactcagccctcttgccctccactctctatcctcacatgcctccccctccaccctcccctccacaccccactcctcattggttgccgcttccccctaccctcctcacatcatcccctcctcgtctccccctctccctcccacacaaaggcccccccttctccacccttcagccccagagactttggatgcagcaggggttacacgcgggcatcggcccctcacgcctggtcggccttctcggagggcgcgaactcgaacgccacgtcctgccccgtcagcttcttgtacacgcccgcgaagctctccaccttgtactcgatgttggcgcggtccacggggtccaggatgaccttgagcaccttggacccgtccacgcggtaccggatgcgcttgccggagatctcggtggggtacaccaggtcgcccagccaggcgtcgtgcaccgcggtcagggtgcgggagcgcggccgcgcgctctggcgcgcgtggcgcgcggggggcaggatgcgccgcacgcccaccagcaccacgtccttgccggagaacttcttctccaattcgcggaccaggcgctgctggatcttgtggaagggcttgagcaggcggaagggcacgcggatgagcagggccttgcgggacgccgacacgtcaacctcctccgcgccggagatgtacaggtcgcgcaggtcggacttcagctccgcgttggtggcctccaggtcgaacagggcctgggcggggagaaagggggggtgggaggcatgaagcgctgcaagtgagcctttcataccagggcatgaccagagggacaggcacccaggccccggggaggatggcggtgcagagtgtggtggcacgtggctgaggcccgccctggattgtatttggccagccccctctccacctcctccacannnnnnnnnncttcataccagggcatgaacagaggggacaggcacccaggccccgggaggacggcggtgcaaagtgtggtggcacatgcctgaggccagccctggatggttattggccagccccctctccacctcctccacagcccctgtggcaaccccgctccctcccattcctcgcgccccgctcttcggcatctcctgcgggcccccacgcatcccatcccacgcatccccacatcgatcccacccgctccaaaggaccctcccgccactgcacccgacccctcagacctgggcgacgctctcctccagctcattgggctccgagccgcgctcctttacgatcttccggcggacagcagacattctgcaggccggcgggttgccacactcaacctacggacgggcgtttcggacggaggtgtgttcgccagcgcgcacatcccgaatcgggagcggctcagagtgcatggcagcctcatattggtgctccgccccgctgccggccagcacaccgcgccagcgatccggcctgggctcggtggaccagctcacggggctggcgccggcagcgggtaccctgttcccctggccatccgagtgctcccctggaactcaccctggacaaggatatggcacaccgtgagatgtgaaagggcagtgcccggcattcctggcgctttactgccaggcccagcatggctgctcgtggggcgggtgcgtacgacccggggactcccccacttactgaggtcgccctttctatcagaatccaggtgctggactgggcgcgcgcggagatcgaaatgcaactgcttcgccatcggggaagcgagaatcgcactaattcgcacgtattataatctcaccagatacctgatgcgatacgctgccttctggttcgcccggtactcgagggagtgtggtcgcctgctacggaggatgctgcgctggactttctgaagaggaagtgatcaacagggtagttgactcaccgtcgtatgaaccgaggatattcagacaagaaatagaccgaaaatctcctctggatggggaagaagcgtgccgcaaaggtgcgagttaactgagcacttgtgttggtgtatttgcatggctgactgaaaggttctcccgagtcctcccttcaaaagccaaaagcccgaatctatcgtaaacacggaacaggatcgggcctacctcactgccactgagtggaaggaggaatggggcgggcacaaggctggcccaaggggggtccctttcaagagcttgcccttccactgctgcgcgatctctttccagccctttgaggacgcggtgtgcacagccgatggcacagtcttcgacatcgtgcatgcagtgccatacatccagaagttccacaagcaccctgtcactggggagccccttgaactcaaggatctgatcaggtggggggttgaagtgggccaggggttaatggccaaggttggggtacaaattggctctgcaggaaagctcggtgtgcgagggtgtgcagcgggacggatacgccaggagcttgctggcctcattgctgccctcactgctcccggttctccctcaggctgcactggcacaagaacacggatggagagtacgcctgcccaaccctgggcaaggttttcacgccgcacacgcacattgtggccatccgcacgagcggcaatgtctactgccacgaggtgtgcatgcggggggaagggcgctcgctgtggaggcaatgatggggttggtgtcttgcagcaactttcttgcgtgccagcactgagaagctgtatgaatgtcgccagactcattgaggtaaacggtgtgaaagcctccaagaccacacactccctgggaattgcccctgcaggctgtgcaagagctgaacctgaagaccaagaacctgcgggacctgctcaccgatgagcccttcacacgaaaagacatcatccagattcaggcaagttggtggggctgaggacttgtcttgcaaggttgctttccatcacagcactgagttgaccccaaggcaccctgattggagagtgagatggtatggggacaccagacttcctgatgctgccccacgtcctacatgctcatttgccttcgattccttctgcttccagctgtgcaaactccagttgctccctgccagtgcaggatccactgaatctttccgggaagaatctggccgagtttgaccatgtgaagaaggagctgacagtggagagcgcagaggagagggcggcacgagaggtgtggaggatcttggatgaaggaagacagccgcaacctaatccaaggagactgtgcactgcttgagacaagtgtgcaatgtttgaaagtcgacccgggtcacactctccccgcaggcccagccgatgaacggcattcgagcggtggatgaggacacgcaacgcgtgctttccagcttgaacaccaaggaggccgagctcgtgtttgaggcaggaggcggcggcaggtaccttgactggttggctgtgctgagactgggaatcgggggggagggggccacgtagatgggggcttgggccacatggctggtttgatttggtagagaaccccagtcctcttcacccaaactgcacaggaaggctgaggctgagcgactgctggccaaggccctgcaggctgccacggggaagggggacgcctccaacaccgcggtcccaacacagccaggggggaccgacccgcgcctcaggcaagtgtagccactgcacatgatcatcatgggaaaccatggaccagacggtcaaggaggtgttaccgtccgagtactgttactcgcgatgcatgcgcctgtgaacctgtgttcagtcgggcacgaatactcccgcacgcacatgcgaggccgggctggttcccaccacctcccattccgcgcctgccccaggtcggctccgcgcgccgagctcaatgtgtccttcaggccgggcgccagcacgtggaacaccgacgagcccgccccttccgcgccttccacctcgggccaggctggccaggtgcgcgagcatgtgcctggctgggcagaaagggagggcgcgtgagcagagcgggctttccggcgctctctttgctatctacgggggaggtgaaagcgaggacacacagccctgtgaccttttgggtgtaaggcactgtccaagccgactcacaattccccttacccctgctcaggcccctgcattcgatgccagcgccggccggcccctgcccaagccctactctgccaagttcgtggtggggcacagcacgacgggggccgcctcacgcgccttcacctccaccgccatgacgccaggtgggtggcatgggttgcggctaggcagtgggcatgggcgccgacctgtgaggcgctgatcccacatgccatgcgccctcccggggctggaagcaaacgataacctccgccgcccattctcgccgcagtcacccgcaacgagcgcaccatggagctgatagagctgaagtcgacgaagaaggggtgagccttgcagtcggtgttcgttctgggactttgcgagggcgaggaggccccgggcagcagtcatgggcacatgcacgtgggtcaagcagcctgctcatgaccacgaggaccgccgggcccatctgtatgtgacacgctgatcggcacatcgctcgcgccacggcatgggtctcgatgcagggattgacagcgcccacatgcgccccgagcaggtacatgaggctgcacaccagcctgggcgacctgaacctggagctgcatgctgacctggcgcccaagacctgcgagaacttctttgccctcctggaggggggctactacacgggcacggccttccaccgatccattaagaacttcatgatccaggtgggttcctggaaggcggggcagaggtcaagactttctgtgctttggctggggatggtcgtactccagggcaccggacgggatgtgcgtgcagaaactctggccgtcttacgagataccaggttgtacccggcctagatcctgctcatgtagacctgctaggatgcagcacaacgaattctttccatggtaatgattcacaacacacccactgcaaatcagggtggggaccccaccgggactggcaagggcggcgagtcggtgtttggcggaaagttcaaggtgaatacgccctggtctgctcagacggccacggatggcaaggacggggcgtcgctagactgcaacgcaccgtggcatgtttcatcaaggtgccattcaatgcccggtgcctgcgccccgccacacctgccaccaccccacactcgcaggatgagctgacctcggcgctgctgcacagcgggcggggcgtgctgtccatggcaaactccgggccagggaccaacggcagccagttcttcatcctgtacaagtcggcgcaccacctggactacaagcacaccgtgttcgggagggtagtcggaggtgacaggaggagcatggggtgtgcagaagagctgtgtgtgggtgttgctgagaccatgtgtcatcagttggtctcagtggaggtggagtcaccatgatccgcatcccggcccacaggcttcgagaccttgacgctcatggagaaggtgcccgtcgacgacgaggaccggcccctccaggtgggcacgcgaggggtgtggggagtgatggtcaggaccggcgagggggcactcgggacagatggaggatcgcattctgcatgtttgccaatcaattctcaggccatccatgttcatcgatcacatccatgcaacttgcgcagcccatcacgatcacgggagcatctgtgttcgtcaatccctacaaggagttgctggaggaggaggcaaaggctgccgccgccaagagcgctaccgtgagtattgagcgggtactgcattggcatcaagtgcgcctgccctgcatctggctggctgacaaggccgagcctcattccaatcactcccacacactgccctgtacccctccaggaagccaaagaggctgcacgggagacagaatcagcggcaccgatacagcccttcttcgccctgccatctgccgacgatggcgaaggcggggtgggcaagtacttgactgccccggccggcccggctcggggcgggggcacagctgcacctaaaaagcagaagacagggggtggctttgcaaattttgatggctggtgatctgcagcggctgcgttgtctgtaagtaccaggtgcaggagcacataacgtgaatccagcacgaccctgtgaagcccactctaaatgctgcttcgcatctgtactgcattcccaaaagcttgcgaggtatctccgctcgactccccgtgttcttccggtgggcatggaggtacagcctcgacaatgtgtttgcttcgcagaaatgcattcgtcttttcgcgaacccttctccttggctattggctgtacgccgctttcattcgtaccgtgcggatcttgcaagcaatcgacgtcatcctgaaactccccacggaacatttcgtcccgcatgtatggcaggtcacacccaccggtccatgcgcttgataatgaatcctaatggggcctttaccgcgcacatatgatgcggtggcatgagaaatcacctttcgtcttcatgctcgggtacgagcgtcgagcgcgcaagcacaggcagacatcatcatctccttgctgactcacagaggtctggctcgcgaagtcggtctgacggaccatgcgctggcgctttacgatcttgagtcgactgtactgctctaaagacgttgcatgaatctgccgcagatgctcctccacgaatccacgctgtcaacgcgcatctgcgcagcttcaggtggctactaaatatccggcacggctcactgtgaaagcatcttgagaacagaatcccttcagataacaagatagtattgaaatcttgatccttggggcttggaatagctccatcatatacctccgaacctttgcggattgggtttacagtctcggcaggctccctgattagattacgaaaatgaggctgctgatacttcttggcatgttcatgttggttcatgttcacgcagcaggacagtgtgaaaaggaggacgatccaggttttgatttcttcatcctaaacaggtaatgcgcatctgcatggtcactgacggggttgccctacctacttgtcgttggtacggaaagagccgaaactctcaatatgacctcccgcgcaggcaatggggccctaattactgtaccactaccaaatgtcccaaaacagcatagtaagtgactttattaggcttcaatacacggtgattcgatctcgaagagcaagatggggttggggtccctgctggaaggcctcgttttctttgatgtcgtcttgttttatagtgggcgatccggtaatacaatccctttgacactgctgtatactgaaccacccaccacctcatcaatttcatagcgaggccttcaccttacatggtctgtggccacagtacaacaatggcgggtggccccagtattgtgactgctatgacgtgttctcaacaaacaatcttgcaaagagcacaagaagctccatggcatgcaactgggtcagctacaaaggtgcgttagactttcgttttgcagccggtgcatagcagggacagtgctgagggattgaaggtgtgctgatgtggcaagactggacgggctgccggtcccttggtgttgcagcaaggcgtaaagccgttcattttggcttcaggaattgatgcacgatgtacggatctgcagcatcctccctgtaacctttattctctatgtcaggatctgattcaagcttctgggatcatcaatgggagaagcatgggacttgctccacggatgtgcttccaagccaggagaagtacttcaacaagacgctcgagctggacgagaagtatgacatcggcgtgagttactggatggttgagttgcatttctgaactaaaagggatggagggaaggcatgtgagaatctcagaccccttattttacaaggccgcctgaacctgtgagggattttcattgagcgttcagcctccagtgcaacagagcatcctaccttacagcatccgtctcttctcacacaaaaacccatccttgcacagactgccctgtcgaatgctgaaatcgatcctcagactgacaacagcgtgaagaagtcggatatcgtggaggctctcaccgctgcttttggagtagctccgacccttaaatgcagaaagaacaggtgagaagtcccggaggcatgccaaactagatcagggtggagccgttcctagtttggtgatctggggagtatggactttgcatttgttctgccaaaagatttaatgctgggtcattatgtctccgctcattaataggaacatcttagtggagatctggctgtgcttcaataaggactacacggtcaggtcctgccctggtaaaacggcgtcaagcacatgtggagattggttgtacttcgaaagcggtgatgaggtgggctgatgctggactaccagcgggagggcatcgtgctcagattcagtgctattctgtttggaatttgtgtcacatggatggcgtcatgattgggtggtcaaatgactgaacttgagaatctctattgtctgcacttcattcatgcgaattcaataccctgtaccaacagatccccgacagctgtctccaatacttgccctgaagaagcagccgccaacaggcagaaacgaaggcctcatctgttggattgagggatccagactgtcagatttataagtactaaaggtgcctgcccccctaatacatgtttcctgaggcttacacatacccacatgattcctaatgtttgcatttagctagactagtacctctttttactctttgtgagtttgccagaggtgatccgagatgattgtaatatatacacacacttcaagatgcattgcccactgaagatttttataaaccagatggatttcaacgccacttccacagacccttgggctttgtatcacttcgtttgcacacttgacacaccacacatgatgatcatcattatgatgcaagagtctacaggtctcaacaatatagacttgcgagcgtggcctcagtgcttcgctctgtagcttaacattgacaagctctttgtgtcaggtatgtgagtcttggtaataccctgcttatgtctagaggtagatgtctagatacttaccatgtgggctatgaccccttactccgcagtcagacacgatgcatcagctccttcgtatgacagaatatcgtgcatgtccaatgctgagcataaccaagctaactgctgggatgcaaagaattcaacatctttaccatcgagggggcacagcattcgagcggtgcgcggtttctgtccctcgacttggggcgcgaatggccactttcactgtcctctcttttcctcctttcgaaagatgaagtgctgtgttcaccatcaatagcctctgacaccattacgagaccggcaactcgcatcaggaggccaagttggctgcgcggggggcaaaagcagcggcgtcgacataatttgtcttcgccctgccttccaacaacgatggcgaggggaaagggcgcaagtgctcgtccgcacagagacgggtcggcttggggggaaagacacgttgcacccaagaggcaggaatacaggggcgcccttgcagacttttctggatggtgtttcccgtctgctgcgttgtctctgaatgtgagggacacgtaatggaaatggggcatgacctcgtgagcttgcgtatctactcctggctcacacccgtaatctgtccaacaaagtgtgcgaatagtctgcagccgagtcctcgtgtcccgtcataggacaaggaggcacagcatccgatccccgggcgcattgccggaaatgcaacacgcctcgtgtttgagaaatggtggtggtgagcttccgttgcaaccgtgtgagatcgacgggatcatgagattcctaccataactacgcgacactattgcggcatagcacatccatcagaccaatcgctcccaccactgacacgactcggggtgttgccacgtcgcgtagtcgcatcctaaggggtatggcctcttccgtctgcatgctctgggacgcgcgtcgagggcaacaacactggcaaacacaaacagcatcgtgcggaggcatggagagcaggctcaccaagtctctctgataggccacacaaagatactgtacgatctcaaatcgactctttggcgtttcacagagttggtgaagatgctgcagattcgcccctccatgaatccgcgcaaccgcgcagcttccggcggccctgaatattctgtaccgctcgcctccattggcatctggagaggagagccatctgggaagtcaacatatcttggggttgttgctgcttgtggcctccaaaggtttttagtgttgcacttgttgttctgcgagatgggttcgcaggcacagcgggcaccctccttgtccacgatgagattggtattgctcctcggcctggccatgctggcccatggtcaagccacccagggcttcgagaacatttccgaaccagggatggacttcttcattctcgtcaggtgatgcatccctgtagtggtccctgccattcgcacacctttagtgccggaggcacggatggagccaaacccgaacctcttccgacgcgcaggcaatggggacccgccttctgctattttggcgggaactgtacaaatgaagcctagtaagtttcatcccaagctttcattgagtgacggcgacatctcgcggggtcggacgggatttgggtttctcgtcggaaggctgccgtcaagtctgtgttggcgggaaatccaaatactctgtccacctgctactgccgggcgcccagccacccctccatccgctccactacacagtgagacctttaccatccacggtctgtggcccaactacaataatggcagtcacccccagttctgcgactgcgcggatcccttctccctgcccatgctgtaaaagaatctcactagggccatggactgcaactggcctagctacggaggtgcgcttgacgcgcgcaccacagccagcgtcgaacaaacaccatgttgctggattgaggctgtgctattttggcttagatttgggggtggacggctgccaatgcttcagagtggcaagaagacaaaggaggcatgcattccagctttgggagatggggctctgggtgccaacctgcaatgtcctcaagttcactaaatcctcggattgccaggggcgaactcaggcttctgggcccacgagtgggacaagcatgggacctgctccacgcccatcatcacaagccagccagaattctttgagacgacgatgaggctggacaagcagtatgacatcaatgtgagttgccggatggcgggaatgcgttactgaggttagggagggagggcaggggaggatgtcagacccctggcatcccaaggtggacatactttgtgggtggtccaccataggtcatcggagacctgtgccccagcaacacagcacctcaacatacacatgtgtctgttctcacacacatatccttgtactgctcagaaagcgctgctggctgctggaatcgatctccagaaagagatccgtgtgaagagttctgatattgagaccgccctcaccaatgcatttggcgaagcacccgtactgcaatgtggcgagaacaagtaagatgggccgctgccatgcatccagcttgcttgcaggctttgctgagaccgtggtggtgggacctcatcggcatccacgatcgcagcatcagtaccctgcgtgctgtgcacctgctccccacgcagtgacttcaacgacatcctggaggagatctggctgtgcctcaacgaggatatggagatccaggagtgccccccgtccacagcttacagcacttgtgacgactatgtcttcttcgaaaggggtgccaaggtgggcaggtgctgggcagttattagagggtatcattctctgtgctgaaataacaacctgctgctggagctggactgtcttgggatagcgggtgttaacagtgagagtcccagaattgtgcatcacattgctgtgctctcaacacccctccttgacagattcccccaaagtgcgttcaagacctggtctgagggaatggcaaagctgcccaaaagcagagttgagagccctcgatgcaggaactgtagatgcaaagttgcttccattagaccacccaggataaccccgaccgccaaatgcttattgttgatgggttgcacatacccacacagtctcaagtgtagaccacccgtgaccagctgaactgaaccccttttgacccttgcggatagaaataatccatccctccgagaacagaccttgacgattgcaataaccacagttcagggtgcattgcatcaagtaattgactaacagcaggtgtgttgacattcccatgcctaagaggctggatccagcttgccccgatgatcaccttgtatgtttctgcctgcccaagggaataccacaaggaagggctttgaaggaaatgggtcagtccgagggtctcgacagcataagcatgagacctctgcatgggggaagctcacccactacatacgtggctagcatcaaacggcacaggctcagctcagttcctggtgctgccatgcatgcacaccacattgtcgtggagatgcaggatttgtcggatcttcataatcaggtgttgccctgcatagactagtaggaaggaattcagaagcttggcaaggagcgagtgtccggctccatgcgtgttgacgtgagtaccgatctaggatagaacgaagagctcagctgagctatggaatgcagggttttccccctcgaacgaccagcggaatatttttagtttagatacctggagtatgtaacgaggacagcgaccccttcatcaccatgcccaaacacttccttatttttgctatcgccttgttgctaggctacgggaccagagaaatctctggcaacaccgaccctggcttcgacttctttttgctcgtcaggtaatgttgttcctggtcggaatagattacgagtcaggcgacattgcggtgaacgagagcgcattaggccagcaatccccacccccaccacaggcagtggggccccgccttctgtagccagactcggtgcaacagctctcccgtgtgagtaggtggcatccataccatgtttctattgagtttccagctgattaatggggtcagacgtgttccacaacatcacgatcgaaaggggatgagacggagctccgctactggccctcgacatgcattgaaagagctagctttcaccttcctttcatctcatccctgaaacgcacagtgctgccttcaccatccatggtctctggccccagtacgagaccggcaactcgcctcaatcctgcaaccccaacgacatttttgcaactacaaacctcaaccagagtctcatcaactcactggcatgcacatgggtcagctacacaggtgcgctgagagtatggggaagttgggctttctgcgccttgctgtggttgaaggacagggtagcctcgagctagcgctgaacttttggctcatggcttggtattagggggcgtgtgtacactcaacctgcagtatgcatggatgatcaaggcaccagaagggcgtacctctgcaagcatggctgccgtccttggaggccctccccttaaaaccccctttccagggtcaaaccaggagttctggtcctacgagtggagcaagcacgggacttgctcgctcaccctcctgacaacccaggccgagtactttggggctgctgtcaacctcaacacaaagtatgagatcaacgtgagtgtggggagcgagactcccttggtgtgctttgcttgcatctgcatggctgggtcacagccactgggcttgaaccctaccaacagccttgcagccccagtcttttcaagtatggcaatgtacaatgcccttcacaggaggcactcctcaatgcgggcatcaacccccggaccgcgggggggggccccggcagcgcttactggatgtcctgaccagtgcctttggggaggctcccgtgcttcgatgcaaccagcaggggtgaggggaggggccagcaatcttgttggtctgacgtctgagggtgcaagacgtcctcccatgctgactgtttgtttgagaccagaagttttctcccaagcctgttgcccactgtcgaacctgctcattaaatgcctggactccgcaacaggaatgtgctggaggagatctggcagtgtttcgacacagaccttcagatcatgccctgcccccggtcggtgtcctccagccggtgcggcagcagtctgaccctgagaaccggggaaagggtgagtaggagtgcttggcagggaaaggggagggtatttcctctcagtgtgggtagtctaaggggttctggaagcatgtgaagccttgcaggctgcagtgtaattggtttggttctcctcacttcagatacacacgcttggttattcaccttccatcctgcaggtgcccccagtgtgccgtccttactacgacttcacccttaatactgctgctggaaacagtggttgagacaagctacatgcaagtctggaggtagaggacaatggccacctttccagatgggcaaagcatcgaggttgccagtataatgccccctcacgagatcccatgaaatcgatacaccgagagatcgcgcgcgcgagcgagggttgcaacctgtactcttgtccatcgcagcaacctgtgcatgctcgtaagccactgatatatcacctcgacgtggtctgattgtgcacagaccagaatggcaatacccgtatcgcgcgaaacccttctcacgtgctgccactctggggcatgggcagacgcggtgctggccaagcagccgttccagagcatggaaaagctcatcgagggtgctcgctcagcctggtggaatgaggtgcggaggcgatgtgagatgcgaccacctagggcttcaccccatgtgctcatgctgaggctctggccatcctgcccccctccccttcaacagacccccatcacgggctggctggaggccttcgccgcgcacccccgcctgggggataggcgcggcctggctcagaggtctggcgccttctctgacctgagccgcgacgagcagtcctcggccgccggcgcggcggaggccaccctggccgcgctggccgactggaacgcgcggtacgaggcccgcttcggccacatcttcatcgcctgcgcggcaggcacgcccgccgaccgcatgctggccatggtgaagcagaggtgatgctgggtgtggtttgtttggctggcttttgctgatgggggggtgggtgggagcgagagggatccctcagagcaaggttcgtgatcgcaggggatcccgccgatggatcacgtacagctcgacgcgtgggaagtcccctcacagctaggaagtggccacaccagcgcgccccgccaaccagctgcgcatggcacggccccgtgcccagacacatcgccagcccagcgccgccatgtcggtcgtgccatcttccagagaaccagtggggcgttgaggaacgccgttggttcgcggcggccctttcgggcgcgcgcgcggacgggaacccctcaacgacgacacaggcatgcaggaaacagcaggaggatgagctcggcgccaccggccggccaggtgcgtggtttttttaaccccggcacggcctcatctttggggcacggatgaatcgttcaacaccctgcactcccgacccctccgatgtgaaagtctggcctcacacatgcatgcatgcacccacccccccgctccagggtacctgcggtgaggagcggatgcggatggaacatggctgccccccccccctcccaaaccccggccactgccccaccaccccttcagcgcacgttgacgctgcggaggagggaggagctgagccccgcggtggccttggctgccgccggcgcggcgggcgcggcgtcgccgaagcagcgccagaagcgcagcgtctcgtccgcggccgcgctgcagacggtggcgccgtccggggaggtggcgaggtgcaggacgcgcgaggtgtgccccgtcatctccgccaccttggccatggtggggtacttccagaggcacagctggttctgggcgaagccgtggctggacaggatctcgcgctcgtgccgcgaccaggccagcgcgcagacctgggaccccgtatccacgctgttcaccagcgcgcctgtgtgcgtgttccagaacttgatggagccgtcggcggtgccgccgccgctggccagcaggttgccttggaaggggcaccaggccagcgccttgaccgccgcgcggtgcgcggtcaggcggtgcgcgggcgcagcgcccggggccgcgcccg

SEQ ID NO: 25918 - DNA, 115 bp, Chlorella protothecoides
gcaggtgctggtgccacctgaagggtgcctcatcgcatggcaaggttgcctgaagcgctgctccaaccgctccctctctccctccttcatcagaacggtgaagccatgaccttgg

SEQ ID NO: 25919 - DNA, 62 bp, Chlorella protothecoides
tgtgtgtgtgtgtgtgtgtgtggacagggggtcctggggataatagacacaggctgacacat

SEQ ID NO: 25920 - DNA, 893 bp, Chlorella protothecoides
ccccccccccccccccccccccccccgggcgcacagaccacaccagaggcattcggccggagggtgcaggcgagccgtgcggcaggctcggatctgccccccgccgtcggcatcgacggcgtccagtacctgcatgtgaaggtgaaccctgtcgaggagagtgtaggatcttcaacagacaagaaggctggggtggccttgaattcctctgatacagatgatgtaacagaccgtgacacccttacttcctgcttctcagcttccagctcctctccattttttccggactgtgctcagcccccaaaccctgccccaccccaacctgctccgcctctgccccacccctccaggtcggggacctgctctgggtggccaccacccgggttaacctgtccccctccctggtgtccgaactgctcctccgcatcaccgtcatctgccgcgactactttggccaggtcacggaggagtgcgtgcggcgcaacctccccctcgtctacgagctgctggacgaggtgatggactacggcttcccccaaaactcctccaccgagcgcctgaagcagtttatcgccatccagccccaggcggcgcgcagcctgccccccggcgtcaccggcgtggcggggggagaggcctttgaccgccccgccgaggtcatcaagtcggtgctggacacgtcccgcacaggtgggatggagtgggggtgtgcagtcgagatgaggggaaaagtgggggctgggggcgatggcttgacctgcgtgacatggaggatgtgtcgaccctttgtatgagtgccgcacgcctgccgcgtggcacgcgacgcgaccaatcagacatccctgtgcgcttgcatggtgcgcggcgccagtgcctcgcgccgcccccccccc

SEQ ID NO: 25921 - DNA, 64 bp, Chlorella protothecoides
tgggatgcaggtgggggcaggaaggagcccctgtgctgtggggcaggaaggccatgaatggctg

SEQ ID NO: 25922 - DNA, 74 bp, Chlorella protothecoides
tcatctccgccagaaatggcggcgcgaaagatgctatggttttcagcaagccgatcaccgactggactctcatc

SEQ ID NO: 25923 - DNA, 87 bp, Chlorella protothecoides
tgtgcaccgaagtctggttcagcttttcgcgcatccaccaggccccagatattgacacccgccgaccgccaccctaccgtaggacga

SEQ ID NO: 25924 - DNA, 64 bp, Chlorella protothecoides
ccggcatgcgagcatcgatctccatcccccaaacctcaatgcagggcactgcacactccctcgt

SEQ ID NO: 25925 - DNA, 61 bp, Chlorella protothecoides
gcggatgcgctccgaccggtcccccgaccccacctgggccttcctgtccgcggcgtgcgcc

SEQ ID NO: 25926 - DNA, 206 bp, Chlorella protothecoides
cgcggccgggccaggcgcgtgcgcctgtgtgtcgacctgaatcgtgacgcactgcgtcgtcagcggccgccgatacgcttactgattttgcattggttgccacatctctggaaaggcccacaggaagcccctgtgaagtcttctggcccgtcctgatgtgtccccccaaccccgggcatccccagcccggcatccctcagcaccca

SEQ ID NO: 25927 - DNA, 66 bp, Chlorella protothecoides
ggggtggggatggtgatgatgggaagaggggggtgtgtgcaagaaccgtgctcaggatggactggt

SEQ ID NO: 25928 - DNA, 80 bp, Chlorella protothecoides
cgcacgctcttcccagctgggaaacaaggtaagcgagtttgggtgggaggggtaggggactgccagccccacagcccgcc

SEQ ID NO: 25929 - DNA, 113 bp, Chlorella protothecoides
agtcgagatcgatctgagccagggcgcgacctggcatcaacacctgtggagcctaaagacccaaggaccggacagcgtcaccgccttccacctcgtgaacggtcatggcacac

SEQ ID NO: 25930 - DNA, 61 bp, Chlorella protothecoides
cattccttggcatgtcgagtctgctcccaatcccctagacatccgagcccctccccaacaa

SEQ ID NO: 25931 - DNA, 76 bp, Chlorella protothecoides
agggtggagacactagaaaatgaacgtcttgagctgggcgcctacctgcaggagacgggccagctggatggtgaag

SEQ ID NO: 25932 - DNA, 80 bp, Chlorella protothecoides
ttgcgcacccatcgcccgggctgtggcagtgctggcgctgcgacagctctccaggcggtgagaagggatgtgcagcggtg

SEQ ID NO: 25933 - DNA, 101 bp, Chlorella protothecoides
gagtaggtgcagggcagggatcacttgcctggccaagcatgcacgacactgagcaggccttctcagcagcactcacccaggcgccgggtgatgatgtccgc

SEQ ID NO: 25934 - DNA, 61 bp, Chlorella protothecoides
tcaggtgatcaatatggtgggtgcttcgggtgtgctgcacctgtccaacacaactctgcct

SEQ ID NO: 25935 - DNA, 73 bp, Chlorella protothecoides
gacaccagtttatgcatcaacaagtgctcctaaagagaagggtaatgttttctaccacccggaacctacatgt

SEQ ID NO: 25936 - DNA, 80 bp, Chlorella protothecoides
gcttcctgtgggcgggtgcccgatggtagcgggtcaggcgtcgctgtgaagctcctcggcatgtgttctgatgggaatcc

SEQ ID NO: 25937 - DNA, 61 bp, Chlorella protothecoides
accgaaatcactgctccgagttcagacagttcctgattgcggatggactgggtgggaagct

SEQ ID NO: 25938 - DNA, 61 bp, Chlorella protothecoides
tttcagacttccggtgtacgaaaggaaagaaccgcccgccgaggatcccgcacatggggtt

SEQ ID NO: 25939 - DNA, 116 bp, Chlorella protothecoides
ggtcgtctgcggagattgtgtgtgggggggtggagaatcgatgggcatgcacttgtacatgtgtacaggaagggatgctatacataagccatgcgaaagggacctttgcgtgcatg

SEQ ID NO: 25940 - DNA, 74 bp, Chlorella protothecoides
ccgctctagaggtgcttcggtaccaagaaaaattgtatcgtatagaagcccgtgatcaccgcgttttcctctgg

SEQ ID NO: 25941 - DNA, 71 bp, Chlorella protothecoides
agcatgtcaatcgacgccacccccatggaagcatcggcgccgcctgctgacgcctcacaacctggccctcc

SEQ ID NO: 25942 - DNA, 229 bp, Chlorella protothecoides
ccggggtcaaacatccagagcgcgggcatcgcctcggacaccgcctcggcgtgagttgtgcatgggtggggggtgggaattgaggatggggatcggggaatgtgctggctgggttcaggggagtgtgttggatgcgaacaaccaagggggtcccggggctcagtgcggagcgacaaaggaaaggtgaccatcgaggcggtgcacgctcagcctggaaagcatgggtact

SEQ ID NO: 25943 - DNA, 79 bp, Chlorella protothecoides
gctgtccccaggcctggggtctgccccacaaaactccccaccacagaaccaccccccacctgccgctgctgtcatcgta

SEQ ID NO: 25944 - DNA, 123 bp, Chlorella protothecoides
tcaggactgaatcctccacatgcatgcgcgcctccttccatcttatccactatcactgtgctttatcttcaggaaggtacctcccggcgctttaccatgccgcccgcagccgaggtggctgca

SEQ ID NO: 25945 - DNA, 75 bp, Chlorella protothecoides
attgctcgaggagctcagcaccacccaaatgagcgggccctttttatcccacaccaccccactcctctattcaaa

SEQ ID NO: 25946 - DNA, 73 bp, Chlorella protothecoides
ttctgagtccagagtactggtcatcagtcctggggtgactgggcgacgggtggtgccatggccacggaggagg

SEQ ID NO: 25947 - DNA, 97 bp, Chlorella protothecoides
tcctgcagagccggagttcagggcttaccatctgctctccctcatggctcagcatggcaagtttaaaggggaccagcaggccttcctcgccaccttg

SEQ ID NO: 25948 - DNA, 80 bp, Chlorella protothecoides
tggccgcaaggaggcgccgcgacgaggtgggactgggggagcgacagagtttcgcccaggcaccgccggcaacattgcca

SEQ ID NO: 25949 - DNA, 68 bp, Chlorella protothecoides
caaagctcagtccaaggctgaaggtatgctgggatcaaaatgcgagttcgtgtgggacagggtcggcc

SEQ ID NO: 25950 - DNA, 70 bp, Chlorella protothecoides
aatgcgagttcgtgtgggacagggtcggccacccatcggtggtcgggaagctcacttgcacccatgcccc

SEQ ID NO: 25951 - DNA, 76 bp, Chlorella protothecoides
atagactcttgctctcaccgatacacgctgtgcgcaggagtaggaaggtggtaaaccctgctcacccgctgagcgc

SEQ ID NO: 25952 - DNA, 142 bp, Chlorella protothecoides
ggattccgtggcatgcggatcggtgcactgtcgtctcgggcggtcctggcatccgttgagcgggtcacgggatcatccgacaggatgtggctgtcgctgcgtggggaacctacgccgcggggcggggtcacgcactgcatct

SEQ ID NO: 25953 - DNA, 414 bp, Chlorella protothecoides
  modified_base (115)..(342): a, c, t, g, unknown or other
ggcacgccccggcacgcaggtctcggaacacaagactcccactgccgtccctcacacgccccccctctcccacgccttcccctgccccggcccacctgccggcgccggcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcgggctgcttctgatcaactacgtggcggccccccggcctggcagacccctgcacctcactccctcct

SEQ ID NO: 25954 - DNA, 79 bp, Chlorella protothecoides
tccgatcaggaccattgcgtgatggtttcaaagcatatgggattcctcatggccgatgggccagcaggaaggtcgtccc

SEQ ID NO: 25955 - DNA, 157 bp, Chlorella protothecoides
cccattgcaagttatggcatgcctcgcaccttgcgtccagtcgcgtccagcaaagcccccaggtccccagtcctgcatggccacacatcgccccgtctcaccagtaatttgggatgaatagtgcatcgcctgggtgcaatacagccttcactgcctt

SEQ ID NO: 25956 - DNA, 1375 bp, Chlorella protothecoides
  modified_base (415)..(454): a, c, t, g, unknown or other
  modified_base (990)..(999): a, c, t, g, unknown or other
  modified_base (1121)..(1320): a, c, t, g, unknown or other
ctgccgtgtttgaccaggactggtcgctcttccaagacattccgtgagtgataccgtctttccagggtcttgtctggcatcataacacgcagcggacgagtaccatgctggtaccccatctctgcgccagcccacaccgctgtgacgctgccgcattccaccaccggtccccacatcgctcccccataggcaatacaccaccacgacacagggcgcgcggcaggggtgctcccacaccctggctgtgctggatcgagcacagggtgagaaggggatgtggtcatgggggttgggctggcgctagggccggagcagaggtggggtagaccttgcatccacctcctgcgcccgacactgattcatggaaagggcatgaggctgccagtgacaatcccgggctgggctgcaggccacnnnnnnnnnnnnnnnnnnnnnnnnnnnnnnnnnnnnnnnntctggcccaccctctatgccgcagacttctacgttgtggtgaacccgatgacagacttcgacatttcaggccagggggcaaatttcactgggaaggcatcagtcaccataacaaactcgtccctgagccaggtagaccggggcatgcaggccaagagggggagaggtcctttgccttcctgactctccatgcactgcagagtccctccggggcggcgtcgcctgatccgtgacgcccaccaagacctggatgcagtgcttgagcaccagagccccttcacgctcctgcagcaaaaccctacctccccgccctggtccagatgctggagcacctcatggcgaacaacatgatccaagagatcacggcgatgcctggccagaccatcgcaaaggtgagcagggtccctgagagtcccaggggtcgtcctgtcatgcagggtgcagccagccggctgatctggcacctgcttcgacttgccggtaccagcagccggcagcctaagttcgcagcgagagtggagccatgcccttgccttnnnnnnnnnntaggggtcgtcccgccatgcaaggtgcagccagtcggctggtctggcacctgctttgacttgccggtaccagcagccggcagcctaggtttgcagcgagagtggagccatgcccttgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggcgcgagggggaagcgactgccacgcaggcatcttcctcaaatctggtgta

SEQ ID NO: 25957 - DNA, 69 bp, Chlorella protothecoides
tggaggggcagagtgaatttgccgtgggggtggtttcccggcaaggcgcacaaatggtgatcagcatgg

SEQ ID NO: 25958 - DNA, 76 bp, Chlorella protothecoides
tcgtgcgtgctgcgctgtgtgctgtgccctggctccctcatgtacaccttgctgctaatcgaccttcttctatcag

SEQ ID NO: 25959 - DNA, 61 bp, Chlorella protothecoides
aggtaaggagagacggtctttcaggctgggtgagggctgggatggacgctgtaatggtgat

SEQ ID NO: 25960 - DNA, 67 bp, Chlorella protothecoides
cacttttgcaccgaccggatcgaccgtgaaatatagcgttcagaacgtcgtgagacagttcggtcca

SEQ ID NO: 25961 - DNA, 80 bp, Chlorella protothecoides
tgtctctgtgatggggacacctcttcaaaatttcaaaagttattggccttctgtgcgtcgctctgtttgcagtcagaggc

SEQ ID NO: 25962 - DNA, 85 bp, Chlorella protothecoides
tggcagctgcggtgcacggtgctgtgccattatgtctgtgggggcagcatgcttgtccggtgtgcattccaggcctacacaaaca

SEQ ID NO: 25963 - DNA, 196 bp, Chlorella protothecoides
tgccctggtggtccttgtgcaaagcctatgggagcactccccagctgggactgttgggctacagtggccatgccaacccacctggacaataccttgcatgtggcgcagccaacgcccatacacgtctgcgggtaatgtggtggcggaactggatttgattcttcaaggtagccggaccgtgcgcatgccatgctcg

SEQ ID NO: 25964 - DNA, 80 bp, Chlorella protothecoides
ctttcctgtaacataagactctgacaggacgaatccgaaaattgcaatgaagctcttgaacatgccgccgctggccacaa

SEQ ID NO: 25965 - DNA, 161 bp, Chlorella protothecoides
ggctggggctgggagatgggctggggctggactggctgcagtctggtgccgtcgttcccacgacgtttcctgcagagcctgtcagctcaatgactccagtcccacaagcaaatcctgcttcagagttggcggagccaggtgccgtagaattgatggctccc

SEQ ID NO: 25966 - DNA, 66 bp, Chlorella protothecoides
cggcaggcagcggctccgcctcttccgtttgggtctgccgccttcccatgcccgcatgcaagccgc

SEQ ID NO: 25967 - DNA, 61 bp, Chlorella protothecoides
gaagggtgtgctgtacaggctaggagggggtgatggacacgctgccttctttctgaggaga

SEQ ID NO: 25968 - DNA, 61 bp, Chlorella protothecoides
gccagaaaacaaggtgaggcgcccgtcgttaggcacttccgggctcacacggtgaaggact

SEQ ID NO: 25969 - DNA, 61 bp, Chlorella protothecoides
gtgctgcttgaagaaggtgcgggcgcggccattgccccccgccgccatcaccgccagctgc

SEQ ID NO: 25970 - DNA, 73 bp, Chlorella protothecoides
attgcaagcatgattatgcagggtcgaagggattgtgcttaccttgaggctcgccgacggagtcgaatcgctt

SEQ ID NO: 25971 - DNA, 79 bp, Chlorella protothecoides
gaacctctgccggtgcaggtcccgcaccctccgcagatcccccgatgctttccacggcggtgtggcagggggcgggcgg

SEQ ID NO: 25972 - DNA, 171 bp, Chlorella protothecoides
tcggcgtcctcggaggccttgtccacccacgtcggccagtttctcttgaacgtgagctggacctgcacaggggtggcgaagtttggaaggtgagattcagggcgctcagccagggccagtggcggcccgagtgtggactgacggtgtgtctcactgtgcaaccgacatccc

SEQ ID NO: 25973 - DNA, 209 bp, Chlorella protothecoides
ctatgtgcaggtcccttctgtcgacctcaccagtgatgaacaaggagatcagcgcaggcggaacgtagtcgaaggaggggttgtgaacttgaaggtatggatgcgatgtgctcaccgagtcgtccacatcaaactcaagcccagattcagcatccaggcaggagctactatctgcgcgcgtgaaagaggagtcacaccttgagctgcgc

SEQ ID NO: 25974 - DNA, 79 bp, Chlorella protothecoides
ggctcctgcagggggtccatatccggccgcaggcggggccccatgggggtcatagccccctgcctggggagggggaccg

SEQ ID NO: 25975 - DNA, 77 bp, Chlorella protothecoides
tgcctcgcctgcctcgctgtgaacgccaatcatcaagtccagcacaccgtatcttgtgcgccatccttgcccacttc

SEQ ID NO: 25976 - DNA, 71 bp, Chlorella protothecoides
ccagagcaccgagccagggctgctgcatggaacctatcaagcagagcattctggtgcgcacaccttccaaa

SEQ ID NO: 25977 - DNA, 72 bp, Chlorella protothecoides
cgtggtggcggagacgggccacgacgcggccgccggggacggcgtggtggcggagacgggccacgacgcggc

SEQ ID NO: 25978 - DNA, 113 bp, Chlorella protothecoides
ttcggtcttgcggtgggtgtgagagatcaccgcagcaaggatgcagggccacggctaagtatttgtgcatgtggggcggtctgcttcgtgcatcttgctcgcctgtatcatat

SEQ ID NO: 25979 - DNA, 69 bp, Chlorella protothecoides
tagattacattctgatgaaggtattgctgtatagagaatcacgacccctcattatgtcgagccggcagt

SEQ ID NO: 25980 - DNA, 70 bp, Chlorella protothecoides
actgacttgcgagggacaaaactgcaagtggttgtggtcgatggcgttgagtgggaagcaagtcctgccc

SEQ ID NO: 25981 - DNA, 113 bp, Chlorella protothecoides
gaggcgatgcccgccatcagcacccggtccggcgtcgcggcttcctccaatgcgcgtctgacctccgcgggcgtggccgtcgggttgttggacaggtactgcgccgccaggcc

SEQ ID NO: 25982 - DNA, 12403 bp, Chlorella protothecoides
  modified_base (7381)..(7468): a, c, t, g, unknown or other
ccggggtccggggcgccggggcccgggccgggccgcgtgccgccgggccgccccagccgccgcgccgcgaaacgccacaggagggtcagggggatgacggccagggagagggctgcgaagagggcgagggggacggcccaggagacaaacctgcggcgggcaggaacattccggtggtggggagcgggggcatggccaggccgtgaagcctgcgcgcccagcgcccctggtcacgcaaggagggaggcggagcaacccgacggtgggagaggaccgtgccacgccccttcagacctgagggccaggagagctccggccgtcgccgcgccggtccgctcgccggcgtgggagcactgcgtgaggaaggccgccgcggtgaccgcgccccaggcgccgccgcgggccgcccacctgcgatgagtgggcggcaggcaagggagggagggcccggggttggtgccagcggtgggccaccagaggcccaggaggcgtgccatgcagcgaactggtgcgctccaggacagcaaacatgcagggatgcggcctgcagggaggaccccgcccctgcctgctcttggtgatgagcggggatcgggcacgtgcgatcatgtccccggcatgaagggatggcaaggggcaggcccaggcctgtccctgcgttttcattccgcgccgtaactcatttcccacccctcacatccccctccctcccacaaagaaagtacgcacaggagcagagggactgccgcgagcctggccgtccggagctgagtctcaggcggcgctttcctggcatacgccagcagacctagcaccgggggaaggtgggtccaccatgcgggggtccacagcatgcgcagcacaagaaagcgtgccagctggaggcccgagaccgtgaccagcctggatgccagcgccggggggggggatgatgggaggggatgagggctgtagaagctgctggaggtttgatcagtggcctgtgaagcatgtgctgagacagggcaggcagtggacctgtgtttgaatgtgtcctgcagggttggtggagtacatcgatgcggcgcgcagcatcgacataccttgaggtcagggctgtgccgagggaagccgcaaggtagctgttgtagggcaggaagagtaggagcagcgtctggcatgtcagggctgggcagaggggtgaaggggaaatggacaacgtcaggatggaactcagtccagctgtggcaaggatgggacaaggctctgcaaccccacagtcagtactacagcccatctcagccagagcactgacaggatgaattgcccagggcccgccgccaccgagaaagcgcattacccaggaggcaggaggggaggggcccggcgagggccacaaccaacagggtgtgggcgaccgcgatcccgatggacgccacgctctggtggccctccagccactctgcggcagccctgacccaggtctggcgcgacagccaaaccaagagccggtcgtagcttgcccacagacccatcatggtaggcctttgggggcgcagccaatcagggtgctggaggagggtggccccaggcgcaggactcgctggcgaggagcacactttagaccagtgaacccaggcagcccagagtgcagctcagggtggtctaccgagctcaatgagctgagagactcctcagtgtcctgttgaatgatgtaaagctggttgagcaatcctgtgcaggagccaactcgataacttagctccctcctcttcagataatgcgccaaacgggctcagcaatgatcttgcaacgaataggagcccatgtccggcgcagtatgtcgtataactcacagcttgcgctctggagacatcttattgaacgtcatggatgtcaagggtggcgatcacgagctttccggtcagtgtacaccaaggtgggtggaggatattctgagacctgcagtccaggtgaataaaatgctacatgcctttactatgcattcctatcgggaagcagacaagcactgaatgccttggaaattggcatacacttcccgagttgggggccagatcctaccagggaagtgccgatctgaacattgcacgggggtaatgcgccctgctcaaaaggtgaccattctcccggagtgtgctagttgcatctcctgaaataagcaagcacaaatcagctaccacacacgaacatccaagcgatatcctgttgaggcaggcgccgcggggagtgctccactcgagtgatctcagggctaggatgtcggaccttgcgtctgcacagaggaatctgcagcagctcgaggtgtgtggttggtcatagaatggtattcaagcatgaggatagaagctattgagcgtgactcacagagcttccccgccccgcctatctggctctgcagagcgctgtgcagagcgggagcgtggaccaggccaacaagctgctctcgaaactcaaggcaggaatgcgtagttatcacttgcatcgattgtggtcgcgcgatgccgtgtctcacgctgatatcgccccgttcacctttcccccatcccctctgtcctcgcgtcctgtgactccctgcagctggacctcatctccttacccgccctggcagccaactcccagcccagccccaccacgaccgacgagctccttcttgcacgtgagatctcgttctccctcaaagtgccagaggctgccatgtggcggcggacactgatgccctgctcacccaccaggcaccgctcctcgccaacttgggcccctccccaccgccgcagggggcgtgtatgagcaggcggtgctgctcgggaccctgcgctccgacttggtcgtcttccagcgcagctggagccagctggcgccgtactacatcccaggcgacctgtccaggagcctgaccccctctccacgccaggccttcctcaccgccctgaacctgctgcgcctgctctcacaggcggcagtggcggagttccacgccgagctggagctcctctcggatgaggtccgtggtgggagggacagtcgggtggacgctgccatggcgcacccaggcatgctgggaaaatcggtgctccttgccgggctactcacagcgagggccgaagcctcagagcgctgtgtgaccccgcacggcgactgtgcctgcacccactccccgccgtcctgcgccgccccagatcaaggcttcccccgaggtgaccaagatcatggaggtggaggcgtggctgatggagggggcctacaaccgggtgctggaggcgcaggacgccctttccacctcgccctacactgccatcttcctccagcgcctcaccgacaccgtcaggttggtgggctggggtggcaagacggggtgtgcagggtcctaaggcggtgggcttatcctctgcatggtttgaaaatgggggagtcaggggcgctcgagactgtgtctttgatgagactcgccttatctgtgattccaaggcactgtctagctctccaccccctcccgcgcgcaccaccgacaaccccccaccctcgacaatcacatcagggaggaggtggcggcttgctgcgagcgctcgtatgcctccctgaactcggccgaggccctcaagctgttcaggctggaaagcgaggcacagcttgaagagctggcacaaggccatggctggaggctgacctcgggccgcgtggagtttgcgggcccagacgaggggggggggctgcctgcccccgtctcccaggacatcatctcaaactgcatgttgtatgccaaggagctggagcgtattgtctgatggtcggttgataatgcgctggtggggaaggtgtgtgaacagaatctgccccagatgggccacgccacactgcgcagcgtgaggggcacggccgggttgggcgccctccgtcttgggggattcgcagagttggacctggaagctcgggccccgtgcatggcatcgcgacaagcatattcatctctgattgactgtgggaccaggaacgtaccccaggggctgagcgctcgtcagggatcactgccgctggaaccgatcacagggaggttagcctcacggggcgtgggcagggatggcgagttccgcctccgatccgagggatgcggccatctcagagtaccggaacaagctgttgcagcaccgggagctggatgcacgggtgaggaccctgcgggagcaggtccgcaagtcccggcaggagtatgacaagacggaggacgatctgaaggccctgcagagtgtgggccagatcatcggagaggtgctgaggcagctggacccggagagatgtgagcaggggtgtgttgaggggctggagagcggcctgccacgtgcctggctgcaagtccgctaacttgcaactcctccagaaccctctcccctgtcctgacaccacctgcctggccatgctgcctccctccgcatgcatctcggtctgactccgatgtgatacctcccccctctcaccgcttcccttcccttaacacacacagtcattgtcaaggccagcagcggcccacggtatgtggtcggctgcaggaccaaggtagaccgcgccaagctgttgcccaacacgcgtgtcgccctggatgttaccaccctgaccatcatgcgcatcctgccgcgagaggtatgggggtcggcagggccatgggtccggctggtggacggggatgcagggactgcccctgctcacatgatgcatgtccatcatataacccctctcccctgagcactgcaggtagaccctatggtgcacaacatgaccacagaggaccctggtcaggtggactactcctccatcggcggcctgtctgagcagatcaggtgggaggagcaagggggctttccatgtgagaggcatccctgctcggatttgtagtggttagtaccatgtttgtgggagcacaagctgagggcaggggcctcactggcgaagcatggggaccttgctggaacaagagggctatccttgacaagccattcctccctcgtccatgcaaacagggagctgcgggaagccatagagctccccctgatcaatcccgagatatttatgagagtggggatcaagccccccactggagtcttgctgtatggtcccccaggtaggcacaggcctgcaaggcgcagcagcatgtccttttctgcaagccggcatggtattcagccgggcccctgcctgacaccgtgtgtgcctcatcgagggggacatggggagagggtccttgcggcgtacaccctcttcatgaccatccctccatgtcttgcctgtgcaggcacgggcaagacgctgctggccaaggccattgcttccaacatagacgccaacttcctgaaggtggtggcatctggggtggtggacaagtacattggcgagtctgcccgtgtcatccgcgagatgtttgggtgaggacctcgggaggagaggtggggatggctgtgcagatgcgagcaattctgaaattgaggtgcgcagccaggccgttgaacggcttgaggctggggttccactcggctccagcaccccgaaacacctctgcgcatcattgctcattcagcgcacacacatatatatacacagtttttgcacattcacacaaatgcttgcaggtacgccaaggagcaccagccctgcatcatcttcatggacgagatcgacgccatcggtggcaagcgcttcagcgagggtgggtgggttgggaggtggagggcccccgagtgtcgatgctgcgcccctgacggccgcgagtgtggatttcggcctgggccttcaggcctcccggtcgctggcctcacccacggcccagtcgtgtgactgtggcatcaacccatcaaatgaccggccccctccattgaaaccccccttgccaggcaccagtgcggaccgtgaggtgcagcgcacactcatggagctgctgtcccagctggacggcttcgagtcgctgggcaaggtcaagttggtggcagccaccaaccgccccgacgtcctggaccctgcgctgatgcggccggggcggttggaccgcaagattgagatcccgctgcccaacgagcaggcgcgcaccgagatcctgaagatccacgcctccaagatcaccaagcacggcgagatcgactacgagtccgttgtcaagctgggcgacgccttcaacggcgcggacctgcgcaacgtctgcaccgaggccggcatgtttgccatcaggtgcgggaagggggaaggggggggtggagtcgtgggaaaggcagactcggggggaacagggggaggaaagggaagcaatcgcatggtcgtggaggtcgagggcctgacccatgcgcggcacaaccctggccgtcacgagtgcgttgctccgcccagtgccgcgctgcatgctcgggccctggctgcgctgccaccttccccccctcgcatgccgggctcgggccctggctgcgctgccaccttcccccctcgcatgccgggctcgcgctcgacgtgcgcctgcgaccagtgccccacacttcaccgctgcagggacgagagggattacgtggtccaggaggacttcatgaaggcggtgcggaagctggccgaggcaaagaagctggagtcgccctcccccttctcctctgactttggtgacaagaagtaggggctcaaatcgcatggaggggtgggcaaagggtatggtgcccgactgatgcaagagcgacaaaaaagcgtcgacaagaaaagattatgcatggcaaacacggcggtcatgcatggagaatggggggctggttgtgcttgcaaggtggtgcgatgatggtgaaggtacgcaacagggtggaggagctgcattcgtgctcaggtgggcctccatcgtcggacccctgggatggatcccaggaccaccttgcctgcacgagcggcgcggggtggggtgggggtgcgcgggtggaggggtggtcccccatctccccccctgcattccctctgctgatctacgacacggccactctgctgcgcccccctgccgcgggcccggggtcgtgcatgcaacaagtctcggctggcgggctggagaacaacggctcatgtgcgaccccagtcgccggccccgccctcgagccagcccgcgcccgacacctgctccaagccgcacgcctcgggggtgcaggaaaggaagaccagcgtcccacgcgcggccgccccgctgtggtgccactgccagtgcgggggcaccacgctccgagcctgcagcgcctcctcccgcgagacgtcgggcagcactaggaccccgtcctgtggcgggtgcaggagaccagggtgggaaggggagggaggaaagcaccatgcgcagggagcagggtgcacagggggcctgccagtggccggcggccggccgccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctctcaaagccccacccatgccgcgcaccacgggtctgaggatgccgacggcgcgcttcagcacggcggcgcgggagctgcgcccgacggagatgaagcgcagcgcggcgtcgggcggcacggggcagttgacgtagcgccagcccgtcgcatgggccgtgtcgttcgaccccggcaggggcacatactgcacctcccagcgcttggtcaggggggtggcatgccgctgcgacggggagaggcaggacagggctatcgggagggcgagtgaggggggttctgggggaatggtccagagccggcagtgggtggaggattccgttcggggtggtgggtcaggccttggtctgcagcccccccccccctttacccgcacaccagagcattcccacatccccacccgctgcacgcgctgtgctatggcagccaccgcgccgtcccgctccacgctgaccaggctctgcagcctgccccgaaggaagaaaggcaggccaggacccaggccccactccaggccatgcccggagctcccttgatccaggagcagggagaccaggcgggtggcggccctggtgaacccgctgccgcacaggtcgggcgggagggcggcgggggccggcgcggggaggtccagggcccaaggctcggggcaggccgctgcggcagcctgcgcctcggcctctcgcaccagggaggggaaggctgcgctcagcgacgttcctgggcagggtatcgggagattcagggcggggaagcatgaggtgcgcgggtgccgggcgggagcgccggaatggtgaggaaggtaggtggatggggtgggcctggccgggggaggaggtcgaggccaaccactctggcacgactgatcatgcactccggcggggcacagcccaacctccggccccaagcttatgcatcaactataccatgaggcttgccgctcagccgagtcccgccgagcagggaagtcgaagaccaggctagatacacggtgtatgcagcgaacaggatgccaaaaggaaggcaccatcccccagtcctgccgcgatgccctgcgatctggcgcctcatgcaggtcaacggaagtccaaagggatggaagccgagcgctgggggaaaatgtggtcggtccgtggtgctaagaggtgcctgctccgtaggccatctgccctgcagtgccggtgttaccggtgacccttgaaatggactttgcgagaagagagagcaagggacgaggttaccggagctgtgcagcgtgtttttattgtcgatccagcgatgcctccttgtgatgtctggctgctggccgctaagccggagggttacccggtgcgcagcgcgcgcatggcagagggcgaggcgcatccactacaaaaatcaccatgaaagacattaaggctcaaggggtcggatggggttggggaatcatggagtaagctcaaatagtcgacaagacaggagagatgcttggacccatgcagctcaagctgcgctcaagcacatgtcatagcaagaagtgctgcgcagcagatcaaggagtgtgggaaggtgcatgaactttgagcacaatcgtgtcggttgtgcgtaggtccgtcacagtgcaagtgtcctggccgccatcctgaatgttgttgcaaacgagattgtcgccccagttctcgctccccgtggtattgctcccatgattgtgattgcctgcggagtgaggagggcaaccaaaactcgaagaaaggctcttgagaaggccaggccgaggattggggttgcatgctcccttaccgacgttgttgttgccattgttgttgtgacccaagttgttggatcctatattgccgtttccaatgttgccactggcatccggtgtgcatttgggaatcccttctggcaggcattcaatcaccgcaatcgactggcaggaggtcgcctctgtcggtgtacacatctccagagtccctggatccagtgtgctgatgctgaacttgctgaaaggcgtgctcagggtgatgggcagaattctcatcgaccctgaccctgcaaatcccttcaacctgtggcatttataggggtaccagcttgcaaaattaacagtaagttgtttcaatagggttgtttgatctaatctgcgagctccattgtcgaaaacacactccataccgaagtctgagcagtggcctggtgacaataggaactcaccgacagtaggcatcggggctgctcggactcgtcagatacagaaccccattgtacctgccaatcatgtggaggaggttatatggcttagctcggcagcaccggaaggacaatgtcctctgcttagacgcaccgtcatctccgccctcccagtccactcagccatcagcataccaccccgcgcactcgatggtgggcagagcgatgaaccttgtgccagagtcgcaggtctgtcccggcggcggaggtgaaggtggcgggagtggggggctgggaggggaaggagacggaggatcaaaaggccgagggggccggggaggagggtaggggggcgcatcgaggaagtaggtctctcctgttagcaggtctgacagccgacagcggtcattgcctgacaggttgtggcaaataatgttctcgccggtgttgttgcttcccacgttattccaccctatgttgcggttgcctgtgagcatctcgtggacatggatcagagaagtgattttcatggcaggcacagtcaccagctgaacaacaggtctcacctatgttactgtcccccacgttgaagtctccaaagttccagctccccgcgttgcccgttcccattccaacaatccatgtgaagtcatccgaacattgataggcgccctcgggaacgcactcaacgaagcgaacaaattcgcactgacgctgacggggatcgcacgtcgcgccatcccctagattcagaacccggatgttgaagtcagggaacatgtccttcgtcagatatatattattctggtaaaatccatccctgaaccctttcaacctgtgaggaatgtgcacaaggacaaaatggtcatggcatgcaccactgttgctgggactccaggaggctggaacagatcccatttgccaatcagcatgggaatcatatgtagggtagcgagaacaactcactgacagaacttcctatggttgtccaccagcatgatctcgccgcggtaactgcgattgggagcggggagcacgataatgatgaagcgcagagtgccacacttgaatgagactgccgagcccgtcatcccatgatccccctcacgtgaactcactacacagtaggaagtgcgaagagcgcgaccccgggatcgcagtccgcctgcgaggcaacatttactctctattctgatcatccggtgcgtatttatgagcattatgctctcgggtcatgcaggtttgcgacgatcaccgacaacccatacctacatgcgcagtctggcagatagtcaaggcagccagaatccacacaagtgctgctgtgttccttttcagaatcataacgtacatgatgctaacgttacgagaacatgtaagaactgtttctcactggctgggggatggagatggtgattgtcagctacacggcgcgaagtacccatggactccacggctttgtccgcgtccgtaccggagaggcacgcgggcttgcatccggtcccactcgcatgccagctgcaatgcgcccaggctaagcgcactgccccggaccgcgctctcgattcagtcgcaatgcaaaagtgtcatctttgagtctatcgtaaattgacctgctcgaaggcgtgttcgtagtgctcatccgcgcaagagtatctttcaagcctgggcccctgtccttcaggatgggaagacctggcgtgctgtccctctcactgggcatactgcttctcctctccgtcaaaacccgggttgcagatgtgaggatagtagtgcatggattcaaggatcggttattggcatgaggtgcacatcctctccctcgggaatgagcaccagtggatttacaaattgacccgtgcccccgacaggccgcctgcgatcccggcatacgtttcttcgccctccccacaattcggtgagcaggcgcctgaagaggttcgaatggttcggtgcgatttctccggcaccggcttcatcccttcctggcgatgacctctcagggccgcctcgttccgcacgcagatatcaagattctctgcacatggtgaatgacaaggaaaccgacttctattgccggtacgtgcacgcactgttcgggagggcaggaagctcaatatataccgatatgagtctcacattatttatcattcatctatctactctagtacggatgcgctgctgtgtcgaattgagatgtgcgtccctcgccctgctcaggctcaaaggatacaacggtggaggcatcgtcatgcagtccttggatctgaaaaatgatggacctttcaaggactttaccataggcaccgtcaatccagcctcattcaccacctgcaccccctccgccacggtggtgtgcaaggccatcgccctcgttcagtgcctccccaacggtgtaccggggtgtgtggaggaccaggatcacaacattgggaccgggaacactggcaagaataacataggcgacaacaatgttggagaccgaaaccacggtacgtcccatgccaggagggttgatgctggtggaggtaatgatggcaagtttgtgcgcctgctggaatgtacccccatgtatgaatctgtgaggcgattgcatagacacacatccacaggaaaccacaacattggcagcgataacatcgggactggactgactggccagcgaatgttatgcaactttgccaaaactgatcggtgcccgctgctctggctggccaccaacgagacgatcaaattgttcgctcctccccccccccacccccca

SEQ ID NO: 25983 - DNA, 61 bp, Chlorella protothecoides
ttgaagaaggctgggccgacggatgaacaacccactcaagtagttgaatgtagttttgaat

SEQ ID NO: 25984 - DNA, 61 bp, Chlorella protothecoides
ttccccctttccaggccgccacggcggtgtgtgaggcggaggagcgcgccgcggacgcgga

SEQ ID NO: 25985 - DNA, 229 bp, Chlorella protothecoides
ccgggcgagcactgggcccacgccgactacggctggctgttgtacaaggacggcgacctgcaggtgagggggggggggattggttcgctcttcaagtttgatgcttggtcgggcacggcacgcatgaggacaggccacgtgaaccccgcacgagcgaggacaccgacaccctcccgccgtgctttcgtccccccacccgatgccagggcgcgcgccagcacctggagga

SEQ ID NO: 25986 - DNA, 79 bp, Chlorella protothecoides
cgccgcggggccgcagctgacggggtcgacgctggaggggtggaaggcgttcaagcgggtgttccaggagggcgtggag

SEQ ID NO: 25987 - DNA, 79 bp, Chlorella protothecoides
tggcccccccgcgcccacctcctcgacgccaccatcaaccgtgggcggcggcaggaagcgcagcacgtcgtccacgccc

SEQ ID NO: 25988 - DNA, 71 bp, Chlorella protothecoides
ccccggcatgctcaatacccagtgctgagaccctcctcctccttgccgccattcaggcccttgcagtggtg

SEQ ID NO: 25989 - DNA, 61 bp, Chlorella protothecoides
cagctgagacgccgtaaaaaccaagaaacgctgaaatgagaagaagaagctgccctgattg

SEQ ID NO: 25990 - DNA, 61 bp, Chlorella protothecoides
gagaatcagggggagtcgtcgaacccatcacccccctgccatccctgcagaagcagaccag

SEQ ID NO: 25991 - DNA, 77 bp, Chlorella protothecoides
ccggccacaattcgcgcgcgcctgacgactttcccgagagtcgcggccagttcccgattacgcatgcatgcatgtcc

SEQ ID NO: 25992 - DNA, 61 bp, Chlorella protothecoides
gcaagcaaaccctgggatttcataacccctttcatgctgcccacctgcagatggcgtcggc

SEQ ID NO: 25993 - DNA, 71 bp, Chlorella protothecoides
gtgacgctgctgcacccggcggctgacgtggtgctgcacctggcggctgacgtgctgcacccccaaccccc

SEQ ID NO: 25994 - DNA, 76 bp, Chlorella protothecoides
agcaagccatgcattgcatatgttggagtaagagatacagagcgagaccaatgtaccgctctgcaagcaaataaac

SEQ ID NO: 25995 - DNA, 90 bp, Chlorella protothecoides
agttgcgtagggtggcgcacttcgctgctgataaacagcacacccgcaatcgctcccaggaacggagcagccaacacccccgcaccactt

SEQ ID NO: 25996 - DNA, 157 bp, Chlorella protothecoides
gcacggtatcatgtgcagtcctggtccttgggaagcaaaggatcattcacagcacgcaaggggtctacttgtaaaaaggcaccaaattgggagggcagatggtaccagaagccatagcagaatgtatgcgagcttcatcatctgaccgtcagattag

SEQ ID NO: 25997 - DNA, 86 bp, Chlorella protothecoides
acatacgcatcatggcgaacgatgtcatttctctgtgcaatgtaggtcagcgttgaaaattgtcggaggggattgtacgaggaggt

SEQ ID NO: 25998 - DNA, 117 bp, Chlorella protothecoides
cctgcccagagtggaaggaatgctatatacgcaagtattggggttgatgctactcccatgatctcacatgatcgcagcacccacagatgcccccatccccaccactgcattgcaggt

SEQ ID NO: 25999 - DNA, 75 bp, Chlorella protothecoides
gcgaaacaggctgaggaggacggcatagccccgtctctggtgcctgcctcggcaagcaaggcgatcgagcaatcc

SEQ ID NO: 26000 - DNA, 80 bp, Chlorella protothecoides
agggcgcccagggtggccctgcgctggccaggcctatgcagcagcccttccaggcaccccggggaggctccacacccatc

SEQ ID NO: 26001 - DNA, 63 bp, Chlorella protothecoides
caggcaccccggggaggctccacacccatcgcaggggctcgagacgtgcattgccttgggggt

SEQ ID NO: 26002 - DNA, 79 bp, Chlorella protothecoides
ttcccacccacgaagggccaggccttgcagcacccccaaaacactgccagctggagcagctaggccgaggcccaagccg

SEQ ID NO: 26003 - DNA, 77 bp, Chlorella protothecoides
ggctatggggtgacggcaggtgggctggagtgaggaagtttgctgaatggcagtgaggggtctccaatcgcggggcg

SEQ ID NO: 26004 - DNA, 62 bp, Chlorella protothecoides
cgggtgctgcggaccctggtgaggggaggggctggatttggctggacggcggaggggtgttg

SEQ ID NO: 26005 - DNA, 61 bp, Chlorella protothecoides
ggccagcacgccgccatccaggcagaaatcggccccgcgctctccgagccccgcacccagg

SEQ ID NO: 26006 - DNA, 75 bp, Chlorella protothecoides
aggtccataatgaaagacaagccacagcaactgtttgacatgatgttgtgttacactgctgcatcgactgcttgc

SEQ ID NO: 26007 - DNA, 61 bp, Chlorella protothecoides
accgggaaggtgctggccagtgcagcctggggaggggatgtagagcgggagaaggatctgg

SEQ ID NO: 26008 - DNA, 80 bp, Chlorella protothecoides
gtccttgtacagcttgttgcagaaaaaggtgctgaagaagtgggtcttcggccacgacttctgcgggtgaggcgaggcgg

SEQ ID NO: 26009 - DNA, 142 bp, Chlorella protothecoides
gcgaggtttgcaccctgcccagcctggccgctcgttgggcccccacctaccctcaaccccatcccgcatcgccctgcccaggattctggtggtgggcgccgggggcctgggctgcgagctgctcaaggacctggcgctgtct

SEQ ID NO: 26010 - DNA, 70 bp, Chlorella protothecoides
acccaaggttgacaccaagtgtttgcacgtctcctccccgacccaacgcctggcagtatgtacattggag

SEQ ID NO: 26011 - DNA, 61 bp, Chlorella protothecoides
gagggaggtgggtgtcaggcgccagacatgggatgcgatgtctcttcctcgcaggaccttc

SEQ ID NO: 26012 - DNA, 61 bp, Chlorella protothecoides
cgggcgggagaagtcagcgatgttggcaaatgtgatggcccacttgaaggtgggtgcccag

SEQ ID NO: 26013 - DNA, 71 bp, Chlorella protothecoides
caatcgtgggaaattatggatggggcttggaatcaatatcacaacatcacataggctggttcgtcgcatgg

SEQ ID NO: 26014 - DNA, 86 bp, Chlorella protothecoides
ccaaggtcgcatgaagacatacaagggaagtggccatggtggggctggatggcagaaagtgtcactatgggatgccgatgcctggg

SEQ ID NO: 26015 - DNA, 61 bp, Chlorella protothecoides
gcccgccgcatcgggtccgagccgcagccgtgggtacagcttccccagcacctttggggat

SEQ ID NO: 26016 - DNA, 61 bp, Chlorella protothecoides
ttgggaaaggggtgccgccagactcctgcatgcctccgatcgctcccaaatgccggtccag

SEQ ID NO: 26017 - DNA, 79 bp, Chlorella protothecoides
ccagccaatcccgccccagctgcggcgctgccggggctcacacctctgtaagataggcacccacatgcaggacgccatg

SEQ ID NO: 26018 - DNA, 70 bp, Chlorella protothecoides
tcccttctgaatgtaacactgtgattaacctttcttggtcatgttcacgatgcggtgatcgcatggtggg

SEQ ID NO: 26019 - DNA, 205 bp, Chlorella protothecoides
gtccgggtgacagcctccctcgacgagtctcgacgtctctctgtcgcgggcggggaggctcgaggacgagccgatggggcaatcaatcgcagcgcccgacggcccgtggatttttgactggccacagcaccgacgggttgcaggccagaatacacccgccacaacacataaaagctgctgtgcgtgccctgtatgcgtcgagtgt

SEQ ID NO: 26020 - DNA, 78 bp, Chlorella protothecoides
caacatacttgacatagcagggacaggtgagtgcatgagcttgccagatgtgcctatcttcatctctgaagtcacata

SEQ ID NO: 26021 - DNA, 229 bp, Chlorella protothecoides
cagtgccagccctggagggcatgccctggttgccatcgatccccactcagtccccacaagggcatcagacagccatctccacccacccccacacacatgcgccccccactgcccacgcagcgagacgccccaggcctggctgcaaccccagcccagcatggacggccttcccagcccccctccctacaccggcccgcacatgccccacacccagtccctgcctgagctg

SEQ ID NO: 26022 - DNA, 61 bp, Chlorella protothecoides
gcagtcacaggaccgacacggctcggtccagggtatctctcgacgcaatgctcggtaaggt

SEQ ID NO: 26023 - DNA, 13844 bp, Chlorella protothecoides
  modified_base (1166)..(1175): a, c, t, g, unknown or other
  modified_base (2336)..(2455): a, c, t, g, unknown or other
  modified_base (3652)..(3661): a, c, t, g, unknown or other
  modified_base (3902)..(3911): a, c, t, g, unknown or other
  modified_base (5183)..(5192): a, c, t, g, unknown or other
  modified_base (6310)..(6337): a, c, t, g, unknown or other
  modified_base (7543)..(7552): a, c, t, g, unknown or other
  modified_base (7844)..(7853): a, c, t, g, unknown or other
  modified_base (9233)..(9242): a, c, t, g, unknown or other
  modified_base (9409)..(9418): a, c, t, g, unknown or other
  modified_base (9727)..(9736): a, c, t, g, unknown or other
  modified_base (10151)..(10160): a, c, t, g, unknown or other
  modified_base (10640)..(10649): a, c, t, g, unknown or other
  modified_base (11292)..(11301): a, c, t, g, unknown or other
  modified_base (11610)..(11619): a, c, t, g, unknown or other
  modified_base (12331)..(12340): a, c, t, g, unknown or other
  modified_base (12745)..(12754): a, c, t, g, unknown or other
  modified_base (13348)..(13357): a, c, t, g, unknown or other
cgccgcccccgccgccgccccggccaaaggtctcccgcccgccgctggcgcgcagcgcgtcggcggcaaagtccgagcagacggcggcgcgggcgggggcggcacggccgtcggggccgaggtcatacactgcgaggcgggaggcggcgtcacgcgtgtagaggatgtgccgctcctcgtccaccagcgcctccagcaggggggaggggggaggcaccaggaaggaggggaggaaggaggggaggtaggagcgaacgcccgctgtgtggcacacctgccagaatcagagtgtgtgtggacaggtgtaagggctgggaatcctcaggctgagacccacaggaaggaacgggagcatggacagaggttgcgcacggcacaccgtcacaaacaacacacccggggcgcaccttggtgaggggccggccgccgcgccagcgccccgccacaccgctgctgctctggtactgcagctcgtacaggttgccgtccgcgccgccgaggaagatgcggccaccggcggtacaggtgacggtgacggtggtgacgccgtcggagggcacggagaagaggggcaggggggccagggtgagctggtcccactcgtccccagtgccgcccggcgagcggccgcagcacgccccaaccagcagaatctgggtggggggatgtgggtggagggagttttatggagtgtgccgaacagcactgcgttggagcgtctcgacccataccccaggggttgtagtgacagtgattgccagtggggtgaggctgtccagggaaagactgtggattcgcatcgagcatgccaggcgcaggatgcctggcaaggacggctggtcacaccgacagccctcgggccttcctggcacgaggcaatctccatgttacttccctttcctcccaaaaacaaccactccccgatcaagcacctcggtcgtggtgcagaccacgaggacatgctgtatggcagagacaaagacgcctgggcgagccggggccaaccccacggccacaatggactggtcttcgccagagtattccatgggcacgtcttgcctgtggggtggaaaggagaaacatggagggtgggctggcgcagcagacgggcatggatcacctgctcacgccagcagtttccaagggcaccccgaaggtatccgagnnnnnnnnnngtggcgcggcagacgggcatgggtcacctgctcacgccagtggtttccaagggcaccccgaagggatccgagtgtgcgtcggcgtgccaggctggcaagacaggtgccggaacccagccgctcaccagcgatcaaagcgccagaggaagagggagctgtccacggaagcccacgcacggcgcagctcagggaacacgccgcagaaggctactgtctggcaggcggcgaagcgatccaggaccgctgccggcatctccgacatggtcgacgtggtgtggcgcagtgcagcgggccactgcgtgcgaggtgagtgtggggaggctcagagggggagggagcacggcagcgggcccttggttagaggggggactgccctccttccagcatacccctggctaggggacagtggcagaaggctcctggtatgcttaggggaacaccatgaacacatactcagccacaaggttatgccatgtaactgggttcggatgccctgcctgcgtgccttcatgccctccctgccagccatcacctctgggggagctggcgagtactgggtctctcgaaggctgtgcgacaagaggtcccacaggtcgctagaccttccctcatcgcgactggagactgcctttacatgcttccaggccgatgcaacggccccgacatccccagcctcatctgcgctggtgctggcgtagcgctgtgatgggccgggactgccgtcaggcaatccatccgaagcccaggcaacgggtggagggtgctgagcctgcatcctaacccatgccctgatacgagatcgattgggagggggatgcagaggtaatccctatgggtgcacacgaacgatgaaacctctgcctctgcaatgcgacctggagtttgcgcgcgggaagtgcagaattgaacgggaagacagctacgccatggacaaggaaaccagcgcgcacgcgccacagacatacagctgagcatagcgaaccaggaagggaaatgaaatgggcgacactgcacgcaattcgcagtcacggcagagaagcagcacaatgacaccgctggctgagaccacggctcccaccacggacactgtgacggtctcggaactcctccaactcgatcccagcgccttcattgaggacttacacaacgcggtaatggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccactgcgccgatgcctttgacgacttggatgagtaagtacgagcaagggggctctgcatcgctacagcacaccttgcttgcagtctggttggatctcaactccttcatcctcctgttgttgtcatgtctgtccccagccaacgttgcactttgcaaatgcccaacacctcacgacctcccctgacagagcgatccgcaacgatgtgggccccgccctctcccccgctcaacaagcagctgtgatgcaagggacggcgcagctgtacaacctagcgcgcggcagcctggatcgtcaactgcagcgatttgaggagtttgcgctggagacctgcctgcgagtgcccgctggcctcatggcctctgttcaggtgatggagaagactcgcctgcgagtgcacacaagcggcagatgtttttctctgtgcttgagcgattagcgttgctgacctgaaaccctttccccacccaaaacagatccaggcaccagtcgtcgacgtggaggcgccctgtggggaggaggaggagggggtgatccagcgattgggcagcctccgggcgcaaatcctagaagaaagggagaagatgctcacgctgcagcgccagctggccgcctgcgacgcggcgctggcagaggtgggtggcgaggaggcgggtctgcgccagctggcgtctgccgtccgcgagaaggagaggctgaccgaggatgtgtttgtgctgtcgcacacgggcgccaggctgcaggtttgtggacctggcagtgtctgcgcgacggtgtttggatatggatgctaggctgtggtgggatgggggtgcacagcacgactccacagggcacccctccctgtgctgggatgaaacatggaggacttgcagcatggggaagctgctgggaagtgacaggatggcatgtgttccacacctacttcaaccggtcctcgggacaatcagtgtatgcctccaccatttctgcgccaggggctcctgggagacttacagaggctgtctgtggccaggcatcaagggcaggatgctgaaggcaagtttggcggtacgtcatcaaactgtctctgtgtgtccgcttgtctgtgcacacaggccccccccatcttacctcgacaagcgtgcaagccacggcctgaacctcacctcgatctttgccctcaacccagattctctccatggcgctttgaaccnnnnnnnnnnacttgactgtgcacacagcccccccccatcacacctcgacatgcgtgcaagccacggcctgaaccccacctcggtccttgccctcgacccagattctctccatggcgctttgaacctgatgcaagctgctccggtggagagcctgcaggccctgcacaagacgctggtggcatgagcctgaagatggtcgtcgcccagggagcacatggtcggcggaagtgcatgctggtgtgcacagatnnnnnnnnnntctgcaggccctgcacaaggcgctggtggcatgagcctgaggatggtcgtcgcccagggagcacacggccggcggaagtgcatgctggtgtgcacagatggcacacaggcccctgtcccctcgcatgagcactgggcgcggggtctcactgtatcaactcaacaagccttacatggtgcctgcacttggctgtatgaaaggaaaggcaggactgtcaacatcatcgcatgagcgtgtcattagtcatcagatggtttccaaggcactggggtgatgggattcgaggcttggcctctgttgctcaggtcttggactttgaaaatgagaagcggggagggctcgctgccctccagccgcgctcagcgctcggtcctttacatgacagagcagccgcagaagcccttggacttctcagcgtcaggacccccggccgtgcccgcgccaggctgggtctgcaggtcggcccccgtcgcaggagtggtctcttggccgggcacgccggcctcacgtgcagcggtgaggccggggttctccgccccagcatcatgggctggaccgccctcgctgaccggcaggctggcaggagggacgccgccaatcacaccaccttccgcggcgacgggaccggcaccccctccaaagccgcccgcatcagtggtctgggcggcactctgttccactccgccgaaccctgtcgtctccactggaccgccgtacccgctcgggtctacgaccgctgtctgcccgacgtttccgtagcctcctgcgaggagcgatggggccacatggcgtctccgtgagcatgcagtcgcttactttgggacattacatgagatgtggcatgtctctcacccgtgtcagccggctgttgcacggactggacgtagtccacaccaccaccgcctgtgttgccagaaaggctcatagtttcgaactgacctaccggtctcgactttgagactcggaatatttccaagtgaatatttcactataatctggctgcagactgcacaacaagtgccctcctttgcactttcgcaggtcccgagttcaaagatctcggctggatcccctcggatcgcccgtttggcgaacgggcggcatggcctcaaactatgctcctggggccaccaccggtccgccgtcgcaatactctgtcgaatctgaattcttgggggagaaatggtatgattgcacgctgatcgtcacctgtctttctagagatgtgaatgtctcggcgggccgtttcctcaggtcgctctgcaggcattnnnnnnnnnntttggaggagaaatggtatgattgcacgctgatcttcacctgtctttctagagagatgtgaatgtctcggcgtgccgtttcctcaggtcgctctgcaggcatttcagcgggggcatgcgcgagcacagcacttggttgtcctcgtgcacgaacagagtgatcaccatctcttctatacttcatttataaagtaatatgcttccgactggacgcatgagcacgtgcggagggcgcaattacctcgaattctctcgtggggatgcaagaccttaagggacacattggtggggctgtttgaaaccctaatctgacaagagcagctcgttgtacacgctcgtctgccagggtgcatgcaagtatacccaaggccagcagacagtcacagcagaaagttgccatcttgaccgagagcaagcgtgcctcctttgtcaagcggccgctcctatgtgtccagcttacgcggcggacgaaatacagcccgctgccttgtgctgaggagcggcttcaaggccttcctgggcagatcccccgcattgccaccatccgagaggacattctcggagattggggccagcaccgggcgggggagtgccgctcgttgtgccagcgcaggtgcctcctctgccccatgcgcatcctctggcacggccggtgcttccgggacggaccctggggcgccctcctcaacagcaggccaccgtctccgcttggggaggcgcgggatgacgggaatcatactgtgcgcagccgaccctgccgctgggagtggcgagggagcaagatgtaaaagcccgcaatccgcgccctgatcgccgacgccctcgctcccgttccgcccgctcccagtctcccctccctcctcgtcgtcctgcccttcgccgccgggccggggtcgacccgccgtcgccgccatggccgcggcgaccctggccgccaggcacgccgtgcgctccagctttcgttccacggcccccagcatccgacgcaccgcctggtatggcgtgtcacgaggggttggtgcggcagcgagcgtctcccactcttcgcagcgaatccccgtccctcaatctcgccagtgcgccacgcggctgtcgttgggccctcacgccagcttcacnnnnnnnnnnnnnnnnnnnnnnnnnnnncgcgtctgtgcaaacgtcgcacgactcctcgccctgcgcgggcgtgcaccatgtgccccgccgctccccaaagtaggccagcagggctttccgacggcaccgggcaccctgcatgaaccccttgtggaggtctgtggaacgagagcccacagagcgcagtgttgccctggggtttcaggccggctcgcgccgcgcccccgacgatggcccatgaagtccctgctgaggcccctaccactaccaatcgccaggccctgctgcgcctcaagcccctgccagacccacccgctcccccaaccaggggcaggcacctgcacgatggcggcaacctctgccatggctccgcgccgctcccccctttccaggcgcgcagcctcctgcatctctttatcggaggcgtagagcaggctgcagcagggcaggccgtcccgccccgctctgcaggggtatgggttggagggggatgaggatgagggcagaaggattgagggcaagagcaggcaggccccctgcatggcatcccgtcggccagggacgctgccgcccacccaggtggaagttggtgtgcctccagcaatcagccggtcctccatcttcctctaacccagccatggcttgcagatgatgctgccgccaggtccagagaatcccgacctcccaggcccctccacccaccaaaacacccccctctggcagcagcctcacctccctgactcctggtaaaacccctccaggctgctgggcacctcccagtgcaccacccagcgcacgtcggccttatcgatgcccatgccaaaggcgatggtggccaccaccacggggcagccgccctccatccagtcgcgctggacggcggcgcgccgcggcgcatccttgcccgcgtggtaggacgaggcgtccacccccgcgtcccccagcacgcctgccagccagtcgcaggtggcgcgcgtccgggcgtagatgacgccggactggccggcgcgcggcgccagccaggccaccaggtcggcgagtagggcttcgcgggagccgtcgcccaggacctccttcctccgcaccgagtactggctgggtgcagggggcaaggggccaggggttagggtgcagggtgcagggtgcagggcggtgcatggaagggggtgtctaaggaaaggagaagacgagcaggaacctcgtatcccaggaactccttgccggatgccaaannnnnnnnnncggtgcagggaagggggtgtttaaggaaaggagaagacgagcaggaacctcctatcccaggaactccttgccggatgccaaaggacatgcaagcagggagcagcgcgcctcccggggcactgggcaacctcacatgttgggacgattgaaggagccttggaagacgatggggtcctgcatgcccagagactctgtgcgaggggaggcatctccccatgagcagtgatgcggagaatcggaagctatcatgcacggatcacgatgcatgctgtcgcgcagagcaggtggtggnnnnnnnnnnacatctccccatgagccaagatgcggagaataggaagctatcatgcacgcatcgcaatgcatgctgtcgcgcagagcaggtggtggcatgcaggagcatgcagcggtgcggtaggggacccaggtccaggtgcatgttgcacactcctgggcagggtcatggcagcacaagctcatccacaccgaccaccccatgctcccctaagagagaggtgagaagcatctccacctcccccacctttaatcccggcttgcacgggtgaggttgccgtcgcggtgacagcgataacgggaactccgggacacagcgtgcgaaggttgacgagctcgaggtaggctggccggaagtctgtggtggtgtgaactgcgagcttcgagcagagccatatactggaaccgtgcatgacattgttagggtgagtagccagacccttgtaccgagttaaacacacacacatcatccacccaccatggccccactggctgacgcagtgcgcctcgtcgatggcaaaggagaccaggctgccctcctcgtgagcagcctgcaagagctccctgcggcgagcgatgggagcacacatgcagcaggctgagcctattgttgcagccaggcacatttcacgacactcgattcctggtcgcccctcctccacatcccccccccccaaatcgcataatcctcatcttttcctgaacaccagagcggccagcagcgccctcttcaacatgcctggctcacctcatagggggcgtgcggaggctctctggtgtggtgtacaggaggcgcagacccccttcatcacccctcccggccagcacagaggatctgatgctagcccgggcggtgtccgacgtgtcccccgcccacatggcagcctcgatgcccctgtccagagcggcctgcacctgatcccgggccagggccaggaggggcgtgatcaccactgtgaccccccgagccaccagtggcggaagttggaatgtcaccgacttgccgccgccagtgggaaggatgaccaggacgtcccttccctgtaacgtggcttcgacggcctcgcgctgcagagagcgaaactcggcatgtccccaatgggctcgcaggcagtcggaagggtcaccaatctcatgaccggccgtggccatgatgcagagactaggcgatattcgtattgggcagaagtgaatgcggattcatcctttggactccctgaactgtgtcctgtcggtgtcggtggacgatttgttcagtggctgcacgcacctgtgatttcggatttgcatgtgttcaccaggagtgaacagtgttggacggaaaatcccacagggccgggcaatatgaacatgaggatactcccaattatgcattcgatcatcctcttcnnnnnnnnnnattcaccaggcgtaaacagtggtggacggaaaatcctacaggggctggcaatatgaacatgaggatgctcccaattatgcattcgatcatcctcttcggtagattttgctttcacagcggaagggtttctctcgaagtgatctccacctcgtttcggatcctgtccnnnnnnnnnnaattttgctttcacagcggaggggtttctcccgaggtgatctccacctcgtttcggatcctgtccttggtctagcctcctaccacgcagagtcctcatcacaactcgctgtattattgcgttaaatggcattgaactcatcattcgaaagggatgcagtgtgacggatcggtgccgcaggtagccccattccctgggtgccacagcacgatcacaaacattgttgaacggattcccctaaaaagcccggatggatttggctcaagaccccgaaaccagaaacattgtacatttgcatttgcaacatacnnnnnnnnnnacacgcagagtcctcatcacaactcactgtattattgcgttaaataacattgaactcatcattcggaagggatgcagtgtgatgaatcggtgccgcaggtagccccattccctgggtgtcatagcacgctcacatacattgttgaacagattctctttaaacgccctgatggatttggctcaagaccccgagaccaaaaacattgtacatttgcatttgcaacatacaccaaaagtacatgctggagagccctgtccccattcctgtcgtggcgggaattttggaacatcagtcatttttctcccccttgttgagcgaaacgaccttgaggaactcaatgagaagaaaagccgcaaagtctgagggaaccacttcgtgcgttaaataggatccaccggttgggctgctcgttgtnnnnnnnnnnctgagaataaaaaccgcaaagtctgagggaaccacctcgtgcgttagataggatccaccggttgggctgctcgttgtcacttaggctttcggcacgtcagcacagaagccatggcgagtgggttcgtgtatgccgacacctccaagggcctgtataagctattccataaatctcactttgcccttgcgggcctcgtccccgctaccttggccttgccgtccgatggcttcccagccaagctcgcggacgtgggtctcgcggcagtcctccctctccacagccacgttgcgatgaacagcggtgagtggaacagcacgcagcgcgcccgctcaagatccgagataaattatgttgcttcaatggagttggtaccagggtctgggtttaattgcggaagtcttgctgtgctcatcccaggtccacatgcgttctgtgggtgtgggggagtgtgcctcccggctgtgccttggacgcgtggtnnnnnnnnnnttgcccgctcaagatccgagataaaattatgttgcttcaatggagttggtactagggtctgggttcaactgcggaagtcttgctgtgctcatcccaggtccacatgcactctgtgggtgtgggagagtttgcctcccggctgtgccttggacgcgtggtcgaaacccctctcccggacctctcccacaaacagtggtgaccgactacgttccgaaggctctgcagctcccagccagggcaggcgtgattggactctcggccgtcacattcattgggttgatgaagctctctctcacaggcgacggcattggcgggaccgtgaagaaaatctgggctggtccgcagaaggcttgaagcctttgagtgcaatgacggcgctggtattcctgccatgatgggacatgctcctccctgtagaattctgtaggcaatcaccaacagaatcgacctgtacacaaagccaaatgtgtcctcaagatgatgatgcaataccgtggaaggggtgtgctggagccaagactgagatgcatagcacctattaagctctggacgatggtgtgagggtctcagaggctctcgttgctgtacacaacatgcacgacccggtgaaccatgaacaccatgctccagcatcatctcagcnnnnnnnnnngaagctctggacgatggtgtgagggtctcacaggctctcgttgctgtacacaacatgcaagacccggtgaactatgaacaccatgctccagcatcatctcagcaagggtccctagccttcgaaaaattgatacctcctgactatcaatgtccaatgttgccagcatacagcgtagaggggaagcagaatatactcttgttcattcaagcctcacatgcagctccattcacagcgtttgagagggctgtcagtccgaagtcccaaagtgtgaattcggtggggaatgcttacaatgatgagaaggcaccnnnnnnnnnngaagatgatacctcctgactatttatgtccaaagttgccagcatacagcgtaaaggggaagcagaatatactcatgttcattcaagcctctcatgcagctccattcacagcttttgagagggctgtcagtccgaacttcccaagtgagagttcggcggggaatgcttacaatgatgagaaggcaccgtttgagcaagagttcaaggcgagcaaaaaggccacagtcggttggttgttcaataaaactacctcctggaaatgacacgacggcagctgcatccccgctgaatttggcacgcacatggaacccacatgggtcagggcggagaaaaagcatactacgcgctgcagcttcttgttaggcccgtagcgaaacacccggatctctctctctctgatgtgccatgcacctttattacttgtatacttcagggagtgggtccgatcgaagcatctagccctgactgtggagcgctgctccctttcgtcggacggcacgacagtaaacaaagcgcttcgcggtccgagcgcagcgctgctaggcatttaagaaatcagtgcttcattacagcactttttaggcaaagagtgaggcgctgggggcctcccacccgtggggagcgtagcttctgaccccgcacgaggttttgaaccctcggagtactgctctcaaaggacgcgatgcaggcccgacctcgccaggcctccaccnnnnnnnnnntcggagtactgctcccaaagaacgccatgcaggcccgacctcgccaggcctccacctctggcgacagcagcccatctagccagagtggtcccgatcttgcggccgctacgccacaacgcgctgctggcaagaccctgagttcccgggcagcgtcttatgcgcgccttcccgccagtgcctcatgctcggagatgccctcggcagccctcccggctgccacccccaagtggtacagcaaccgggtgtggtgtgcagcggccctcttcgcggtcctcgtcctgtgcagcctcaatgttgccaaactgatgggcacggcgcattctggagtcgaggtggtgaccgccgccggccaagggtccaccctgcaggtgaggagcgggtgccggtgattcgcatctggcttannnnnnnnnnctctggagtcgaggtggtgaccgccgccggtcaagggtccactctgcaggtgagaagcgggtgccggtgattcgcatctggcttactctgccagagctgggcgggtggagtgagcatgccatgtgctgcatgggatggcaggcctgcccatgccccatgctttttcccaggtgtgcactgacaagccgcctcgtccacgatcgccaggtggggaccctggccggccctgccgatgctgccaccagcgatggagtggagtcgggcaagttctcaaacggccccgctcctacgacggcaagttcactggcggattcgatcgtggcgacgctgagccagttcacaaactccacctccaagtccatccgggagtggatggtggtggtgcctgcaaacagcaccaatgcgacggaagccaaggctgcggacactcagggtgaggattgccgtcaggatggtcgagtgggatgcagctgggccggggtgggatgggagggagccccagtcgcaaatggtcgagcagctggagtggggtcgtcgagcggggagtcaagtgacttggcgagggtgctcagggattgcaggtcccagctctgnnnnnnnnnntgtggggccgttgagcggggggtcgagtgacttggcgatggtgctcagggattgcaggtcccagctctggtgtcctgctcccctttgggaagcccctctcggggaggggcggtcatgtcagtggtgtgatgaagggagggttcatctccaaatcccttcctattctcatctgtcggagactgcagatcccttaggaatcccttcaacacaatcctcagattcactcaatccccttcttgccgcaccgctcgcaggggagcccgagaaaaagtttgttcccgcagagctcccgccggccgaggtttggagcaggagcggcgacgcctgcgccgacgccctcaagatccccaaggtggcgatactcttcctgaccaagggcgacctcttccaccacgccgtctggcgcctctggttccagtcggcggcgggcgtcctgccccgcgcgccggcgcacgccgcggcctgcgcccccggcgccgcgcccggc

SEQ ID NO: 26024 - DNA, 61 bp, Chlorella protothecoides
agtgcatgggatgacatgcgatgtcagcccaaccagggagggcagcgtagtgggagtagac

SEQ ID NO: 26025 - DNA, 93 bp, Chlorella protothecoides
gggatttcggatgcaggagaagggggtggcgtactggccggaagggggctggtcaagagtgcaccgacccctgccgcccctccttcaccgcct

SEQ ID NO: 26026 - DNA, 63 bp, Chlorella protothecoides
ggtccagacatttcctcagtgtcacggcatcaccccccccctcccttgctcgagcaatcccct

SEQ ID NO: 26027 - DNA, 61 bp, Chlorella protothecoides
aagtgcgattgaaacgagcacgacctgcgccctccagcgccacgccatgccagcccatcct

SEQ ID NO: 26028 - DNA, 3198 bp, Chlorella protothecoides
  modified_base (2241)..(2250): a, c, t, g, unknown or other
  modified_base (2567)..(2576): a, c, t, g, unknown or other
caccttttgcaaccgggtctgggctggcaggcctggcaccgacgtccagctcctctggtgacagggcgaaggcagcgatctccgccttcacccttcgaatggcctcgccagccgtcctctgccccgccgagtcccgggagcccttggctttggctccagcccgaagagcctggcgcaggcaagggggagttattctggaatctggaccccttatcccctcagccggatggaatacctgcaagcgtacctcggccgacatgcgttcatggatggcgaccctgagccgccgcctcacgagcctcactcctctcgtgggcgcatgcgcctacctcctgcaactcccgccccagctgtgcagcgagctccccccgtgacagtgccccaagctgctcggcccgggagcgctgggcccgacgcgctgccacctcctctggcgcgccccagacctcccagtcctccacgctgctgctgctcgactgcggaggacggaggacgcagggggatgaagggcagggtcgtcatgcgatcaggggatgcagtccgtccaaaacatctgcaaagttcctcctcacgacatgtcctgttgacccatgcactgcccttcgccgggacctacaagcaaggaaacccaggagctactcactcgcagaccatgacctacccgggatcgggaatcgtcgctgtccccgctgctgctccctgcagcctccaggtgctgcaggatccaggccttctggtcggaagccggctcatgtgccgccgtctctgccttcagctcctgcaatgctggcccacagggctcaggcgcctcccgggccatggcacccagcgcacaagccgattcccgggcggcagggtctgccttgcgcagcaccgccacgtccccggactcggaggctgactggagggcaaaaacacgggggatgtcctttggcgccagatgcaggagcagccactcgatcagagcgtcccggtcaagggtgcccgtggctgtcaccgcctccagacactgggactgggtgaagcccagggtgtgaaggtcgtcgatctgggacagggccgcaccggtccatgcctgcttgtcaggcaggtcagggcgcgggccgtcgtcctcagggatagggaacacctgagggaaagggaggaggaggggggggggggggattgtgcttcccaggacattcgagcggatccacgttcgggggccccacatacgtccatcacattctctcttatacccactttgaggatcccgcggatctcggccagttggcatgccgcggccgggaacagggttgcgtccggtctcgcggtgggcctcttgctcaacatgttgcagcagatcttagtcgatggtgctgatctgtaattcaaccaggaggtcgaaactcaaagcagagtcagaggttcatcgggtgcgacatacaccgccttccaggcgaaagagccaccagcagctcgtttcctagatagttcagcgggcacccatgagtcgatgcaggtgctctgctgacattcaaagcttactcggaccttagattacgatactgttactgctaaagtacacccgccccaacatgtctgcgaaagcgagatgggtctggccgagggcacttccggcctcgcaaacctgttgttattgatgccgggctttccaccgactacgactcgactcccaaggaccaacaaacagcaaccgcaccggtaagctctataatcaccaacacagattcagccataccggcttcgtaatcaactattcaaggtaccttgcgctttcggaccaggagcacactcggttcctgacattctcggtggacagttctccccacttggcgtgttccgcggacccgtacgcccattcatggtcgcccgctctcagcaccagcccgactgataaaatgcaacgcttgaccagttcgtgttctggactggcttccctgggtcaggcggcggtcacccgcgcgctgcctcagctgttgaatctgcacaccctgccggtattcccagagagtgccgtgtgcgtcacccataccacatacgccaactgcaacacgggcgacctctccccgagggaaacagaagcccggatatggccgccccactcccgcctgacgcattcccaggcggccgggaggaacaagcgggcccagggccagggacggcgcggcctcgggaccaaggtgggagtggccggattggtggtttggggggtgcaggaagggtacaagtcatgcacannnnnnnnnnggtggccgggttggtggtttaaggggtgcaggaagggtacaagtcatgcacatggaattttgtcgagagaaatatctcactgggtgggctggaggtctcgagtctcataggctgaccgcgaatggcctgttgtcaggggccttggtctcgagggcgaggaagaagggcaggggcccctcaaaacgcataccactgactcaggccattgaattccccattggacctgcacccacacttgatcctccctccctcctccccctcccaaacccagggctccgcgctgtcaccccccacctacggcgacgcgctgcgctccnnnnnnnnnngggctgatcgcgaacggcctgttgtcaggggccttggtctcaagggcgaggaagaaggggaggggcccttgaaacgcctaccactgactcaggccatcgaataccccattggacctgcacccacgcttgatcctcgcttcctcctgcccctcccaaacccagggctccacgctggcgccccccacctacggcgacgcgctgcgctcccgccccgaccgcacgctgcacgccagcctccccaaggagcagctgagcctgaaggccaccatcctgttcgaggcggggtggcggcgcgtggaggagaagtggggcgacacctacgtctgcccgcgcgaggtggtctggctcaacggcgcgcccggctcgggcaagggcaccaacatgcccttcatagtgaagtcccgtgggctcagccgctcggtgggcatgtcccagctcctggacggcgaccctgagatcaaggtgtgcgatggggtgggtggaatggaggggcaggggccttggctcctgaacgggttcaagcctgaaattcttgcctgggcagcagcaccgatgatgctgccaccccatcaagccccaccactcacctgtccccaagccccccccctgctcctctcacccc

SEQ ID NO: 26029 - DNA, 61 bp, Chlorella protothecoides
gctcgaatgtcctgggaagcacaatccccctcccccccctcctcctccctttccctcaggt

SEQ ID NO: 26030 - DNA, 61 bp, Chlorella protothecoides
ggacatggtgagcaacaaccccatgctgcggcgcatgacggaggccaacccgcaggttgcc

SEQ ID NO: 26031 - DNA, 62 bp, Chlorella protothecoides
aattgtataggatgggcaagtagcctagcatactgggatcaatgctagggtggatcgtgctt

SEQ ID NO: 26032 - DNA, 80 bp, Chlorella protothecoides
ttaacatggtcttaagtatgcgacatgatgcgctacatctcttacactggtattgcaagcatgatgcattcacagccgat

SEQ ID NO: 26033 - DNA, 97 bp, Chlorella protothecoides
gctgaagaggttttgtatgaacacaggggcccaagtaccaccccaccccacccttcccttcctaaatccccctcccgacatgcttgtcctaccgggt

SEQ ID NO: 26034 - DNA, 93 bp, Chlorella protothecoides
gtcctcacgtccatcatgtgaacgtcatttgtagctccggccagccgtatgcctgattcgttgttgttggggggggggggggggggggggggg

SEQ ID NO: 26035 - DNA, 108 bp, Chlorella protothecoides
cctagtctacaaggttacctcagtatccctatcgaatgtctcatcaaatttgccatccgcaaagggacgtcttgacgcccttatagttggggatggcatgagaaacaa

SEQ ID NO: 26036 - DNA, 88 bp, Chlorella protothecoides
gtccttcaggtcctccaccacccgccccactatctccccgcagcccacgcgctccgcaatggccaccgtggtctccaccagcacgcgg

SEQ ID NO: 26037 - DNA, 879 bp, Chlorella protothecoides; identical to SEQ ID NO: 1580

SEQ ID NO: 26038 - DNA, 159 bp, Chlorella protothecoides
ctgagtgccgggcctcttggtccatgtgctccgccgccgagtgcggtaccgccagtgtgtgaccccttatcctgcgtgccaggcctgtcctggagttccagtcggtgctgaggtcgcaacctttccctacccttgtgattcatcccctcccaccaccgc

SEQ ID NO: 26039 - DNA, 16932 bp, Chlorella protothecoides
  modified_base (1937)..(1975): a, c, t, g, unknown or other
  modified_base (2752)..(2831): a, c, t, g, unknown or other
gggggggggggggggggggggggggatgtgatgggcatgaaggctcctcccattccaagcatcagtcacacacaaggctcctggtcttccagccccccgtgcatcctacacccagccatgcatccgaaacccagccatgcagctaaccctctaaccagcatttcaagaccaggcgtacgtagtcagagtcccaccttcggcacatcgccacgaaagtccttaaagatcacacagtcgccccgaggtgagaggacaaagacctggctgatcatgctgtcttgggcttgcgagacaccaggtccaaccccttgtttgcaaggtagttgacaagaatgatgctcgggatgtacagcgccacggcggtgatagccacgtacaggtcgtaggtagggaaggggatgctgtagccgaacagggtgtccgccatactgagtgatgtcaatgccgccctatcattgcatacaatcaatcagaatcagcgagggagggtgcgagaatggtaaggcagatcctcttcgccttcctggacaggtcgtcggtgtcctcgtgacaccgcgcgcgggacacggggagcgtcctcactttcaaaccccaggggttcgccagatcagatcaggcaggggctgaggacactaaaggaggccgcagcatgttctatgcaagcgagcacttgtattcaatagaaagagagtgcgacccctgattgaatcagtgggagcgtcatggatttcgaggaggagctggccgacctgctggcagaggaggacgaactccggcaggaatccagcgtgcatgtaggcaagtagcgcagctaggtgctgcagctgcagtcgcaggcgttataatcagatattcaccctcgcccaagctcacaacttattaattgcagggagcaacaagcgtgactgccctgtccgccagctggcctttggctccagctcaggtgggtagtgccctgtgcctgcacggatgcacagctagttattatggggacaggcagagtttttgtatgccatgagggatggggtattccttgatgagcacgtgactcgcagacgcagctcacaaatcgagctccatgccctctctatctccagaggccaagagggggcgctgggtgccggacgggggagctgcatcgagcctcaccaccttcacggagggcgagctggatgatgatgagctcctgcgcctggcagcagagaggctgccagagtcccagatcgcaccggggctgcatgacgtaactgccagcgagctgcagatgctgggggattgcacccccgcctcccagccggactttgaggctgaagcccaggagctgcttgcggatgcaggtggggttcttgtgcaaagttgcaatggaagacagggcacctaggaatttggttcaggatactcatgactgtactcacaacgagaggcggataggaagtgcatatgccctgctcaaaggggactcctctgtcgtgtatactcgcttatagcccacatcacctctacacctccttaaatcggcaggcattgatgcaactgaggccgcagccacgctagagctggccgctggcagaaaaccagtccatggaccagagggcgaggagaacctcatccccctgcgtccccacattccgccatccctgaatgccctagacgtcccaggccaggtcatgccagtcacggatggcagcgggaaacgagcgtactgcagcctagaggatgtgcagaacactggacaagggtgagctgcggacggtgtgggagcacatgcagcttgcgtgggagagagtggtgacgctgggtgcttgggagatgtgcccttggcgccagacgccccggagaggagagcggcctggatgccgcacctctggagacagggttccacaaacctctggaacaggactcgacatcatccccgcatccccccccccccccccccnnnnnnnnnnnnnnnnnnnnnnnnnnnnnnnnnnnnnnngtgcaaaggcgtgcggcgctgcaggcgaggtcgggcacgctgctggcgcggccctactccctcctcctgcaggacatcgaggcggggagggtggagcgagccaggcgggcttcggtgtctgggcgggggggggccgcgccggccgccaggcgggcggggcccgctcagaagccgaggacgctgtgggccgataagtatgcccccaccgccttcatggacctcctcagcgcggagcagatcaacaggtctggccgggggtggtggaggctgtgtgcgttggtgggggggagggaggggaggaggggaaaagaggggttggggggtgaattgcagggctgaagacagatgccagtcgggtgaagagggggcgctgatcttgtgaatgacggccagtcctgcacaagatccgcatcaacctctccgtgccctcgaaatcctccccccccccccccaaaaaagtagggatgtggtgcgctggctcaaggagtgggatgcctgcgtgtttgggcgcgcggtgccgccggccccggctgccaggtccggcgcaaacagcatggggccggccgccgcgcccgaccctctgggccgcccgcagcacaagatcatcctgctggctggccccccggggctgggcaagaccacgctggcccacgtggcggcggtgcactgcggctaccggccgctggagatcaacgccagcgacgaccggagcgcgggggcgctggggccgcgcgtcgcggcggccgccaccatgcgctcggtgctggccgaccgccnnnnnnnnnnnnnnnnnnnnnnnnnnnnnnnnnnnnnnnnnnnnnnnnnnnnnnnnnnnnnnnnnnnnnnnnnnnnnnnnacggcgcgctgggcggcgccgagggcgcgggcgcgatcgccgccctgctgcgcatagtgcaggccccgcccgtcgcgcgggcggggcggggactcgtccccggggcgggggcggcggggtccaggtcgagccacgaggccgccgacgcggcgtccagcgacggcgagagtgacggggaggagcacccagcgcctgcggggccggagaagcggcccaaggggcgcgggaaggccccggggcccctgctgcggcccatcatcgccatctgtaacgacctgtactgccccgcgctgcgcccattacgcgacgtcgcccgagtcttccacttccgcaagcccacggtgcgtgtgggagcgtgggtggctggatgtggatttgcatggcggtgaggaggtggggatgatctgatacggcgaggaagggtgcttgtcacggcatgtgtgggcttccgtgcgatgatgactatctcgtggggaatagtccatggggttcatggcatacccttctgtcactgactgtcttagcgtgaaggaccttgatcacccctccgcccgctccctaccatgcagacggagaggctggcccagcgccttgcctacctctgcgcctgcgagggcctgcggtgcgagaagagcacgctgcgcacgctggccgagatggcggagtgcgacgtgcgctcgtgcctgaatacgctgcaggtggccccggagagggggtgggggaaaggaagtggtgggaaggcaaagggaatgcgcctgcagcatcctcacgcacagccggacaaaacaagaacaggcggcttctgatgctgagagaggatcaagtcctcgaaaactaatgccgaggcgcactcgcctggatacacagcctctccaccgtactcgattcctagcctcgtgtccccaccacaaaccttcccctcccatctccccccccccggagcccagttcctggccagcagacagacgcatgtgcggttgcaggacttgaagggactgtcactgggtcaaaaggatgtcaccaagggtgcattcacggtgtggcaggacctgctgcaacacaaggtgagggaggggggtggaggggcattaagagcggcgtcgctccatggaaactgtccaggtccagaggctggctgaatccgccctgcagtacctgagcgctggtgatgcaggggaagccgacatgtgtttgcctcaaccctcccgcccccgggaccccccaccagccgccggccgccattgctgggagggcgtctgaggcacctgcagcgcgacagtctcgcctgctaaccctgctgcaagattttggggagcacgatctggtcctcaggtgtgataaagcttgtgcccagtgatggggtcagggagaggtgacgggcctggtgctgcagcccctgctcctcgtgcctttggcttgtacatgcatgcctccatcagttcttcaggagcagccataagtccagttgctggggacccatgatctgaggatttcacaggggcaccggcagccccactcccccaagcctgccccgaccctttaaccctggctctctccaatcttcgcacagtggcgtgcacgagaacctcctgtccctccgctactttgacctggcatgctccagaaccgcctgggccctatttgccctctgcgacgctgacaggctcctgggcagctgctatgcttccggtagctggggcgcagcccggtatgtgcctgctgccctcctctccgccgcaggggaggtgaccagcgttgagaggtgggtgctgggatgggagtcattggagaggcctggaaaggtacatgggtgtgatcaggccatgcaaggcagggtcagccctgtgggtggaatctttgacaacttttacactgtgcacgtggccttgaggccaattggccagcagtcctgctcagccatccatcccactcttcccatcccctgtgccctcccttctgagcacaggcctgccatggtgtggccaaagagcggagcggatgcaaggcggaagcaggcggggcaggcggcgctgctcagagcctggcggtgtgccatgtcgccgctgggtgccgcctgccatgccccccgaagcctggtcctggtgagtcaaagctggcgggtatcgaccaggccttcagctgcgtcgcagccaaggcactgtcagcagctgccgactgccacagcagagcactgcaggggccttctgacctggattagatggatgcggtgtctctgggagaaccccacatcatctgcaggcacacgggcatttatgcacggctttctgcgcattgcatctgctcatccatcaccatccgcactcccgcaggacatcgcaccgatgctggggagagtcaccgccccccctttgcgccctgtgggcctgcggctgttcagcagcgctgagtcagcagccctgaaccaggtggtggccctgatgctggccctcggcctgaaacctgccccacaagtggaggacgacgaggatgagaatgccgatggggaggagcgggaggcacatcagggtgcgggcgggagtgggatccagagggggctcagctgtctgtgggatgtgggggccacgaatggctgggaaccctgcgctggacgtgctgctagacccggaccagggcatcctaggggtcattgccaggggtttgattcctctgtccggcagccagatgaacacttcccacagccgacattctccccccccccatccgggacccctaggcctggcatcctcctcgggccgacccaggcaggcccacaccctgcgattccagccgccggtgcactcgctggccaggttccggggtcaagccgcagcctgccctgtcccgagctgccaccccgccacctggcagaccctgcagcaggcactggacatggaggccatccgcagggcggaggcagggcgcttggacgccggggacaagggaagtgcgaggagcgacgcggtcgctgcctcccgggaggatactccgccggggctgggccctggccccacacgacccgtggtgcccctgaccctggccgaacgactccagctcgccaagacgggtgcggggggggggtgtttgcatggggcattggcatgccagggcatgctctcgttctgtatcacacctggtaggcactttggcccatcacctgtccagcaacctgaatccctaaccccccatttcaaattctcccatttgcagcgccgtctgctgccctcaaaccccagcggagcatgagttggctggatggcctcaaggaaaggaagcgtcccatgggacgacagacggtgggaggaaaggacggcgccgctccccattcggtgctctactgcttccacgaggggtacaccaacgccgtccggcgccccgtccgcatggctgacctgctgtgagatgctctgcctcaaaggacccttagcatacatggagagagtatgggatcaggaatcccactgtgtcacgagggactgggccaggaccgcgccatgcggtgccgccgcagaggacatcctcgtcatcgttttgctgccgtggaaacctgacccaggtctgcatctcaacctggacaatgcttgtgaatgaggaccacaacacatgtttgccgacgaccaggtaccccgcggggcgcttcttacagttggtcccatgttgcattcttctcagcacgattgtacagcagcagcacacagccggccgcctgcctacgggtgggggagggccgcgcggagcggccctccaccaccgggtgcactccctcctagcgcggcgagacggtgatcttgtcatcgtcggccagcaggttgccggtcctccagtccgccaccgcccgcacgggccagaggaagccctcccacaggttgcgccaggcggcggggacgtcgatgatgatctcgcggttgaaaggcttggccgccagcttggtctcctgcaggtacttgctgccggcgtacccgatccagcccgcaaagtagatgaagccgatggtggggaccagcacctcccccgcgtggttgtagcgcagggccaggcccgggtccgcgatcaggtgcggcaggccgtcgttgccgcacagcaggttgccgcggccgtacgcggcgaagcgccgctccacgttcttgatgttggcctgcagggcgatcgccggcgcggtgccctcgtcgtactgcgcgatgcgatgtgtgtgcgagggagggtgagggattggcagtggagggacgcgcagcatggtcgcacaggggcggccggcgtgtgagaccggcccctaccctcccaaccccaccccccaactcacgttcttcaggcgacggttcagattcttgatctcattcttctccctcttggcaaaagccttgctctgggagcagggggtgagccctgccacgtcagcctgtgctggctccaccgcccccaaaccgagggccagggccagggccgcggcagcagcgggtcccacacaggcctgccgggagggcagggcggagcagctgataactggctttgccaccttggcgcgggtctgctgtggggcatttagggtgcgggcccccgaaatggaggcctgcaatggtacaaggggggagggggagggggtgaaggcgagtgcggagcccatgcggggtgtgggctggtgcgggcgtgcatgctcaccttggaggacagcatggtgcacgccattggagctaaatcctatcctcgagcacttgtcgattgtcacgagagctcgtgaatcttactctgcctgaggggggtggtcggggcctggtgagatagagggctgatcggattcgatgccggggacatcatccagggtcaaacccggcacagcatggggctgtgaagtaagtgtcgtattcccaccaacctgcgaagattttctcttacgaggactcagtgaagcatgcaagttacggcaaaatattccacatgattgacgataagcacgccgctcgcagcagggtttgatggcatgcaaccatgttggatggtgtgtagttactgacatgatactgctcgggatgccacctctgcaggaatcagatataatcaagcgatatatcgaatgctcatgtcaccgcacatgtagcgaggggtagtcgctggtcgagtactggctagatgagctgctggtttttaggcgggaaaaaagtgctttgaccacaacccagctcccccttgcaaccgcgttcggagccccgaatagctttcttgttacgcccactgcgtcccgcccgcaagcgttgcgatcccgtttacaagcccccgtcttaagagtccagtgacgatgtctggatatcctccaccctccgggtacgtcggcagctcgaagcttgccacctgcccagttccggacgttggagacctggaactccttgggtggagccacatctgtatccatgttgacttggcatgatttttgctgaaacatgatcgattttctctttctggcaggtaccctccagtgggcaacggcggataccaggggcctcaagggtaggaagggggggaagctgctctcgtgtgattggtcctcaccagatcccttggcctgacttgggcctccgtgttcatgcaggtacccctccgaggggaagggcgagaagtacgccacaggctaccctcagcaaagtgggtttgtgtcgggtagtgttgtattgcctccttccaggggggccgagccgtgtccaggaagaccttcaccctcaatcgagcatgtctgaacaccctccccgtgcagatcctggtcagtaccctcctccccagtatgccggtgagcgacgcccatgccctgatttgatgctggcatgtctctctcagtgttgatgcacatcactccagacaatgtcgccagaggacccacactctcgccctcccccgctacaggaggtccgcccggatatgaccagcagggctacgccgggtaccctcctccccagggctaccaaggcggctaccagcaaggaggtgcgttgacgtgggggaggtgggggttgcgagacaggatatttgccggactgttttgccctggtcatggcattgctagattacttaagaagttgcatgagacagcatttggacttcctttgccaagctaaacttgcatccatcaaactctctatccaacagggtatggtggaccccccccccccggctaccccggctcgcaaccgcctcccaactacggtccgccccagccagtgtacgtgaacaacgccaactcctcgcctgccatggatggctgctgcgctgcttggtgagtcgtgggctgtgatcctgtgcaggaacgttgagccaccttccctgcccaggcagtttcaatcctgggtctgagtggctgaggaacccccgacccaacccgcatgtgccgagcatagtctaatgcacctcgtcacagtgcttcacatgtacccctggcccccttgcctgcagcctggctgccctgtgctgctgctgcttggcagaggccatcttttgatattgccatttgacggctcattctctctttgagctcgatattgggggggaggagctcacaggtatgctcctgctccaggtgccggcagcccgcacacgtccagcgaggcaacgagatgtacagaaaccgtcacacctcgctgcagtcggttcaggttgtcgacaaactgaagtcatggagcactgttgctgccccgcaccctgcttcattcttgtatgaatcacaacctcacaacaaacagcactgcaggaccacgaatgaggctggttgttgtaacatggcacctcatgattgtccaacagactccacaaaggccatggcactcttcttcacatgctccaccccctccgcattgccctgcgccttctcaaagtccagccaccgcttgaaaaggaacttcatcttcttggctgggaggtggaggtgggtggccctctcaaacagcgccctgcagatcatgaaacagggggggaggacttcttgcatgaaatgctttctcatgactaatggggagatgataagtcagcagggacgcacgataatatgagagtgggaccccttgtcgcacatagtaggggcagaaatacaggcgagcaccccacaatggcctcaagcagccctgcacccagcagcccctctccaaaccagccaatctccactcccggcttgcctgattcgagcctcatccccggtcttgatctcttggtcaatgtacacgctccacaggtctaatcgcttggggtagttccggaggatgccctcaaagatgctccttcccctctctgatgtgttgacaaatggaaaccgaaggctatgtgtccaccttggcaggtactggaagttgaagcacccacgctgctgatcgcttggtgcaaaagcctccccctccccaccccccccaaatctaccaacctgcgtccccatgcttgaactcgaggagggcggtgtgggagatcatgtgcacatgctccgacttgggcagggactgcagcgatcgcgccagagtggcacttgcagcctcctcgtctccttggtccagcctcagcctgacgatcctgagccagatctgtagggaatgcggtgatttggagggaaggggatggggagtgagtcacttggaggtgagcggtacaggctttgccttgtgatgttggggcgcatgctgcgatatgatgctgccccctcgtgcttggtttcgggatgccttccccacgacctattcacccctcacaaaaacattccctgacctctgtggaggcactgaacttccgggacatggccttgcagcactgctccagcagactggtcctctcgctgcgctgaaagatgtctgtggccgccaggtacatccggcgggcgtctgtgtgctgcagcgcgcgccccagcgtgctcagcgtggtggtctcatcgccgtacgtgttttccaggttcagcagcgccacccacacattgaacttctcggcgtcctccctggaacggggtgtgggagatcatgatgggagctggagagaagctgggcatgcgtccagcagctcaggctccatgggtcccaggccgcacccaggtgaccgggcagggccaccagcccacctgtagtttatagcgctgaaggcccgctgggcgacggctcgagcctgctcgatgtcacccagggagatgaggaaggccatgtacttgatccacacaaaggagctgtctgctgaggaaaggaggagcgcctcgtactcggccgcactggtgggcgctgcatctccctgaagtgccgacggggagggtggacctggtactgagccgattcaggcatgtcaagaaactttgcatgagcttccacggcagggcatgcacgcctgcactgcaccttctcgtacctgcaatcgcctcagctctgcctcacgaatcgccgtctcctctgctttacgccgctgcagcttctggtgcttgctcagctttacctttgcagtctcctcctcgcctgttggggagtttgagcatgcagtaagcagggctccagctctggaaagcgaggtcacggcggcgcatccctgcaagacgacaaccagggaacaacccacccacctgccaccaattcatctgggcttgggcccgtctctagctcctcccatccggtctctgtgtctaactgaggcttcaaaaccttttgttgcttggaaaggggtgccagggtagcgtcatgtgagactttggccttcttcgctgcggccatgccagtcggagtaagaggttgcgtggaagatactcgcgacagcagttgagacttcctgggacactcgttttaataggtaaacctcgttggatatgcttatcatgtgcggacaatgtcccttgccgtgcttgttcgcacatgcactggtactcgaattgagcgccgcgaggaacgcgccggcgcgccaacctctctccttttcacatcgatcagtgtaggttcgcgtcgtgtagcgcctcgacacggccaactggagtgaatgctgggtagattgaagctacacgaacacccacttgatatctccctcacagctgggcatgtcgttgtcggtgagctggggaggctttactcagagggcttgaccccatgatgcacacaccccttcacctgcattccattgtttctcttcaacaccgatgcagggcaagctctttcggtatggaccagaggtagcacacacggccttcatctctggtatgcagagcaaatccattgcctgtggcacatactgcgtgccatgatggtgcaggcactgatgccctcacctccccctccccctgccaccccaggctccggccggcggcatgccatcctggtgggaggcttgtcggacggcatgctcttcactgcatactgtacgcccctggcccggaggctgaatgcagcggggtgggcatgcgtgcagcccctcctctcctcctcgctgtcggggtggggcctggcgagcctcgaccaggatgcagcggagctccatctgctggctgcagccctggggagggagcacggggccgaggtgggcggtctgtcgagggttttgaataccgcgtcaggttcgtcagagcgctggtccccctgcttgccaatgcacagcgctgcccgcctcagaccatgtcgatcatgattgaattgtctccctgctttctttgatctgccggaaaacgtgatcccctgcgcagggcgtcgccatcctgggtcactccacggggtgccaggacgccgtgcgctacgcgagcctgtatgccggtggaaaggacggcgcgccgcccctgatgggcctggtcctccaggcccccgtcagcgaccgcgagttcctgggcaagcagcaaagcaccgccgccctggcccagcgtgcacagcgcatggtggaggaggggcggggcgaggacctgctgggcagggctgatgcgctgggcgggacccccatcaccgcccggcgctttgtggcgctggcgtgcgggggtggcgacgacgacatgttcagctcggatctgagcgacgcacagcttcgggtgaggggcatgttggttgaggatggtgagcagtgtcttgaaggtggcctccctgcacggcatccattccaacttagggtcactatgtccacgaggcttcgggaggctgatccgctggacaattcgtttgatagtcactgtgcacctcgaatcctcctccccttacacatcaccctcccaggagctcttgaagggcgctgcctcggtgccatcgctcttcctcctgggcgctcaggacgaatgctacccggctggttgcgacgttgagggtctgggccgccggctggttgccgcagctggaagctcagcgcagctcaaggtcctggatggcgaccactgcctcaagggactggaaaacgaagttgtggaggtggtatctgacttcctgctcagtctcccaatacaatgacgaatggatgggctgcaaagcggcggatgtgttaaactcattcacttgcacattccttcccagtgagaggctgggggacaatgatggagagagttgtgtattttcttggcatttgataaaaaatcagacccattcaatttccttgcacctggtaatcgttggagactgcgaatctgaacatctccacggccgaagcgagcaaagtgcatcagggacagttaacaacggaagatttccggagttgatgtgcaccaaatctcgcttcggaacccatgaggacgttcgtctagagtgaaactcagcattacatctccaaacatgcggtgccatggcgacaggcctagcactgctgttggagctgccaggcctccccatctcgtccatcttccgagtccatgtcccgctggcgccgggctcatcctgcatgaccgatgccgagaaggatgctcgggctagaggagcccttacagccatcaaggctctgagctcgaccgctgttccctttctggctcgcattgcagatgcctggaatctggagctggtctgctccaaggcgaggctggaaggggagggggaactcctccccctgcccttcatagtagatgttcccactggtacatccattgccatgccccaccccgacaacctactgataccaatgcaggcccacgtcggcgccatctacaagctcctgctggcccagcaggcaggcctgggcatcgccatgtcgagggatgtgcgcgcccacgtgcaggtgggcgcccttgctggcgcgcaggcggccaccgtcgcgcggtgggtggcggagagcgcgctggagcgcgctgggtggtggcgcgtggcgcaggaacacctgctcagcgcctgcctcctggaggcagcgacaggagaacgcctcgggcagtgcctcaggctgggagtcgaagcggttgactgcgtgtcaccgaccgcgctgcgggttttcctgcgcacaggtgggatgagaatggtcccagagtgggtggaccgagaataggagtactggcatgacagggcagagcgggccaagctttgtcgcagtgggtctacatttgtgcaacggtcccaggcaccacgccccgagtgacacccccgccgctctgcagacagcgtccggtacacccgctggcacgccctcccgagcgacgatccagcggcgctggctgcgctgtcggagcgggtgactggatccctctgcagcgtccttcccttctgccggtgaggaggcaggattccggcgctgggcggggagaatgcacatcgccgggctgaatctgctcaccgccgccaccctcacgccaccctggtccatgaaccctgcacaggcctggcatagtgagtggcatccagccttgcagcacagagctggcgaccaggctgcaggaggagtggcgcgctggggcgggctatgccctccctctcccggggcacactgtgggtgtgcgattcgaggaggaccctgacggcgatgtggcaccataccctccgtcctgcatcttgtcttcttctggtctcgaagctgaaagcatgtcgcctgctgctctcatggccctggctggccgcctcgtcggtgcgtggcagcgggttttgtggcatctcttgtctttcttccctcataggagccggtgttggccttgcatctcggtccacgctgctttccacacctattgggaacgctctcgcacacaatcgtaagccctcctctgtccgtacaggggacttggatgggcaaccgaacccgttgctcccagctgcgcgcatggcgtgcggggcggtccacacctggcggtcgtcagatgcttcccctgtcaagggggctgggaacagcagccccttcacctcggggctgggggtggggggactggtgcctggcagcgcctcccgccacctgggcctggtgttgggccctgccgtagaggccggtgctgggcagcctggctcgcacgacgagcaaaggccttgtcgtcaccggaggaagacgcgggagcagcacagcagagcaggtgcgagcttgagatgggtgggctgctagggtggatgccgcgggagaatgcctggcacagcactgctgggtgtgcaagctcgtaacacacatgttgtggtccctgcatacaagcttcccgtcccactccgccccggaacctgcaggggagtggctcaagcagtatctggtccgtgtgacacagcaggccgctcaggaggaatgcgaggcggcagcggcgaggggtgcaggctataaggtgtcggccaggctgctgaacgcccccacgccacaagccccaaagcgcaggggagcggtgcccaagaggaaggtcgagtcgtgcgtgcttgccctgcagcagcccaagcggccgcggttggtgcagccccggcgtgccattcctgtaggaccgtctgaggcggcaggcatggccgctaccacaccaggtccaacaaaggagagcggtgggccgggcacaggccaggacgccacaccaacggagccctctgcgtgcaacgatgcgccaggcgcagcggccgtcgcgctggaaaccatgcctgcagcgccgcctgccggacccaaggccatagcgaggccgcgggccagggcggccgacgtggacgtcggagcgctcatggtcaaggcggccgctctgcactccgccggccagctcagcaaactgacggtgctggagctaaaggccttcctgaaggcgcggcaggcggggctcaaggggaaaaaaacggagctggaggcccgggtgcaggccatgttggtgtcgggtgcagctccagcagctgctgccgaggagtgagcagccagacaagtcggccggcgagggcgacaccatgcctttgttctgtgacttgctgttgtaaggtctgcggcgccaccatgaaatgcgacggcgagctatgggtgccatgacttgtgtggggtccaggaagtggacaggtggaatacttctgaggaatgcgacgagattcaaaaaccggacacgatcgaaaccgatggcgtcctcgtgatactagcggaacaaggtactgatcaggcggcccctcacttgggcgtcaatcaaccagcattgtacagaccgagtgagaaactctaaaaacaggaggagctcgtgggatgtgacggtggagtagatctgcgggagcgggggttccatgcccaacgtgggcctccaggcctacttatggaaccgactccccgaggatgcccgcgtgaagcgcctggtgagagcgacgctcatggcatagatctggtgttgatagcattcccatgctgatctgtcgcccgggttcacccgggctttcgcgtatgtgcctggtgtcttccgacaagagccccatgtgcacaggccatccccacagcctgggataccgagtggacatgccctccctgctccgataccatcctctccacctctggccttcccacactgccaagcatgcagctctggcagcagaatgcgggcacgtataaggggtaccgcgcctacatccagcatgtcaagggggcggggttccccgaggtgggcgccgaggaggttctgcgcgcccactccacgggggagtggacagcccaacaggtgagtagatgggcgatgctatttgggttgcttctcatacgcgggcctccagcttgtttctgcctgctgcatggggcgcccagttcctactgtatcccccccccccct

SEQ ID NO: 26040 - DNA, 75 bp, Chlorella protothecoides
gccagtctcctagtatccaaccactgccgcatcctcagaaactggatcctcacaacaatgtccgcgggcgcccca

SEQ ID NO: 26041 - DNA, 69 bp, Chlorella protothecoides
gagtccctggagggcgctcaggaggatgcgggcataccggacgatgggacgctgatccaaaaagatggc

SEQ ID NO: 26042 - DNA, 71 bp, Chlorella protothecoides
cctgtgtgagtgacaagaggcaaggggctttagataggagtagtgcaagtatctcactgccatcatgaggt

SEQ ID NO: 26043 - DNA, 61 bp, Chlorella protothecoides
ggtccaccctgcactacatcaacaacctggacggctccatctcctggttcttcggcctcgc

SEQ ID NO: 26044 - DNA, 193 bp, Chlorella protothecoides
cgaacttccccagcgagcgcgagcgccaggctgggtgtgcttcctcccgtcttgaccccaggtgccccgtcccacagtatcatcggggtttcaaatccgttgcatgcacgaccgattggaatatatgagtacacaggaaacaggggtcacaggctccctgggcagtcggcacgcagtgtgagccagggggggg

SEQ ID NO: 26045 - DNA, 207 bp, Chlorella protothecoides
tgcactgttgggaccagcttccatgcgaggattgcagtggcatcctgccgtgtcaacacctgccttgccttccattccgcttgcaagcgggttatgtccactgcgtcatgacgaagcatcacacctgcaacccacctggccagcctccacacacacaccgaccctccccccaccgctgctgcaggacaaggaggacgaccgcgagat

SEQ ID NO: 26046 - DNA, 61 bp, Chlorella protothecoides
aacctgcctggtcaggcggcagtccatgcgccccgtctgcagcgggtagaccaccatcatg

SEQ ID NO: 26047 - DNA, 522 bp, Chlorella protothecoides
tcgaagagaactccccgatatcgatgtgtgcaatgctcgggagctttgagggtgctcgtacttttgcagcagctgtgcacgggtatgaatcccagagcagcatgccacagacacccctgcccccataagtgccttgagtagcgtttctagtgggaaggagccggctatgagtgccattcgcgctggcaatttcgcgagagcccgtgattacttgaccgtggcatcccctgttgctgtgcctcgccactgagtgccagccggtcggatgtgcgactcttgcaaggctgatttcttcatggcgcaagttcattgagactgaagacacgtcaatcggctgtagtccgcatcgggtgcgcttaaaaccagaaaacaaggcgtttccggagaccagggcagtcgccctgcactgaccaagtgtgctgcagaaacgcattggcggcccacaggctgtcgtcacaccatcaccgttgtaaactgggcctttcgaagacttgaaaaggctcagggctattgtcccgctgc

SEQ ID NO: 26048 - DNA, 159 bp, Chlorella protothecoides
gactctgtggttgccatggagaggggaagacggggcctggctgcattgagcgcgcacaaatggatctcagcaggtcaggtgcctccctgcgcatccccaaacgctattccaccctcgtttcccctcctccttcaactccaggctgtggaggacgcgggg

SEQ ID NO: 26049 - DNA, 61 bp, Chlorella protothecoides
caatgtatggcctgggcccctgacgcacccatgtggcccgcgatgtcccaccactgctgca

SEQ ID NO: 26050 - DNA, 145 bp, Chlorella protothecoides
gggctgggggctctggggaggcttgggtgcgtgctggggtggaatggccgggagtcacctcaagacctggggtcaggtggtgagccggcagcagcctcccgtgaatgtgaggcgggggagtggacagagaggagaggtccacgcc

SEQ ID NO: 26051 - DNA, 79 bp, Chlorella protothecoides
ggccagtgcagcagggctcacccggatgaaaattgtgggccagtagggtcggaggaggatgaaggggaacacccgcccc

SEQ ID NO: 26052 - DNA, 61 bp, Chlorella protothecoides
cccctcacaggagcttcaccttctcatccatccagcaagaagccaccagacactcgctcaa

SEQ ID NO: 26053 - DNA, 74 bp, Chlorella protothecoides
gatgagagtccagtcggtgatcggcttgctaaaaagcatagcaactttcgcgccgccatttctggtggagatga

SEQ ID NO: 26054 - DNA, 61 bp, Chlorella protothecoides
ggcaccagcataggcacaggattgcagaaatctctctagccagtgtgtgcctgggacaacc

SEQ ID NO: 26055 - DNA, 74 bp, Chlorella protothecoides
gcacggcagtagcaatcacccccctttctcttcccgtcaacctaccttggagtgctcgccgttgatgatgggcg

SEQ ID NO: 26056 - DNA, 166 bp, Chlorella protothecoides
atttgcagccgatgagctcatgcaggtggggcatgtgggaggttgtttggaagacctcacagacgggagtggaggggatgcatgtgccgtccccgggctcacatttcaagcgttgcaggctggctgtcgcataccttgcagtgcgcatgagtgcctggcccttgcc

SEQ ID NO: 26057 - DNA, 757 bp, Chlorella protothecoides
cgcggcgagaccggcgcgggcgtgccccccgcggccgggcccgccccgcccggccaggcggtgccgcccaccacctggctgttcaacggcatgcaccgcggcatggaggtgctgctgtcggagctggagcgcaactcgcgcctgctgggcacgcccgagcgcgcgcaggtcctgctggccgcctgccagtcgctgctgctgggcgacccgcgctgcagccagtccctggtcccgcgcctgtgcggcgtggtgctggccgcccccgccaccacgcgccacctgctggtcaagtggtgggccgagtgcccggccgcgctgctggaggcgcgcgtggtgcgcccgctccagcgctacctcaccgacgagttgtacaccaccaagaagctgacggtgagcgtgatgaacgtgatcaaggtcctggcgcgggtggaggagggcagcgcggcggggcgggtgctgccccccgacgccttctacaacgagctgatcagcgagaagctggacgtgctggaccactacgtggcctggcgccagacgcacgacacgcccgcccacgcccccggcgccgacgggcccttcagcttctgctcctacccattcctgctcaacccccgcgccaagagcaagctgctgcacaccgaggcccgcatccagatggaccagaccgtggcggcctgccgcgccgaggccgccgcgggcggcgaggcggcggggggcgaggagcgcgtcgtgccggccaagcgccgcgcgccgcgcg

SEQ ID NO: 26058 - DNA, 61 bp, Chlorella protothecoides
gtaggagcagaagctgaagggcccgtcggcgccgggggcgtgggcgggcgtgtcgtgcgtc

SEQ ID NO: 26059 - DNA, 77 bp, Chlorella protothecoides
gtcggcctgtggaagtgagagggaaatatcatgctgtgtgtgtgtgagagaaagagaggatgctttgtggtcctcag

SEQ ID NO: 26060 - DNA, 159 bp, Chlorella protothecoides
ttttgctggctgactcagcacactgaagtggggaggtcgagccgctgttatggacacgctggcaggccaagggtgcacttggggcacagtaaattgataactggtgtcaactgacgggccccatcacgccagggtgctgggtccaggagggagcttcaa

SEQ ID NO: 26061 - DNA, 76 bp, Chlorella protothecoides
gcctaccaccgcatgactcttagcctcacaacctcactccgtcccctctgcaggcgcaatgcgctgtgcccgacac

SEQ ID NO: 26062 - DNA, 61 bp, Chlorella protothecoides
gtgtgggggggatgtagtccacgagcgacaacccgccgtttgataaatttcatcctatacg

SEQ ID NO: 26063 - DNA, 77 bp, Chlorella protothecoides
tgagcttggacttggccaggacactggcacgggttccgcgtgggggtggccatagcccaggatgctcaacggcagct

SEQ ID NO: 26064 - DNA, 131 bp, Chlorella protothecoides
gccatgcagcccgctcgacttgcggaaatctggcgtgtcatggagttgcgtgcggagcgaggcgtgtcctctcacttccggtcctgcgcaacgagctcacggatctccgccatcatcaccaggacgccatg

SEQ ID NO: 26065 - DNA, 72 bp, Chlorella protothecoides
ggcatgagaagtttgacaggggcggcgtggcgaggatgacgaggctgcagcttcccaccgagaaggagtgga

SEQ ID NO: 26066 - DNA, 61 bp, Chlorella protothecoides
cacacgacccccagaccctggatccacggaacatcgcgggacgatcctacagtgtattgcc

SEQ ID NO: 26067 - DNA, 76 bp, Chlorella protothecoides
cggctggcgattccagcatgtcgcatgacagaatgtgctgcctcctccagggaatgctgaggaaatggtcaagcgc

SEQ ID NO: 26068 - DNA, 553 bp, Chlorella protothecoides
  modified_base (118)..(328): a, c, t, g, unknown or other
ggaggtgggtggttctggggtctgatggggcagtggcatgccttggtagcacacgtcgctccatgtctggtgtccaaggtacatgagcagccgccagggacattttgccctcactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaattcatgggaatctgtgtgaacacccaaatcagggtagagcttcctcgcacaatgtctgcccaagtactgccatgtgtgcttgtggggcacagtgtttgcagcgacaccttcaggtctcggtcaggacctctttcagcatgccaagcagctccatggttgcagggatcctcgtggcacccctcctcccaccaaccacaggtccactgcgtcagagcggtcgg

SEQ ID NO: 26069 - DNA, 115 bp, Chlorella protothecoides
gaggagttggagctgcaccccttgtcccagccatcgtatcccatccccacacaccggtaccccgcagaggctttgatgtgtacgtaaacatggtgctggaagatgtcatcgagta

SEQ ID NO: 26070 - DNA, 61 bp, Chlorella protothecoides
aaacatggtgctggaagatgtcatcgagtatgagattactcccgagggcaagcaggtaggc

SEQ ID NO: 26071 - DNA, 61 bp, Chlorella protothecoides
gggggcgagtgtagaggtccagggcggtaacgaaggccagcacatcctccgccagcaccgg

SEQ ID NO: 26072 - DNA, 240 bp, Chlorella protothecoides
cgtacacagtgagtccttgggaagggggggagcactgcaatcagaacctggggtgcatgtcctgtttgaccagaccttggggtgtccagtaggcctgattttattggggagagcaagcctgccacaggaccaggattgtgaaccttgcccccatgtggtctcctagcgttccaggatcgggatgcttcacaaatcacgcaaaccttccactcatgccaccaaaacaaccgcggtccactc

SEQ ID NO: 26073 - DNA, 170 bp, Chlorella protothecoides
cctgcagacttcagcctggacaagctgatcccctttgacctgaagcacagcctggatgacttcctggagaacagtcagctggacgagttccgccggccccataccatccctgagctccatgacctcttcgagtctaccctcgccaagttctgcaagaatttcacgtaggt

SEQ ID NO: 26074 - DNA, 61 bp, Chlorella protothecoides
gaactggtcccggatgttttggggctcggcgaccccactgttctctaggatgattctgcca

SEQ ID NO: 26075 - DNA, 200 bp, Chlorella protothecoides
cgtccgatggcgccgtctcaggcctggggacggtggttgggaggaggttgtacatgtgtttgtgcatgtgtgaggggtgtgctgggcaggggtgcccaggaatactgaaataccctatctaactaggacaccgcagaaggagggctcaagtagtgtgcaaaggacccctaacatggtgcatgcgccgggccgccctctca

SEQ ID NO: 26076 - DNA, 248 bp, Chlorella protothecoides
gcaggggttgcgtgggcagagtgctgagagaaggcggggtggttggtggtggtggtaagggatgatggggactgcctgatggtggggatggggccgaggcctgggcaacagcctggtgctgttcattgggggctggatggacatgtgcaatgcacctggtcctgtatgaggggttccttcgcacacttcacgatgagaatgcatcttgaagaccgcaactcgctcgccagtctcgtcgtcattgccag

SEQ ID NO: 26077 - DNA, 91 bp, Chlorella protothecoides
ccagcccagctggactggagacctgtgatcggaaactggacaccacctcatgccctccccaacctacacccatctccatagcaccacaaag

SEQ ID NO: 26078 - DNA, 79 bp, Chlorella protothecoides
tcgtcgtggttggggatcgcagtgaacacggggtgggtcatgggcggtgtcaggggcctggcattgcgccagggggggg

SEQ ID NO: 26079 - DNA, 65 bp, Chlorella protothecoides
catcggctgtgtccaaaggcatgagatcatcgacgcccagtcactttgtttcagactggatttcg

SEQ ID NO: 26080 - DNA, 61 bp, Chlorella protothecoides
cgtgcgccagtggccccaggcgccgcggggtactgccaggtcagcacgaaaattcaggctc

SEQ ID NO: 26081 - DNA, 17252 bp, Chlorella protothecoides
  modified_base (876)..(885): a, c, t, g, unknown or other
  modified_base (8209)..(8246): a, c, t, g, unknown or other
  modified_base (9207)..(9216): a, c, t, g, unknown or other
  modified_base (9311)..(9431): a, c, t, g, unknown or other
acgccgccggtcgcgccggccccggccccgcgccgccctacacgctggccgcgctgcgcgcgctgggcggcaaggccggcgccccccccgccatgccctttgagctgcgcgcgctggaggcggtgctggacacggtcagcgcgcacctggagcgcgcgacgggggagctggaggcggccgcgcatcccgccctggacgcgctgaccggggccatcaccacgccgcacctggagcgggtgcgccgcatcaagaatcgcatggtgcgcctgaccacgcgcgtggagacgctgcgggaggtgctggagaagttcctggacgacgactcagacatgcacgatatgaacctcaccgccaaggtccatgagggggtgattgtggggggaaggggggcggggcccttgggggcggggaggtgggtgcgtgatacaccggtggcggggtgggagactcgcaggacgcaacgacaatcttccccatgctttggcactctccttcacgaaactccagagcatggagcgggagcagctgctgcagcgcacctccctgcgcggctcggtggcgggcacgccctttgatgtccccgtcaccctctccggcggcgcggacggcgagctgggggagctggcgggcatgtcaccacgcactcggcgctcggcctccagcgcctccaccgactcttccatcgtggacgaggaggtggccgcggtggagatgctgctggagccctacttcatgcaggtggacaacacctacaacaagctgcagacgctgtgcgaatacatcgacgacaccgaggactacatcaacatcgagctggactcccatcgcaacgaactcatcagggtgaggggagaagtgtgtgtgtgtgtgtgtgtnnnnnnnnnnggcggcgtggtctcacgtccaggcaaggtgcacactttgctgtgagaggagtcgatcatgtgaaaagtgacggctggggattgggaagctggcgattgacctgagggcccctcaccgcctttcccccatatcactacagttggacctggtgctgacggcgctgaccgcttcggtggcgctgatcaccgccatcaccagcctgtttgccatgaatctggagctgtcgccgggcgtgcagggccaggcaagtcgtgaagtaggggtatggcgccgggcggtggatcagtggtttggagcaggggtttgcctcgtgctagaactcggcagccccgacaggggcagtggcccggactgcttgccaaaatcccagagctccgagctgcatccaagggcaaatccaggcgcggtgccggggcgtaatttgaggtgactgccccggacaccctaacccccgctccccgtccatggattgtgcagggcccctactggcagttcatcgtcgtgtcggtcgtgtgctgcctcgccgcggcattcatcttcaccggcgtcatggtctactgccggtggaagcgcctgatctgaggatgctttgcctgaaagcatctggtcggagctggccctggcggagccactttgcattattctctctccctgctctctccttccacctgccccacctgaagcctcaccaccccctgccccacctgaagcctcaccaccccctgcccagcacagcgcctatctattatgccaccacctccctgcctggtccagtgtaatgttccagcagggaccaggtgcatgccggggaacaacatccgcacactgcgcagcgcgcacagcgtacagcacgtcacagcatcttgtagaagcgctcgggagatgcgccggggccgaagaatctggccacctccaacgcctgttcctctgcgcatagtggggaaggttgaggaggtggcaagcagtgttgaggagaggccctgcgccgctgcattggcacgaacattttgtcttcccgatgggaatgcacagcatcgagcgcctggagcggtgcctgcagatcccgagcagacattgatccaccaggtgcaccccatggggccgcacctccacacctgtggttggcaggatgatccggggtgggaggcaggcaccccccggccccttcctcaagtcaaacgtgaactggaagttgaaggtgttggtgatggtagtgagcgcgtgctccggtcgagtcacggaggcctccacctgcacgtgagccatgccctgcagaaagggcggccatggaaaggaggggatatctgagcgcctaggcatgatgaaagtgcagcagcgcttgcatcgtgagcaggggcaggcgcgtgcagagtctgacggcacatggctccacacccctggtcagtccttcctgccttggtggggtccctgccagaggtccaggtgtggaggacacaggcgctgaactggatgaggtcacccacatccacaggcttccggaagaggatctcgtccacctcgactgcgggagatgggggcgaaggggaggatataaggcggccttgctggggtactcatggtcagacgccttgaaggggcgccggcagggacaaccttttgtgctatggggcagatgcttgcatgcaccagccaataatccagatcaggcccctacgacactgacttaccgagcttggggcgggttcctgacagcatgtaggcagagcaggtggccagctcaaatgctcgcctgccaagaaaaaggggtgtgtgttgcagtgaaaagagtgcaccccgcggggtttagatgcgctcttttatcaactcaaaatgtgtggatgcatgtcttgggtcatactacatcgacagagcccctcccagaggccttgcaatagtcaagtccctggcaccgctgatccatcctcatcccttcctcctcccaagccagcgcacctcatgaggaagccgccaaacacacggccgtatgtgttgcgctgctgcggcatgcagatgaagctgctgtccaggcgagtggccgaggccagcagcgcctgagggtccgccagcgccggcgccgtcgccagcagctttgcatccgccagtagcgcggccgcccagcgctgcgcctccggggtcaaaccttgcgggggaatgggggggattgcgctgtggtggcagtcgactctcagggcagccaggtggaaacatgcctctctcgctccagcatgggtgatcaggggtgtgcatgacccaaccatgactcatccccctctcgccgtcctttcccccaccttggctgtgcagccccgtggcggcggcggaggagcgggcccgggcggtccgcctggcgtcggagatctgctggcgccgcgcaaacagggccctgtcctgcgccgtctccggcacgacggggctgatgcgctgggcggcgttggtcagcgcgtcgcgcgccacaaaagtgaagagggccaccagctgcttggtcccactctggtggggaaggggggaacagagggaggcggacatgggcctgcagacctgagaatcgaagcctggcccaatgaccaggtgcaggcagggccacaggcagaccgcacctggagcagctccatgcacacatccatggaggaggatcccgtccaggccactctgccgctcatctgcggcgagggagggaggagtcgtggtcgtggggctgcccgggccgatgaggtcgagcgccagaatcccagtgggggcctcgggtgcaggcacatgggcctgcctctgctcagcaggaacccgctgtgccctgaatgagctcgaactcccatgcgccagatccaaacgaccccacctgcatgtcctccgtcaggtctatgcgcttggtgcgtagctcgatggcttccaccgccgccgtcacgcagagggggggtcgtgccgctgggtcatccaccttgctgcaggggtgcacagtgagccgatcgggctggggccagtgatggaccaccaacctgtccaggacaagatcatgcagtccctgcatggcatgccccggctggaccagctccccttgcaccccaccagtggttgaaggcgatgaagcctgccagcgagtccagatcctccaggagtctgcccagcctgacctcgtcccagggatttcgatactgcatggtgattgtgattggatgggatcaagtcacagcaccagggggcgggttccatgattcagcatgcgggcaagcgtggttatggctcccgctcgcttcacaagtgccctccgcccacctgctcccgcaggaagaggttgccactgaaggggtagttgattgtggtgacgattgatggcttcggctgcgggttggtgggagggtacgctgcctccagctcctccctgctccagctacggtgctgcccactccagagctccttggtgacgggggtgtgcgagccaacaacgccctccggcccgagatactttggcagggaggacgcccctcggagctgaagagtgagctgcacggcccgtcggcgtactgcttggcacagcgccatgtggcctgcgccaggacttggtacgagggtgccgtgtcgcaccgcggcaaccctagccgtcaaggccacaccaacaaacccgcagcgctagtcctacgattaagaaatcacacctcaagcatttgtatacaggaaaagcttagttgagtgggtgtcttgtggaaaagggggcaatctgtatacatcgcgcccccagcggaggcccatcggattccgggacgcgacgcggtgaaaacaaacttgaacatccctttacctgtcaagtgttactccaggagcaggactccatcttcctgatacattcgcagggatctagctgtaatttgaggggcaggcagtcatgagggacccgcgacagctctcgctccagatttctgaccgtgaggagaccagcaaagtccggggggatggccacctaacctgggccggggtgctgcgcgcccaggactggggaaccatcattctcaatgtactcctcattatagcgctgatcatcaccgtcagagtagccgacgagccgaggcagcggtgaggcgtgtggcgtcaagagggaagggagctgctcaccaactttgccagagaatttccaaaggagagcagcggctcgttgtggtcccagcgtagagtagccccagaacggctccattctttcacatgcaggccgttctccctgtacgacgccaccatcagctacccccacaacccgtgagtgctgggttggtcggttcctgtacctcgtcgctgttcccctccccagtatctccccccgtggagcctgcatcccaaccttctcccaccacgcaacgcaatgcagggacagcatcccctactgggtggcggtgctggtgcccttcctctgcctcctcatcagcatcgccgcgggcgaggcctggcgcgtggggggcagacccggggtcaagagggccaccgcctccatcctgcacctggtcctggacggcatctttgcctttgtggtcacggcccaggtcacccaggtgggcaaggtcctggtggggcggctgcgccccgacttcctggcacggtgcaaccccgctgccccggcccagctgaccgtgcagtggggcctggcagccagtgccaacccggcctgcgactcccccctcaccgccgacgagctgcgggacgggcactacagcttcccctccggccactccagcaccgcctttgtcttcgccgtctactccgtaggctatggcatctgggtcctgtaccaccggtgtgtttgggggggcgggcagggggggtccagtgggtagaggcagaccgctttgcacccctggccgccaccaatcccgatggacaccgcttgcacccactccattccctctccttccccccccctcctgcccagggaccgtgtgacgcggctggaggtgatgcgaaggggcgtgggccaccggctcacagacgcccttgtggccgcgctgggcctcctctggctcctggcccagctctcctttgcctggtgagcgcacgcgctctggactggcgtgggaaccctctgggatcgtacaggcggagtgggcgcgtaggtcgcgccgccgacgcccccacgccgtccccatcgcatggacacccaccccatccccccaccaacctccctgctgtgcaggggcgtcgcgatcagccgcgtcatcgactaccgtcaccaccccgccgatgttgtgggaggggccctgctgggcacctccttcgccgtgctgtacatcactcggtgcgttggccggctggcctacgtcaccacggccgtcgcgatcgaggcgggtgattttgtgccaggctccgacgacggcgcgcccccgacgccctagggccggcaaagcgcgtgtgcagtctgcctggcacctgctcctgggggcatttggcgacaaccgcacacccctcccgtgccatggggtccccaggctgtgctacccctggtcctcctcacccctcccaagatccggtgtgcgtgcctgtgctctcactctacctcaccacacccatgtgatgttgcaatgacatccatgtgccattctggagggccggtgcatgatgctcactttgcatcccagtgcagttgccatcttttcatcatctgggccgcaacctgccaggggccacgacgtgccaggggcctcggccaccgtcctccgggcctcaccgcgtggcggccttccccctggcctcccccctggccagcacgccgcggatgaggggctccagggacgccgccagccggtcgcggtcgagcaccaggttgctgcgccagtggagccagtcgaagaagcattcgggcttgtggtcgggggggcactccccgttctcctgcaggtctaccttctgctcggccggcagcgccctccacaccgggtccttggacagcgcctggccgtgcaggaggggggtggggcaagggccgctgaagtgggtcaggtgaagggcagccagctcgagtcggaggcatataatctagcatccctgccggggctgcgccacccatcccctggccaggcatgggtgggccgtgctttggctgtctccttcacacccgtccccctgcaatccattgcattcccaccccggtgctcggacccatgcacagacacgaccaccgccctggccaccgacacccggccgctcacatgccagttgagcacgaggttggcgcggtcgtcattcaccatcagccccacctccagggtgtccagctgcatctgccgcttgatggactgtgtgcggggcggtgttgcggagggggctggcgggggggcgggggatggacacagactgggaccgtgcccagcagtcgcgctggcctgggctcacacccttggccgcccacccatccagcccggcgtccccatccccttcgcatcgccccctccccccacccacaccccagcgtgcgcaccaggagccagccgtggggctccgtcacgttcttccaggggatgacctccagcacggcggcgttgcgcggcaggaactgggcgtgtgccatggtggcgccgtgcgggtacaccagcaccgaggcgcgctggaagacggcgatctggtcgcgcagctcggtggcggccgacacgctgaccgcctcgaaggccaggggcgcgccgaaggagcgggagggcgcccactccccgcgcagccagtccagggtctccggcaggttgagcagggaccggccctgggaccaggggcggttgacgaagacgacgcgtaggggggccaggggcgccggggtggtgtggaacccggtcccggtgcactccccaagcagcttgctccactggcggtcgtggaggaggaggatgggaggggggtcagtcggcggggggtgcaccgcgcgtgcctgccgtggatggctcctgcgccctgcacgccacggccgtccttcacagccacctgtccctcccacgcatacctagcatgcaggccaccgtccctcctcagcacaacattcttgcctggggcataacgccggggggagggtccttgaaccccgcaaagtcctcctgccgctcgtacgcgcgcatgtagggcccgatgcccaccaccccgtgcttgatgaccagggcctgcagcgggaggggaggaagggaaggggtgagaacacaagacttgccacgcctggcaggcgctgaccggcgggtcaggtgctgtgttggggaggaggctgcctggtcgagggatgcccgcacagccgcccggttgccccacaccgtggcaaacctcgcttcacgctccatgcccgcatccccccccccccccccccaacccccccccnnnnnnnnnnnnnnnnnnnnnnnnnnnnnnnnnnnnnnccctcccgcacacgctgcccgtcgtccgcacctggctggacacgggggggaagcgcatgtagcggaaggagccgccgcccaggcactcgaagccgccgcgcggggcgtgcggcatcgcgaagcggcgccgcgggtcgggctggatgaagagcagctgttgggggcggaggtgttgtgtgtgtggtggggggaggtcagggctggaggtgggatgggaggggtgagatgcttgtggttggaggtgggagaaggcaccatcgccatccagccactgcccctgctacacagctccccgcaaatcctgagcccccacccatcccccatatctcccccccccccacaaaaccacctgcagccctgcgcggctggcggcgtcgcacagccccagcacgccgcactggttggcaaagttggtggccgccacctcggtgagcaggtggtaaaagttgccagagtccacggcgtgggccagcacggcgcgcggcacgacctccgggctgcggagcgcctcggccgcctccttgggcagctgggccggcgccacgacggcggggacgaagaacttgtcctcccgcagcccggcctccaggttccactcctcccaggcgatctggatgtcgggcagcgtggtgctggcggggttttctgtgcagtggtgggggcggtgaggcgtggggcgccagaggggtggggaatcgggccattgctggcattcgctgcgagggaaggggccgcgcagatgcaggcacgtgcagtctggcggaggggcggctcgccagaatggctggagcaggccgaaaaggattggcagcaaggcggcgccacgagtctccctcatcactcccgacaaccaaccggagccagagggcgccgaaccctccccacccctcccccgagtacaccccttccctcccgccctgctccccgtgcaaacatccacccccccccccccccccccccnnnnnnnnnngcgtacgtgagatgtagtagatgacgccgccgtgcgtgacgaggttccggaacacgcagtagcgccgtgcggccgccccgtcgtcgtaaacgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgtccgtggtccagtcatacaccgcgggggccgtggcggccgccaccgctgcgcccgggacagccggcgtgccggtcgctgccggcgtgccggtcgctgtcggcgtgccggtcgctgccaacgtgccggtcgctgccgacgcctccgtcgctgccggcggcgcaccagtccccaccgtccctccggcgccggcgccgctctccacctgggccagcgcccgcgcgggatgcgtgcccggggaccttgaagggggcggggccgcccgccgacgcagggtcttgggcttgctgggcgcaggctcctcgttccaccccgccttgaggcgctgcagggcctgccgcactaccggctccagcgccgcccagtcgaagttcaccgacaccttccagtggttccaccagaaggggcagaggaaggcgtccacacccgcggggcactccccccgctccagcagtgcgatcttctggtccgaggtcaggcgccggtactcttcgtactccagcagtttctgatgtgtttgggggtggaaaggagggcgcggcggttgtgtgggtaggcagggggagttgatggtgactcaaatgcacagcgccatggacttccgtgcagggccctgccacctcctcattctgccgtgcctgaggctaccattcctgggctgtgcacatgcgctggcgccccccgaatcccccgcatgcacgtcccgccccccgcccccactcccctccaccgccctacgtcttggttgaacatggagcgcggccgctcccggttctggatgtcgtagagcttgatgcgcaggccgaacgcgtcacggatggcctgcacccattcgggaaggttggccttgtcctgctgcacccagggcaccacctcaatggcctgggcgccctgcgatggcggcggtgagggcgcgcagggacgcgtgcaggcgtgagcggggaggacaagggcgcctgtgttgtgtgaaacgaacgccgtgcatgctgccggggcgcggtcgcagcttgcagggcacccaggcgccagggcggccggcttgcacggcacacccaggcgccagggcggccgtcctgcagccactgcttgcctcctcctcattccttcatcccctttcccccatccgtccctctggttgcccccttcctcaacccacaaagaaaagaagaagaccgccggaccaaacctgtggtaggaagaaagtgtgggacatggtggcgccgtggggccagatgaggagggaggcattccagaacagcgcggcctgctcgcggatggactgctcggactccaggtaggcgatgtccaggcgcgcgccggggaaggcgcggaactcggacatggaccggatctggtgcgccagtttggcggcgttgagcacggtgcgcccctcctcgtagtggcggttgatgaacaggacgtgcagcgggcggccggcggcggagcgctggtcgaaggggaagccgaagcagtcggcgatgcgctggcggtacacctgcatcgccgcacgcggcggctccttccagttctccttcaggtcctgcggggagcggttgcggagattgcaaggggcgtcgaggtgagcataggccgccgtcggttggtgacggaaggatggggttggcccttgttccgtaagagaatgtgtggatggctgtgtagaggggcctaaccctagcccagtgccaggctgccggcctcccagccacagcacatggtggcctgaaactcagcacattccaaaccaggcgggccccctctacatgcagggcatcacccaccttttcccagttgtggaagactcggacctcaggcgacacgcccaccactgccttttccaggatgacaacctgcaggtgcttggtattggggttagggtcctgcagggtccggctcgcccacaccctctgcccccatactcgtcgatggggacacgccgaaatgctgcccagaaggctcacccgtccgcttagggggacatcgtccttgtggagcaccggggcgggcgagaggcacttgaagacgtcggccagtgaatctagcatgatgtaggctggctgccccgcttgcttctcctggacaaagaagaggcgcaggctgcgaggagaagaaatggtttttttggggtgggggggtgtggaggaggacagtgatgagtgacctgcagaagactgacgcagacaaacagtaggccgctggagtgtttgaatggggtgatctggcacgccgagcgggctgggcaggaggcccttgcaggcgaattcgcgatgactctcgccatgagccctccagcacacctcgccagccgcccccgccagacctgctgtgggcgtcgtaggtgcagtcccccagccacttgcacaccacgtggtgcatggtgggcgctacctcggagaacatgtggtagaagttggaatagtgctgctggtggaagaggccggcggtggccaccctctccacctgggggcaggggcatggagcggtgggggacgatggtgtgggcacggattgggcacgtcctcagacagcatgcatgtgcactcgcaggctccagagagcagacgtcagcaggcaagaggccggatcacaagcccacaggcaccagacggctcgtctgtcaccacgtcaacgggtgaccccaagaacacatccaacccaactccttccttcttccaaaggtcccacacacctccaccttgtcccaggcaaaagggagcccagactggttgacgatggtggccttgaacatgtcatccccttcaaacttcttgagccaggcatactggatgggcggcagctccacctgagggtctgtcgtgccatggcaaggccggggggtcaagggagtgatgctgggcgggggtctcgacgtgtgcatgcaagcgctcaacaatgcacctgccgcaaaccctgccatgggacagggcagtcatgcacagcaactgcccgggctccatcctcccaactgcctaccaggcgaaacatagaagacctggcccttatgcaacagcagattggaaaagacacagactcgctgctctggtgacccatcctccggctcaaaacactgtgtgcgaggcgtattgtatggatgcattcgatcagtggccggcagtggggaccgacaggggcagaaccatgcagctccaaaacagcctctactcacttcatgggaggaacgcaggctgccaggactctgtgatgccccggccagctgccgcagccaagctgtctggtctgcaaagccgctccgtgcagcagcaatctgttgtgcatttggggtcgtgcacatgtcatcagcgctcacattccatcgagcgggcaagggtgatcagggcaacaccgtcttcattgctgtggctaagatctgggtacccgatgcgctaagtcacattaaaggtcggtacgtctctgcccattcacctggactccggatgcgagttgtataatgacaaggatcacggccgctgcgatggctggcaggagccatgatggtgtgagaacgcggtgaggtcgggacggcttggtctccatgtccagccgtgccaactgatgggcagacaattcggctgctagcacgtctcagagatcctccattgatgtatggctatagcatgcgcatgtggaacgagggacaggagcaaaggaacaccagtctgtgtaccgcagcgagtgtgctgcttctggccacaccacgatatgagatagtcgcgattgataacggcagcgaataattcgatgatgtctggatcgcatcatctgctgcagccatatgatcatgtttaggaaacatcgtcattcgaacgaaggggccgattctccgcgcgatgcggtacagcctggtaccgtgtacggttccagcaattccgatgcacacagcctcgggtgcctctctgcgccagccacgcgagacatctgagagctcctgccctactcgaaacacataactcatctccccattctcaagaatccgcggggtcgtggtgtccacctgccattgccggcatattctattctcgaccacgccagacatgtccgcgttggaatcttcgtccccaaactggagctcccagagcatgggtagcgacatcagctcctccgaagaccatctttccagtcaggtgggctccgctggtccatcatgtcgcgagccgaggtgtttgcatgtggttccgggagcgcacgcgctggcgtgtggaatcccaccccaccccactccgccccatgcccccgcagctctcgctcctggactccctggagtactccgatggcaagcccagccgtccacgtatgggtcgcggcagccgcggcccacgcccgcggctcttcgcgaagggcaagtgccaggctgatggctgctccgtgaacctgagcaagctgccgttctactaccagcgcaaccacgtgtgcacggagcacaacaagtgcccttcgttcaggcgtcaggtgggcgccattctctgcagtgtgctctgtgcaaggaggagttgaccgagcaggttgaacccctggtatctggggagttggttctttggggttagtcctaccaacaccccccctttgttacacaatggccagggtgaggaggtgcgctactgccagcgttgcggcgtggcccaccccctgtccgactatgacggcgacaggcggtcctgcaggcgccagctggagcgccacaacgccaggaggtgggcggggccggacatgcatgcaggattcgggtcgcgccgagtcaatggatgtccgggcgccatggaccaaacccttgcacccgtgcaagcggcgccccgccgcctcctgatcccacctcgcacgcacgtcactcccttggcaacacctcccccgcttcccgcatatgcagacgacgcctggccctggccgccgccgccacgccccgctcgcgctcccccgccggcgagcgctgggcggcgccgtcggagcccgggccgctgcccctggcgccggtggtggcccccagcgcgtcgtacgccgtgccggcgctgtcccccgccgcctccgcagcggccgccggccccgtcgacgagcgcgtttgtcgcggcgacgagtgtgtttgtgggccctgttgtccccccgctgccttgggatgtgggcgaggaggagtccccgctgccgctctgggcggagctgggtcgggcgccgcctccgcccgctccccaccggcccctgcccagcccctttgccggcccagcggcagcctggctggcagcagcaacgactccgccgccagctgcgctgggcccgctgaggccgtctcgacggccgacgggcccgccgccgccggcctgcctgctcatggtcccgctggcggccgtgagcgtgcagtgagccgctcgggcgcggcggccgccgcgaccgaggcggcgctcggcgtgctgcagcggcagcacgccgacgcctacggcttcctggtgcagcaccagctggagctggcggggctactactggccgccgcgcgcgtcgccgccagtgccgcgcccggccggcgcgccgcctgccactgacacccctgtcgtgtgcctcctgtacccatcccccttcctccccgggccccctgtctgctgctgcgcaagcacgccaccggggcgtgctcgtttttcctagatgtacatccccgtcggatagcatggggggcccctggaactctcgaacagcgccccagacggcatggcttggcgtgtttgccagccccacccatggtcgtaaggaccttgtccccctcccaggcagcgccaccgcatcagcgccggcggggcacgtactccgcgtcgctgtagctgttgcccagcggctccgcgtcgtggatggaggtgcgcaccacgatgcgctgcagcgtgggcctggccttgcccgtggagaagccctgcgcgcatggattgagggggagagaggggcagtgggctgatgggcagcgcacgcacagtccctcgtgcaaaagaatgcgcatcacgcacctgtgccttggggatgccgccccgtcggttctgcagcgcggcgggcaggtggtagttggactcgcccgccagcgagttctgcggtggtggtgagcagggtcggaggggtgagggtgatgcgacggtctgcctggtgccatgcgcagcatgtgcatggcaggcatggccgagccgcaggcccaggtacctggaggaaggcgtccatggggtcggacatcgagttgtgcggtacgtactgcgcgcggcgtcgtggttcgtacactccatctgcagcggggcgagtgggtttgagagtgtgggtggaggtggggtggggagcagcctgcctcctggacacccttggcgcaggggactcaacatgcaggctgctggaggccccgcacctgacatggagttacccaggtaggtgggttcgctcagggaggaggcggaggccaggcgggtggccttgacgctggggctgttggacaggggccggtccccgtcgctggcgctcgctgccttcttcccgtccgaatcggaggccccgcccgacatggatctgcgaagatccacgggcacgtatgtcgatgtcctcaaccaggacagggacggctggatcagccgggtcagggtcttggcctggggtgtcgtcgccatggtgcactggtcgactgggaaccttcagagtcggcctgcggaacgatcgatcacccgcctgaaacaacttttagaagcgccgctgagtgcagtgtttcaaaggatcagctgggcacacggcttgtacgcgtacccctgttgcgttttcgggaatctcatgggtgacctacgtgacgtggcctgcaagcttcacatcatggagcgcgtggtcttgagctgcactttaaaccactctgcacgtttcgttccgatgccttacatcatgcagatcgagtggctccctcatgtgtccgatctggggtcccagccaaagtgtgcctctgtttgaacgccctctcctgcaaggcgttgctcacttaccaaccctgattcctacccgaagcaaagttcctgcagcagagcaggcaaaagtgacaaacccttgggggggattaacaatggaacacagttcctggtcggccagtaccccggccgcaccaggaggcttacacactaccatgtgacactgtgatcaccctccagtgtactgcactcatctatactcattccaggctcagaatggaagggttttaccaggatagggcaatttctggattgatagtattctgaaattaccaatgcatttgcgtgcccctgcatggggaatcaacctcgccgaacgaaagtccgaataacttcatgcacacctcacgatctgaggcctcgctggccacatgcatctgcatactccctcgcttccgcagtcgtcctgcattcacaattcttgatcgctcttcccaccatttacatgtctctgatgagtgccctaaacggcatgcggagtgggagggcggtgctccagcaccccggactgcgaatccacgccaccggcgggatgcatgccaccatcagggccctgccctgcctccgcagcactcgcatgtttgccaagaagggatccaagcccggaggtacgagtcgaagcccttttcctgctccatgacaccccgcgcatgccggccacatgaagcagtgggggccctggtgtacgggcgagctacgtgatcgcactgcatggcgcccatcgcctgatctcataggcattgcacatctcgaaatccgtcaaccccccccctctttctccctctcccgcagcagagggccccctggggggtccgagctccggcgtgcctcccccacccccgatcgcgacccccaccagcggaccc

SEQ ID NO: 26082 - DNA, 77 bp, Chlorella protothecoides
ccaaattgacatggagcgtcacctgaattgtaatcgcacgcccatccacccatgcaggcctcagagaaccaaggagg

SEQ ID NO: 26083 - DNA, 62 bp, Chlorella protothecoides
ggcgatcacattgttggaggggactcggccatgcatattttgaacctgcgcgccaggttcca

SEQ ID NO: 26084 - DNA, 115 bp, Chlorella protothecoides
atatgctgtacattgacgtgaggtctgggggatgggtgcccactgtcttgccatgcaaggtttgctggagacaagtctgtgtctttttttcgttctgctactgtatggcatgaac

SEQ ID NO: 26085 - DNA, 63 bp, Chlorella protothecoides
gagggcttctgtgattgtgttttgatgggggtccgtaaactctcccctggtcaaggtctgctt

SEQ ID NO: 26086 - DNA, 74 bp, Chlorella protothecoides
gggcgtttgggagtgtttggggactgatgaggtgtgggagataagggggcagcggatggcagagtactcctgca

SEQ ID NO: 26087 - DNA, 114 bp, Chlorella protothecoides
actgctttgagcatctgggaagggggtgtcatgaagctgtgtcaggatgtattaggttggtaacagttgcactttactgagaacgactcccctcataccagtgccacgatcatg

SEQ ID NO: 26088 - DNA, 61 bp, Chlorella protothecoides
ctgcctgagttgctgctgcatggagtggtggaggaggcactccccgtgaacctcacttgcc

SEQ ID NO: 26089 - DNA, 149 bp, Chlorella protothecoides
cctgccgtagatgggaggatggtggggtggagtcacgagagatcggatcatggggttagtttggggggagccccaccctgtgaagtatgcttccattggcatgcttgcctgacaccagaacccccaacctggatgcacacgagtgcggc

SEQ ID NO: 26090 - DNA, 80 bp, Chlorella protothecoides
gtggggcggcagggcaggggccttgctgcgtagctgaggatgacgacaaggggcgaggtcgagtgacgcgcgagggggcg

SEQ ID NO: 26091 - DNA, 61 bp, Chlorella protothecoides
ttgatgcctgccccgcccctctcctccacatgttccaggaaacaaggtttcaatccacctc

SEQ ID NO: 26092 - DNA, 61 bp, Chlorella protothecoides
aaatcccatgctttgcagggggagtggctgtacatgattgagtccgactatgtcttcatga

SEQ ID NO: 26093 - DNA, 206 bp, Chlorella protothecoides
ggcgccccaggtcctctttgaccgcaactatgaggatgcctacacaggcaagaccccccgggtgcacaagggggtaattgtcctggcagaccactcgcagcgcatggcatgcaaggctaagggaggaggcctcccaatccctcaaccctcccttacgctgccaccccttagacccgggctcgcccgcgctgcgacggacgaggtgg

SEQ ID NO: 26094 - DNA, 140 bp, Chlorella protothecoides
tggccgagtggttaaggcgcaagcctgctaatttctttttgcttttggagtgtgtgaaagtattcaagactgctacagataccaggtacacctttgcatcaggaaaaacaatgcaagtgattcaacgagtgcttgtgcca

SEQ ID NO: 26095 - DNA, 73 bp, Chlorella protothecoides
acactgatgtagtcagcctttacattcaaccaaccccatccttacactcaccattcttgcaggtatcccacca

SEQ ID NO: 26096 - DNA, 62 bp, Chlorella protothecoides
tcatgcggcggatcgttcgccgcacagccccacggcgtccctgctgcagggcagctgtgctg

SEQ ID NO: 26097 - DNA, 74 bp, Chlorella protothecoides
gaaatctcgatgttcaggctccaggacgggctccccatgctcttactcgacaacagcacatgtgcaaagcaaac

SEQ ID NO: 26098 - DNA, 298 bp, Chlorella protothecoides
gagatggcttgaagaacgaaaactccccaggtattatcaaccacccattctgcatacatcacagctgcttggaacgttgagttcaaggatgtgttccaactgtttgcatgctctgttcctggagttctcccctgcaccatgctgcactaattcccaactactgtatgggtacattgtgattcagtgagatgctcagaacttctgattacagtaataatcactgctgtcagctgctgcaaaccttgtcatcctaagattggatccaggatacagtctgtgctgtaatggcattaatcgc

SEQ ID NO: 26099 - DNA, 61 bp, Chlorella protothecoides
catatcatgcagggaggagtgggagaagggtaagacgcacgacaagctctggaatgcatct

SEQ ID NO: 26100 - DNA, 61 bp, Chlorella protothecoides
ttcgcccagtacatgcgcatgaagccatgcattttgccgccatatatgagctccaactact

SEQ ID NO: 26101 - DNA, 7096 bp, Chlorella protothecoides
acaacataggtgagagttgggagaggaatcgaaggacatggatgatcctcacagccgatgctacccctggattatgaactatcgttcatacaatggtgccacctctgcaaaaatttccattgtgggccctgccaactgggggaatgccaacaagggcaagggcaaccgctgcttcaaatgcgtcgggagcggaaagtcgtcaacacgtgtagcttgcttgagcttcgcaagtatgcatggaagctcaatttccccccaacccccacaaagaactctccaccccgccttccaagaagtcaccaccgccaattgccaagaagtctccatccccacccgctaggaagtctccacccccacccaccaggaactcaccacccacacacgccaagaactcaccaccatcgcccgccagccctgggccccctcctccaaccagctcgtctccaccaccagacccatcttcaccaccagacccatctccaccaccaggtctatcaccgcccagtccccctcctacacctagcccccctcctcctaccagccctcttccccacctagttccttttccccacctagcccctctcctcctcacccccctccttcctccagccctccccctccctccagccctgctcctcccactgggccccctcctcctcccaagcccccttctcctcctccttcaccaatgggcctttctggcacagttgagttcagcgctccctctgactcaagagtggatattacaatggtcatcaccacgacagggtacactgccacagacataggatgcaaactcttgtccgccaactttacgttgctcactattggattgggttctccaccaataagtacggtgaccactatcaagcccacagcagagatggggtgtgcatcgacagagtacaaagttggatccgtgtacaccgtcaatgaacaccaagatctccctggtgttgcaccgctgactctcctctttccttcaccaccaactccgggccctttccctcctccaccaagttttggacccatcactgggaccgtctcatataaagatggcacattcacattcacgatgtcgactggaaagtacgtggcggacaccctgcattacgcattttgtcggcaaacagttgtcctttggagaggggcgaggaacgtcccaccagctcgacgaccacttggacaaaaggcttgctacccagcgaggaggcctttgtggcttacgcccaagtggtggcggagagctcggccaggaactcgttacttgtcctgactctgaagtggtaggttcgccgctgaacgcacatgccatgtgtgacgacgcactacgatcagaaggcagaatcatcatctgagtagcacaccgaagtccagcttgagatgacaccgtgagctaccaagcataccttgggtcttgttggctgaggagaatggtggtggtttgtggtgatcctggccagagaggtgggcatttggcgtctgggtgggggacatgacacacataatacctcaattttccgtcctttgcaatggtgcggtggctcaacttcggatcctatggcctctctctgccacaggaactgacctggctgcagcagactgaagcacatcgcccctctcacctccggatgtgtaacgcatcagaccacgaatgcggaggcgctgttagaggcgcatggcgtggatggcgccacgctctgggagagcgaagaatggacaagccattccgacacttcatgctccagacccacaccctccgccagcggggcatggataccagggtggagtgggtttgggccccatccggcgaataccatcgttgtgagtgcgggcaatgacggtgccaaatccaaggggttggggcgtgggggttgatgcggggtcgcccgcctggccgctggatcaccttcctccactgcctgcggcggatccgcagggtgggggtggttgatgacgttggtgttccaaagttgtgctctggctgccaaacctcgcggcgcccccacacatacttgcatcacacatgccacacctcgaccatgaaccaaaacgtggatgcagctttgggcatgctatcatcaactcgccactctgttgttgggaaagatcgccttgttgcttcttgcgagcctcctcccgcccaaatgcctggccccccttccccaatcccttctgtagcctcttgtgggccgccccacgctcacataccctggattcccaagggaggagacgtgtgtgcatcccacacctgatccccagtggcgcaaattgccgtgcgtgtcgacgggatttgagcccggcaggggatggtgttcgaaagcatgacggtttgcttttctcaatcccactatctatgagggaagtccctataatgctaagctgcgtaacagcacctcttacggctgatgcgcatgattaaattacttgggtgtggagtaaatcaatgcatgtctgttcggggttatttcgagatgtttgtttcggacatcaagtttgcaggacttgttgctctcgcgcctgcaacaaaaaggtccgcaagttaagcctgagccgatactctccgcgttgcgatgaccaagctccatgtcgatgtcgttggacgccatcaactaagtcaatttgattcttgtcatagagcggtcaagagtcaggccggccactcggagaccactttgtcccggcatgtatgccgacacccgcaagcccttggtcgtggcgggcagtatcaatgccgatctaatagccaaggtagcccgtctgccggcccccggcgagacgatggagtcgcaggggtttgatgtgtttcctggtggcaaggtaaagtgggtcgcaggccctaacaccccgcaccggatgcatcccaagccggcgccgtgtgagggtgattgccagcctaaactccaaatcacaatctccttgcagggagccaatcaagcggcagctgccgcgcgactgggttacaacaccttccttattgggcaggcaagcactgcgtcctaggcgagaaggggatgaggtggtttggggacaccctccatgtcgcatcttctttgtgcttggattgccaaactcgcatccttcctgcatggcactctcgccctagcaaggcctcacggcatcgcatgacaggtggggacggacgcctatgccggcatgctccgaagctccctgtcagactgcggcgtggacacttccctggtcaccagtgcggatggctccagcggaatggccctgattctcctgcaacctggaggtagtaggcttgggatgcagggggcgatgtcagtctccttgtttcagtatgagtggtgggatttccatcggtcccactaggcggctcgacatgcaggcatgctccttctcccttgttccactacaggagaaaacagcatcatcctggtaggaggtgcaaacacttcggacaactggaagatcacggatgaggccacacaggcacgccgcagggttgtcttggccggggggctggtgcttgggatgctccttggcttgcccatggagcttggaagggagtcaggcagagtagcgggtgcagcgggagccagggcgacctctcaacattccggcagtgattgcccgtgtagggcagtccatgatgctcaaactcctactgctgcgtttccacaggcagtgcagacggctggagcgctcctcctgcagcgagagatcccggaagtcttcaacgtcatctttgccaaggtctgtgcagggttggatggaggcttgggatgcacgggagcggctcctttcccctcagatgcatctgaccacagtcgccccagcgtggcgcacctggcacggggtacagcaccggcgaacccccccggacccgccaccacatacccacccccacacacgcagatcgccgcttcggccggagttccagtcatcctggacgcggggggcgtgacacagcccatacaggtggacctgctctccaatgtcagcctcgtctcccccaacgagaccgagctggcccgactcacgagtgggtggcatggttgctggaccatggagtgggtcgatggggtacagggagattccgttgggtggccttgcgattctggagtccgatcctgacatgctcaactcttcaactcaagagccaagatatcccacccagtgcacatgcctaggcagtccggttcactgaacatgcctgggcggtctggctcgctgttggatgcaggcttcatcaccctcaaaagcatcactccagcacccctccccctcttccacccccccccagacatgcccacaaagaccatggcccaggtccaagcagcagccgaggcactcgtgcactctggcgtgaacaaggtcctggtcaagctgggttccaagggatcaatgctcgtcggtgaggggcgagacggggctaggcctgggggctcacggggtgggagctggccggggaactcatcgcgctgtgaggggcaggcgggccatgggcccgctgagctcagtcatgcgcctcccgtgccagcacagcatgcggcaggaaccccctgaaccagctgcatccgcggatgcatgcaggaccgtgcgccaaccctcacacctctcttcccccgccccggcgtgatgacagacatctacggcaacgtgctgaagcagaaggcggtgcccgtctccgacgtggtcgacacgacgggggcgggggactgcttcactgcggcctttgccgtggccatgctggaagggaagaatgacgccgaggccatgtcgtacgccagtgagtgtgttgggggtcccggctggaagagggaaatgctggagagagcttcttcaatcggcatggcgtcccaaaccgcaaacctgcatgcatcacatccctggatggtcaagtgactggactgagtcgtgtgccctcccacgaaattgctgcgccgagagggcgccgctgacagccacatggtcagctgggcgctcgtgatacgagtcgtgcctctgagtgagggggcaatctcgaccacacccacctcatcgccctcgatcctgcaggcgcagcggcgtccgtctgcattgggcgggcaggcgcgctgcccagcctgccgacgcggcaggaggtggaggccgtgctgtctcggcagctggccacggccacgctcgccgcagcagaggatgctccctcccccagagccggggctttctggtgacgaggctggctgttgaggtcgggctggttgcagacctgtaccgagacaacccaacacaataggaccatggctgcaaccccatccaaagcatggccaccatggctgggagacaccgcacagcatggactccagtcctgcgggaaatcttccacagctagccaggacttggggcacttcagcagtgccagctgccgattctgcatcgatccccctccggagacacctgccctgaaccggcttgtaggcacctaaccccctcgggagctgtctgaccaccagatttaggtccagttacagcaggcacccttacaaccggttaacggtacttaacaaagccgatgtcgccagccagctccctgaaggcctgacggcacatgttcaggccgtacttgcggatgataccgccctggttgccagagacgcggcagcggcgggagcccttgccgtagcccttgggatggctgttccacacagctgcagggatgaggggtgacgggggaggtttcagagggacctactgaggtaacaaaaagcctgacgaacctcaccacggggtttgaccttcccagccgggcaagcgcaccctcgtgcgccatggtgacgagtgggtgtcgaagagagggctgcggctaagcgacagacctctttgccctgtaagttggtaaggagtaatgaagtgctcagcgatagtcggccatatcctgatttttcccaggcccccgccacttcgccaggctggaccgagtgtcgcactccgcgcacagggcgaccagctcccctgttccagccagagaccgaaatcaccttactgacgggatgccgttgaacgcgacgtggtgagagggtgcttgcgctcgtcgcaagcacttttgtttaccgaaggccgccttggggcatgccatcctttcttacgactacatgcaggtgaaacaaactgtcccggaccacatggacaacatcgaatgccgcatggggagcggtacaaccccattcgcatagattaccaggcataatacgccataaagggcatcgcattccattctgcgccatgacgaagggcttgctgcatgcggtgtcgtccctgcagagggttcctcacagcgccctacccacattgccatcgccccgaccgttcgtgaagagcgccatcccaccccggaggcagttccatggagcgcgacacaccgtgtgtttggcttcaggtagcgtattcctttttgaagaccatgagacatgtcgggtacatgcctgcctggagaatgctcatggggagggtggagatcagtacagtacctccagcctccgacctccagcagccgtccccatgcgcaggctcatccggctctacacccgacgacaacgacgacgacgacaagtttgaggagcggatagccgcgctgcagggcaagcgcgcctccaagcagcgtcctactagccagggcgccgcggcgcgggtgccgggcagggacatctcggcccccgcctccaagcccagccccacccctcccacccccaaggactggggccgggaggaggtgttcctggactccccgccccaccgtggcgacctggccagcaacatcgcgctgggcgccaccctcctctggctgcccctcactgccgcggccgttggccgcgcggcctttgtgcgctatctcgtcaccgacaagcgcgtcagcgtcagcacctctgcgccttggaagagtgaggggcggtgtgtcacccgcagggggccgggcgggagaacagccgctgacatttgagggcacctgatggtatttcagcgccgcaagctctcgcgtgcgctccgtcttcccctccctttccccttgggatccaatccgtttttgtcgtcctcctgcaccatgccacacccagactcctctctcctctccccccccccccccccccccccc

SEQ ID NO: 26102 - DNA, 4012 bp, Chlorella protothecoides
  modified_base (398)..(407): a, c, t, g, unknown or other
  modified_base (679)..(742): a, c, t, g, unknown or other
  modified_base (964)..(973): a, c, t, g, unknown or other
  modified_base (1174)..(1183): a, c, t, g, unknown or other
  modified_base (1360)..(1369): a, c, t, g, unknown or other
  modified_base (2512)..(2521): a, c, t, g, unknown or other
  modified_base (3199)..(3208): a, c, t, g, unknown or other
  modified_base (3784)..(3793): a, c, t, g, unknown or other
ggcggggcgcgggcgcgggccctggcgaacccggtgcgggcagcgagtcggcagggccgtccacctccgcggcgctctcggcggcgtcctcgccgggcggcgccccctggcccggggctgggcgtggcggggagggggcggtcgacgagagctggtacgccagcgacggcgaggagtcgtgggccggctccggctcctcgggcggcgcggagcgcgacgggacgggcctgggctgggccgagggctccgtggaggaaggggagcgggaggaggaggaggaggaggaggtgtgcggtgcggggccggtggggaggagccgatgacgggtgtaggagccaatgactggtgccggagactggtcggcgcaaagaggaggccgcgcggctgcgtttcgagtnnnnnnnnnncgggcaggagccgatgacgggcgccggagactggtcggcgcgaagaggaggccgcgcggctgcgtttcgagcgcctgtgcgctgcatgggcagcctcagacctgggagccacgtgctgctgtgtatgccctggctgacgtgcctggcaccgtgatgcatggggcaacgctgtactgcagctttgtgggccaaaccttatgggaaggggaaggcgtgctcccagcccggaccgcagctggtctgtaggcttgattcattagcatgcagaccannnnnnnnnnnnnnnnnnnnnnnnnnnnnnnnnnnnnnnnnnnnnnnnnnnnnnnnnnnnnnnntagcatgcggcatcgccccgttgcttgtgacatgctgtcttagccaggtggcctccgcagttagtggtttcggtgcccaaagatcccaagctgcgcgatgttgagacggactcttcaatactccaagacattcacaggatggcaagcttgggaggcggctcgtgcatcttgctccccatcttccacctcctcggtgcctctccgggtagcatggacgccctnnnnnnnnnnaacagcctggcagcttcattcttcgatagatgcagcatcacgagcgttcggggtattggacacgagtgcgcaataaagttaggccaaagccacacgttgcatgacacgacagcatgcggcatcgccccgttgcttgtgaacatgctgtctgagccaggtggcctccgcaattagtggtttcggtgcccaaagatcccaagnnnnnnnnnntctgcacgagaccctcctcacgggggctcagcacaaattctcggccagaaggtgattctggagcacagatctccactgtcgtcgcctgttatagccctctgaagatcctctttgcatgttcacaatccctcggcccgaacctcaaacccatctgtcggcccttccactgggccagannnnnnnnnncctgtacgaggccctcctcacgggggctcagcacacattctcggccagaaggtgattttggagcacagatctccagtgtcgtcgcctgttatagcgctctgaagatcccctttgcaatgttcacaaaccctcggcccgaacctcaaccccatctgtcggcccttccactgggccagagcacgaccccatgcggtctgccctgatcaaggcgtgcgcgctgggcctgctgggcctggctgccattcgcaccgcgccgctgatggccagccacggtgtcgggcacacgctgcagctgctggacgcgaaggagcccttcctggtgagggcgggcctggggaggctccacttcctgctgaacctggaaagcacgcacaggatggccctggagagccaggcggtcccccgcatcctctcactcctcgatcagccacgcgtcgacccgggtgagggtggcgagggtgtggtgatggggtttgatgcatacatcagccatgtagattacttcacatgcgaggtggaatgtagtggcctgttcccttgtcccccaaggaaaggcgatgttcttgaattgtcggcagtcagtgtgcaccacactacaagcattgcctcccggggagcatgttcaagcttctccttctatatcctctggggttgaagtagcccttggctccccgttttgaactagcccaccactcacaacctcgacaactcacctccctggcattcaggtgtggcccactcggcgctggaggtgctgctgcgcctggcggagcgccaggagggtcgggaggctctgctcgaggcaaacgtgcctgctacccttgccacctttgtggcccgcatcgagacggggagcgagaagcggtctggtgctgtgctccaagcagcgcgggagctggccctccagctcctgggacccctggatgacaggggacaggcttgaattggtccagcgccaatcttgacgtagtgccctgatgcatctgataaagatggctctcaatcaagtgatcgacatcggcggcccccggtgcatggggcacacagactgatgtgcccccaggtgcgtcggcagctgcgtggaagtctagcatcgacacttgaacacaatgtaccggaaactcactgggcagaggcgatacnnnnnnnnnntatcggcggcccctggtgcatggggccgccagactgatgtgcccccaggtgcgccggtagctgcgtggaagtcaagcatcgacacttgaacacaatttaccggaaactcactgggcagaggcgatacctgacccattcgatcagctagccgtgtccgcaagaaacaacaatcagcgatgaattcggcatcatgggaggcaaaggagcagagggcgaccggggtcaccccggtgggagacgccgaacgtccagccggcctgggagggtaccacggcgatgccaggctgagcgcacaaggactcaatccggccactcaggaggcggaggaagcgcgtcagacgggatccaaccctgtcgcaacaggtagcgggacttggtgccggaagcctcgcttccacctcccgcaggccaggacaatgtcaccaccgctcacgcaccctcttccctccgcacagtgccagtggagcatgaatccagccctcaattcaggaacttgacggcccctggtctgccagatccgacccccgagcagaggcagtcgatgtacgaggtatgctgggtatgagggccgctgctaactccctgcttgcactgccttattcttgcaccagcttagtgtctgttcctgcccaccacagagctgggatgagggcattgagcttcccgcctgggccgagnnnnnnnnnngtgtacgaggtatgctgggtatgcggccctgtgcgaactccctacttgcaccgcttattcgtgcaccagctcagtgtctgttcctacccaccacagagctgggacgagggcattgagcttcccgcctgggccgagaagttttcagagaggactgccgagtttggtgtgaaggcggcggatggcatcgtgaccgccagcgagcaggcgcagtccaaattgacagctctgggccgcgccgcgctatccaaggcaggagccctgggttcccaggccaagaccaagacacaggccacgctggctgctgccgccactacatcaggaggatacctgcaacaggcaggccagaagctgcagacaacacctggaggcagagaccagcctggtacaaggcctcacgagacgccctgagcctttagcggcaattctgatcaatttacatttaattttagaccatataaaagccctatgaggaatgtactcctgctttggttcctgctgcaatgacatcctatggcccatcacaattgcacattatggcgatggtctcttctcatggccccgttcaacaagctgagnnnnnnnnnnctacaaggcctcccgagatgccctgagcctttagcggcaacctctgatcaatttacatttaattttagaccatattaaagcctttttaggaatgtactcctgcttttgttcctgctgcggtgtcatcctgtggcccatcacaattgcatattatggcgatggtgtcttctcatggccccgttcaacaagctgaggcagaagccttcagcggttttccaa

SEQ ID NO: 26103 - DNA, 61 bp, Chlorella protothecoides
acggagaggtggcgggagtcgaggcagtggcagtggatgtcttggggctggatgctggaga

SEQ ID NO: 26104 - DNA, 61 bp, Chlorella protothecoides
ctcctcacatatatcggcgaacccatctggatgacaaaacaatcctgctcgggttcgtgcg

SEQ ID NO: 26105 - DNA, 61 bp, Chlorella protothecoides
agccccgcatcccctaatcaacaaccctacgcacacacacacacaccaagcgggtttggga

SEQ ID NO: 26106 - DNA, 67 bp, Chlorella protothecoides
cgtctcaacccaccttcagtcctctgccacccactcaaaacacttgccacagggacgcgggtggatc

SEQ ID NO: 26107 - DNA, 99 bp, Chlorella protothecoides
acgggccacgccgacttctcagagtactagaggagttttcctcatagggtgtgagtgtgtgcggccgaagggggctgatcgtcacgctctgggtctcgg

SEQ ID NO: 26108 - DNA, 71 bp, Chlorella protothecoides
tttggtgtggtgatcgtgcacggtgcgttaccatcgttgcagtgtgtcaccagatatcaatggcaggcacc

SEQ ID NO: 26109 - DNA, 80 bp, Chlorella protothecoides
ggcgtaccgcgacttcctccaagtaggagggatgcatgtggtgggcggggctcagccaaggggctgtgccccacccatga

SEQ ID NO: 26110 - DNA, 85 bp, Chlorella protothecoides
tgaagggagccagagtgccactcgatggcaaaaagagggcatgcatgaccagagctgtgagcgtgcgtgctggatgccacccaac

SEQ ID NO: 26111 - DNA, 61 bp, Chlorella protothecoides
gcctgcagctctgaacaaagtgatctcatcgcatcaagcgccctgcaagccagaatggcgg

SEQ ID NO: 26112 - DNA, 143 bp, Chlorella protothecoides
ccgtgtgcgactgagcctcaccgcgcggactttgcgaactacagctccacaccagaatgtaccgtggaacccacagctcagcacatatgtgcgcgaaggctgcacttcacgatgcgtcaaaagcccgccgggttggctctgtc

SEQ ID NO: 26113 - DNA, 68 bp, Chlorella protothecoides
ggacgctgctgggcatatcaatggctgtcgaggatgcagcggaagacggtgagggcggcggagagctc

SEQ ID NO: 26114 - DNA, 61 bp, Chlorella protothecoides
catgactcagaggcagcatccaatggagggtgtctgtactctcgtgacggtgtgacttcca

SEQ ID NO: 26115 - DNA, 89 bp, Chlorella protothecoides
cgcattgacggagatcacaagccgtgggcaagtggcatccaatgtcattcacaccactcctgcacctcaagcacgagcaacccttttca

SEQ ID NO: 26116 - DNA, 83 bp, Chlorella protothecoides
cggccatacaccagaatggagtctgggcctgcacaagagctaaaaggacagtcccctgaggtaacctctgctctcccttgcct

SEQ ID NO: 26117 - DNA, 777 bp, Chlorella protothecoides
cgcgcggggcccgccggccccgccagcgccatcgcccccgcgcccgcgtacacggccacgagcaggcccacgcaggcccatagcacgcgccctgcgccgatgcgcaacggcgcggtgcgcacgcccgcggctgcgtcgccgcgcatgtccgggaggtccttgaagagcgcgatgacgacggcaaagccgagcatgacggccgaggccgcgaggatggggcgggtgagcaccggccgcgccacccccgcccccgcgccccgcatgtgcaggaagaagccggcctggaccaacactgcgcgcacgcccaggatggcggcggcggccagcacgggcgtgcgcttccagcgcaggcccgggagcggcgccgagtaggcgaagcccagcgccaggctggcggccaccgtgcccagcagcggcggcgagcgcgcggccagggccaggcccagcgccaacgcgccggcggctgcggtcacgccccgcgcctgcgccatgctccactgccccgagggcaggggcagccagggcttgttcaccgcgtcgatttccacgtccgtcagctggttgtaccccacgatggccacgttggccagcagggaggggaccagggcggagcatagcgcgcgcagcgcgcgcggcgtcacgcccgcggggcccagccccatgtaggagatggacaggatggagatgatcgtgccctggatggtgtgggggcggctgaaggcgtacagcgtgcgcagccactggagcggggactggggggcgggggagggggcgggg

SEQ ID NO: 26118 - DNA, 78 bp, Chlorella protothecoides
atggcgagatccattcgccgcagcgtgaagcccccccgtgaggattatattgtttgacgacacctaatctacaactac

SEQ ID NO: 26119 - DNA, 71 bp, Chlorella protothecoides
gtatgcccctccgtctcaaaagcacagttgatgcatggcttggccaatgactgcttcaactcccctcaaag

SEQ ID NO: 26120 - DNA, 76 bp, Chlorella protothecoides
atccttggcccctgggggccgggtcctcgtcagggattatgcgcgaggcgacctggcacagtcgcggctgtcggag

SEQ ID NO: 26121 - DNA, 62 bp, Chlorella protothecoides
atggctgcccccgatgctcaagtaccaacggctctgttgcatccctgcaatgctcttacttc

SEQ ID NO: 26122 - DNA, 528 bp, Chlorella protothecoides
  modified_base (241)..(425): a, c, t, g, unknown or other
tgtccaggatgcttgcgaggagctccttcaggcgctgggtgtcgcctgccttcactgcctcaacagtggatggtaatagagcctaggatggtggttggggggaccgaagttgcccttggacctagaggcatggtgagtgtcaggcacccagtgtgccagcccgcatccactcggcgacgattctaacccatccacccaacaatgggctgatgcacacctggatcctcagcaagggtgcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcaccctcctggccacattcgatttcctcctcctctgaatacgctcgttcacccgcacaagctcaccgtcacaactccagaggccgcctcagctgcgtct

SEQ ID NO: 26123 - DNA, 151 bp, Chlorella protothecoides
aggctccactgcaatgatcaatcatgagatggtataaaggcgggctgtcaggtcagttgtagatggcactctgagtaaaaagcctggatcgtacacaacattgtctctcgcctaaaacccctgtcacttgatgatacggcgcaggattgat

SEQ ID NO: 26124 - DNA, 77 bp, Chlorella protothecoides
ttgtaatacagaatacttcaagctgcaaagtcggcgaactgtacgttatggaggcgacatgacagcagtccgggatt

SEQ ID NO: 26125 - DNA, 88 bp, Chlorella protothecoides
ccgcgtgctggtggagaccacggtggccatcgcggagcgcgtgggctgcgcggagatcgtggggcgggtggtggaggacctgaaggac

SEQ ID NO: 26126 - DNA, 71 bp, Chlorella protothecoides
tccacagatgctcagcttcgcactgatttcttttttgaagtatacggtgagggaggacatgaggccaccaa

SEQ ID NO: 26127 - DNA, 61 bp, Chlorella protothecoides
gaggatgccccaatccatcttctcaaccgtacccgccagcgcaagcaatccatgtacactt

SEQ ID NO: 26128 - DNA, 77 bp, Chlorella protothecoides
ccagggctggtgccgcaggagctgggcggggggcccagtgtgggctggctgcaggcctgaggaatccccaccaaatc

SEQ ID NO: 26129 - DNA, 109 bp, Chlorella protothecoides
cctccgggaggaggtcggcgtgcggccccggaaccgacgccacacccccgtcgtgtgttggatcctctatgccaggccgaccagcaggctcaggcccaggccttgtggc

SEQ ID NO: 26130 - DNA, 63 bp, Chlorella protothecoides
ccatggcagtccgagcttcggtgggggtgtcatgggggggcgatttgggtactggggcatgct

SEQ ID NO: 26131 - DNA, 87 bp, Chlorella protothecoides
ccctgccacacccctcctcggcgcgcgccactgcttgtgagtcgcacccccaggggcacatccctgctgtttctggccccaggggcg

SEQ ID NO: 26132 - DNA, 4833 bp, Chlorella protothecoides
  modified_base (4130)..(4199): a, c, t, g, unknown or other
tccgaggctgcatgcagggtgcgtgggcggtgggtccagcttgatggcgtggcggcccggcgcaaggcaggtgatgtggtagtggcccatggcgtcggtgcgggcgtccaccccggctgacagggccaccatggcccccgcaaggccggcctcgtctgggccagcgaacccatcgccgttttcgtccacgaacgcccggccggcgagggtggcctcgacgaagtcgggttcacacgccccggggatctgcagcacggagggcgccaccctggcgctgccgcgcgccgcctccaaggtccccgccaggctgccgtagcccaggccgccaccggccatgagaacccagcccagcgctcccgccgagtcgctggcgctggggagggcgaagccgtcgggcaccgcatcgacctgcaccccggcggcgacgctgcggagcggccacaggctcttgacgccggcgccggggcgcaggctgaagcgcaggtcgcccaggctgccgccggcgagctggtcgatcttggcgctgaggtgcaccaggttgccggggcacaccgcggcgacgtcgctggtgagcacgatgcgcacctcggggaagacggcgagcaccacctcgggcgcggtctcggcgcacaaaggcgccgcgatgcgctccaccacccgcgccccgccctagcctcgcccacgggcggcgcggtgtaggcgcgccgcggcggtggcagcgggcgtgaccgcgcccccgccgcccgtcgcctcccaggtggcgtcgacgtgggccgtcgtcgccgtccccgacgggtcgcgcagccgcacggtgggtccaccgtggcaccggtccccacctgggtggcgctggcctcgacaaagcaggcgccgagggccggcggcgtgctgtcggcgcgcacggtccacggcgtgtcgaccaggggtggcgctgccatcggggtgggtgtggcgcgcgcgcacggtgagcgtgaggtcggccacctgcgggctcggcgcgctcgacgccgcgcttcccgggccactcggctgcagcaaggcctgggcctcggccaggcgggccggcgccgcggcggcgacgaccacgaaggtagcgcggctcggctcctcgccgccgctggcgttggtggcgccatcgacggcggcggccaccagcaccctggcgaccgccgcctgccccggtaggctcagcgccacgctgaggcgcgtgaccgcccgctcgacctcgatgccgaggcgcacaggtgtcgccaggggcggcgtgcccagcgtcaccgccacgtcgccggagggcgggtcgggcaagccgaccgatgccacctgcagctgagcgggaaagccacccacggccgtgacgctggcaaaggcggcgaaggcgccatcccacaggccggccgcagcggcggcctgggcgcaggcgacgttgcttgcgaacgcaaccggatcggcgaggtcttgcctgtagggtaccatggagccgttggagagctgcgcctggagctgctaggtgaggcccaccccagcaacgttgtgcccctggacggggggcgtggggccgatccacaccgcggtcaacacgggccgggcggcgctctggcaggcggtgttctcgccgccgcccgaggtctgcgggctgcccaacacgtcgccattgccgacgtcaagggcgcataccgtgggggccccgcatctggtggcgctcggatgcatgcgcacggtgagggtcaagatcagccatgccgcctgcgggccatcgccgggcaggttgaacaagacccgctggctgcccaggttgttcaccagcgcgacctccaccccccgcgcccccgggcaggcctggctggtgcatttgtacggtgactcagcggcacaggccgcgagggtggtggcgtcgaaggcggggccggcgtcgcagtccaccgcgagcacgccgaggtagtcacgcagctcggcaacattggtatgcacgtcactgaggcctgtgtaacgcagctgcacgcggtacacgatgccgtcgtagtaagtggtcacgtcaccgccgacggggccaaagggcacctgcgcctgggcgcccttggccgcagggacgccgatggccagcgccacggccccgaggacccaccgcttggttgcaagacagccaggccacgccctttgcatggcgcggaccttgacccgccgtggcgcatcttaccaagggcggagtggacggcgaggaagtcagcggcacatgggtccgcaggtgaaacagaacacaaacatcgacacgctgtccgacggaccctaaacagtgcctaaacagtgcgccttagacaaaaaagagccgtgccatgacgagtctccgagccgctgctgctcccccctcctcccctgccatccgttccagaagcggcctgagctccacagctcaggttcggtgtcgcgctggcgatacgttcgcctctgaggccgtggcgccgatcgtcggacgccgccctagagattttcactggcgacacggactgggcaacttgaagaacttgatgttcttcccgacctggcactacacacacgataccgtcaatcagttctgcgccctgcagaccgtcgcgcggggcccgcaggcgcacacctgggccacggcgcccgccgacctctcgcatgtcgcctggccgcaggatgccagcctcgagacgttcctcgcccagcagcaggtcgatggcttcgccctggtgcaccaaggggccctggtgcacgagagctacctatcaggcacccggccgtcgacgcgccatagtcttgcgtccatcacccgcagcctcaccggcatgaccgccggcatcctggtggaccgggggatgctggacctcacctcacccttggagacctggatgccgcaggtatgcggctccgggtatgaaggggtgaccgtccgtcagctgctggacatgcgctcaggcgtcaactccagcgcgattggcgcgctgcagtccatgcacctcatcgctgcattgccgtggcagacccgccacgacgggctgcatgcctggtcgcacagcctcaagcgcgccgagggctgcgaggggcctggtccctggcccttcgagtaccggaccggcgactccgagatcttgggacagctgtgcgagcacgtgaccgccaccagcatggccacgctctggtcgacgctgctctggcagcccctgggggctgcgcacgacgccagcgtgatggtagacggccataaccatgccctgtttggtggtggcctcgcgatgaccctgcgagacaccgcgctgttggcgcgcatgatcttgcgcggcggcacggcgcacgacggcggccccgccatccttcccagggcgtacatcgacgatatgtttcacggcgacgcggacacccgcgcggcctttcccggcaccatgttagacctgccgctgccaggcggcatgtaccgcaaccagagctggagcctgcagtccgccccccccatcacgctgctcctgggcgccggcggccagctggtgtacctggacccctcagctgactttgctgccatcgttacctcgcactggggcaaaccgtacgacacaacccgcatggccgcctggctggacgtactgccgcgtatcagcgccgccgttgccagcgagccctcggcccgagcgctcggctgaggctgttcaagccgtgtacctccctgccgtagcatcgctgtcagcgccacgcctccaccgtcttgccctgggccgcctggcggcccattgaaaacagggagtgttgcggggtactactttcacggccggttccctctttccatccccacgtctccgtgcctcgtcaacaacgaggcacatcaacctgtatcagctgtcccccagaggagaccggggacagttgtaagaaccctatttcaggtagtacgacatctgttcccgttgcggaggcatatagcctgccccgcaacaaccgaggctggtggctggtgtgccacaggcgcgggggcgggcgccgggtccgtgctatcaggcatagcagcgttggcggaacacttgcggtcgcgtgtgtccacaaccttgtggcgagggctcggagccccgggtgactaggtcaaacctgttttccgaaaccaaattgttgtgggggcgggnnnnnnnnnnnnnnnnnnnnnnnnnnnnnnnnnnnnnnnnnnnnnnnnnnnnnnnnnnnnnnnnnnnnnnttaggattgttaaagacgagacccagaatgcagtgtgatggttgggggtcataggcgtcgcaaggcggcgtggactcggcgcagagcgagaacaggtggaaagtggcgaaagggccaggtcaaggggaacccccacaacattccggctcccgatgttcttgttcccagcattgttgttgcctacaaggggggaggaggagggtatgaagcttaaagcggccagccatcaaagcaaggtatgactcagggtctactgccatcccaaggcccgcatgcatgcccaagctcagcccttgcctttcggcaagcggcccaagagctctttccaggaccaccctattggcatgtccaatgcctgtgccctgggcgctgccattaggcaccccacaaagtgtcccgttcccataggtctcacacaagccttactcacctacacctagatgtgcaggtctgccagtggtgacaggcagagataccggcctacaggggcattgggagatgttagaacgagccttccaaagaaggagcgttgcctcatcgagcagaacatcaaccctgattgtccagtctccctgctggtgaggctgattctttcacacaggactgtccatgttgcaggcatcagcatgtcccg

SEQ ID NO: 26133 - DNA, 10929 bp, Chlorella protothecoides
ccggcgggggagggggggcggtggtggggactgaccttggtgactccccggataccctttccccaaggtacctggccgccaggtctgcggggacggggcgccgcaccacgcaggtcagcaggtccaggacctcgtgcgcatgctccgcgacctcggccgccttggcctgcaccgccgggtctgcatccgatggaggtttgggggcgactgaagcagctggaacagcctgccgcgctgttgagtacacgaccaagaagtagtctgggacgttgccgagccacgcaaaggatcggtccgccgccaagaacaccactggtgactctgaacaatcaccgtgatccagccacccctcttcactctgcagcctgccagcccaacaaagtacacgttccccagacagccacccaccgccgcagcagccagcacccaccctcggggtcgcacccagcggcttccaggtcgcgcagcgcacccagcgcatcaggaaactcgcccatgcgcatgtagcaggtggccagtcggatgccgcagcgcacgtgggaggggtcgtgctgcaggaggatcatgtgtaggggaaggatgagagccagagaactagcagtggcgactagggattcgggctccaagctgaacatgcaggcaggtctgtatctctaacttgagatgcacccagtgagcgacactcagacatataattcggcatctcatccccataccttgaggccaaggatgcagtctgccacggcctcctccggtcgtccgatgctcagccaggcggccgcgcggttggcgagcagcggtgcgagtttggcgcggaaggcttcagcgggccgcagcgtctcgatggcctgttgcgaggtgcggtgatgcgcgcatgtgggtcagtgcgttcatgaggggaccaaaaaaggcgttccctttcccttgcacccagccacagtgcagccgctctaagccttggatcagcagcctcgggtacctgtgtgtaggcctcccgagcgtcctcccagcggtgctccccaaaggctgtgttccctgcgcgccgcagcctttcggcggcgacctcggccgcctgccgagcctccatgattgcggagtcttcaggcggcgagcgggaggcatgccgcgctgctcgcagcaggaaggagggtggctggggcaggggacccgccgaaacagaagacacaggttgtgtgggggatggtgactgcggtggggacggcgtaggcacggagtgagccgcctcctccttctctgcgctcgcggcgtcaaagtcagcgaccgcttccaggatcttctcccaggtgacggtgccattcgacgcccccaggctagcgattggcgccggcttcttgccagacccaggggacttgggttttcgagcgcgcgctggcctggcatcctgcgccgctgccccaaacacaaatcctccttcgcctagtgctggaggctgtgcggcatctggcggggaggcactcggggcatcacttggggccgcggctgtggtgaagcgtggcagcggggcagccgtgggggctggatcggcttgaaaagctggtacagtaaaggagaaggccggctgttcgacagggccagtactgggagcagtgaacgagaaggccggcgccgcagtagggccagggtttggggcagctgtaaagaaggcgggcgccgcagtagggccagggtttggggtagctgtaaagaaggctggcgcagcagtagggccaggatttggggcggccgtaaataaggccggtgcagcggcagggccagggtttgggaccgtggaagaggctggccgggcatcagggaaggcaggcgctgtggctgcctctgtggagccctgggtcatcttactgggctgcgctccacctgtatccgagcctggccagcggggcggtgggtcttccccgatcctcacgcccgtaggccaaggtggccggctccgggacgccacatcagagtggccagccgaggtggggcgcgccccgggggtctcgaatatcaacttggccgccaccgcgtcggcgagcgcctcagctgcagggtacggcgaccaggccatcgatacggcgctgcccgggaggccaaagcccccgccagagttctccggaaagaggggggtgcggggtccagccctaccaccgcccccgctgcggttccctgaatggggcctggacttcctctgagctatgccggcgcctggagttaggcccatggggggtggttgagagactgtcatcgtcgtctagattccacagctccatcgagcacgtgataaggaccttgaaattgaccatgggcatttacctggcgtggagaagctaaagcccggctcctgttccgtttgggccgggatggcagatgaagcctcccccccttgcctttgcaccctgagacgaggtcgggacgtgaaggcattgctgcgctctccagctcctgcttcggcaccaaaagtaaagggggcagcaaaggaagtcctggatgcgctctggacgcccgcatcacttcctgacatcccggcacggcctcagggcgaagggtttgagggtctcctctttcgacacttagggccagcagctaccaggagggccagcagcttcaggcatggtgttcgtcatgtctgatcaagactgacatatccacgaagcgttgtagatcttggtgggatcagtgcccatcgtcacacctaacacaccttcctgccattttcaattcgtgcatcgcccaggcgggaatccgagggcgcggaagtacgcccgtgtgcacgaagcgaaagctccgacgagggtgtgtcagagcaaattcgcgttgttgtccacacttggacaacatggcgctcagcaacgaggtcgtgtaggagctcgctggggcccacttccgaacctgcagcagtagttgacaaccaacacggagcaaagttcgagcggtgtcagtgggccagcacacctctgagaattgtccagcaaactggtttctgtctctggtggctcattaagtgaatccaagggcggtcggctgctagggagggggcgggatcgccatggttggccaccaggtcatactaccggaggggtacagggacgccaagttgggcatgatcatcgccgcaacgataggagagatagtgcaaggtgaggccaggtcttgcgtgcaggagcaaggcgagggtaaggcgaggcttggttcgcctgtgcatgtccttgactgagcggcggcgtccaatgctcaaggttgccaattctctctgactctctgacaggtggcctcttcttcggatggaacgctctgtgagtcacaagagtatgcatgatttttggagctgactggatgttctgcaagtgctgagtccctgacgcgctgcggcaagtcgccctcacagaaagtggttgttcatagctgcccattccacttggtgcaggggtatcatgataaaggaccttggaaactacgctgatgggtgcgaccctgatcaaggtgagagtgtttttggagattgctatggtgatggggggaaagggtcagggactgaccaatgtgccaatgaactcctgagcctgacaagagcttctcgattgtctcatgcccaacaatgctgctgcctgcagaaacgttgtgtaaatcccaggagtccaagctggctgtcctgtggacagtcggcatctttgcattgaattgcgggccggtgctggtcggcttcgtgctcgactactgcggccccaaattcacatgcatcatgggtgcgtgagagggcatgtggtctttgagggtgatcatcaagagggtggtcagtgggagcagacgcttctcgacgttttgcccaacctgttttccttcgccttgtcccacaaccccccacccaaggcccccccccccatgtgcaggcagcctgctcaacatccttggcctcatcctgtttggcgtgtcccagtcttccggccccaatgccttcatcccggcctccatcttcctgggcctgggcggcatcaccttccacctggcccagatgcacgcctccgcgctgtacccaagaaagcgcggcatgctcaccgccgtcttcgtggcggggttcacgggatctggcatcattttctacctcctgctcctgatattccaggcagcaggcagtacgaggttagttgcgagggggggcccagagggggtccgtggggcggttctctctggaactcctgtgctgagtgagagcatgatgatgcagggccttcccaccagcacccagaaacactcgagaaactccccccacccccactccccccaatttctcctgcagggcggcgtacatgggcgtgctgatggggtatgcagggctctgcgcgctgtggatcccgctgagcgcatggatgatgccaaactcccccttccgggtgggccaggtctacctcctcaccagcaagtggaggtttgaagtgcgccagcgctcaggtgcgggcggtttgtgggaggagggtgttccaagtctggctgtatatcagggtgggagttgagtggggtgcagcggggactgccaaagcatgccacgcatggttttgggctgctgtgtcatacagcgatgtgaagggtcaggtggaggagccatggcccctgacatgctctcgagcaggctttgcaatcagactgggttgttcagcactctggtgctgcatcactcacaccccatccgcaatcacccacgctgcatcccacaccctttttcattcgcctgcctcctctgcagacctggagatccactacaggaggacaacgtcgctccaggatttcgtggcggccggcggcggcggcgccgcgaccatggcgaagcccccggcccccaactcgccacctgtggtggagctgatgtcagcaccgcccagcggtcgcgatgcagtgcgctccaacctcatctcagccggagtgccggacagcagcaaccccttctggcaagaggaggaggagcactcgcggagcggcatcagcggggatggcggggcggcagtggggtggggagccttctctggttccccggggccgcatggcgctgggcctacgcaggccaacggcagcgtcttgggcgtcgcgcaacgacagcacgctgaccctgacgcggcggctgagggcgctgcgccggccggcgactctctgggcggcgggcagcggcctggcctgatcacggaccaggcaggcttgcaaggactggatggcaaccggggcccccccagcgtggaccccttgaccgacccctcgcccctgccgcatggcgtggtgtggggtcccctggtcttcgaggctcgccgctttgtggagctccgcaagctgtccttccttggtgcgctgagggctgtggcagcattcgggctggttggggacttggtcgtgtgtgtggtgatgccctgcacggcagcatgggaggagtgacacccaagccctgcatccgtccttcacccacctccactccccatcgccacagagcaattcaagtcttccgagtcgtttgggatggggctcttctacaccctcaacgtgttcaccatgcagttctacctgggtgaggagcaggcattggaggggtggaaggctctgcatgcgctcgtgcgctgagtgccaccgaccgcatggcacaagaaggggggggttcacttctgtcgcaagggtgacaacgtgcacagcacaccctcatgctgttgttccgcccacgcgcgtgcacacgccctgcccctgaaccccccagggacgatgcgactgcagctttcaaacaagggtagcaatgccgagacctactccaactttggaaacgtggtcgtggcgtttgcgttcctcctcatccccgtcatcggctggctcctggacaagaaggtgtgtgtcatgggagcctggctgagcgggccttgaggcccaagaggagggaggggaggggagggccgggcgtggacatggcgatcagtggatggaacgcttgctggagaggcctcgcgccagcagggcgatcggagcccatcgccggttgcgttgttccttccccgcctcgccaagtctgtccatcattcacgccgacctcccacgggtgtattccttgtttcccccacaaacccgcccgtccaccaaccctgttcagggctacggctccacgctgggctcaatcctgggcctgagcgtcctgaccctggtgctgcaggccctaccctcgctcccgctccaggtggtgaccatcctgatctggatgaccgcccgcttcttcatgtacgcctcgtactttgccatcttcggcgcgctctttggcttccgcaactttgggcggctggtggccgtggacaacatcttcaacggcctgtttgggctgctccagtatccgctcacctacctggccatccatcccctgaacgggaacttcatgtgggtcaacctcggccaggtgagtgggtgggtgggtggagaggggtgctgggggggggccccagcacctgtcatgccccatcaccactgccctgtgcgttgcccctgctgcatcatcacccaggccccttggcccccctcacccccaacctccacaccccaacacaccacaggcggcgtgcctgatcccgctctcctggttctgcgtggccatgtaccgctgggagcgtgaggacctggtgcccatccggccgctggagggggaggagctgccctgcgacatgctgggccaccaggagcgcaagaagctgaaggacctgcacctgcccaacctgggcctgggcgagctgaggatgccccacgtgcagctgccggaagccatccggaagctgacgcggtcggggacgcgggagcgtgaggtagatgtgtgaggaggaggactcctgcgagaacacgtccggcgcacggctcccgcctgctggaagcgcgttcctcttttccagcaccaatgacacgttggatacataacgttgtgaaacccaggatcagagatcgtggctgggagagctgaccagggggggggctgacaaggcgctgacctttcatggccaggaaaacccaggaccagaaacagagcaatttgaccgcgccaagccatcattcaggcaatcctccacacacgacaccgttccgctctcagcgccgccggtggacgggtcgccggcccaggaccttggtggctggcccagggaggggcgcggggagcgaccagcaggccgccgccagcagccagtgcaggaactggaagactgcagacgtcgcagcgtggggagggtagatgttccaaacaccctgcacacgaggaagagagggggggcggtgggagtcaacggtggctgccccggttgccgagggagggaatgggactgcagctcggctcgaaatagggcaacggagagccatgtccttgtgcaccaggagccgagagtacgtcatgctggatgtggtgccggaggtcacaccactgaccaatctcatctgtaaggcccatcagctctaaagcagtaatcatgcacccacctcgatgcagagcagcaggccgatgcttagtgacttgggcagcctggtgcgcagcagcaggtacggcagcatgtggaagtacctggacgattgggtatggaaggagctgctgaagtttgcagcactgcagcatcagcagaaacgggcacaatggacattagggacatctcttgctggtggatgcagaccgcaaacaagcgcaatacacagcacggcatgctgcctgatgcgatactcccaactcccaccctctgcaggaggaaggagatggcttccccacactgcttcatagtcgcaccagctgtaaaactggtagtgcagggagcgtgccgagaggatgccggccaggtttgcagtgaacagaatgtagagcatgaagtccaacgacatgggcgacgcctcggcctcctccttggtggtcctggagaagaaacggcggagcgcagggcccacccctccctccgcctggaacctgtttgttcaaggagcaaagaggggggtgtttcagagaatcgcagctagaatgtgcagaaccttggcccttcaccaaactgcaaacatcactttgggatgcagatcaggtatgctgcagtgcctcatcaaggacccaaacgacgcccgcctgctctcttcacttgctcgcactcccaggcactggtgaggctgcaggtgtctggttgagtccattgccctcccggacccagagccatagcgcatgcaggcgggctccccgccaaacatctcatcaccgccactcaccatctgaacctggcaaaggaccagagaagacggaggtgcagggccaggaggaccagcgcaaagcggcggtcaacaaaccagtcggcgggcacgaactgccagttgacagaccagcgctgctggaagacgcgggtgagctcaaaggcccgccccaggtaggcacgaggggccacggcgaggaaaggtcctgccagcagggcctggagcaggagacccgccgccagtccccgcagcacggggaggggagaggccaggcggatcagcaccgcaagcacgccgggggcccagagcaggacattcatcttgacgctgactgccgcactgtacacgaagatggccagggtccaccgacgcgactgtatttgggggaaagagagtaaaagggggctggaagaggggtcttagaaggggccagtgtttagcagggccaggcgcaatgacggggcagggagaggggggtaattcgagccatggagtggtgaaaagatcaaatgaacactccattacgaatcagagactgtgaatcgatgtagcacagcatgcgccgggggagagtggagatgtcatagttgcaaacagctacagaactcgtggacactgaggatgtgcagcatcacaaagcatgccacccagctcgtaggcacagccacataagggacctcccaagaaagcatcacctggagcaggagggtggcggcgtatgcaagcagcatggcccagcagtcgttgaagaggcggaggaggaagatggagtggacgcggcgcgagaggcacagcaggcacagcgtccaggggggcagcgccctggaccggatgtacagcgccatgacggcggcctgggtcagcaggtagactccggcgaagatcgcctggatgttttgtagaggggtaggggtggtgcctgggtttgggtagttttgacaggcgctaggaagggttcccccgcttccaacataaagtctgggctcagctggcacgatggcgccacccgaccacgttctgtaataaacaggccctgttgccccgcccacctgagccgccgcgatgctgcccccggtcagggcctgcagcgcagtgaacaagtacacaaaccctgcagggtagacgagcggcccggtatcgcccttgagctcctcatagttgcgctcgccctggaggtggcgttccgatggagaaggattggaccatccatgcgttgcttgatcatggcttgaagggggtgggaggggttccgaggcgagccctccggtttgtgtcagcaaccccatctccagttttacttaataccagcagccagtactctcctgggcaagaccacatctaccttcacaaacccagagacttcttgcatgtaggcgatccaatcaatctcggtgtctgcatgtgttcatcatggaccagggctggtcaaggggcagagtccactgtgcaccaggggtggacgtcatgcgaaaatggcatgcgaccgcccacgtacatggaactcgagcaatgatgatgtacgacagcagcgcatcgccgatgaggagcagagtagcaaagagtgtggccgctcgcacatcccgggggtcctgcagacgcttccaccacggcgtcgaccgtgccatggcgtccccgctaggagccacccaacactcgatactgcctgcgagatcaccgttattccatgcgagtggggtgcatttgcgtatttcgggggagcattcccacaccgaccttagactggcacaactttgatcacttttctgcaaggcctcgatcgcgcgcgcattaccggtcctcaaacagatacgtctgagcatcagaatctcacagaacgtggatgccacgcctactgacgacatactatcccacttatgctactgtaatttccaccttagctgcaagctcataacactttctgctccttgcttctcctggccaacatgcgtggcattgggaccccttttttatgcaaaaatcgtgcagaactccaagtcacacacgttcagctggtctttgcactgctcctgaatgatgaaacacttctcacaaatgacgtcttggcactgctctactcagtcttccactctcagcagcattcagatgtctccctatcccacaatgccccggagtccacacgcatgtgcgcctgccgctgccgaatcttgtcaagaaggctcggcggtgtttggcagaggaaggtgggatgctttgtcggacccgtacctgcagcgtcatgtgtaggaacgctcacgtaggtttccagacagagatgcaaggactgcacgagtgaagctggagcagaagccactgctttgtccctgcaggattcttgccagagctcaatgcaccgttccagcagcagtcgagccccaaacgcaccggatgcagtgccgggctgagagcgcacgacgggtcgtagagtgtactctcgattccgtatcgcctgcatcagctcatcctccatcgctcgcggctgggcggtgttgtcttgcggtctcacatcaggcttgaccacacgcagctgccctgcggcggcttgcagctcctcagtggagataggcggagcttttgctgtggtaaggggacgctgcattccagtcttctgctccggtggcttgggcacgcctggcccccttcgtgatgtcgctggcggtggcggtggcggtggcggtggcggcggcggcggggggggcggggggggggggcggggcgggg

SEQ ID NO: 26134 - DNA, 77 bp, Chlorella protothecoides
cctgccaccctgttgctgcacttccccctctgcagggaccagatcttccagtggtgtcatctcatgctgcacttcga

SEQ ID NO: 26135 - DNA, 79 bp, Chlorella protothecoides
agtgggaggggtatgagcatcacagcgcagcggtgaaggtatacgcgtacacgtgtgggttgcaggatgtagccaaaac

SEQ ID NO: 26136 - DNA, 73 bp, Chlorella protothecoides
gagggttgggtgttgtttcatgagcaattcgagttcagtgaggataaggtcctcagatgatgtcatcctactc

SEQ ID NO: 26137 - DNA, 125 bp, Chlorella protothecoides
catcaacacctcagacaatgcccggctgcgcgctcaattattgataccacaacaattgaggggtgctgcctggaggaggtggctcaccattgcatggagcaaagctcttttccttgacaggcttg

SEQ ID NO: 26138 - DNA, 61 bp, Chlorella protothecoides
gagtcaatgacctgtgagccacccatcgaagaagccgtcaactggccgccctgactcacct

SEQ ID NO: 26139 - DNA, 61 bp, Chlorella protothecoides
tccacaggctcaggggagggcagcgccagctcccgccgcatcgctttatccaggtgcacat

SEQ ID NO: 26140 - DNA, 208 bp, Chlorella protothecoides
ccccgaggaggactgtggagacgcggagtataactcgccgtttgaatgaggggcatgacctcagccgactcccgctgcacccttggagcaccttgcacccattggaggccttgatggaacccatgaattcctactgttgatctatggcatcgatcttttattttgatcttacgtctgtgagcacatcctctcgctgtacgccgaggac

SEQ ID NO: 26141 - DNA, 89 bp, Chlorella protothecoides
ccccggaatccggtgaccaggcatgcaggagggggagcgcgtggcctccacaacgagccaggcgccgggggagagcctgcgggccagac

SEQ ID NO: 26142 - DNA, 96 bp, Chlorella protothecoides
atgtttgccagcacagactgttatggtgcctattcgctgagtgtgctcaagccctgagtttcttactccgcacccccgacatgacgacagggatga

SEQ ID NO: 26143 - DNA, 173 bp, Chlorella protothecoides
gggcagagggggccgagggggaggggggctgcgcctgcgatgggctgctgtccagcgcatgagcgtggagcctggactctttgaaccctttcgtcaggcctctgctcaaaatggcccgtccatttgcatgtttcacccatcttcacccccccctccaccccttgcagccggtt

SEQ ID NO: 26144 - DNA, 79 bp, Chlorella protothecoides
acggttgtcgcagcaacgatctgcgggggggcacaggcggtagctgggcgcgttcttgatgtcgccctgtcaccaagtg

SEQ ID NO: 26145 - DNA, 67 bp, Chlorella protothecoides
atgcgcggggcacgtccactgcgcggtgtcgtgtgtggtgtggtgagaggagggcatgtggggctgc

SEQ ID NO: 26146 - DNA, 62 bp, Chlorella protothecoides
aaaataccggcgaaaggactcaaggcatatgtaacgggcattttgcattgtgaggtacaaaa

SEQ ID NO: 26147 - DNA, 61 bp, Chlorella protothecoides
caatgtgtgagtgcgcatggcggcagcgggtgcatgctgcgggatgcattcagcacggctg

SEQ ID NO: 26148 - DNA, 124 bp, Chlorella protothecoides
gcgcatgggcgtgatgacgttgcgttgctgggtgtgtgtgagaaaggggggggagattcgagttttagctaggatataaaggtttgtgaggaccgggggggtggtccaaagggaagcagggcca

SEQ ID NO: 26149 - DNA, 61 bp, Chlorella protothecoides
cgtccgccgcggcaactggcggctcggggggggcctccttgctgctggaccccgcactcgg

SEQ ID NO: 26150 - DNA, 208 bp, Chlorella protothecoides
ctcaggtgctctccacaccttctgctgattgatctaatatgatgctgtggcgacgaggcctcacagcaattttctactcctctgaactcaagggcatccttcataccggtgctcaatcgtgatagcagaaccaccttgctattcttgacttgctctttgaatgactttagtcctcttgtgcaagcacatgaccgtgatgccttgtaaa

SEQ ID NO: 26151 - DNA, 128 bp, Chlorella protothecoides
ggtacctcatctgcgaggtgacggtgcccgtgacggcgagcccctccaccaccccaggaaggggagttcgtccctgcgcatcctcatgccatgcgctgtcgctcacccgctgctcggcctcgcgtgcc

SEQ ID NO: 26152 - DNA, 76 bp, Chlorella protothecoides
taatgtatccctctgttgcatggcgcccttcccccctcatgcccatactgacgtactcttcgatttccttctgttc

SEQ ID NO: 26153 - DNA, 168 bp, Chlorella protothecoides
agggatcgtgggtcagggcatcgaggctgtggcatgcagtttacagtcccggaccgcatgatcatgccatatactggaatgcctcccctttgcataggcacctcggacccaagtaagtcgcgcaccaggccctgcagcgtggcgtttcccccgaacccaagatcggag

SEQ ID NO: 26154 - DNA, 61 bp, Chlorella protothecoides
gggctgcagagtccatgttgtcaaccgcgatgtcaacggagcagccaacatgctcatgctg

SEQ ID NO: 26155 - DNA, 114 bp, Chlorella protothecoides
gcctgcctcttccagtgggtggtcggcaatctgaacgggtaagatgctcatgagggggggccgagcgtggcggtatgggggggcagctcttgtgcctggagtctgttgtttggc

SEQ ID NO: 26156 - DNA, 207 bp, Chlorella protothecoides
gaggctgggagccaaagtcagacttcatagaagtcgcctacagaaaccccacaccgagactcgggccaggtgtcttgcagcgtcatgcacaggcacacaccaccgcaggtgcatgggctgcggctgaccagcgcaccccttcctccccgttcccctctcaatagtatactcacacaacccgccgcagccgcaaagtctcccgtgccc

SEQ ID NO: 26157 - DNA, 136 bp, Chlorella protothecoides
cgacggcccatgtggaggtgtgactgggccccaagagactgccagggtttattacatgcaaagaatgagatttggtgagcttctttgatgtgttgagttggtgctcgatcgaaagcttattggccttgcgcaccta

SEQ ID NO: 26158 - DNA, 152 bp, Chlorella protothecoides
cgcagggatgtgagaggcaaactcctcaggtccccccaaacccgacaggtcctgtgcgctctcacttccccccccgcggcgtgccgccgagcaccacttcccttccgactcgtccccctcccctgcaccgccgtgcagtcgcccccgtcctc

SEQ ID NO: 26159 - DNA, 69 bp, Chlorella protothecoides
gcaggaggctatcatagctctatgcatgaaagaccagttttggaaggagacgtttggtcagaagctctg

SEQ ID NO: 26160 - DNA, 113 bp, Chlorella protothecoides
acgcacccccacactccccatcctgactcgaacccacaaggatgatcccacgcccccacctgagatgagcgtgccggcgtcggggcccgcaaaggccagcgccaccaccggca

SEQ ID NO: 26161 - DNA, 61 bp, Chlorella protothecoides
agggccctcctgggccccagcgccaagcgcgccagcccctgactcgtgacgactgggcacg

SEQ ID NO: 26162 - DNA, 73 bp, Chlorella protothecoides
ctccttcggccgcacctcctacatcctggcactgcagaaagcacgcacccctggcaccttttccatagcccgg

SEQ ID NO: 26163 - DNA, 72 bp, Chlorella protothecoides
ggtgggggtgtttgggtggcgaggccgaggcaggcccgaaatggggcagacgtagtcagacccagtatccca

SEQ ID NO: 26164 - DNA, 79 bp, Chlorella protothecoides
gcttgggcagcattggcaccgcatgtgcaatcatttgatccctgtgcccgctcccaaggaccccatcccacctgatctt

SEQ ID NO: 26165 - DNA, 63 bp, Chlorella protothecoides
tttgagcgcacgaggaggatggggagcgggtttgggtgcacggctgcccaccctctcgcctgc

SEQ ID NO: 26166 - DNA, 124 bp, Chlorella protothecoides
tccatgccatcaggtgcctcaaggaaggcaggaagtgtccaaatgccagtcgttccaaaagatttgagcgccgacatgcctgcagggagttgacgagctgcaggaggcgccgccagtccgggat

SEQ ID NO: 26167 - DNA, 61 bp, Chlorella protothecoides
tctccgggcaaaaacggaaggcggaagctgcgcaaccccttgatggaacccatgtgggtgt

SEQ ID NO: 26168 - DNA, 61 bp, Chlorella protothecoides
cctagctccacctgtggggtgaatagtgcacatctatgatcgaaagatggctgacggccat

SEQ ID NO: 26169 - DNA, 106 bp, Chlorella protothecoides
gttcgccgggcgcgagccccagcgaacgttggcttacgtcattgtcattcaggaagtgcagttatggaggtagaatctacccaaacgcgacaggatggcgcaggaa

SEQ ID NO: 26170 - DNA, 67 bp, Chlorella protothecoides
gaaagttgaagaggagggcgaagaatgccctcccgttgtgtacaaatcagtccgtcttcttctcctc

SEQ ID NO: 26171 - DNA, 320 bp, Chlorella protothecoides
cactttcagctgtgaatatccaccatgaagggcaagacatgctcataattaactgtcaggcaggccaggccttcagctacaacgaccttgaattggtttattctgcttgtcctctataagtttgccagagggaatcacacatgagccaaacctattgaagaaagcattaggacagtgccagtcttaatcacagtggggggtatgttattcccaatgaagtcgtccagaaacggactaggtagttagctttttctagtgcccaacacattagaggtgtggttttttttctctaaaataagggtggccataggctcttttaa

SEQ ID NO: 26172 - DNA, 130 bp, Chlorella protothecoides
tgcaggattcgtgacgggtgcagggcccatttgcgcctcagcagccgcggcagaacccagtgttagcacacccgcggagagggggtgtgctcgccctccacgctctggtgagtccctgcctgcgccacgc

SEQ ID NO: 26173 - DNA, 61 bp, Chlorella protothecoides
ggcgggagccctctcccatcgtagtggaggttacgagcctagcaaagtctcgtccctacca

SEQ ID NO: 26174 - DNA, 76 bp, Chlorella protothecoides
tggcagctagccctgtgtcagtagatgacctggtacatggatgcaagatctggagacaatctggtgcacagccgtc

SEQ ID NO: 26175 - DNA, 157 bp, Chlorella protothecoides
gctgcggccccggcgtcacagcccatcctgactggggcccacccagagcgtgcaccgacgggggccggtatggcacccaaaaacggggcgccccaggaaggaccaggctcctcacagcctccgcccgtggatgcggccatcgactcccctcgtgcgg

SEQ ID NO: 26176 - DNA, 147 bp, Chlorella protothecoides
agagggtgcatcgcggagcggcgcgtgggacccaggtccggcaggagcctgctgccccagcgagccccgtctgcccgcgatagcccctccctctgcctcagcggccaccagtctgcctcgctccactctgcaggcaccctcccactc

SEQ ID NO: 26177 - DNA, 67 bp, Chlorella protothecoides
tcgctccactctgcaggcaccctcccactcagcccacttccaaacccacgccagcgcaccgcaacgc

SEQ ID NO: 26178 - DNA, 175 bp, Chlorella protothecoides
atccccattttctcctcgacagaacacagctctgctgtagatacacgaaggtaattgatggtatataagaagcaaaagaagcgacgtttctcctcgtactgtgacctataacacccacagacctgcagcccttctgtaagtgtatgtctcatctacagacctgcagtcttctctg

SEQ ID NO: 26179 - DNA, 103 bp, Chlorella protothecoides
tgacgtgatccgtgatagcccttgtcccttgcggaggattcgagatcgatcaacctcaaaaccccgctcaccgtccttccacgacatgttacaggacatcact

SEQ ID NO: 26180 - DNA, 329 bp, Chlorella protothecoides
tgtgccggaatttcaacctgtatgaaagagtggcgtggctcaagctggactatgtgcagctgagtgctttggggtgcctcagtacaggcgacagacacccgtctatctcatgggctgtaaatctgcttccctgtcccaaggatagcagcggattcttacttttcatgaagcaatgcaaacaaagtacgatgcatgagaatggtagctggaccaggaagtggttgacaacgcagcacgctccgagctaaactagggaggggatcagtcgagggcaggacatgtttgatagcactgggaatggcggctgcgtggacttgaagtttggagct

SEQ ID NO: 26181 - DNA, 61 bp, Chlorella protothecoides
gacggaaggatcacttgggacgagagcaacacgccatcgcccagctagccgttggaagtgg

SEQ ID NO: 26182 - DNA, 153 bp, Chlorella protothecoides
gcttcacaatggacattcactcactccagcccaacaccgaatcaggcggtcaaagcagagttctccaagctgaataccgcatgtttgagacaccaccgtcttgtatgctacttcatgtcaagctaaataactcgagaatctcacgcctccgtt

SEQ ID NO: 26183 - DNA, 161 bp, Chlorella protothecoides
aagttttcggcacccaagtcctggctggaacacagaaacagcgcacccacccgtccctccctccctgcaggaagctgcagccgcaggccacaggccccctccaccttgccatcgtcaccgcactaactttcttcggaggctttgtcggccacttcgtgacg

SEQ ID NO: 26184 - DNA, 61 bp, Chlorella protothecoides
ggattgtagacacctggtacacttgatgaacaatagcaccccccttcaggatccactctag

SEQ ID NO: 26185 - DNA, 61 bp, Chlorella protothecoides
gccgcacccatgcgcagagggaaggatccttttttgtctggagggcggctacaacaccgag

SEQ ID NO: 26186 - DNA, 66 bp, Chlorella protothecoides
ctgggtcgcgctaggagccgccgtcaccgcagcgtttgccccgtccacgatgagcagggcggggcg

SEQ ID NO: 26187 - DNA, 136 bp, Chlorella protothecoides
gccgccctggccacaagctattcagccaccgctcgagggttgatgacgccggtgacgtcgcggttcacagcagagacatcaacgtgcctgatgctacatggcctggtgtcccagacgtcctccagctcccatctgc

SEQ ID NO: 26188 - DNA, 76 bp, Chlorella protothecoides
aaatacaggacccaagcatccttgcggaatgcaagcaggttgcaggtattgatgaccttggtgttccctgtcttgt

SEQ ID NO: 26189 - DNA, 61 bp, Chlorella protothecoides
ggacggcatgctcagcagggtgtcgatggacctcgggtcggcggtgatgttgcgtttgcca

SEQ ID NO: 26190 - DNA, 211 bp, Chlorella protothecoides
ccacggcttcatcagccgggtgggtgtacgtgtgcgctggaatgagggagggcaagcagtggccagggatgcagggccacaggactggaccaggaaagcgcatcatgccctggctcgtctggcagggtggggttacacccatgcgctgctcacctgcctcccccctgccgcatgtgccagaatgagctcgagtccgccctgctggagccgc

SEQ ID NO: 26191 - DNA, 61 bp, Chlorella protothecoides
ggagaacctgaagctggacatgcgcatgaatctcaagagcaagaaggtgatggggcacaga

SEQ ID NO: 26192 - DNA, 93 bp, Chlorella protothecoides
accactcttgcagcgatacctggatccctgtggcgggcaagggggggggcagctgtgaggcgtacttgctgcggtggaaggcaagcaatgatc

SEQ ID NO: 26193 - DNA, 73 bp, Chlorella protothecoides
tgtgggaacagcagcccaaggcttttggtcctaaaatgcattgtttggacgagttgatcatgcagacactcaa

SEQ ID NO: 26194 - DNA, 63 bp, Chlorella protothecoides
tttggacgagttgatcatgcagacactcaaacgcccgaggcactatagagaaagagcaagacg

SEQ ID NO: 26195 - DNA, 61 bp, Chlorella protothecoides
catccgcccggccagcctgctttcgccgctggaactcctccaccatgcggatggcgtggaa

SEQ ID NO: 26196 - DNA, 125 bp, Chlorella protothecoides
ccagccaagcctgaacatcacgagggcctcggaaccaatcttgcgcctcccctgccgctcagcctgcacacctgtcccccccctcccccgccctcctacctaccaagaaaggccggcgtgcccag

SEQ ID NO: 26197 - DNA, 93 bp, Chlorella protothecoides
gctgacacacctggcagcaggaagggacagggtattctggctctgcctgcacactccacagaaatgctacctcccccacgctgcaggtcctgg

SEQ ID NO: 26198 - DNA, 2469 bp, Chlorella protothecoides
  modified_base (191)..(200): a, c, t, g, unknown or other
  modified_base (1011)..(1020): a, c, t, g, unknown or other
  modified_base (1454)..(1463): a, c, t, g, unknown or other
  modified_base (2264)..(2273): a, c, t, g, unknown or other
tcctgttcctcgaatcgaatggtgagccccgggactgtggcgggagggtggccatgcgtgcgcagcctgccatgcacacggtgcatgaagcccgctccagctgcactcggccagctgcagcgcacattgccagggtctgccatcccagaaagcacgccagggtctacctcccattctcctcgacacagctnnnnnnnnnnaggactgtggcgggaggatggcaatgcatgcgtagcctgccatgcacacggtgcatgaagcccgctccagctgctatcggccagctgcagcgcacatgttagggtttaccatcccagaaagtacgccatggtctacctcccattctcctcgacacagctgacttgtacgatgtcgtcgactggatggaccccagccagcgcccttcctggtccgagggcgccagctccgacccacatgaggacgaggcagggcaaaagggcatgggaaggcgacacaggcgtgactctgtgcgtgcgtccaagcctgcatcacaggctgcagccgagcgactattcaaccaggtttgagttgcaggctcagagttgtgtcttcttgtgtggcacggggtcctgaggacgtgagtctgaaaaagtatggagcaggcagtcatatcatcatgagatgcatgccaggcctgcctggaggcgtcgtggtggcagcaaatttgccggcattgtgccagccatgtcctcaccccaaccatcaccctctctgcctgttgtggtgcagctggccacgacgggaaagtgctcggccctgatcaagctggcgccagacctctccgaaatctactttgggcactccacgtgggacacatatacgtaggcaatgggctggaatgggcaggcttgcggactggcctgccagggtgtgcaccagagacatcgtgagtcctaccccgatgcagccaggtcccctgtgtgcacccatgggccacctgacccacctcccgccgcccacccatccgcgcatagtgcaatgctgcgcatnnnnnnnnnngccagagacatcgtgtgtcctaccccgatgcagccaggtcccctctgtgcacccatgtgccacctgacccacctcccgccgcccccccatccgcgcatagtgcaatgctgcgcatctacaagcactacaacttcaacctgaccgagctccgccctgctgccgatcggatgtccttctccagctaccctggggagctgttctcggacgacgacttttacctcctcagctcagggctggtgatgctgcaggtggcaagatgggatttgctggggattggggtggcttggcggggcagtggcaaggtgcggtttgcctggcacagcgtactggcaggtttctcggcttcccatggcgaggagtgataactgccatccttgtgaaaagtgggaaggtcagagacgtgggacaccactttgcaagatgctcgcctgctnnnnnnnnnntttcccatggcgaggagtgatagctgccatccttgtgaagagtgggaaggtcggagacataggacaccactttgcaagatgctcgcctgcttccagccgtctccaggttcccctccacccgggtttcccgccctccctcagaccacgaacaagatcttcaacgacgagcttttcgagctcttgagcccgagcaccgtgctgagctggcagcgcatccgcgccgccaactggctggcgagcagcggcgaggggcggcgcggggccaccctccccgaccttgctgtcctatgttctctcctgccctctctcatgcggcccgcccacgctctccaagcctcccaccctccaggagtgggccgcccacctggcccgccacaacagcggcacctacaacaaccagtacatggtggtggacctggccaggttcaaggccggccaggtcctcatgcccggcctgctggtggtggtggagcagatccctggcctggtggaaagcgcggacgagaccgacatcctggcgggcgggcactgggcctcctacaacgtgcccttcttccccagagtgagtcgacggtgcacctgtcggagggggccctgccgagtctcaataccatcaggcacttcgtcaccacttgcatcccccccggccactcagatctacaacctgtctggctaccccgacatggtctccaaggccgacgcccatgggcagcacttctccaaggtgggtggggactggtgaagtgggttgccgcgcagctgaaaagggtgctgtggggatcctcgtgcatagccgccccnnnnnnnnnncggcgggggctggtgcagtgggttgctgcgcagctgaaaagggcgctgtggggatcctcgtgcatagccgccccttgctgctgtggccacacaggtcacctgccccgccctagcaccctgttgcaatgcagccccagcccccgcaggcgggccacgggtgacgccatttcgtcagatcctccccaatgcccccccc

SEQ ID NO: 26199 - DNA, 1359 bp, Chlorella protothecoides
  modified_base (965)..(974): a, c, t, g, unknown or other
atgaagcgtggaatgggagtgatgcatcgaatgccacggttcacccacacctcccacacaacataaaaatggcatcgagcacgaccctgttttcataggatgtgatacacgagcctgtcagaagaagtggacggcaattatcagttgggaggtgtctggcatgcaccagcttgtcaggaggataccttccatcgtgacttcacatgattcagccggcggcgttctacattagctcacaatcaacgtggatctggatccgctccactaaagtcgatctgtgcataactcaatgggaaatgtcagcttcaatgaggctcttgttagcgtacaatgctggtggtcgcccactccaagtaggggatggcgaaccctgttgcctctctctgcacctcctttttggagttactatgaccgggccctattctcctcttcgcctggacccgtgcactgcgccgaacccacgccacgcgtctcagaccacgaaacccaacgcccacactggagtttgggacttggatgtggtaagtctaccttggaccaaccaaatcagttcatgttgccgggaccagccaaaccccacgatactgcacccaaccccctgctggcacggcgctggcacgcgcattaccttcatatggcatgggaattgagaatgtgatgcctctgggcatggtaaggaagccatgcaataagaggaacagactacctccccacgactgtagcgcggacgcgtatcgttgctcttgcacggatgacgacttctcctgccaccagctgttcagtttgatgtgcatgagatcatccaatggtgccaagcagcaattcagtcggactggccctctcggctatgaaagggtagagtgtgcagaaacacagtgctaagatttatggaccgacgagtaccctgggagagctgatgaagcattaccactcatgctccttatctgggcacaccttggagcggnnnnnnnnnngcagctgttcagtttgatgtgcatgagctcatccaatggtgccaagcaccaattcagtcggactggtcctctcggctatgaaagggtagagtgtgcagaaacacagtgctaagatttacggaccgacgagtacccttggagagctgatgaagcatcaccacctctgctccttatctgggcacaccttggagcggaaataccgtgcctgccaaactctcggctgggaccctgagccccggtctgctccggtattatcagaaggggctgatcagatgatgacactgttcaaatatcagcgggttgaaagtacttgtccgtatgtcaatgctgtggcagacttgtgcacatggtgggtcacaggcttgagcggtcctcggggacggca

SEQ ID NO: 26200 - DNA, 680 bp, Chlorella protothecoides
gctggcgtgctcaccaggtaggcaggaactacgatgggtaccagactggaagtggtcaaggaaggtactgtctggatggagtgggagtcctaccgtccttggtcactgttgtcattcaagtctacgcaaacattgtgcaggtctgacatcaggaagtttaagaagctggaaatccagtagcgtgcagaatcaagtaggaagcttttcctgtttattctgaggcctgccataaggcagaatgtatgctaacagcatgtggtgatggagcagggtaggaggttgagaaggacgcgatgacctatcatttccagtatcagcattggcacgctcactgtctatgcttagtccagctcttcccctcctagcaggtctgttctggatggagcaggagtcactaggtctccatcagtatagtatgcccccaacccagtcgtccactacggtgctcaatacaagtgaatcatcagaaggatctcagcaaatccaactcacgttcttcctctcccaggcgttcatcaccctgtcctcttacaggtcgctctctccacaatatgtgttcaattcatctgcatcccaggccctttatctgccttatgagaagctgttctccaacgactctctaccgattcttttgatcatcacctctaaactctgccctgttcctttccctgccgtccccg

SEQ ID NO: 26201 - DNA, 79 bp, Chlorella protothecoides
tgatgatggatttgcagagcccaccatgcttacttctagccaagcaggggccccacccccaagaaagacctgtgacatc

SEQ ID NO: 26202 - DNA, 61 bp, Chlorella protothecoides
agagggctgccattcctaggcacagagcagccatgaggtaggtgtcggggaggtcatcgtc

SEQ ID NO: 26203 - DNA, 96 bp, Chlorella protothecoides
tggtgagcggagaggaggagtgtgtgtccccagggctgcatggtacagcgctgtgatggatgagggggggtgagcggggcggcgtggggagtataa

SEQ ID NO: 26204 - DNA, 80 bp, Chlorella protothecoides
acatggggcgggtgccagccatccccaccgcccccaaccacacatcccccgcacctgggcggtgaagatggggaaggtga

SEQ ID NO: 26205 - DNA, 77 bp, Chlorella protothecoides
ggactccaaacctgcgacactgtcttgagttccctggcagagatcgatcccgagcgcaccggagtgagagcagggag

SEQ ID NO: 26206 - DNA, 73 bp, Chlorella protothecoides
tgtcgcagggtccattcatggtatggcccaaagccgtgcgtaacgcaccatcccagcaccgcccggagcccca

SEQ ID NO: 26207 - DNA, 97 bp, Chlorella protothecoides
ttggccacgaccagctggtgagtttggcaagcatgcccccggaacgtgtcgccgggcgtaccaaactaagccttgttcataggcccagtgagctttc

SEQ ID NO: 26208 - DNA, 206 bp, Chlorella protothecoides
ggcctcgtcagtgccggaatcaaggtgcgcagggacttgatgttttggatgtttgggtggagtgaggatctataattgttccagtgcatgccttgcttaggactgtgtgccaccacaggtcgggcaccctgcttcatgcttacgctctgccctttcacacacctgcccaggcatacttcaaccggggttgagggagccagaatgtg

SEQ ID NO: 26209 - DNA, 121 bp, Chlorella protothecoides
ccgcacaattgcagattgtgcagggcgctcgctgctgctgtgaatgaacacctgttgcacctttcattcccttgtatatcaccatgtcttctcaaccaacacccaactgcctcaggacgac

SEQ ID NO: 26210 - DNA, 90 bp, Chlorella protothecoides
atccctgctggcaggaggcgggtggggtggaggggcggtttgagttgtggggtcgagtcctgcgttgctggaggagaaactacagatgcc

SEQ ID NO: 26211 - DNA, 67 bp, Chlorella protothecoides
ggtagcgacatatcttcgactcgcatatgttgcattctgtgtcacagcagctgatccaacgattccc

SEQ ID NO: 26212 - DNA, 61 bp, Chlorella protothecoides
catgcccacggcttgtgatctccgtcaatgtgcagggagctacaataagggcaacagcaac

SEQ ID NO: 26213 - DNA, 2826 bp, Chlorella protothecoides
  modified_base (719)..(728): a, c, t, g, unknown or other
  modified_base (1087)..(1096): a, c, t, g, unknown or other
  modified_base (1727)..(1736): a, c, t, g, unknown or other
  modified_base (2249)..(2258): a, c, t, g, unknown or other
  modified_base (2401)..(2434): a, c, t, g, unknown or other
gcgaggccggccggcgccgcgcgggcggcgcgccccgcgccccgcgcgtcttgccacgcctccacactggcgcggccgggggggtcctgtgcgggcgtgatgacacgctggcgtcgaagctcctcgacgctcggcgcgctggcgcccagctccgcccgcggccggtgcggcaggctggactggaaggcgggcaggtgcgacacggcgtcggaggtgagcctgcatgagggagtggtgggttgttggggtgtgattgtgagctcatcgccgacaccggcgacacccctgagatcccaacgattccgtgcagagccagcaaggccctggggccccgccgcctcaccagtggaagcggttggctgctgtggcgacgcggcctggcacgtcagcggggttgctgaagaaagcgcgacggttcaccgtgagcgggcagcccaccgccgcggccgtggcatccagctccgcctgtgccaacggccgagaggtgggatgaaaggatgagttgaacggctggacaaagcatgcacgggcgcagtcatgaatccaaggattcgaccacctcccgcagcatttgtcgggcccactgagcaagatgcttccccacgcatgcacctgggaggggggtggcggctcgtgctggatgaccaacgttttcaccatcccgccggcgtcggccgcgccatgcgggcacacgccgtctccatcgcggaaatcgtccnnnnnnnnnncgtcgggcccactgggcaagatgcttccccacgcgtgcacctgggaggggggcggcggctcgtgctggatgaccgacgccttcaccatcccgccggcgtcggccgcgccaagcggccacacgccgtctccatcgcggaaatcgtcctcctccccctcatccgagtcgccttcgtcccagccccgggacaggtcattccagtcctccaggatggggtcctgcgaggcgtcggtcatccaggcacccgcagacgcatgctcgcccggcacgtcgccctcatcgccgccagcggcgtgagggagaactcccaagacccccgtggaaccctttgctctgccagaggacggcgcatcagatccnnnnnnnnnntcatgagggggaactcccaagacccccgtggaatcctctgctctgccagaggacggcgcatcagatccaccagcctgcagagggctcgagctttctccaggtcctgcggatacgctgccggggctctccaccagcaacaggctggcagggaccagatccagggatggcatggcatgggccgtgggccccgccgcctctgcgctgcttgactggctgtcgggcagcaccagggcaggagcggcggggcccacaggtctgcagctggcttcggttctttggggtatgagggagctcactggtgcagggggtgccatcgcctctgtcaatcctggagccgtggcgtcggaggtgtccgcatgaggatgagatggagcgacgtcagctggtgcatcatactcaggatcttggccgtccattcgtgtcatgacagctgcactctcgtcatctcctccaatcccactgctgccgcatttgcccacgacgcccctctccgtgcccgagggtctgcgcaggccgccccccatccaggctttgggagcgcctgggaaggcagagcccgccctcatcccaacagtgtactcagcgaccgcgccgtcaatttggggaatggtggggggcgcggcgcctgccnnnnnnnnnncagcgcctgggaaggcagagcccgccttcatcccaacagtgtactcggcgaccgcgccgtcaatctggggaatggtggggggcgcggcgcctgcctccccgggttctgcgtggtcgggctgccccctgccgcccgcctgcgctccaaaatctagacctgcggccctgaagaggctggacccttgtgcaggcaactggccctcgggcccatcatcaggctcaaactccccatctccggtcagggcttggctcatcaggatgtcctggacctcgcgctggctcgcgaccagccattcgcggagctgggtctcggtctgggtgcggctgtgctcctacaggatggggttgggtggcagtccttcagtagtcagtggatgtgcttcaggcgggagctgcatccccctgctcactgatcagagcagcttggaaggagcagtgcagatcaaacgcgccctctggaccaaggcattcgtcgaagagtgcatgcaacagcactgcccttgaatcgagacgnnnnnnnnnngtaagcagtgcagctcaaacgccccctctggaccaaggcattcgttgaagagtgtatgcaacagcactgcccttgaatcgagacgagcgggcctcggcaaaccggtgtgctgactcaggcaggccccaccccacccgctcacnnnnnnnnnnnnnnnnnnnnnnnnnnnnnnnnnngtcctcccgcccctgctcacagggtgaccgccctccagcccgggcgtgaactgagtgcccaggactgccccctgcgctgccagcctcaggagcatgtcctcgtcagcgtcgtcctcgtcagcgtcgcccggcgcgccgcggccgtcctcctccacgtcgctccccgaccccgccgctcccagatccccccggcgggcctgacgctcggcctggccccgggctccagctgccggcgggagccgagagaagagggccgcgagtgccccggtgtccaccagggcgacccctgcatcacccggctcgggggacgcaaggcgggcgaggaggggcgaggggcccaatccggccccgccggctccccgcagggcggaggctcgcgcggcggggctggc

SEQ ID NO: 26214 - DNA, 61 bp, Chlorella protothecoides
acctgtgggccccgccgctcctgccctggtgctgcccgacagccagtcaagcagcgcagag

SEQ ID NO: 26215 - DNA, 181 bp, Chlorella protothecoides
atgctgaatctgccaggggttcagcaggaaatcctggtcatccatgggttggccctgtacaggcagtaggttgtcctttggaaagtccctgcatgcagtggggaaaaggaacaacaggaaggagggctcaagaacggcaacaggattggggatgcaagcttccaagcctgcagtaggactc

SEQ ID NO: 26216 - DNA, 96 bp, Chlorella protothecoides
ggagttcgaggtggacgtggacgaggatgggcagctcaggaaggggaggaaggtggtgaaggcggagaagacggagtcgaagaagacagagtggtt

SEQ ID NO: 26217 - DNA, 73 bp, Chlorella protothecoides
gaagacggagtcgaagaagacagagtggttcgtccatgtgggctgggccttcttcgccctcctgttcaacttc

SEQ ID NO: 26218 - DNA, 98 bp, Chlorella protothecoides
gggtgggcttcacctgcagtggcgggggggttggggaacccataacaacggccgcgtccagcatgttccggatatgcagggcaccacgagtgccattg

SEQ ID NO: 26219 - DNA, 74 bp, Chlorella protothecoides
gtgtgtgtgtgtgtgtgtgtgtctgcgtcggggaagggattcttaggatggacaggtgtgttggccgcttcgcc

SEQ ID NO: 26220 - DNA, 61 bp, Chlorella protothecoides
tgccaagaacgccaagaacatcatcctgctaaacctgctggacgcctgcctgggctccatg

SEQ ID NO: 26221 - DNA, 79 bp, Chlorella protothecoides
caagttttcgacccgggactgccaccacgctttcccccccttccccccaatgttgtgcttgcctggagtgccgcagggt

SEQ ID NO: 26222 - DNA, 61 bp, Chlorella protothecoides
gcaacgtcatcccgacaaaatccgctcgagcgctccgacccccctgcccaaggccatccca

SEQ ID NO: 26223 - DNA, 31376 bp, Chlorella protothecoides
  modified_base (1286)..(1295): a, c, t, g, unknown or other
  modified_base (2235)..(2244): a, c, t, g, unknown or other
  modified_base (3860)..(3927): a, c, t, g, unknown or other
  modified_base (3996)..(4005): a, c, t, g, unknown or other
  modified_base (5221)..(5282): a, c, t, g, unknown or other
  modified_base (7635)..(7644): a, c, t, g, unknown or other
  modified_base (8227)..(8236): a, c, t, g, unknown or other
  modified_base (9364)..(9373): a, c, t, g, unknown or other
  modified_base (9433)..(9442): a, c, t, g, unknown or other
  modified_base (9941)..(9950): a, c, t, g, unknown or other
  modified_base (11119)..(11128): a, c, t, g, unknown or other
  modified_base (12026)..(12035): a, c, t, g, unknown or other
  modified_base (12769)..(12778): a, c, t, g, unknown or other
  modified_base (13195)..(13204): a, c, t, g, unknown or other
  modified_base (13427)..(13436): a, c, t, g, unknown or other
  modified_base (13946)..(13955): a, c, t, g, unknown or other
  modified_base (15259)..(15268): a, c, t, g, unknown or other
  modified_base (15672)..(15681): a, c, t, g, unknown or other
  modified_base (16329)..(16338): a, c, t, g, unknown or other
  modified_base (16634)..(16643): a, c, t, g, unknown or other
  modified_base (16710)..(16719): a, c, t, g, unknown or other
  modified_base (17285)..(17294): a, c, t, g, unknown or other
  modified_base (17370)..(17379): a, c, t, g, unknown or other
  modified_base (17874)..(17883): a, c, t, g, unknown or other
  modified_base (19557)..(19566): a, c, t, g, unknown or other
  modified_base (20779)..(20788): a, c, t, g, unknown or other
  modified_base (21399)..(21408): a, c, t, g, unknown or other
  modified_base (22078)..(22087): a, c, t, g, unknown or other
  modified_base (22229)..(22238): a, c, t, g, unknown or other
  modified_base (23370)..(23379): a, c, t, g, unknown or other
  modified_base (23667)..(23676): a, c, t, g, unknown or other
  modified_base (24530)..(24539): a, c, t, g, unknown or other
  modified_base (24675)..(24684): a, c, t, g, unknown or other
  modified_base (25183)..(25192): a, c, t, g, unknown or other
  modified_base (26257)..(26266): a, c, t, g, unknown or other
  modified_base (26834)..(26843): a, c, t, g, unknown or other
  modified_base (26906)..(26915): a, c, t, g, unknown or other
  modified_base (27373)..(27468): a, c, t, g, unknown or other
  modified_base (27557)..(27603): a, c, t, g, unknown or other
  modified_base (28016)..(28025): a, c, t, g, unknown or other
  modified_base (28865)..(28874): a, c, t, g, unknown or other
  modified_base (30702)..(30711): a, c, t, g, unknown or other
cgcccgtcgcgtcgccccgccagcgaggcgcgcaccgcctgcagcgccagcacgctcgccacctggcgctccgcggccgcgtcgccgcagccggccagcgcgctgggggcgccgtcgtcggggcgcaggacgatgacacacgccgcatgcgcgccacccgcgcggtccacgtacacggtggaggagggggcgccggggcgcgtggcgatgtccaagctggtgtgaggcagggccgaggccaggtccgcgtccatctccggcttgggccggtccgccaggatcaccaccgtgccggggaaggcgccgcgctcgcgtcgcgccacctccatctggcgcagcagggggaccagctggcagctccagcccaggatcagggtgtggttgcgcgcggtcacggggtagctcccctgccggatgtgatcgtacctgtgagtcgtttgttttgggggggagggaagaaggggagattgaagcaccagtaggggcaggtggcgagaatgtggcacgcacaggacaccactcgcgccgctccgcgagctcacctgaaccgaccccaatatgcctccacctcagcaaacccccctgccccccacacaccacacacctcttgttcaggtcttcggtgatcacacccaggatcaaggcaaaggtgagggtgcccatgaagaacatcaccacgttcaccgcagtggccgcgatgttgacatcattcaggaccatgggccctgcagggatggggtgtaagaaaggaggaaggggatgggggcagtggcggtgctgggtgggagagggaggggcgtcatcgggttgcgtgggccagggcgccaactgggagcagggcccgaagctgcccggggagagtggatggcggagagaaagagtgccaggagcaggcacgagcacggtggcgccctaccccaggtgcagagcaccagaccattgccgcttgggttgctgaccgagtcttttgaagcaacttcctgacgctcacacaacccgacgctcacacaaccggacgagcacaccgtacccagcctcccagccaatcactatgtttatttgcacctgggaaatggtagaggttcccaaacgcctgcaccaagctggcagccagggacttgccgctgacctgcctggtcagggtggttgcgtgcgggagtagggggggggcgttagggcttgtgccagtgggttcagatgtgccttttcttggtgcacccctccctggacccctgggtcccccacaatcccgccctcgtcccgatgagtgatggcaacagctgccnnnnnnnnnnccgtcagggcttgtgccagtgggttcagacgtgcctcttcttggtgcacccctccctggaccccctgggtccccaacaatcccgccatcgtcccgatgagtgatggcaacagctgccactcggaaccccaacccaccacacccacccaccccctcactcacttgtacagcagcgccccagcaaccaccgccggggctcccaggaggaagtagccggccaccttggcgggcagcgcccccagcatcagcctctgctgcacctggtacagcacccagctggacagcaggcgccgcacgcgcccgctccaggtgctgatccagccccagcccccgctgccagagggcctcttgttcttggcctgcgtgtgtggggggaggagcgtttgagggaccgggcacagtggggggcgggggagcctggggggcacctggtccaccactgccgcacaccataccccccccctccagccccaatcactgcagcgccggcgatgcgcaccgcttcccgccctacgtcttgggagtgagggctttctgaaaagggaagccagacggcggccggggtctgcaggcggtcgggcgcgttggagccctccagccgagcgtcgtgcagctgttcgtccagactgggctccgcctcgctgcgctcctctgacgtttgcctcgccgggtcctccttgttctccatgccgagagtggcaggcaggggtccgtgcgtcgttcggcccaggagcaggcgcctgcagtgttggggttcctggttgagctgcaaccctcgcctgctgcttaacccagctccaccggaacaggtgtatggacatcccccccgccacccaccgagcgcgatggggcttgagacgaccccattgacactgaaggatgatgctgttgccgaagtctggcacagcagaccagccggtgcggctggcgagccgcgccgnnnnnnnnnnccgaccccattgacactgaaggatgctgctgttgccgatttctggcacagcacaccagccggtgcggctggcgagccgcgccgagtgctgacgaccggtccccagtgagcccgacggcgcagggcccgagcacgccggcccgcgcgccagcatgcttggcattgctctggatgtattgctgatatgaatatggacaggtttctgggcagccagcttgtcagatcggtgcggacggtgccgtgttggtgcacggaaggtgctcgcctgccagtgagtcgctgtcgggaccaatcgatttgattccaaagtgacccttcgctggggacccaccaccagccctgagagggacctctgatactcccaacgcacgacaagcctctcatgttaatgtcgcgagcaggcatcatgggcacggcaacaggagttcacaagggccaccgcgatggtacaagcgtggggtggttgaggggaacaaaagagcatggtacatgggcaaggagcccaggagggggcttcaggcaaccacaatcacgtcggcatccagcgccgcccggcgcgcattgcgcctcgcccgccggccagtgccgctggggctggagcccatcggctgctgctggcctggggtgggggaggcgcccgaccaggaagggggggcgccgggcgacacgctcccggggtccaggcgcttgcgcgccggcaccgccacggccgcgctgggtgcgggcgcaggggaggcgccatggcacggttgccgactcgcatgcttgccctgcaaaggaaggtcatgtggctgggggttttgggggcatggcgagcggcgaggtgtgtgtgtgtggggggggagcatcccgccgagggtgcctcgatgcacactcgacccactccgcaccttgccgctgctgggagccggtcgggcttggcgccgcccgctggcgatgtacccgccctcgccgaagcggcggttgccaagtgtcacgcgcgcgcgccccgcggccgacgagaagtagaaggcctccaggtcgtcgtcgtcgtcgttgcagaggtcataggcgtcctcgtcagcccagctgcgctcgcggcgcggcgcggcgccgtcctccggcggcagcgtgtggcgctctgcccgatccttgaaccaggccgcgcgcttcagtaggcacaccgagttctgcaccgggaagtcctgcaggggggaagatgggagtgtggaggcggctatgaggggggccggggtgaggggtatgaggaggccaacaatccctagaccaggacacgatgttttgcctcaggccccatgggtgcgccacaccaacctcacagagccaggccctcacctgcaacgtcccgtccagattgcggtaggtgatgatctcggagaagggggtcttgcactgggggcagcacgcatccccctgctccctcagcgacgcccagtggatgatgcagtgtgctgcatggtgtgagcgtgcgtggtggtggtgggaagcgggcatgcattcgatcaccaacgcactgcagcgggcagatcaagaagtaggtgcgtccactctgggggaaacgacaacaagggcaaggcactcggctctccaagaaacccgtgctgaagccccttctgnnnnnnnnnnnnnnnnnnnnnnnnnnnnnnnnnnnnnnnnnnnnnnnnnnnnnnnnnnnnnnnnnnnnaaaattgtactcaggggcttgccctggatcccctcctagtgcatatagacccaaggcaaaaccatccannnnnnnnnnggggtttgagtcatcctcgtcttctaggacctgctgcttcccctgcttgtgcaggattgagaaattgtactcagaggcctgccctggatcccctcctggtgcatatagacccaaggcaaaaccatccagcccccagctcatacctacacgtcagcggccaggggttgttatccgacccacacaccttgtcatcgccagtctccggcaacgtgagaccatccatgtggtcgacaagctcctccatggcctcccaggactcccggaggatgaagctggcacgctctcagtcacaacacgctgcacaccacccaacttcccctcagcgcgctcggacttccgggttggtcgccagggtcaggctgaccgctcaaatgttgtatcaatactgggcagtaagtattcaactaaggcgactcgacgagaaaatggggtggaggaccacagaggcacggagggacccgtgacagcccggaagcttgaaagggataacgaggggagagcgaggttgtgggctgcaggaaatgttggaagatcggtggcgtaagccacagtcccccgcgttaggggggatacggacgctgtgcccctcagggagaaccgtgaagtatattccagcgaactgatcgaaactccgggagggcccggctctcccttggcgcgctttccaccatcattcagttttgcactgggctgaccagcgggttgacaggccaatctcgatctcatacgctggtgggaggcgttcctttgttccttgtgctgacaccgcctgctaacgctgcactgtgtaccccgaggaggccccacccctcatcaagccgagtttgaccaggagctccgcaaggtgcccgatggggcagtacggggcttacacgccgtcttcatgctccatatggcacttcttgggcattatggtatcccactcaagctccttacgctcaaggagagcggttcgctgtcaacctccctgtcgtgccatgtgcagggctgcaagatgagcttggcggacgtcaccgccaatcttcgcgctcccgtggagaccgcgacagacaacaagccaatcgtcaaggtgcacgctgtggagtgggccaagatcatggcgggcgagcctgtggagatcaatccctccatcgggcacggctacaaggtgatgtccgtcaaggagtgggctgccaggtggaagcccaacgaggcatatcccgagtgcctggtgtgnnnnnnnnnnnnnnnnnnnnnnnnnnnnnnnnnnnnnnnnnnnnnnnnnnnnnnnnnnnnnnacacaggtgggaggggtgttattggaggccaggtcggggcaggtggcccaaacgaggattccagatcaatgcccagttgtcggcctctttccagcaacttccttgctaacccttgcagacatggtgccggggcaagaagaaatgggagagcgagaccctgtgcctggactgccacagcttcaccaagcgctcctattgcgatccggacttcaagaccccagaggactttgagaaggagcgctggcaggtatgcgtggatggggtggctgcgacctctttgcatccgacttgcaggcatggtgcgtgccggcttggacatacaggcctccatctcagctaggccttggattgaaacatgcaggagcttgttcgggagaacacagccgtggcagcaaagtgaggtggtgacgacacagggtcgatgtcatatccctgtttggcaagcacatgagcacaagctggatggctttttagcctcattgattgtaaagcctgattggttgcttgcatgcaatccatgccttgcatgaaggccagccactgtaagaacttgggtccatggcgcactcatttcagatctttccaaacgcactatcaaggggtaagcttccactgggttagtgcgatttggccacctttcagtgtgaatggggaatgtggtggcacagatctgacgggcaggcatttgtgggcagctgctcctctgagccgtggaccgagcacgtggaaagaccctgccctccacgaccgtacgccctcgtgccccgccattgagatccgtcaaatattgtcgcggagcctcgtacgggagtcgatttctgccaggtccaaggcaggaagtcctttacacctgccggacaagaatgggagccgggtgttgcaagcttgctcctaacccagacaccaaggcgctctcgggaggcttgcgggtctctgaatttaagaagccaagatggaaatcagagcaacccatgagcatcgaacaggttcaggtaagcgcacatgccggggcggagtgggttgacagtgcagggttccctcgacttcctcgcctcagtctcggcacctcaaatctcccccgcagtccatgcgggaggagttctgggatacagagccacactacggaggagatagaggtgcgcctggtgcatcacatcgccgggactcccgggtacaaagaacgaccttcatgggccacaaccccgctctcccctgctcctccagtgatctgggatgcgctgcgagccgcggcagaggcagatctccgcacagcaaagctcatcctacagagtgccggtatcgtggtagccgcacccgatatgacaacctactatgacgagcggggtgagtgtacgggcctgctgcctcctgaggcccctgttgcattgtagatgtgctgcatgctgacctggttttatccccaaccgtaaacacatgcagggaggatgtatgtcctgcccaagtatgtgctctcccttccaacaaacatcctgcgcacaagttccgtaatgggaagccgaaaatctgccaatgcagttgaactgccgcagcttactgcctcggccctgtagaatgtggcatggcaacacatcagctgcctcctcccaaagggagccgtgacacatggctcgtgtaccgtcttcagtctgtctttccttcccactggggagtggagaccataaaattattcccccaaagagtaaatgactgagctccttgtacctacacctgatgttctccattcctcataaatcttcagtcctgatgtaaatgtaaatcaggtgctaaagttctccgaggaggagcttagacacctgcaagttggagcacagcacgcgcaccacggagacatcacgatccaggagctttcgcgtcgcatgcatgccacgagaacctcttcaaggcgagtaccaaccttgtactgcgattattgggtcgctgagggattcgaggagttttcgatccggcggtggtgttgatggtcgctcccagccgcggtctcgcaccctgcagctcgccacttgccatgcagcgctgcgcccagaggctcgcgcatcaggcctcacgattctcggcaccggtcatccgcggtagaagcctgagcagggagtcgttcctggtctccaacccctacgatggcgcgaggtccttcacgacacccacgctcgtgtgccacgcacgggcgacgaaggagaagggcagcgtgcctgtggactccgccgatgccaaggtgtgtggccgaggggctcggtgcaatgttggtcatgcgatgtgtgtcctgcatggtattactgggggggggtccgggccatgttggcaaggatggcgcccctgcctcgcctctgctccccgnnnnnnnnnngttactgggggtgggtcgggccatgttggcaagcatggcgcccctgcctcgcctctgctccccgcatgtagcagccagcaccacctccacaacacccccgcctcgtccaatgagtaacgcccctgacacacaccgaccgccgcgcgttccactaggccagcgccctggaccacgtgatgaaggagattaacagccggtttggcaagaacagcatcatgctgctaggcgacaacaaatttggggaggtgcgcaccacgccctcaggcgccctgaccctggacatcgcgctgggcgggggctaccccgtgggtcgcatcgtggagatcctgggccccgaggccagcgggaagaccaccctggccctgcacgccatggccgaggtgcagaagcgcggcggtgccgtagccctgatagacgccgagcacgccttcgaccccctcttcgccaaggtggtttgtttttcaatgggaaaggggagggggggggttcagatagggtggctcaggatggtgtaaggggctcatgagggctccacatggtagttgtcacacgccaggctccgcacctgtctcgccgcaacccnnnnnnnnnncaagggggtcagatagggtggcccaggatgttgtaagggctcatgaggggctgcacatggtggttgtcacacaccaggctccgcacctgtctcgccgcaacccctctcctctctcacaatgcacctttgcatctcctcccgcacacccttctttcccatccacccatacatcgatcacctatcccctgaaacccacccacccacccaacccccacaaaaacacccatccgcagcgtttgggcctggacattggccgcctgttcctgtgccagcccgactcgggggagatggcgctggaggtggcggactcgctcatgcgctccggcgcggtggacatggtggcggtggactcggtcgccgcgctggtgccgcgcgccgagctggagggcgagatcgggcagacccagatcgggtcgcaggcgcggctgatgagctccgcgctgcgcaagatcgcgggcaacgcctcgcgtcacgcttgcaccctgctcttcatcaaccagatccggcacaaggtgggcgtcattttcggcagccccgagaccaccagcgggggcatggcgctgaagtattatgccagcgtcaggctggaggtgcgccccaaggagaagatcatggccgacggcgagcaggccggcatcaagattaagtcagtgtgtgctcgtgtgtggggttaagggggggggggatccggagaatggagggggggcaccggcttgcgtccttgctgctcgaccaggtcggaggccctggctatgcatgcgccttgctacaccccactgacaccccaccgtcacaatcccaaccccaacaccgaatcaccacccagggcaaagtgcaccaagaacaaggtggcgccgccataccgcatcgcagagtttgacatcatgtttggcagcgggatcaacggcgcggggtgcgtgctggatgccgccgagaaggtgggcgtggtgatcaggcggggagcctactactacctgggcgaggagcggctgggacagggccgggagaagacgttggagaccctggcggagaggccagagctgctcaggtgggtgtggtttggggggggaatagaggcctggggcgctggatggagtgtgccgtggtcatagggcgcatggtcgaggnnnnnnnnnnttcacaatcccaaccccaactttgaatcgccacccagggcaaagtgcaccaagaacaagnnnnnnnnnnctgggggggaagagaggcctggggtgctggatggagggtgccgtggtcatagggcgcatggtcgaggctgtgacatctttctctgagatacgctgccgagggcagggccccccactggcttccatcccagccatcaaaccccacccactcatccactccctgcagccacctggaggaggaaacgcggcaggtgctgaccaaaggtgggcacgcagttggggacgcatttggcgaggcctccagcagcgaggaggagccggagttcctgagcgaggccgacgagggcgaggcggaggcaggaggcttggacgccgaggccgtacagccgtgagcgccgcggctgagggcgaagcccgctccccttgtatgtattacgtcatgttgtgccacccccgccaccttcttccctgtacacgagcctcgcgccaccggaatcgttgtccctgcgacccattctggctccccacaccgacgcccgtgccctctgcaccctcggcannnnnnnnnnttgagcgccgcggccgagggcgaagcccgctccccttgtatgtatcacgtcatgttgtgccacccccgccaccctcttccctgtacacgagcctcgcgccactggaatcgttgtccatccgacccattctggctccccacgccgacgcccgtgccctctgcaccctcggcatcatgtcttctcctgaccgcaccctcgctcagaatagtgatgctgtgtacatttcatcgctgcctccgtgcgcttcagaaggacagggactcgtcagctgcatgggcgatgccgtaggcatcgcccagccccagcatggtcaccagggtcttgaagcggccacgcatggcctccacgagctgatgcaggttggggtcctgcaggagggagggtgagggctcacacatgtgccaacaggtttgaaccccggaggccatggggagtcacctgggggcctgaatgagcctggacccccaccccctcacctgagcatcagaccaggggaaggaccgcacgagatcctccagtagtgccatgtgtcgtaggacccgggggttgagcttcaagcggccgccatgctccccggctgtgtgccactgactgaggcagcccgaataaaaggcaacttcatatgagatgcgaaaaccttgttcgacgcccatggcccggccctctgcatacccagctgcctttccctccctgatgcacgaatgaaagggttggggtctgtgtggaatgaaggtcgaggcagccagtgcatgtgcgaatcagctgctcaaggcttcacccaggctccacgttgaggtgagggcctgccaaccctactttcacggggcagcaacccaaactcagcctcgtgatcgcaactcactgcactccagcctctctgccgtcccgaaagtggtgctcctccaaatccagcgcggatgcaaaggggtccaattctgccactatctgtgccggcgccatggggccttcgagaccttgcacacctgcgtcttcgttgatgccgctgaacggatgaataccgagcaccaatccgtctggatgtgtcgaattctggaattaatattgggagtcgcgaaacggatgtaggtaggagaggttgaagggatcccgggagcaggttcctgcgacccaagttgattgaatgccgcacacagatgacaaggggattnnnnnnnnnnaaatattgggagtcgctgaacggatgtgggcaggagaggttgaggggatcccgggagcaggttcctgcgatccaagtcgaatgaatgccgcacacagatgacaaggggattgacaacggagcttgaacttcttcaagttctccaagacaacattcttgcggaagcgtctccattttcaggggcgggccggtatgcgacagaatttatccacgtgacctttgtagagaatcctgagccttctgggcctttagatctcagaagctgcgagcactgcaactgcattaaaaacttgactattcgagacagaatgtctattcagacgactcactttgctgcatgtcgcccatgtacgcggcctggcatttgcccatgcagccccattccccacgagcccctccatgcgggccccgcgaggcggtccagagtgggctcgtacccgctcagggcagtaaaacgccgggtagagatcctagatgagcaggcgatcgacaatttggcggcatgttgtgatgacttcgtgtgcacctccagtcccgccgtggagaacagcgtccgcacgctggcgcgcgacatacagcgagccgatggctcctggacccgccggatcctggcaccagacgtggtgtacaaggtaatggtgcaacgagacaggcaggatgctgctggaccatggctgagggtctgcatgaacaccatggaggaaaatgctgactcagcaatgcatggacgggcggtctgtgcacctggcaggctgatgcacctcagtgcgtctgcgaccggctctttttcgtgcagcgctacaggtctgccctcccgtgtgcatgcctaaagatcgtgcaattcttactgaatgggcctcctcaccttgaccctttctgcaggacaactttcgtagttnnnnnnnnnngggctgatgcagctcagtgcgtgtgcgaccggctcttcttcgtgcagcactataggtctgccctcccgtgtgcatgcccaaacatcgtgcagttcttactgcatgggcctcctcacctcgaccctttctgcaggacaactttcgtagtttcaagggcatacaaggctacgactccctagactttgtgccaaacatcgtctctccatctcgcgtgaccatacgacgcatgcgcatgctgcgccaagatctggcggtcgtggagtgggtgctggatggccgtttggggcccctgtccctgtcggtgcagggagagaccgaggcacagctcaacttgctgtcgggccgcattgtggagcagagggagtcgtggccaggggctcccctcccctggaccctggcaagggcgctctggtcagtgggtaagaagaccaaggacacggtcaggggtgggaaggcggccataaactctgccctagatcaggagggcgagagccaaaatcagtttcagggggatcccaccgaccccacgaggttcttcatggatcaggtgtgcatgggtgttggggtgggtgtgttgtgggcgagtgcccccagattgatcgtggtgggtggggtagaaggtgccacggtgtgcctgccatggctttgcaaccttcctgcatcctgctaccctctcaccgcttccacccgccccttgcagacgaaaaacagtttgtggaatgacatgatcaacnnnnnnnnnnaattgtggtgggtggggtagaaggtgccacggcgtgcctgccatggctttgcgaccttcctgcatcctgcaatcctctcatcgcttcctcccaccccttgcagacaaaaaacagtttgtggaatgacatgatcaacctcagtctgtttggcgcaataatatatctctttacccagactctgtaccacctttggaagtgagactctagacttgccgtgctgttgtgagatgtaaggggagactgctgtgcccaggcccaggtgcaggaaccagcggggtcagatgcatgagggtggacatgccacatgggacagagagagatgggggccacggttgggggagcccgtttcagcaacttcaggattgggtctgggatgcagtggtaagggctcagcctggtagatgtgcatgctgagcnnnnnnnnnnttgggtctgggatgcagtggtgaggctcagcctggtagatgtgcatgctgagcgcaaagattgtatcaccagagagcacacatctattggaacagtagggcgaatgtgttgcgaccgaggttatggcagtctggggacaggcgcaggggccccaaagcctgtaggggtgtccaaacgacacgcctccaagcaatgcgctccgccctcagcaatgcatccgacnnnnnnnnnngtatggcagtttgaggacaggcacaggggccccaaagcctgtaggggtatccaaacgacacgcctccaagcgatgcgctccgccctcagcaatgcatccgacaagtcggcacggctcacgccagcccaaactgcccggcaatggtgctgtccagggccctgcccagcaccttctgcagcaggcctaggacccagagcttgagcgccccgcccgctgccaggaaccaggcgggtggcggcttcgcgcccggcgcggtggcggcgttgatgacgccggcgatgcgcgccgcgacctgggacgcgggctgcacgcccttggagttctgagacatgcgggcgcgggcgcggatggagggggcgtgcgcgcggtagaggctccccggacgttcataccgctccccgctctggcccgcctccgcattgttggagaagctggaggtgattgcccccgcagtgacggtggtcacctggatgttaaagggccgcagctccagccgcagcgagtcggagnnnnnnnnnnggggcggtcataccgctccccgctctggcctgcctccgcgttgttggagaagctggaagtaattgcccccgcggtgacggtggtcacctggatgttgaaaggccgcagctccagccgcagcgagtcggagagggcatgcagggcagccttgctggcgcagtaggcaccggcgtagggcgtcgcgagccaggcggagacggacccgatgttcaccaccagcccgccgccgcgggcagccatggaggggaccacggcctttgcggggatgagaattggagggtgaggaagcagaattggcaggcgaggaatgtgggacacagattaagggggtgagggactgcatggtggctctgggagtacccacccgcaggccgctcagcccagccagccgacctgtgtcatgcgcaacacgcccatgacgttggtgtcgaagacggcggtcacttcggacaggggctgctcggccaggggaccgaacttgctgatgccggcattgttgacgagcacgtcgaggcgctcctcttgggacagcaccgtcgccaccgcctcctttacgctggcctcgctccccacgtccagcgccagcgtggatatgcccaggtctgccaggggctcgagggttttcaggcggcgcgcggtcgcgtacaccttgtacagcgtgcgcccatcgggtgtggtctgtgagtgcaggcacgtggccaaggcctggcccagcccgctgctgcagcccgtgacctgatggttggggatccagagtagagtttcaagggggtatcgttcagcagtcccatcggagcatcgtaccttcagtgcgacaccctccggcgatggagcctcgagcctggaggccgacgcttaccagcacaacctttgcgagcagggaatcctgcgagctcgaagcgatctccaccatgaatatgtgcaatcacgggttggatagaattctttgaggcagccaggggggataggccgcctgtgaggcgagtgtgccccggaacaggtgcacaggaagggatctcggagatctcgttgaacactttaaaggaagccaagagaaacccacgtccgtcggctgctcgctggcccgtaacaatacattgtggttcccgcgaagtttttgtatgaagctctcgcttttttaccagcaatacctttcagttcttcaggatgggcgttggtactgctcgaggctgctgtcgtgctgcttcctgtgcacgtgggtacagagcggcaacccaggttacaatgtcttccatcatcatcaattccggtccaacgtacacatgtaatatcctgtacagacnnnnnnnnnntacattgtcttccatcatcagcaattccgtttcaacgtacacatgtaatatcctgtacagacatgcaaacatctggtgggccgcatgccccacgacaggcacaagaagagaaaacgaagagagcacgacagggatcgcgattccctcgctgaactcctcatccaggctggattgggggatcacaggcgttgcaagagacttctcaagaagggagcatctcccaatggccgaggcttcgacggcaccaatcccctcctccaagtgattcgggcggagtggaggggtgatctcctgatcgacaagtctactctctgcgtcatggattcggcgtgctatgaattcttatggacattttaagagtagagctcctcgcgaaggaggctgacagacgccgaagctggtcnnnnnnnnnnccggcgtgctatggattcttatggacattttaagagtagagttcctcgggaaggaggctgacagacgccgaagctggtcgcacaccccacaactctgtccaatcccaactttaacacacgcaggctgccacccacggccatgtgaaagtggtcaagactctgctgcggtatggtgcagatgccatggcacgcgatgctcgtgggaacacccctgtacacctggcagccagggggggccacctcgaagccgtggcggccctgctggcggctgaccccccgcccgacatctttacggcaaaccttgccggcgtcacgattacggccgcaataaacgccgccatggctgcccaggaccgggccacagacgccagtcctgagaggagcggcggcaaggcggacgacggggccagcagagggtgggagggaggggatgcctggagcgaccgcctggcagctgagctgtctggcgacgaggacgatccgtgagtttgaatgtccagggggagggcggtgattccggggcgtctgtgatgcattctgcatgtattttcgaatcagggatgggagaaacttatgcttgaggatggcgcacaatgtcacaatgacccagatcctcaaatgcagctgcgacgaaatgtatcgctcacnnnnnnnnnnctgggaggaacttatgcttgaggatggcgcacgatgtcataatgacccaaatccttgaatgcagctgcgacgaaatgtatcgctcaccatcgtcacatccctcgccaggtttggggggccatggggtgtgccagccacgcccgtcgagtctgttgacgagtttgcccagcgcatctggcgggagatgcaggagcggcagagggcgcgggctgcggccacctctgccgagtttgtcagtgccaggtgaggtgactgcatgaggcctccaaggggggggggggggggggggggggctnnnnnnnnnnaacgagtttgtcagtgccaggtgaggggactgcgtgaggcatccaagaggggggggggggggttctnnnnnnnnnnttgggactcgtggtgtcaggccaggggagtagcgttctgccaaaagtatcgggcgctcagctgctcgaagcaaccctgccctttgtgagcctagggagcggcagcgagcccggcaggcggaggctgcggcggcagctgcccgccagtcgagcaggattctggaggatgagcaagcccgggacgccgcctggcgcgaggctgtggcccaggtgggtgcatgcgggggggagctagaactgctgtgattccggtaccgcttgctcaggctgtgccatactgtttggcccatgaaagggaggagtaccctggtgaatcgctcccccgccgcatggtgcacaacctccctgctcgccccactccgccactgccagccccgcattttgcctatggccaagcccatcctttctcaccaggccccctcccgccatacagggagacgccggcgcgcgcagggcgtcgtacgaggcccgctggcagcgtttcgtggccgaccccccggccagcattggcctgcgcgatgtcccctggatcctgggtgggccccaggacctggatgctgcacagcnnnnnnnnnncccccccggccagcattggcctgcgcgacgtaccctggatcctgagtgggccccaggacctggatgctgcacagcnnnnnnnnnnttgccttcccgagcacgaccgcaagggcgcagggctgacatgccacccagaccggccgtctggccattgcagtccccctccccccccggcaggccagaggctccacagatcgctgccggtagcggctcctgactgttatttgacaaccaacgtgctcccccctcccccccccaaacacactcgtcaggtgccacggatgcgggggcgcagcggcggtgcatccgtgcggagctggtacgctggcacccggacaagttccagtctcggtttgggcagcgcctggcggcggccgaggcggtgggggtgctggccggggtggtcgcgctttcccaaagcctcaacgctctggcagccggggtggccacatgagggtgcgatgcgtgtggtggccatgcggtgcatgccaacgggtggcagggagagtcgagacctgtcaggcggggtgtcaagcacgggcgtgcagagagaggggtccagagcagcgaccggcaaggnnnnnnnnnnaccacatgaggatgcgatgcatgtggtggccatgcggcgcatgccggggggtggcagggagagtcgagacctgtgaggcggggtgtcaagcacgggcgtgcagcgagaggggtccagagcagcgaccggcaaggacatggtggtgcgtcgacgggatccaggcctgggggccggcactcgacaggagatggggggtggagggcgtgtgctcggtagaatggccacacgagagcgcggtggggcatgccacgccgcatctcctcagtcgtcctcgtcctcatcgtcgctttggtgcacgaggccctcggagacgaggctcagccccgccagccgctcgccgagcgtctggccgctggctgtgaggcagcgcagacccagggccagcagcatccccgcccccggcgcttgccagttcggcagggtgtcgagggaggctgccagcatggtgcgccaggccggcgcccggtgctcccaccgcacatcctcgtaccacagatctgggtgggagagggggaggtgatctcgccctggcggacatgctggagcgcgtgggcagctgtgatcaggttggacgcgcgtgccacgagcagcgtccccgcgacagtcagtgaaggaggagaagtttggcgcctgggccaccccttgaaccgcctgcccaggcaggcactcatgactcactcatgactcactcctgcacccactcctgcacccactccgcgcacccctgaagaggacgctggcgacggggcgccccgccccccagcgcgcccccaccagccaggcggagagcagcaccagcagcacgactcgcggccagtgccagccctcccgccacgctgcccgcgctgcgctcgccagcaggccctgcaccgactgcgacaccagcgcctccagcaagcggatggggaggcctgggacctggggagtgccacgatttggggggagaatcgcttgaagggcgaatgacttggcaggacaactgagaacgcggactcgcgggatgagctcggagcgtgacctgccccgcgacttccatcccatgatgcatcctcaggtcacctggctgtcgtaggagctgggggccttgccacacagcttcctgaacccggcggggtcgaggtgcctgagccggcggtacaggcgcagcctcgccgtggtccgctccagcaccgcaggcgccagattccgggcccgcatgaaccgctggaactcgggggaggcgcgcagcgcgcgcaacgcgctgaccgtgcaaggccccccctccgattccgactccgagccactcccggcttcgcctgagttggagggaggggggggatggcgtggggcggcctggacggaccggcggacaggagacattctgggagggggccctccatgggagtcccaccctacttgcgcgccctgccagcgagcaggcggctcatttggagcgtggtaccgctcgcctgcctggctgtctatgaggttccccagcgatgttatccgaccagctccctcatgcacacgcatcccagccaaaagttatggaaaacgcacctggacccaggccgtagtagttcccagcggagggcgaggcgtgagccgcaggagaacctgccgcggatccactctgtctggggcgcaagggggatgccgccgaaggggctgggtaccgcactttccacctgtgannnnnnnnnnacatcccagccacatattatggaaagcgcacctggacccaggccgtagtagttcccagcggagggcgaggtgtgagccgcgggagatcctgccgcggatccactcggtctggggcgcaaggggggagccgccgagggggctgggtaccgcactttccacctgtgaggcgtggggttgttagtccagggtgcagacgggtgtccgcaggatgacagggagcccagtggcctctttcctcaccctggtgatgggcttggggctgatcgttgtcgagaacggtgccagagccgttttagggccatcgctaggctggcagccaggacgacgcagcacagcaccatctccatctcctcctgctgactccccaggcccgtcatgaactggcttccagctggaggtgtagatgcaccatggtccagggaatcacactccagaaggcccgtgcagacaccgtcggggtcgtccccgaaccaagccatgtgcgcggtcctatataacgagaaattgttcagccataggggcccagtcagcgtctcgacaagtcatttggtgagcattgacagcagcgcgccatgctgtgcggctgaggagacgctgtatgacatggacagcaaaagcctcgcgcccatgctacgtccggcaggcattcgaaaatatcttcccgctttctcccgagaacataaaactcggaatatgtcaatggggttgcttcccaggctgtgacaagcgaattattattttaacaggcgtcctgcctatcataccagcaagcttcaaccctcaggacctcgagcaaccccaagagccggccaagaggagctccttttcccggaccctggtacggaaggcacctcgcacggcgatttgctgcccaactggacaccgctttagggaaaggaagcttttcaaacatccaatcttcatcagtagaagtaatgatcggcgcctcgacctgcagcagcatcatcgccaggaccgggagcggtacccccagctcgttggtgaggggggttggagaagctggccggggccaagggcttgctgcttttttgacggcttatctcagtatttgctcagtaagtaaggacccatctcgtccattcggtatgcgatgagctcagacattcaaactgccatcgtccccgaccatttgtacccgggatgatccggacgatgagcaagcagccggtcgaacaggtcagaggtttctctnnnnnnnnnnatgtatccgggatgatccggacgatgagcaaacagccggtcgaacaggtcagaggtctctctcactctctcatccttcaggacctaaggcagcatgagccgagcctcaaacaattcctcgtccatcagcatgatgccaaatgggtgagtggtctgtgatgagtgtgcttgggtggacccattattgaaacacagtgcagtacattcactgcagtgccattgtcatcagcccctctctttggatttgtcaacgcacagtctggatctcaggatgcatccagggcatggaagcttggtgctgcagtgatggtactggtccttctagtgggctctggcctgctcctcatgcttccttactcggatgcaaattctgtgacaggtgggtctgagttggcatgaatgcaacaggattcctgtggaggcttggagagccagcaaacagcctgctagtcttgcacacttcttctctgtaccccagttcaccacatgcacagaagtcgcgagtctagaaattcggtttgcatgggaagtaagtcatctccaccatgaatatacaacctggattgctcatttcctacccatccctgcactttgcagctcccagcttagagnnnnnnnnnngcacttcttctccgtatcccggttcaccacgtacacagaagtcacgagtctagaaattcagtttgcatgggaagtaactcatctccaccataaacatataacctggattgctcatttcctacccctccctgcactttgcagctcccagcttagagttgcaagaggtaggggcacaaggggagctcttgctcctccctaggaaacgttctccctttggcctagggggacaggcagctgccatcgcattcaatgccctcctggagagccagctgcagggaggcaacaccccttttgcgcgggtccaggatgaagccagcggcaccgcagatggcctggacctggcagaccggcacgatccgggggcgggggtagccaggtccgagcatcgcaagatgggttcgtgagcgcctgcctctcatgggactgcagccatgaagaatcatgaggtgacctgctcgaccccattttgaagaccgctgagcaatgcgcaggctccactgtgccatagtccacaacgaacgagcttaaagtcctaattttcctgcccttaccatttgtttccccagcactaaagcatgcatgcttggctatggcactaccattgcctgaccatcctctttgacatcggcctcgcattgatatcactgcccagcataaaggccaggtgtannnnnnnnnngagtcctgttttcctgcccttaccattcattcacccagcactaaagcatgcatgcttggccatggcactaccattgcctgaccatcctccttggcatcggcctcgcattgctatcactgcccagcataaaggccaggtgtannnnnnnnnntgagcgacttttctttcaagccctgtttacaaaaatcctagccatggcatgagtgtatactcagccaggccacaaggggtaccacaggtgtgtactgaagggggtcaatgggcagaaggagaaggctgcaatctgcagggtcacgaggaaggatgtgagcaaagtctgaagagattcaatcaggggctgccccgcacagtcggctggccggacagggaggggtggtggaacttgcaggatgcgccaaacttgcaggccccaaaacgttcgtaaaaggagcagacgggcgtgcctggccgcaggggcagcccctgctcgttcctctgcacggcgtactctggcgggtggtcgaacctgcaccaccgcccaaacttgcagtggcctgcggggacgcagtggttcgcattactggcatgaaagcgggccatgcaaggtgtgggggacggacgtgggccacagggctgggggccaagagagcaagaatgccaggcaacatgggaccacctcaagcccctgcagacacccaattactccttccagcttccctatcaggcggtcgtaccctccccctgccttgcgacccatcttctctccatgccccatgcctcgcacccaccggtcttcgtgtagaactcgcagatggcgtggccggggcggcgtgggagttcgccctcgacatccgctggcggcgcagcaccaccctgcccgccccgtgcccacccggcccctgcctccgcccggagcccaggatcaaaggggggccgatccggtgacaggaggacgggcagggtccgtcgcaggtcggcgggcgggcccagcttctccaccagctccgcgctgtcgggcgtgaggtacttggcaaacaccggctcgtccgagcagtgccgaaccgcaaagtagtagcacgccaggagcagcgaggggaacctgtgtagggacggggcgctgatacatctgtgggtacgtactggatcaagagtgagcgcccagctccgatgtggctgcagcaggatgagctggtgccacgatgccaaccatctcaaattcgtgtagccccaccttcttccgttccctttcatctgacatcctcaacccctccggcacaatccaacccctctcctcctcacacctnnnnnnnnnngatttgtgtagccccacctccttccgttcctcttcctctgacatcctcaacccctctaccacaatccaacccctctcctcctcacacctctcctcaaagtaggccaggaacccatgcggcagcgggcccagccgctcctgcaggtccagcggcagttcacggaagtgggagtgcttgttgcggatgacgcggagcaggtcccgcaggctggcgtagttgtaccgcctgtacttccctgcacatgacgcagagggatgcatggcaaaggaggcatgcctgcacacatgnnnnnnnnnngcctgcacatgacgtggagggatacatggcaaaggaggcatgcctgcacacatgcagaggctatctcagtcaaccccggtgtgtggccctttggagggtccgaggggggctcaaactggcagaccgagaccatcagggatcgatgctgctataaacacccttgcggacgcccctcccaaccccttcaagcctcacccaggttgttcacaaggcgcgaatcgagcgcgggggcccagctgccagaggggatggccagcagacccagcccctccagcgcctcatacatcgacccatcctcctgcgggtagggggggccaaggcgtcggtcactttaccctggagcaccacccatccagatgccaacaagcagcacgacccccaacctcaggccagggaaacacactctcactgggctcgccggccccatccgctgataacagtcacaactcaccacacggtcctcgccctccacgcggtcgctgacgtcgatgaggaaagcgaggcgctgtgccgagggccaccagagggggtgcgtcagcacggctgctgcgctgggccggcggcggggatcttgcgccagcatgcccctcaccaggtccgccgctatggcctgtgattccagcctgcccatgcgcagcttgccctgcaggtagtggcggggatgggagggtgagcaggcggcaaggagtttcagcaggagggagctctgtccgcaacagaaagaagggtgagatgagaaggtttgtcgtacgtgccaaccccccacagcaatctgttgccgccaacctgcccccccgccatgcacctcctctcaaagattccgacccacgtggaagatgttggcgtccctctcnnnnnnnnnntcgccatgcaccccctctcaaagattccaacccacgtggaagatgttggcgtccctctccacgcccgagccaaaggggtgctggccctgggtcaggcagtagaacaccaccaggcccagggagaagacgtccaccnnnnnnnnnncgccctgggtcaggcagtagaataccaccaggcccagggagaagacgtccaccgccagcgtctgcctcgccgactgcccgtctcgggcagccagctgctccggggcctgccaccccgagctgccacctgtgttggtgtgggcattgctgatcatgatcgagcgaaagagtgggcgggtgcttgcgagtgcgagctcctggggggggcgagcggctggcagggcatgtgtggagcatgtctggaggagcagggcaggctgcttgatgtccctgcatggatgcagagcgcgcccatccaccacccgcttgatgcagagcaaggcctggatcgtggtggcaaggacctcaaccccgtaaaccaggcgactctcaaagcgcgggagtcagaagacaccaggggcgatttgcagcagtgctctctccgcaccggtcccatccaagcatgctggcccaagccatgcaccctcccccccctcctcctctcatcccacctgagcccnnnnnnnnnntgatctgcagcagtaccctctccgcaccggtcccatccaaacatgctggcccaagccacgcattctcctccccctcctcctctcatcccacctgagcccagcgtctcgaagctgatctggtcggggacgaggcggcggctgagccccatgtccgacagcttggcgcagccggcggcggtgagcaggatgttgtgcggcttgaggtcgcgatgcacgatgccgcgcgcgtgcagcgctgccacgccgcggcatgcgtcggccgcgacgcgcagcgccagcgcggacggcgtccccgtcgcagcgtcccagaagtcggcggcggcaaggcgccgagggcgtcggtggtgcgaggcgggggagggcagggcgccgtccgtaccttccacactctcggtcgcctccgcctgccaccccgccttccgtccctcctcctccccacacgtcccgccccccgccaggacgtcgttgaggctgccggcgcacctctccagcgccaggtagcagaactgggcgtcctcctccatggcgatgtagcgcacgacgttcacgtgctcgtccgacaggatcagggtccggatctcgctggcggccaggtcgtagaactggcgcagcaggcgcttgacggccacgggacggccgtccagcgacccctcgaacaccacagtgccgccggaccccaggcccaggataccggggcccaccagcatgcgccccacggccagcgcgccgcgggacgcagaggggctggggcccgggagggtgcgcgctgggaggggggtggggcccgccggcatggggggtggatcagaggacgcagggtcggagtccgagggtgcggggctgcgctcgggttctgcagggatcccctcgcacggcgcagctgcctgcaagctccctggggaggcggtgggcgtgcatccctcgccactgcccgccaggccgttggagtctgccaggattgcccctggcggggacccgccgtcctttccttcccggccgtcggcaggggacgctacgttggcgacaacggacgcagacttcccacgctcaggcgaggcgggtgcnnnnnnnnnngttgcccctggcgggggcacgccgtcctttgcttcacggccgtcggcagggggcgctacgttggcgacaacgaacgtagacttcccacgctcaggcgaggcgggtgctgcctcgctgcgcacgccattcgctgggccctcctgcgtcgtgcccgcatcgacgctcgaagctgcgatcaggcgggactgctgcgacctcttcttctgggcgctccccggcttcctcctcgggcgtggtgcggggctgcctgcgccggcttgcacctgcgcctgtacaatcgaggttggggagctcatgcagggctggtgagggacccgcggggaatgcaacagcacggaaggatcccagtgcagcagggggaagtcctcctccttcttcgactattgtcaactgcctgtccacgccccgacctccaggacctcatgtcatgcatcccagcttggacatcatcatcgtcagacaacccccccccccaaaaagtaaccccatgctcctccacactccctccccaccgtctgcactgctgcgggcccgcccgccaccctccccttcctccaccagccacccnnnnnnnnnntcggcctgcaggatctcatgtcatgcgtcccagcttggacctcatcatcatcagaaccccccnnnnnnnnnncctccacactccccccccaccgtctgcactgctgcgggcccgcctgccaccctccccttcctccaccagccacccgccgcggccgctgcaatcaggacgcatgcggttgccaggagcggcgctcccatcgcctgctgcctcccgtcccgactgcccgcgccgggggcctctccagccgcgcccggcagcgcaggcaaggacccccgcccggcctcgacccccggcgcgagggggaaggagccgagggtgagcggggggcaggccgcgcccgcctccacgctgcacgcctcctcgcgctcggcccccgtccagcgctccagcgcccgctgcgccgggccgcccagcgcctcgtcggcgcgcgccggcccgcgtggggccacggtcttggatcccgggtccccgccgtcgccgatgaccgccaggcggccccggggcatggcgtagatgcccgcgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggctgccctccagccgccgctcctcgctcccgctccacagccccgcgcccagcctcgacaggagactcggcgacggcgccggccnnnnnnnnnnnnnnnnnnnnnnnnnnnnnnnnnnnnnnnnnnnnnnncgggcgcgcgcagcagctcgcgcccgcccgcgccgcggaccacggagacgggcggggagtcgaagtgcgcggcccagtgctgtgcgccgtctgccgcggagtagcgtcgcagcgagtggtcggtgcccacggccaggtggagcccggggtcggcggggccggtgcccggacccggggtcacgcagcccccgcccagagaccccatggcctccagtcgcgaccacgacacgttccactgctcacccacctgggggaatggttgatggggggaagggtggacggggtgtgatgtcggggtgtggatgtgcatggggtggtggcgcgaggaactcgccgccgagccctgaatctcgtgccagcaacattccgcgcagcagctcttgcagcgagcacgccccggaccacccttggcnnnnnnnnnnaaactcgccgccgagccctgaacctcatgccagcaacattccgcgcagcagctctcgcagcgagcacgccccggaccacccttggcactcactcccccccaaccccatgcaccgctgtccagccagaatgcacgcaccaaggggtctacggaacggagcacgtagtccttcctgcccaccaggacggtgcggcgcgggacgggggcggtgttgtcggtgatggtcacacgccccttgatggggcccggccccgaggtccggcgcggggggggggtcctgggtggcgtgtcggcgtcggcgtcgaggccgtccctcgtcgcccgctccccagccgccccatcgcctccctgatcgtcgccgtcctgtcgggcggggaggcgcagcaagccctccaccccgccgcgctcgcggggcaggagcctgcccgggtcaccctcgaagtcgtagacggtgcgcagcagctgccccgtgtccccgtccaggacataaacggtggtgtgctgggagcccagcaccaggctgccgtccgcggcgggggagggcgccaggcccaccaggtccgccaccttcaccggcagccgctccacgcgcacgggggaggggccggggccctctcgcgccacgtacaggctgccgtcggtgccggggaagacgatgtcctgggggccgggggggcgcgaccccggggcgggggccgcgtcccacgaggcggccgaggagacgaggggcgcgccggagtcaaaggaccagacctcctcgccggtgcccgggtccagggccaccaggcggccgttggcaaggctcaccaacagatggttgggagcggggctgggggtgggnnnnnnnnnnaccgttggcaaggctcaccagcagatggttgggagcggggctgggggtggagggagatcaggcatggggtgttacttgggggggttcaacctaccagatgtccaaggacaaccacaatggcgccctgcagtacaggcctgcagggtccgccctgcgcgaatgccaaaggcattgcagcagggcaggcactctgatggatcagatgcgagaatgggccacctgggtgcctgtccctcacggccatgttcccccaccttgctccgggggcaggggcctcggcagcagcagcggggtccaggacggagacgctgtcggaggccaaggatgggtttacaatcaagatcagggccaggaggatggtaagccatctcccaccgcgccccgaagccatccgcccggggtgccggagctagggagcaggcggggccttcgagaggcgagtgcacccacgccaaaaaggcagggactctgcaatcgcggacgcactcgttgtcatagaagctgcttgaagacaacttttattataatgtatgctggaagctaccccttgcgccctgggcctggcctggcgagtacttttccggcctgctctcggatgctggatcgcttttgaaccacggagggtccttgaacgaccgagacctcagctccaacaggcctctacttctgattttaatttcgtagcgtacgtatgctgtgtttaaatcaagcatgctgtgtgcggtgaagcgactgcgggcccccacggcctagacatccctaccccgccatgctgggggagcgagagggtgagaggccctcccaatccaccgacttccccgacacggaacagggcgagtgtctgcggctgctcgacgtcagcctgcgatgcagcatctgctacggcatctacgacacccccctcatgctgcgtggctgcgggcacacctgtgagtcctggtcctggtagggtctgtgatcaaggctctgcagtgcacagggcaagtgcgtgctgtggcattccgacgacctcttacactcgctcccactcacaccatgctgcagtctgtgcctcctgcatccgcggcagcctggactttcaggagaaggccggtcagccggcctgcccaggctgccgccacccctgcgatgcgcgagacctactgccctgccactcgctgcgtgaggcggccgacaggtaccgcagggccaggggcgcgatcctggacctgctgcgaccggttcctccacctcgagcgtcctccgccgagctggagggggcgccagccccgccgccggcggcagcgccagggccccctcctcctgccccgcaacgcatgcgaacccggtcctccagcaagtcctcagaggcagaggcggggccaggctcccgggggtccgatggcacagcctccccctctgcgagctcgagctcatcgggcagcgagtgggatgtcgaccctgctgcagtaagtgaggcggacagcagcccggccaagggggggcggagcggcgggcaggtgccctgcaagcgtcagcgcacaggggctgggggtgggtccgacgaagttaggtgcgtcactgggagtgacccagaacacagtagaaatcctggacttggaggaccctccccgcccgagtcagacccgcccaaggtgagggggcggggtaggcatgggagtggagcacggcaaggagcaggtgtcctctttgtcggtcaccgcttggaggagcgcgagtcgtgatcagaccctggcccgtcagcaacccaccgaggctcgccgccccgcccaccgagtactcttaattccccccgctgcctcaccctgacactcctcgaatcacatgnnnnnnnnnnacttggaggagcgcgggtcgtgatcagaccctggcccgtcggcaacccaccgagcctcggtgccccgcgctctgagtacgcttttcccccaccgccgcctcaccctgacactcctcgaatcacatgcacagggttttgtggcgtgccccatctgcgcccgccgcgtccccgccttttacataaactcccacgtggatgcctgtctggcgcggggcgccgggcccggggatggacccggcggaggtggcgcaggtgatggaacaagactcccagcctggaaggggcgcagctccagcgccgcgccgcagcaagaccccctgggaccccagggcgggagggatgcaccggcagcgccaagcaccgccgccacggggcccttgcccctgcccccgaagctcgtccccggcctggtgtccgacaaagcgctgcgcgcgatgctgaagcgcgtgggcctgcccctggacgggcgccgggccgacctggtggcgcggtacgggcgcctgcgacgcgaggtggaggtgtccaacgaccggggagaaagggcgacctacgcccggctggcgcgccgtgtggtcgccgccgagcgccaggtggcggcggcgacgctgctgcaggggggcggcggcgagggcggcggcggggccgcgccgcgcgtgctcgctccc

SEQ ID NO: 26224 - DNA, 61 bp, Chlorella protothecoides
gctcatcacacgggccttccgttggaggtgcttcgaattcgaacctgggttgcggggtggg

SEQ ID NO: 26225 - DNA, 103 bp, Chlorella protothecoides
tggcgcgtctggacgacggctgcatggcatttgaggattcgagtcgatggcgtgtgttgagcagcccagtgtacctatcctctttgcagtctatagcctgggg

SEQ ID NO: 26226 - DNA, 61 bp, Chlorella protothecoides
ggcagcggggagccctgccgttggccccacaccagccgcagcaggcctacgctgcccgtgg

SEQ ID NO: 26227 - DNA, 66 bp, Chlorella protothecoides
ccatcatgcgcagggagctacaacaagggaaaccttaactggggtctcaacaacaagggcacaaac

SEQ ID NO: 26228 - DNA, 89 bp, Chlorella protothecoides
tttgatgctgggtgcagtgcagtgcgtttcaaaatgacatgcaagtggctgtgtgggggcttgctcaggctggctggggcccaatagag

SEQ ID NO: 26229 - DNA, 61 bp, Chlorella protothecoides
caacctacggcggctcatcactagtgggtgtacaccatgtcggagccgatcctggatgtgg

SEQ ID NO: 26230 - DNA, 80 bp, Chlorella protothecoides
gaggaggtttggggtgacatgcagattcagcctcccattgctgcatgcaggcgccagagacccatctcaggccccccctc

SEQ ID NO: 26231 - DNA, 61 bp, Chlorella protothecoides
acgccattctatcctggctgcagccgacatccgtttccagctggagtcgcacctgaagagg

SEQ ID NO: 26232 - DNA, 105 bp, Chlorella protothecoides
gcgtgcgcagctttgagcatcgccagtgtaaagcttttgagaggccctccggctcgttttgttccatggatcaaatgctgtgctttagagtgcgaggttgatccc

SEQ ID NO: 26233 - DNA, 75 bp, Chlorella protothecoides
aggttctttctacaaagacatttacgtccaggcaattgaatgtgatccactgctccttcccatcccgaatgtatg

SEQ ID NO: 26234 - DNA, 459 bp, Chlorella protothecoides
  modified_base (152)..(362): a, c, t, g, unknown or other
ctgtgaggaggatcgaccagatgttactacctggcacccaccatcaggcagaagcagcaggtccacataccttgatccaatatgtccctcaagagataacccctcatagaattgagaattatacttgccccgccctcaatgtcccttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaggtgggaagggcctcaggggttggcaaggggggccccattcatgcgagatgagagggatgatggttggggaaggtcagtagaagcacagctt

SEQ ID NO: 26235 - DNA, 61 bp, Chlorella protothecoides
ggcactggctctggagtactcttcatgcaccgaggcctcctgccatgagcattttggatgg

SEQ ID NO: 26236 - DNA, 61 bp, Chlorella protothecoides
agatgcgggagaaggtttgtcttggcggggggggccttgcgtgctcagccctcgttggctc

SEQ ID NO: 26237 - DNA, 75 bp, Chlorella protothecoides
atgggcctgagcagaggcttatgccaaaaagttctgtgcgattgaacatagaagtcgacaggcttcacccacacc

SEQ ID NO: 26238 - DNA, 106 bp, Chlorella protothecoides
ctgagaccaaagatcgcaaggagaggatcacaaacatgaaggaagcgggtggcttggtcggacctgtgggaactcgatgtcggggttgatttcgaaaatgcccgcg

SEQ ID NO: 26239 - DNA, 85 bp, Chlorella protothecoides
ctcaagcactctcaaggtaccttgaccccaacagcacgacatcctgcctgtcacacaacttcaaccctgtcatcccccctccccc

SEQ ID NO: 26240 - DNA, 76 bp, Chlorella protothecoides
ggcagagagacgcaggacaggactgatgcacgacttctggaccccaagatacagagagtgatcaggacaggctcga

SEQ ID NO: 26241 - DNA, 103 bp, Chlorella protothecoides
catggatcccatgccccttctgccctggtatggtgtcaaggggtccaggccaggcccccgccataacccgctgcccaatccccactgccacgcaggagacggg

SEQ ID NO: 26242 - DNA, 81 bp, Chlorella protothecoides
gtcccacacagtacaaactgatcaggtccaacgactattgctgcatggtctacacccacctatagaaagttgcaagcaggt

SEQ ID NO: 26243 - DNA, 124 bp, Chlorella protothecoides
ggcgaccatcgcaggtttgatgcgggatttcggggagaatcgagggggacgcaaatggcagggtgcatatcgggctcgcgttaccacagagtgacgtccgtacacccgcagaaacaggtctgtc

SEQ ID NO: 26244 - DNA, 117 bp, Chlorella protothecoides
agcaacgccatcctgctctgctactatgccacgcccatgagcacgctgtaccacgtgctgtgtgagcgccgcgccgacagcctgtcactgcccctctgcgccatgaatgcgctcaac

SEQ ID NO: 26245 - DNA, 79 bp, Chlorella protothecoides
ggaccgcgagggatccaccccgacgcatcgagagtctcgggacaagtgcgagtgatgcagcgacctggcagcctcccag

SEQ ID NO: 26246 - DNA, 61 bp, Chlorella protothecoides
aagctcatggagattgccgccagtggtatctggaactgagaaatccacccctgcagctcag

SEQ ID NO: 26247 - DNA, 78 bp, Chlorella protothecoides
agggtgtgccattctcccccatcaccagcatttaacccccctccctttcccccgcttccctcaccaaccaccaggcat

SEQ ID NO: 26248 - DNA, 6438 bp, Chlorella protothecoides
  modified_base (939)..(948): a, c, t, g, unknown or other
  modified_base (1741)..(1750): a, c, t, g, unknown or other
  modified_base (1853)..(1862): a, c, t, g, unknown or other
  modified_base (2236)..(2372): a, c, t, g, unknown or other
  modified_base (4615)..(4624): a, c, t, g, unknown or other
  modified_base (5038)..(5047): a, c, t, g, unknown or other
aaggaaaagggggaagtgagaggggggaggggggcgacaaggaagggggaagtgagaggggcaggggtcatgtgtggactgggaggagtgcacagggccctgcaaccatgtcgtcaccccggcctaagacaaccctctttcgtgaaactcccctccgtggacacacatgtagacgtggcccctccggaactggtactccgtctccgagctcaggttggtgtcggggcagaaggggtagacccagcgcgccagcacgtccctggaaactgcgtcgtagctgcgcaggttgtgcacgcgcgcggcatactcctggcggggtgagggaggggaatggggtgcttggcgggaagtttggcacggtgttgtgagggggaagagatctgggtatcactggctggccggggcaaccactcaaatgcgtgcaatctcagagcgcgggagccggcatgccaggagggcagtcccggggctccatcagcaacaggcccagcgcacgtcgcggagctcgtggacaaagagcttgttgcccagctcctcctcggacaggaccccggagacaaagtcttttcggacgttctggtgaaggaggggggatggggaggggaggggtggcagggcacgaagccggaatgctcctgctggggtgcctcctgtgtgtctctatcagatttcagcctgcacgcactgctggggtgcagcacacccttgcatgtactgcatcaaaccccagacccctggtagcaccccccaccccccttcacaacccagtccacctggtagtcaaaattgtcggaaaagagcatgagcacctcgggggcgcagatgtagatggaggcctccaccatgtcactccgcacctgtgaggagcggggccgccgagttcccttgggggcacacatccgcaattcaccgacccagccttcctggaggtggcgggtnnnnnnnnnncgaggagcgggccgcggagttcccttgggggcacacatccgcaattgaccgacccagccttcctggaggtggcgggtggtgcgcatcttcgagcccccaatgaacctcgcccgacaggcacctccccccacacacgcggccgccagtcgcctgccagcaccccaccccggcgctcacctgcacagagtcccgctccgagaagagggtggtgtccagcacgaagcggcgcctccgtcgccggcgggccacatccacctccgcgccgccgccgccctcctccctctcctcgaacttgaagagacggccggaggtggggtccatcaccaccgtcgtcggcatgtcgcccagccggcggatgtgcgcgggcgacagcccgccccgcatgacctgggatttgccgggggagggtggggggagggaatgtggggttggtcaagctacgaggatggcagtggggggacattgcactcacagcagcgcaggcagccccgctcaccgcccctcccctcaccccaccatggtcatgatggaggccttgtcggagctgcggcgctccaggtgcgctgccagtgctgggcgcaggttcatgttggacacgacgtcgcctatttgggggggaaagtgggggggggtgatgggacttacagcgtgcagagtgcggcgtgtggagagcagtggggattgacaggtcctgcggtgtgccagtcccatcccaggcgatgcaccttgggcccgggagacacggtgcaagatgcgcaacctcctacccacccctcaccaggccctccaaccnnnnnnnnnngagggaggggaagggtggcaccagctgtgacagcgaggaaggtcttggtttccatgggacgcggcatgccctgggattgcctggtgattgggtggcaagaggnnnnnnnnnngggcgtgtggggggcagtggggattgacaggtcctgtggtgtgccagtcccatcccaggcgatgcactttgggcccgggaaacacggtgcaggatgcgcaactccctacccacccctcaccaggccctccaaccgccagaacccacctgcgacgaggatgaagtccgacttgaccacgtcccggttgtccatgacgcgcagcgcctcgcccaccgacaggcagttggtggagaccacgacgtgcaccctgaacttgcgagaggccagccagccccgggccttcaggtgctcctgcacagcatccgcgtgcgcacagacaaagatgtgcacctgcacgagcgcgtgtgtaggtatgtgtcgtgatgagggatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccctgcacatgccataactgtcctgctgcattgtgatccaggtaaagaggcaggggaaagtgacgcagagcctgccacactttctgcacaacaccaaccacctacctcctcaacatcgttgatggccagccactccagagtgtagtccagcatgggggtgttcaccaacgggaggagcaccttggggcgctgcagggtgacggggcgcagcttctgcgagcgcagcggggtggggtggcagaggaggtgggtgcatgtttggggagtgaccgaccagcctgccagtccaggagcagggtctcacagaccatccctagccctagaagtgaaagcactgacctgtgtgaagctgtcagccagaacgatggccgacagggcctccttggtctccagcccaatcccgcccttgcgagaggggggggccattctgagtgcaccgcctcgcggaagtgggggcgtccaccgggtcaggggcgtggtgccgggccagccgggttgaaagattgatacttaatatcgaaggtagctgatcattgggcatcggtctcaagcacacgagatgtcatgagcattggtccggcgggagtgacatggaggagggcgagcgcgcgatcgcccagcagtgggttttgaacctgggagtgccacaagaggtgctggtaccactccagtcccctcttgtttcctgtctagctcaccgcttcccaatcatcacgatcgattagtcccgaagcacttcccatgacgacaccggaggtgaccgacgccgagatccctaaggcgctactgaagcgtctcatcaaggccaaactttccacagtcgctggggcagatccaaccagggactaccaaattcacaaggatgcactgctggcctttcaagaagcagccaagattttcatccactacctgacggccccagccaatgacgtgtgccgggatgcacggcgacagacgattagcgccgaggatgtgctaactgccctcaatgacctcgactttggggaggtcacaggcgagctgacggaagctctggaaggtgagacattgcgtttccaaggattgggccctggtggggtgcaccgcagcatatcgcatgacatgtgatcctgcgaatagccgccagcgacctgaggggcttgaggcaccagtcacaaagcaaatctgtgcactgcagagcgaacagaaggacctgagtgtattgcagaaggctgtatgacgaccttcctgcctcgcacacagatttccgcactgaggcgagggagaagtcaaagaagaaggctgaggggaagaagcggaaggccgaaggtgaggaaccgttctgtgttcatctggatttgagactctttggggcccaggggaaggttgaaaggtcctgcattggcagatcggctgtgctaaggtaaggcagactcacacccctcctgttccttcctgccatctgcttcagagacggccgatgctggggagggggagcaggccggggcgagcatgcctgccggtactcgagacacagatggggctgagcaggcagatactgtgcacgcccagccacccagccagaacccagaggggttgcaggttgcccaggcatgggttgcccaggcagggtttggggaggcagggccgaaccctgaagccccagcaccgcccgtaacggccggcgattccctcccgacatccattgcccctcctgctgttaacccttccgcttgataaggcgtggggtcggtgtgcattaagtggagtaagcagcggtgtaggaagcaaaatagagccagggagccagcacaaaggagatggggtgggcagaaacttccacagcaggggcagcgcagcagctcctactcgccaatggcttcaagggcctcaatcgtggcaatgctgtttccccggattacgaccatgccaatgtcaaccttcagcttctcgtccacagtgttgtccagcacaaggttcatgaattggtcgaacccccgcagcactcccgtcacgtgccggttagcgttcagatgaactgcgggatgaggagtgggcggaagaaaagcatggagcattgtcaggtcaacagttgcagtgagctggcctactgagtgatggtttcccaactcactgctcagcttcttctccatgaagccctttagctccgggggttggattttcacctgcagcattggggaaaattgtcatgcgatgagtaccactgatgagcgcgcaggacagggcaaaacaggtgtagcnnnnnnnnnnaattttcacctgcagcatttgggggaaattgtcatgcgatgagtaccactgatgtgcgcgcaggacagggcaaaacaggtgtagcacttaccatctcgctgtgtctgtcttgggaggcgcgatgagggttatgctgcgcagcccaggtaccaccaatgcttctattcaaagacaccagtacaagcttccggcatttaggtgggctgtgtggccttcagattgagactggctcaggctcagtgtgtcgagcccggcctcccctttcttttgggcattcgggagcggcatggatccacggaatatatgcgacaaagatgccgtgcctgcgagtactgcagtctgaatgaggtccaactccgaatttacggcctcggactccgacccactgattcgcagagaggtaattccccgcannnnnnnnnntcttcgaatttacggcctcggattccgacgcactgattcgcagagaggtaattccccgcaaagaacacaagccttggagcataccgaccctcctctctccgtaccccgagagtgggaggcaccagtcaccagctggagctgctgagcacccctgggaccccatgtccctcggcaccctgattggcccgtgcctgcctgccgagtgacagcctcgatacctgcttccacccaggtacacccccgcacccaacctggtaccggaagggataacctgaagggaccctcctgcccaggtctgacccactccccagcctcccaaacctgcagctacatttctttcatccgggggtatgaagtttgcggctgccttgcggaacagcgcggaagagctgcccgatgccgcggagcttttcaccctatataagcacctgaagaagtccctgaagcgcatcccctgcggcgatgccggccatgacgactccagcctggtggcggaccccgcctccgagttcggggaggccgcgagcggggacgaggatgaggcagacaccgccctggagctgccctccctggacgcctccgcagccaccctggccgacagcgcccaggatgcggccgctgctctggacgagggcgagcgagcctttgttgcggagctgacgcgggacgtggagcagctgaacgagcagtacatggagaaggaggaggtgaatgtcatccgctttggcacgctgaaggaccaggtggggcggcggggtcgcggggtcaggagcggggtgagaacggggagaagcagagggggagagtgatgcgggttgcacctctggattgagagtcgggatggtgatgaccggtaattgcaggcctggcagccaggcacgccttcagctcccaggcagccccaggtgttggtgcagcaagccctgcccgcattgcatggttccagggtacacccaggagggctcagcgggcgcattatttgtgtaatctcacttgcaatcgcgtgaggttgcatgtcatgtagagatgcactgccacccaaccctgaccatcccaaacccaaccaacctcaggctgcggcggccaggtctcgccaggagctgcagcgagcctaccgcgctgtggtcgacttccacggcgagctcctcctggtcctgcactggagcatcctggcatacactggccttgtcaaggtgggcggccatggccggtgcaggggcgacaccgtgggctattgcgctgccgcgcaagtctggccgggcaggtggcggtgtgtgggtcggccacgtgcttcctcttgggcaccgcccactgacgctcgaggccccaccttgccaatcggggtcaagcttcacgtaccctgtccgtgacgccccccccacttccccccc

SEQ ID NO: 26249 - DNA, 61 bp, Chlorella protothecoides
ggcgagtgggctctggcagtgtacaaccccttgcgtggcttccaggtcaggctcagggccc

SEQ ID NO: 26250 - DNA, 79 bp, Chlorella protothecoides
ttcagcgacctggcaaatagggcggggggggtaaaagactgtatgcacaagactttcacattgacaatccggcctgcca

SEQ ID NO: 26251 - DNA, 61 bp, Chlorella protothecoides
ccacgccgggcaccagaaccagcaccagcatcagcaccagcatcagcaccaccccggccag

SEQ ID NO: 26252 - DNA, 61 bp, Chlorella protothecoides
gagtgtaaaagagtctgcattgtgcatcgggttgttgttgggcctgcacgtgcccacgtga

SEQ ID NO: 26253 - DNA, 75 bp, Chlorella protothecoides
acgcagcatcacgcaggggcgcacctgcaccgccctatagtagacatcctctgtccgctgggtcacgcttcgcca

SEQ ID NO: 26254 - DNA, 97 bp, Chlorella protothecoides
ggcctgcacatgtgttggttgccagagggagtgacaaggggtgaaaggtaaggatgtacaaggcacgcaccatggcaggcgattgcagccatatttc

SEQ ID NO: 26255 - DNA, 61 bp, Chlorella protothecoides
catcctgtgcgtggttgggaacgcgcggtttcggggcctcatcgcgccgcacctgccccag

SEQ ID NO: 26256 - DNA, 61 bp, Chlorella protothecoides
agcctccaattctgtcttgcagctcaacgatccagccgttgccatatcccatttcttaggc

SEQ ID NO: 26257 - DNA, 1284 bp, Chlorella protothecoides
  modified_base (275)..(318): a, c, t, g, unknown or other
gggcccgcggcggggccgctgctgcacagcgcgcgtcgctaccatgaccccaagaagggcgtgctggggtgcaggcactaccgccgcgccgcgcagctggtggcgccctgctgcgaccgcgcctacgtctgccgcttctgccacgacgaggccacggaccacgtcctggatcggtatgcggtgtgcgaaatggtgtgcatggagtgcagcctgcgccagcctgtggcaggtgcggtgcggtgtgggtgtgtgtgtgtgttggggggggggggggnnnnnnnnnnnnnnnnnnnnnnnnnnnnnnnnnnnnnnnnnnnnagtcttgctttggggttccaggcgcggggagagggggcgacggcagagtggggcgtcgtggaagcatgagaaatgtgtgacccctgctctgggggagtatgtgccgtgaggcgggacgctgcaccctgtctgggaccgatgcccctgccccactgcctgcccagtaccatggacacatctgtgggccaccgcccccaagtcgccctttctcgaagcgttcaccctgccctttctacacactcaggctcgtgctcggggtgcggcacctgcatgtcacgctactactgcaaggtgtgccacctgtttgacgacgacccgggcaaggccatctaccactgccccttttgcaacttctgccgccaggtgcgtgggtctggggccgtctgtggcttgaagtggattcagggggccatggaggaggggggttgcatgggctcctgtttacggtccaccacgcctgcgggggcaacctctttacatcctggggcggatctcaaccatccgtctttgctcgtcagatgcagcccaaactgcccccgtttgagaatggacccccgccccctctctccctgtcttccacccgcagggcaagggcccgggcatcgactccttccactgcatgtcctgcaacgcgtgcatgagcctggagctgttcaacaagcacgtgtgcaaggagcagagcctgaagcgggattgcccagtatgctccgacatgctgttcgaatccaagcaccccgtcaaggtgggtttgcttggttgttgttgggagtgtgtgctagttgagtgcaagtcaggacatcaggacaggcaaacactgacgatgcccctgtgctggacctgcgctgattgctttactcctgacgagccccagtgaagggggaaactacggcgctgtaagtcgtggcctgcagccctgcaccgggccccctcgacccaccccggctcacctaccccatcccccccccc

SEQ ID NO: 26258 - DNA, 61 bp, Chlorella protothecoides
agagcttgctcagtctggcagggcgtagggtgggagccggaagagggggaggggaacgtgt

SEQ ID NO: 26259 - DNA, 80 bp, Chlorella protothecoides
aggaggaaggtgcgaggaaggtgccatgaggctggccattgctcgccccggttcctgccggtcagtctccccatggtcca

SEQ ID NO: 26260 - DNA, 69 bp, Chlorella protothecoides
gtggcttgatcggtgcaagtcatcccacgcctctcccaaccccccccattccccctcaccaggcgcgtc

SEQ ID NO: 26261 - DNA, 126 bp, Chlorella protothecoides
tgacgctcgacaggactagatatgacggatacggtagatgatgcggcccccgcgcgggctaataagtcgaggaagaggagtgacggccctaagacgggggtggccaagtaccggcgaggggaggag

SEQ ID NO: 26262 - DNA, 61 bp, Chlorella protothecoides
agcaggcttggccttcttcacagccttttctgcagcaggcttggccttcttcacagccttt

SEQ ID NO: 26263 - DNA, 143 bp, Chlorella protothecoides
ttgctggggggaaatgccaaaaggccccatatgtaggcgggggcatgacaaagcatcgtcagcaagtgctgagcaaccgcaggcatggaaacagccctcactcccagtaatccccttgcctcccgccagggaggtgttggtga

SEQ ID NO: 26264 - DNA, 139 bp, Chlorella protothecoides
cagtgcacttgcccaaagactcccaagatttcccatattccactcaattctacccatgcatgctcaccccccgacccccctgcccttcattcccttctttccaaaggatacgctcacccgcttgggcatcgacgagggt

SEQ ID NO: 26265 - DNA, 70 bp, Chlorella protothecoides
cgtgtacctccatgcatgagtactgtgtagactgcctacttgccgcagcgtgtgcctagcctcgggattg

SEQ ID NO: 26266 - DNA, 76 bp, Chlorella protothecoides
tgccgcagcgtgtgcctagcctcgggattgacgggtcgaggaatatcgggcgagaatgtgtgctgggacactgcac

SEQ ID NO: 26267 - DNA, 76 bp, Chlorella protothecoides
aatggcagattgatagaagaaaagctagttgtggcacgaccgaggagtggcaatgacttgccatggaatcgacgtg

SEQ ID NO: 26268 - DNA, 74 bp, Chlorella protothecoides
aattaacaacgcgctcggagtataaaggcggaggacattgacctaccagaacacaaaattctcccgatcccaaa

SEQ ID NO: 26269 - DNA, 92 bp, Chlorella protothecoides
agcggaggggtaggagggtcaataacggactacttggaaggctgtatctcggacagaatgatccaacgacacatgcactcaccagcgtagcg

SEQ ID NO: 26270 - DNA, 61 bp, Chlorella protothecoides
aagccctcaggactctccctcaccaagcccggaggactctccctcaccaagccctcaggac

SEQ ID NO: 26271 - DNA, 75 bp, Chlorella protothecoides
gagctcctgtcactataaggctttgggttgttgtcgtttatgcagtgccgtcgaagccgatattttcagaagccg

SEQ ID NO: 26272 - DNA, 124 bp, Chlorella protothecoides
ggaggggaagccgtcctggctgctcgtcgccacaccgcacgccgtgttggcgcccagccaccaccaacctaccctggagtcaaaccttggagcaccggtgtccccaccttgcccctgtttcttg

SEQ ID NO: 26273 - DNA, 61 bp, Chlorella protothecoides
gcaccagctgtgcgtggaggagcagcggccgaatgccgacgccgggcgctcctactccgtc

SEQ ID NO: 26274 - DNA, 70 bp, Chlorella protothecoides
ggctgcgtgaggggaggcggggaaagggggagggtccccgagaggtgagcagaaggaggaagggggtcac

SEQ ID NO: 26275 - DNA, 77 bp, Chlorella protothecoides
ctcccccgacggttccatggaggataccctggttcaccccgatacattgttgtctggtgctgtccacaacccttccc

SEQ ID NO: 26276 - DNA, 132 bp, Chlorella protothecoides
caggaaggggagtgatggcctgctctccgctgcagagtcccctgcaaagcagaccaagtgttgcactgaggtgcacctattttgggcgtgtcccctctgagaaccaaatttatcacacattgtggctctcct

SEQ ID NO: 26277 - DNA, 114 bp, Chlorella protothecoides
ggccatggctgacctgggcatgagggggggggtacattgttaccagcgggagcacacacccacctgccgttagagcgccgaggacatgtgtcgagagattgaaacgagtggacc

SEQ ID NO: 26278 - DNA, 272 bp, Chlorella protothecoides
gagtggtcgacgggtggggggagggggtgtgggatgggatgcagcgcggggatgctggtgcgcatcatatgatccgttggcatggtacgcatgcgatgctgcgcgcctggaggcacgcaggtaggtgggtacaggctggcagagcaaagtcccatgcttctgtaccagggaggagaatccggcgcgtccttgccacagctcgtcacccaaacaactcccctggaactcccaccagctgttggaccactcaccttccgcggtcagggcatgct

SEQ ID NO: 26279 - DNA, 77 bp, Chlorella protothecoides
cacccgcaactgccacacttcaattcagtgatcctgtagatggaaaggtcgacatgacgtgtgttgttaccactccg

SEQ ID NO: 26280 - DNA, 73 bp, Chlorella protothecoides
tcggtcgtgcccgatgggcccctggtggcctaggggcctcgctcctccttagcccttagaggggccagatacc

SEQ ID NO: 26281 - DNA, 241 bp, Chlorella protothecoides
cggacaacccggcgccttcacctgagagcggtccagaggtcgacgagcaatactagcggctggcggcataggttcttccagtcatggagaagggagcgcaggaggaacatgatgcactctacaagcacctcatggaagctgattcgcctgtactgcccgcttggtcggctgagaccattccctacaagcggcacggcaggtgcaaagcacgtcgcatccgctcccaccttgagaggggagg

SEQ ID NO: 26282 - DNA, 61 bp, Chlorella protothecoides
gccgcggcaccctcgaccgtggcgcccggcctcacggcgcagctcctgtcccccggcttcc

SEQ ID NO: 26283 - DNA, 131 bp, Chlorella protothecoides
ggtcacggcttcctcattgccaaggtgatgccaaggccaggcttgctgccggtgctctggtgcatctcagggcaggacatgagccgcatactccctgccgtaagttggctgcatgctgagaaacaaagcca

SEQ ID NO: 26284 - DNA, 124 bp, Chlorella protothecoides
accaaactctgccgcataggcggccagatatctcctcacctacacaccggatgggagggcatggaggaggagctcagcggttgtggaaaatcttgcgcagagtcagaagtacaaagtttgggcc

SEQ ID NO: 26285 - DNA, 128 bp, Chlorella protothecoides
caacccgaccccttcttggtgtccagcgtgtgtcgctgatgtggtccgccttcactgtctgtcgttgacctgctgcgatctaccatccccacaccctgcgccctgcacacctctccaatgttgcagag

SEQ ID NO: 26286 - DNA, 136 bp, Chlorella protothecoides
ctccttggagtctgtgggcaggggttgttggagtatgggaagcagttgccagactccgaccccatgacttgcagcgccgggaatctcgtgcaacacccatggtcatgttgaggccgtcaccaatcccccagcgcag

SEQ ID NO: 26287 - DNA, 100 bp, Chlorella protothecoides
ctggcggcgggatggcgaccgcaggtgcgagtgccggggcggctgcagcgggtccggggtgggctgctgcgtcagggccgcctgcaggaatcaagaatga

SEQ ID NO: 26288 - DNA, 61 bp, Chlorella protothecoides
gtcagggccgcctgcaggaatcaagaatgagaaggctgtcattgcattgaaagatgcatgc

SEQ ID NO: 26289 - DNA, 77 bp, Chlorella protothecoides
tgtggcggcggggggaacggcgggaggcaagttctgtccatgcgaggggacggagtcgcgcacctgccgtcgctgca

SEQ ID NO: 26290 - DNA, 127 bp, Chlorella protothecoides
gtccagggcggcagaagatgtccctggtgcggcttgaaaagatgcccatcccgagcctgatcatgatgcttggccacctgtgcccctgtgctgcaagccttgagaccagtgtacacatccatgcaca

SEQ ID NO: 26291 - DNA, 61 bp, Chlorella protothecoides
attgccctggtcgagcaggctttctttgccacccccaccgtcgtggcagccgacgccatcc

SEQ ID NO: 26292 - DNA, 61 bp, Chlorella protothecoides
ccacctctcgttcacccccagcttggtgataatgtcggtcatgatgacgttgttctcggcc

SEQ ID NO: 26293 - DNA, 61 bp, Chlorella protothecoides
caatcagggcagcttcttcttctcatttcatcgtttcttggtttttacggcgtctcagctg

SEQ ID NO: 26294 - DNA, 77 bp, Chlorella protothecoides
caactagaaatgcacggccttatcggcgaacaacatcaccaggcacagtgctctgtagcaccgacctgtgctccgcg

SEQ ID NO: 26295 - DNA, 61 bp, Chlorella protothecoides
gcccgagaagaacaccttcgggtatcaagcaaggcgggagggagggatggtgagcaggggg

SEQ ID NO: 26296 - DNA, 78 bp, Chlorella protothecoides
tgtaaggttgccttttcctggagactagggagtggacctatgctttggtgagtccgaattcaattgaccgggcgccag

SEQ ID NO: 26297 - DNA, 94 bp, Chlorella protothecoides
ggacaacgacgaggcgatcaaggtgggtggagctgcagtgaggaatgtggaggcatgtttgagcgaggggctctaaccccaccccatcaccccc

SEQ ID NO: 26298 - DNA, 74 bp, Chlorella protothecoides
tgtggaggagaggggcggggcaggcatcaagaggtttcgtgcatgcacctttgccctcctttgagggtgagcga

SEQ ID NO: 26299 - DNA, 95 bp, Chlorella protothecoides
cggcggcctgcgcccggcagggtccatggaaattcaagggtttcttacgagtaccgaacttgggcgcgctcttctcccatgatctcggccctccc

SEQ ID NO: 26300 - DNA, 61 bp, Chlorella protothecoides
ctgggtggttttgctggaaggccaagtggttggccacactggtgtagacggccgaacctat

SEQ ID NO: 26301 - DNA, 90 bp, Chlorella protothecoides
ccacccaccagccctgatttacctccacacccacccctgccgaccgcattctgagccttacctcgccaggtcggggcgcgctgggccgag

SEQ ID NO: 26302 - DNA, 872 bp, Chlorella protothecoides
  modified_base (542)..(754): a, c, t, g, unknown or other
ggcccactaggcctcgcagccagcaatgcgtctggaggcgaagctcacacaccccgcggcggtgaggacgccctcgatgaggacggcgcggccgtggatcggcatgcgccggcggcccattgcttgggcacccaggtggaggccaacgctaagactgtcccggacgccgccgcgcttgcgtcggtgctcggcttgtttgtgcggctcgcgtgcatgcgctcgacgtggccgccaaagcctttgtcggcggggtcgggctcgaagcgcgcaggacaaccgcccgggacgggggcctgctcgccgccggcatgttgtcgacccgcatcagcaccaagtcggtctcgttcgtgacgtggctgccagtgcgcgccccactcctcgtcgtctgtgcacacaagggtcagtcggatcctggcgaggtcatgaggagggccgggctgaggcccacggcccgacgtcaaaaggtggctgtcttcggccctgtcgcgacgtcgtcataatcgcatgtcggggcctacagcaccaacatattgggtgtcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctccccgttttcatgctcttccgggacggctgcggcagcgtcacggcgcccatcgagacggtgggtggttggatggttgcggagcgtggcgcccgggacaagcgcacgccgtcgc

SEQ ID NO: 26303 - DNA, 67 bp, Chlorella protothecoides
gtgatcgtgtctggagtctgatgttgttgccccctcctgcaccatgggagctaccctgtctctcctc

SEQ ID NO: 26304 - DNA, 128 bp, Chlorella protothecoides
tccgcttcctgaagaccgagcgggtgtgtgtgtgtgtgattttgtgttttgttttgtgtgtgtgtgtggggtgtttcagagggggatgtgaggtgtggaggaggggcatggaaggtgtcatagcatgg

SEQ ID NO: 26305 - DNA, 61 bp, Chlorella protothecoides
acacggtgtgcactctcactgccatcttgcaatgacaccgggctcccgcacaatcctgaac

SEQ ID NO: 26306 - DNA, 151 bp, Chlorella protothecoides
ggctggttgctcggcgtaagtgctgtccaatctgtctgcacgcggattgtctgggtcacagggccttgcggcccgggcatgacccaaggcaagggcaagaaatggggactcgcccccttggcaatctgtacaggtgacattctatccctgg

SEQ ID NO: 26307 - DNA, 151 bp, Chlorella protothecoides
acctgcgacagtcatggtcgagcggggatttggagtgagaagcggccacagagtgagcatggggttgtctgtgcttgatggccaagcgtgatctgagattgggagtcggataaatccccatccgtcccaaagtgcaggctgatgatgatga

SEQ ID NO: 26308 - DNA, 132 bp, Chlorella protothecoides
gggtggggagaaaccgtggggctggctgcttgcagggtgctgatgcagggcgcatgccatgcaggccggggggggcaggggcatggcgactcgtgccgaccactcggagccccacctcagcctcgaccacgc

SEQ ID NO: 26309 - DNA, 61 bp, Chlorella protothecoides
acgcctgtgcggagggggggccatgctggaagcggggactcgagaagctgacaggtacacc

SEQ ID NO: 26310 - DNA, 78 bp, Chlorella protothecoides
ccaccatgatgcatctccatggttttgagtaacaactcgatctccgtgaacatcctcaccctcgactcatcagagctt

SEQ ID NO: 26311 - DNA, 65 bp, Chlorella protothecoides
gacaccttgactacagaacagcaagtacaccgagcagcaaccccaccctgccgcagataccccga

SEQ ID NO: 26312 - DNA, 136 bp, Chlorella protothecoides
agaatgatgatcaacttggcagtcatgtactgcaatgaaccacaggccggcagccgcacagctctatttcccccagtcttcttgcatgttgacatgcagacaatctcttccaccatatgcaccattgtcgatggca

SEQ ID NO: 26313 - DNA, 61 bp, Chlorella protothecoides
cgctgggcgcgctgcgcggcggcctcggccgtccgactggcgcgctcagaggccgccgcct

SEQ ID NO: 26314 - DNA, 164 bp, Chlorella protothecoides
gaggagacggaggtgatgtggtttgtcaaaacactgggcagtatcgcgaatgtgccaggcgcaacctggatggtggtgagccaacgtgcatcctttggattgcacagtgccactggccactacccttcctctagcaatcctttccttctctgcagaagcagcgg

SEQ ID NO: 26315 - DNA, 108 bp, Chlorella protothecoides
cacgctgctgaagacctggagcggcaggggttgggatgagggtggggtggtgtgggaggtcgttggtgtcgagggccccgcacctcacggcttgaccggggtctcctc

SEQ ID NO: 26316 - DNA, 79 bp, Chlorella protothecoides
cgtcgccagctcgcgcgtcggggccagcaccacgcacagcggcgcgcgtccgcgcgcgcgcccctccgcgccgccgcgc

SEQ ID NO: 26317 - DNA, 157 bp, Chlorella protothecoides
caaggcctgtgcacctgggcgcagagggagaggtgcatggggctcatgcaacaggggcacccgttgacattctccagcagagtccagcttgccaggccggggctgtaggtgactgtcaggaagaggggatgggagtcgtgctgctggaggggggggg

SEQ ID NO: 26318 - DNA, 69 bp, Chlorella protothecoides
gctggtgaggggctcaggggtgggagtcttacctttgtaggagctgtcttcaccacctcttccttatgg

SEQ ID NO: 26319 - DNA, 62 bp, Chlorella protothecoides
ttgtgtgtaacgcatgacctccagaaggccagaacgagactgtcggccatcccgtggcaccc

SEQ ID NO: 26320 - DNA, 61 bp, Chlorella protothecoides
atgcagacttcccgctgatcgggcgacaggggtgcctgagcgttcagcaagccgctggcct

SEQ ID NO: 26321 - DNA, 79 bp, Chlorella protothecoides
gctgtgcatgctccagcacagagtgctggagaaggtcaagcaagctgtcgagcaggcggcagagagtgagtggccgggg

SEQ ID NO: 26322 - DNA, 61 bp, Chlorella protothecoides
cgtcatttaagggctctgcggcttgctagggtgaccactggtctgctgctggccttgtcct

SEQ ID NO: 26323 - DNA, 165 bp, Chlorella protothecoides
gagggattggcaagcccgggtttcatccctgttgctcctcaggcatgccatgtatttctccttcacctgtgagcgggtggcgcatgcatcaatgtgaggggtcatggcacacagcatgaagtcgacggccattctccactgcaccgaatcctacctctttgcact

SEQ ID NO: 26324 - DNA, 75 bp, Chlorella protothecoides
ccggcccggcgatgcgcgcgggagcagggcgtggcttgcctgccgcgctcccggaggaggtgcctgcagggcgca

SEQ ID NO: 26325 - DNA, 134 bp, Chlorella protothecoides
gcgcggtacacgatctgatcacatcgttaaagaagacaagtggatgttttctcatttttttctgctttgtctcgaccatcggccgatgtgcgaaccaggggtttcaatagagacggcaccctgccctgaggatc

SEQ ID NO: 26326 - DNA, 61 bp, Chlorella protothecoides
ttcggacactgtcgcacagaatcccaatcgttttgaagctgccgcgaaacgaaaaaaaatg

SEQ ID NO: 26327 - DNA, 133 bp, Chlorella protothecoides
gtcatgaccaggtcgtcgtcctcctcctccagcagcgcctgatgtccatggggagggggcgcttgtgtgcagggtttgcaaggcatgatgtttcccctcgacgggtggctcaaccatgccctgcacctggcaa

SEQ ID NO: 26328 - DNA, 77 bp, Chlorella protothecoides
tccttgcccatgagatgcactaggaaggcaacgcacgacatgccagcctcgatggtttcaaacactgatccccccaa

SEQ ID NO: 26329 - DNA, 173 bp, Chlorella protothecoides
ctaccaccctccatccgagattctttgggcaccctggctactgcacctccagcccactgcacccttcaaggagaccctccgcttcccccaagaccgacttcccatggagcactctctccgcgcgcgcacacacacacactcccacacacgcaaacagccgggcccacctcgcc

SEQ ID NO: 26330 - DNA, 80 bp, Chlorella protothecoides
tgcggtgaacgacgcaggtgtgtgggtgggtgtgtctgggtgggtgtgtctgggtggggcgtttctgttgggcgagggtg

SEQ ID NO: 26331 - DNA, 75 bp, Chlorella protothecoides
ggttgtggatgagcctgtacatgctgatttactatgggttgccgcttgtggaggaacgacagggtcctcgagcct

SEQ ID NO: 26332 - DNA, 61 bp, Chlorella protothecoides
cgtctcatttgaagccagctgagaccccctctcccagccttgcacgcgctctgcgcccggc

SEQ ID NO: 26333 - DNA, 799 bp, Chlorella protothecoides
ccgcccacgcgcgcgctgggcggcgcggagcaggcgctgctgtggcgctaccgctacgcgctggcgagcgagcggcgtgcgctcacgcgcttcctgcgctgcgtggactgggccgacggcggcgaggccgcgcaggccgccgcgctgatggcggcctgggcgcccatcgacgtcgccgacgcgctggagctgctgagcccggactacggtaatgaggaggtgcggggccacgcggtgcgtgtgctggaggccacgggtgacgaggagctgctggcctacatgctgcagctggtgcaggcgctgcgctacgagccggccgacgactcgcggctggggcgcttcctggcgcgccgcggcgcggccagcctcaggctcgccacccccctcttctggtacctctgcgcggagctggaggacccggggttcggccggcgcgccgcgctggtgcaggccgcgctcctgcgcggcctggaccccgcgctggaggatgcgctggcgtcgcagctggacctggcggcacgcctgcgccacctggccgacgtggtgcaggcgacccgcgggtcggcggcgcggcgcgcagagacgctgagggcgctggtgtcgcccggcggcgcggccgctgacctggcgcgcttggcctgccccaacccgctggacccgggcactcgcctgctgggcctggacgccagccagtgcaccgtgtttaagtctgcgctctgccccctgcgcctcgtcttcttcaccgagccgtggggagacgatggagcgagagcgggggtgggggggagtggggccggtg

SEQ ID NO: 26334 - DNA, 78 bp, Chlorella protothecoides
atgcattacagataaggcatagacacattataccatcggactgccattgtcctcggcgtacagcgagaggatgtgctc

SEQ ID NO: 26335 - DNA, 147 bp, Chlorella protothecoides
aggaacccccacaccgccgcgggtggcacccatctgcgcagccccgcactcccgaccccaaacctttcgcatgattgatcacccaaccctctcctcctcgacagtctcactggagctgttgtggaccttggcgacgccctttccaga

SEQ ID NO: 26336 - DNA, 74 bp, Chlorella protothecoides
ctaccccaaagactggtgtttgttgattacactttgcgccatagatgcaaggcaggcgccatccctactcacca

SEQ ID NO: 26337 - DNA, 72 bp, Chlorella protothecoides
accgttcaacgtgccacatggtcgagtctcgaacacaaagctgctgtttgggcgatccgatgacaggaacga

SEQ ID NO: 26338 - DNA, 61 bp, Chlorella protothecoides
cacaagcgggtctgcgatggcgtggagacgcggacggaactgtgggacaccaagcggtgcg

SEQ ID NO: 26339 - DNA, 75 bp, Chlorella protothecoides
tgccatcccagtgctgcgccatgccctacacgcaaccacccatcgtgtgcagcacagctatcatggtgatgcaag

SEQ ID NO: 26340 - DNA, 61 bp, Chlorella protothecoides
cgacttgacgacgtccaccggagacccgacacacaccgcgaagaagccggcgcccaggccg

SEQ ID NO: 26341 - DNA, 61 bp, Chlorella protothecoides
ccgttatcagagatccgtcaaatgcacacttacctcagtaatcgattagcttaagccgcca

SEQ ID NO: 26342 - DNA, 61 bp, Chlorella protothecoides
cgctgcatggttggcggggttttgagtgtagttcagattaggattgtgcaatggtgaagtt

SEQ ID NO: 26343 - DNA, 73 bp, Chlorella protothecoides
cagtgtggggccctgtttgatgtgttgaattttgcgggggtttccaggacgagaggcatgtagctgcaatcca

SEQ ID NO: 26344 - DNA, 61 bp, Chlorella protothecoides
gctggggctagggctgggtgactcctcgggactggggctaggagagggcgactcctcgggg

SEQ ID NO: 26345 - DNA, 61 bp, Chlorella protothecoides
cggcaggtggggcggcgatgcgaccaggatcactgtgtgtgtgggttgaggaggttggcac

SEQ ID NO: 26346 - DNA, 73 bp, Chlorella protothecoides
ccggaggccctgcgggtgtccaccagtcccaccaaaccctactccttgccttccatgctgggcatggctcggg

SEQ ID NO: 26347 - DNA, 78 bp, Chlorella protothecoides
gtcctcaaggactggaggcccaaggatgccgcgcacggggagtgggtagctgcactcaaagccgtgctgaaggccatg

SEQ ID NO: 26348 - DNA, 63 bp, Chlorella protothecoides
agctcacgctcgcggaggatgcggccgtcgacacccaggagggcggccatgaggggccgggcc

SEQ ID NO: 26349 - DNA, 61 bp, Chlorella protothecoides
tccgccgagcaagcatcgtgctcaaatttcaaagccagcgaatctctccgtggctcaagta

SEQ ID NO: 26350 - DNA, 61 bp, Chlorella protothecoides
tcagtggatagctgagcctggcatggatggggaggcgcacctcccatgcatttgcggtttc

SEQ ID NO: 26351 - DNA, 76 bp, Chlorella protothecoides
ctgcacagcttgtcctgtacattggcgtgaaccaatggcttaccacccctctccgccgcagagtcatgctcgtggg

SEQ ID NO: 26352 - DNA, 80 bp, Chlorella protothecoides
cggccgactgcggcccatttccctcttttttccacacagagcccagatcgttacctctcgcgcctgttccctgctcctaa

SEQ ID NO: 26353 - DNA, 207 bp, Chlorella protothecoides
gcgcacctccatcgcgcgctccacgcacggccgagttggcctggctcccacgccgctgcgggcagtcgttgccgcggtggcccctgtcgccacagttggggcaggatggcgtcgcggaagtcgtcgcgcccgaggtgtgcgaggcagccgggctggggcgcgcggggcggtggccagtggacgcagagcccgtcgccgcgccgcgtg

SEQ ID NO: 26354 - DNA, 61 bp, Chlorella protothecoides
gtagctgcctggcttaagtggagacctctcaggggtcaacacggccagcaggcggggaggc

SEQ ID NO: 26355 - DNA, 79 bp, Chlorella protothecoides
aataaaacagcgcaggcttggcaagccaccacagagagatgctgcaataaacccgggcagacgcggccccgagcatata

SEQ ID NO: 26356 - DNA, 92 bp, Chlorella protothecoides
tcggcagtgccaacttcttgcatctgagcacgcagaaggtgtgaccacggtcttacgttgtacagacaagacttgctggtcccacgttgcag

SEQ ID NO: 26357 - DNA, 370 bp, Chlorella protothecoides
gccccctggtgtactatgcagccgttgggttgctgtcccgggggcaaccgcatgcctggcaggcagccttaatgggtctcagagctccctctgttgacctgttgcctcttgaccgcatcgcccaccgccccacatccttccctcaactccctcctgggtcggcccatggcaacaggcagcccatctcaatgtgctgcctacatgtggactggtcatggcaaatagtcatggggaagggtgtgtgtcagttgtctgggtccccgtggggagtgcattatgccaggcacattgctcgagaaaggagagttgtgcatgaatgggagggggcacggggagcacattgcagggtcaggtcagggacgtggatggg

SEQ ID NO: 26358 - DNA, 86 bp, Chlorella protothecoides
cacgaaaattcaggctcgagacctcggattctgagctttccgcagttcttccgaccggtcttccccggatcaagcacttttcggag

SEQ ID NO: 26359 - DNA, 71 bp, Chlorella protothecoides
gtgtccctttggcccctgacacccctggatttctcacgccacacacacaacccctccccggccggcgcagg

SEQ ID NO: 26360 - DNA, 94 bp, Chlorella protothecoides
gtgctgggcatgccaggaggggggagctggaacagcgacagccaggggcggtgccgcacctctcctcggctcctctgcaaggcattcgctgtca

SEQ ID NO: 26361 - DNA, 63 bp, Chlorella protothecoides
ccgccactcgttcaccgtggcgtcgttttgcgcctgttgttctctcttctccgcatcgtccag

SEQ ID NO: 26362 - DNA, 97 bp, Chlorella protothecoides
gaaatatggctgcaatcgcctgccatggtgtgtgccttgtacatcctttcctttcactccttgtcattccctctggcaaccaacacatgtgcaggcc

SEQ ID NO: 26363 - DNA, 77 bp, Chlorella protothecoides
cacctccaacccaaatgtccagaagctccaagcaatccccttaccttgcgcggttccaccggaagggggaggcccgg

SEQ ID NO: 26364 - DNA, 127 bp, Chlorella protothecoides
gatagctccgcctcgttcagaatgaaagggtacagattgacaggataatgcctgcttcctctgcagtcgagacgagagacaccaagagggtttgagtcgggcgagacagagttacgcaagcagcaca

SEQ ID NO: 26365 - DNA, 87 bp, Chlorella protothecoides
gccctttgggaagcaccaccttctggcatgattgatgcacagctccgagtgtaccgggcagctggtgtgaagacccaaggccccgag

SEQ ID NO: 26366 - DNA, 61 bp, Chlorella protothecoides
gaacgcacccagggtggcccagcggcagtggatgacctcgatcaccctgtagcgggcaaag

SEQ ID NO: 26367 - DNA, 92 bp, Chlorella protothecoides
aggggccagataccccccttctcatgcactgcccttctggatgctggtccagtcgtttacttacatgggatccacaccaggtgcaaagtcat

SEQ ID NO: 26368 - DNA, 66 bp, Chlorella protothecoides
cagggtgagggtgggaggaaaccagggcggtttcagggactgctaagcggaggctcgccaagatgg

SEQ ID NO: 26369 - DNA, 281 bp, Chlorella protothecoides
cccaacaacctcacctgactcgacgcttgcgccccagggtcgtcactcgagccaactccctgagtcgcgacccgcgagtcagcttctttcttggccatgacgccgccctggtacatccagtccagccgatcgtttcgcctgcacgccgggagggaggaggcatggtaagctttctttcagtgggggggatgaatgcgccatggctgagttctcacatcgacaaagttcctccccacctcccctccagaggtctccctcctgagactcacactttcacccca

SEQ ID NO: 26370 - DNA, 61 bp, Chlorella protothecoides
ctgagggtggcaggggcttgctggaagagggaatctggaatgcagggtgtgctcaataggc

SEQ ID NO: 26371 - DNA, 61 bp, Chlorella protothecoides
cgggcggcatgagcccaccttctagcacccaagtgacaggtgcagggcctggcaactgctc

SEQ ID NO: 26372 - DNA, 77 bp, Chlorella protothecoides
acattctggccactaggccatcgctggcccaccctcacctaagatcagcgggagcggaggaaccttctccagcttct

SEQ ID NO: 26373 - DNA, 73 bp, Chlorella protothecoides
ccggctttccagaacctgtgcgacctgaagctctggtcgggcactctcattccgagtgggttcctgggatgta

SEQ ID NO: 26374 - DNA, 95 bp, Chlorella protothecoides
ggcatggcgacgcagccattcggacccctcccaccctcgctgccgtctgcaccccaggtacctgtgcgccggtctcggtgccgaggcgtacaatg

SEQ ID NO: 26375 - DNA, 192 bp, Chlorella protothecoides
ctattctctcatacatttgcatgatacacggctttacaatattaaacgcgggatgatatctctcagtggatgcttattccgggatgcagctattgcccaggtaccacaacgatgaccgtcatattgcaacctagactatataccctgctatagacagaattgttgcagggcaataggggagggacacagatg

SEQ ID NO: 26376 - DNA, 457 bp, Chlorella protothecoides
cacgaatgtgcaatgtataccagggtgtcaggggatctgtcaattacaacaaatggattccccctcgaagtaggacttcctaaatcatctgtgtccctcccctattgccctgcaacaattctgtctatagcagggtatatagtctaggttgcaatatgacggtcatcgttgtggtacctgggcaatagctgcatcccggaataagcatccactgagagatatcatcccgcgtttaatattgtaaagccgtgtatcatgcaaatgtatgagagaatagtcgtgactccttaagtgggcatcctttcaaatatatagtttgtttgcggcctctctggagcacacgatcagtgacccactatcgctgagtaggtggtgagggtcaatcctgggaggtatgcttgagttccaaacattatccctgtgtatgcctttactcaagggtgaggcaaggtggcat

SEQ ID NO: 26377 - DNA, 61 bp, Chlorella protothecoides
aggaacccacgtgcatcccttgtcgactcggcccacagcagcctctctgttcatcatgggg

SEQ ID NO: 26378 - DNA, 146 bp, Chlorella protothecoides
atatgcatcgtcttggtgactccggaccttgccacggcacgcctgccccattctaagcgatcaactcttgatccctgtgggggcatgtagcaaggcttccaaggatatcacagcccatcatcaagagtatatccccacagagggcc

SEQ ID NO: 26379 - DNA, 75 bp, Chlorella protothecoides
caaagggggagggcaggcccgcatctggggtccgaacccccatggcatccccggggtctccatgcctggtcgcgc

SEQ ID NO: 26380 - DNA, 176 bp, Chlorella protothecoides
tccgccgacatcttatgagaagggggggggaagtggcagaagggtgatgtttgggagcacacaaagcaatcaaaaatgcatgattggatggacaccgacatgccttctgcatcatctgttacacttgccaccaagcgtgcaaagggaggatgtgctgctgccataccccgccaaat

SEQ ID NO: 26381 - DNA, 63 bp, Chlorella protothecoides
tccctgcccaccctcaccacatctctaatggccacccgatcaccaacgctcaacaggtggaga

SEQ ID NO: 26382 - DNA, 65 bp, Chlorella protothecoides
aagctgtccttgggggacgcctgacggtgagaggggagaaaggagttaggtggtcgggggggggg

SEQ ID NO: 26383 - DNA, 76 bp, Chlorella protothecoides
actgcgggggaaggggcggggtgcacctggatcaatcatgacgcctctacctcaaggcaccggggccctgcagccc

SEQ ID NO: 26384 - DNA, 16900 bp, Chlorella protothecoides
  modified_base (6614)..(6623): a, c, t, g, unknown or other
  modified_base (6692)..(6701): a, c, t, g, unknown or other
  modified_base (6976)..(6985): a, c, t, g, unknown or other
  modified_base (7221)..(7302): a, c, t, g, unknown or other
  modified_base (7439)..(7448): a, c, t, g, unknown or other
  modified_base (7565)..(7574): a, c, t, g, unknown or other
  modified_base (8149)..(8158): a, c, t, g, unknown or other
  modified_base (9300)..(9309): a, c, t, g, unknown or other
  modified_base (10990)..(10999): a, c, t, g, unknown or other
  modified_base (11075)..(11084): a, c, t, g, unknown or other
  modified_base (11461)..(11538): a, c, t, g, unknown or other
  modified_base (12254)..(12313): a, c, t, g, unknown or other
  modified_base (12655)..(12716): a, c, t, g, unknown or other
  modified_base (13013)..(13125): a, c, t, g, unknown or other
  modified_base (13452)..(13461): a, c, t, g, unknown or other
  modified_base (13691)..(13700): a, c, t, g, unknown or other
  modified_base (13858)..(13867): a, c, t, g, unknown or other
  modified_base (14058)..(14067): a, c, t, g, unknown or other
  modified_base (14121)..(14130): a, c, t, g, unknown or other
  modified_base (14184)..(14193): a, c, t, g, unknown or other
  modified_base (14420)..(14505): a, c, t, g, unknown or other
  modified_base (15898)..(15907): a, c, t, g, unknown or other
  modified_base (16459)..(16468): a, c, t, g, unknown or other
cgcacgcgccggcggcgccgacgcccactcctcctccccgccccactggccgtccgcgccggcgtcgtcgaacccaccaaaggcggcggactgctgcgcgtggcgctggccctgctgcccgccgccgccctcggagccgtagccgcgccgctcctcgacctcgtcgtcggccgcggaggcagggcggtagccgcctcccacggggccgtagccggcgccggcatgcgccccgccgcccagcgcgggggaggaggcggaggccgccacgcgcctcgcgcccaggtccacgcggtacccgttggcggcggcggtggcctccagggaggaggcggcgctggcgtatgcgctcttgaggaagccccagccgcggctgcccacctcgcgcgcccgctctgccgccgcctgcgtctgatcctggatgcccgcctcctgcagccgggcctgcgccacgaccgccttctcgcgcgcggtggcggccgcggcggaggccagggaccccagcccggacagacccttgctcagcagctgcgtcacgtcctccaccccgcgctcgccacctgcccctggccgcgggctgggcgtggagccgaagccgacgtacttcccgccctggctgggggggaggtcggaggggcggcccgcgttctccgcgacgcggcgcgcgaagaaggtgtccttgctggcggccgaggcggccagggcggaggaggagtagttccccgcgccggagccgttggagaatgaaccacctgcgacgggggcgggggagggagggcgggcggcgggcttagaaagcggtgagtctgggaagcaggcttgcagagggggcccgggccactggctcaccatccaggcacccaaggcttcctgtgccgtcttgccccaccaggacgatagtgctgccccatgtgacccagagccttgcagtttctcagattattccaagcccacatcgtggagagctgggcctctgcccccaaatcgccctgggcgtcacccggttgccccttccccatccccctctgcatacctctggagcccgggcgaccgccagagccagtgccgctcgattcctggggctcgtcccagctgtcccaccccgcgcccatcccccgggaggccacgttgccgctgctcccctccccccgccgcagcgtgcccgaggcggaagaggggagcggggggcgggggggggcggcggcgcgcgcctccgcaggggagggcggcgtgtaggcctgcccattcagctccgccttgatcttctcgcggtagaactccgcggcctgggagttatacttttcccggatgtcggtgtgcttggtcacgccgtacttgccgagaaaggcgttgcaggcgccgttgccgcccagctgcatccgcttgagctggtcggggttccaggcatccatggtgaccgacctgaggcaggtggaaggggtagaagggcacaggtgacacctcttccagggagaccacgacactaagctgggccaaatgtagcggcgagcgccacaggcggccgtgctaccagcacagggccctagtacgagtctctctgcactgccaggccccatttccccccttcccaggaggcacacctgacaaagctgatgtgcacccccagtccgcggtgcttgccgctgcactccaggcacatgaagatgccataggagacagaggcccactgcgggttcttggtgtcacagtcaacacaaacctgcaccggagtatgggcgtgttggctgggagcacgcgcacacaggctgacacgtacccaccaatacggcagccggtctgaggctatgtgaggtgaaagttatgctcgttctcataatcatgttcttaccttgttgtctggcctgctctgcagctcccgcaggatgcgcagtgcctcgggctgagccatggctggggtcccggccagggaggagcctcgcacactccctgtgcaatcctttggggtgataaggggccaacggaggaccagggcgcccacgggctttcgaaaggagcgctgcagccaagtacagttcccgaggtggttgggagtgggacggacgggggttcggcccactctcccgccaccacacggagaggaggtgaaagctggcagggcgaagagatggccctctacaccgtaaattcgagttatcagggcctcctgttcaccagaacagtagcatcaaggtcaatagaggctcacaattggtagcaaggtgatatagggacgtccaggcacgacttacatggcagacctctgggattgtttcggaagcctttcggatgccagtcctggtgcggtggtgtgttgacgggacgcgacccgatcagatcgtgggtcaaggtctgttcttgcagattcaatgacgtttcatgcaggaatgctcctgatgcaagcggggggctcatccgcttcggatcacccctttgcagagacatcgagactggggacaggcaaagagcccacaggccagcagaccgtggcaagcggggtttgtagactgggcatggtctgcaagcattcggtctggaggttgtggggctctgtgtactacccatggcgattgcacccttctgcgaggcggggatccaatgcaacacaacccactcctcatgcacaggacgtgctgtccagtggcagcgatgatgagaaactggcccaaagcacagcgtacattgcctcctgtgtacggacgcggcgcttgcccctgcccactagcatcgagcccaagaagcgcaagaaggagtcaccagaagatcacgaagagccagtcaatgcaaagagtcttcgccgtcccatgacaaaggcaatcagcagatcactgtcagcccctatgcggagggagccaaccaagatcagggaaaggcgacggcctgaaccgaccctggacccacgctcatccaacctgttgcatcgcatcaatgcattgaagggtgatttgatccgtcagttcgacgaggatgtcccggctcaatgtgatgcccctgctccaggtggatgggagggcagggagcactgcttgcaccacaacgggtgctcctttcgggggatggtggcatggtttggtatcacaacagctggcctcttgtgatccttgtggagctcacctctcccgacaccttcctgcatccttccagaagctgtcaagcccgtgtgcagccctccaaggacgaacgcacactcccctccgcgggatgcgggcgaggaagaccggctcatgctgactgtggagtgtcagcagggcaggaaacggatgcggatgaagaggctagaccctttctccaagctgttcgagtcctttgaacgagtggcgcgggaagaggtgcggtgggggctccctttaggcatggatgcacccaatcccccatggacgggagtgaaccacttgggggcgacggaatgcatagatgggaggagggcacgtgcgtgccagccccaagccctcggtccaggagcagtgtcccctgctgtattctcagggctggctcgactctggcgctttacgctttgtttttgatggcgaaactgttgcgggaaccctgtcacctagggaccttgatttggaaggggacgaggtgatagaggcttaccccttgtgactggcaagtttgtgaggacgcgaggccagataggcacccctgattcccggctcaaactgtgcccctcacatgctcgcccctgaacacagggttgctcgttgcaccgtgaaacatgttgctgttgaaagtaccactgccaagagttgagcacttatacatccctcacaacgcggaagcccttcatgccaggcaggcgctggttcgtgctgctaagattgtggaattggattagcaacggcatcgctgtcatcattaaacacatgtcttgagcactgtagcatattgattgtcgactaaaccggaacagatgtgcgttgctcgtcgccctggatatccctgcccaggccagactctaccaagaggattcaacaaatccgactgcaacactgccgccgcgaggtcaaagcacgaggaaagctttgtggttgtacgagcggaccagtgtcagagggcaaatgtcgtactaacccgggcgccttgaagccaacgtaaccgcaaggagactcgaaaagccgggcaccagtacgtcacactcggattagacgccataaatgcaacctggaagcaaaattaactgcttgagtccatagctcacacattatcatccaagtgacgagcaccaggaggatccgaaactgaaacgggtagggaactatccgcagataccttcttcgcacaggctgatccgcgtggcaagctcttccatggacagtcgtcgaccagccttgcacacaaaattgcaagatttttgtatcccaaacttttgagacacaagcagtcaaatcccactggtcggtctgaagtgctctcatggcaggccaggtccatccggtgggttgggtctcactccggttgctccggagcgcagccaggtattatcccccgatgcccagggttttaggaaagcctccgttacatcggggactgcgtgagtttccacatgaccatgctaaaacggagaataatatctcaagcagctattggcttgttgaacttgaatctttggtggagtactgggcgaccggaacaacccagagcggtcggtcattcgaagccctccgcagtcttcgccatgttcaaacccccccaccgtggcctgtggctcttcgtgtgttcgctattactctcaccactcgtcgtcaaaggacatggtacccttgtgtacccgatgtcgcgcaactacatcgcaaacagtgattattgcccccactgcttgaacgccggaggtgaggtatgagccgcagctcctactgggccatagatttggactggctggttccagtgcaggtgctttggtgatttgcagaggaacttcatgttttacataacattacacccccctgtgctgctgacgctgtccttgtccacaggtgtccgagctgtgcggataggagaccagaagtggccggtgggccatcatgggctctgtggcgacaactactcactggccacgcccaggcctcatgaagccggtggaaagcactacacgggacagattggaggtgcgaacaaactgcctttcctcagattggaggagatgaagacttctggggtgggttgggtacaggtgcatgccttcggtgttcagtagctaaaggatcagaccaacaactatcagccctctttcgtcctcatttcgaaccagcttggctaggtgaagggttcgttgctcaggcctttgtgaatgcagtacggtgttggccgaccaccagcctcgccactgttcattgtgcagggaccttcaggaccggctccatcatgcccatctacgtcaccatgtccactttccacatgggaaacttcatgttccgcatctgcaagatcaggggcaacaccatagataacgagacggctcagttgacagaagaatgcttcaacgaaaacatactggtgggtcgcctgtctgagtggtggccatgggcttaggtgttgtccagaacctgccccccaccaagcattgcccagtccagcacagtcgaaggggtgttggtgctgatgactctctctccacctcggctcagccagactcagctcatccgcatggtgcaggccctcaccactcaactttctttccacccctccccgtgcaccccatgctccagacccaggccaatgttcccgggcagcagaacgtgagcgacccctggtatcacacggggtacatggaagccagctcctacacgctctacttccagctccctgccagccttgagtgtgacggggtgacgagcaagtgtgtcttccagtggtactggctcaccgcaaattcctgcataccccccggtgaaccagccgagtatgtattggatcccctccttggcacctgcagtgtggtgaacacttaccctgaagaggtggggcgtcggggtggggaaaagggggcaataatgtgttgcaagtccccagccctgcatggcacatgtgcgcagccggtacagatggcacttctcaaaaagacttaccagcccgcccgcccagaccatgctgttcaagaactgttttgtgccgcacattctcatcacgcctccatccattatcccatgcagttttggaactgtgccgacattaccatcacagacaccgcagttgccggtggccccccaccccccgcctcacctccgcccggaattgcctcaccaccacctcccccttccccgcccaaaaagagaagcccgcctccccctcccagcagccctccccctccaccggaggagttgtccccaccgccacccgagaagagtccacccccaccactcaagaagagccccccgcccgctcccaagaagagccccccgccccctcccaagaagagctcctcaccccctcccaaaaagcagccacctccgccagccaaaaagtcaccacctccaccaaccaagaaagcatcccctccgccacctaggaagacagtgtcaccaaaccctacaaagaagtcgtcaccttcaccgaagaggaagtcgccccccccaaaaaagtgatctgccctggcttgattgcagcctccactatctggnnnnnnnnnngtttgtgctggcggtaatgacttcctccattcacaaagatcgtgcccagcagttcattcccaaaggtannnnnnnnnngttgttgcccttcccaatgcgtttgtgcgtgctgtgcaactctccaagctgatgcctgagtcaggctgccacttcagcttatcgtcagattgctgcgctggcctggctgcactacagcagctcgcaacccccatgcccatcgtgaacccatatgatactcaaatcgttataccacaatggtaccgcactgataacgtggatagctatctcccagcaactagtgttcctgcactctgacggattttcaaattgttagatgtctcatcgagcctccnnnnnnnnnnactggctgcactacaggagctcgcaaccccaatgcccatcgtgaacccatatgataatcaaatcgtcatcccacaatggtaccgcactgatgacgtggatagctatctcctagcaactagtgctcctgcactctgacggattctcaaattgttagatgtctcatcgagcctccacagagcgctgcatccctatcggcctccgcacaatatctcagatggcctttccttcccgctgnnnnnnnnnnnnnnnnnnnnnnnnnnnnnnnnnnnnnnnnnnnnnnnnnnnnnnnnnnnnnnnnnnnnnnnnnnnnnnnnnntctctgctgtcctcctaataaactcacacagaggaccctcataggcctctcgtcactaaagttcgcaaaaccatctattacattctgttggagaggaccaggagaagtaactcagtgtccaaagccaaccccacaannnnnnnnnngtataggaagactttcaacgccttcaacagaatcgtgttacacatccactgatgtcatgtccccatgcttcccatgtcgggggttgggaccagggttatcgaaattgcgggtttcgnnnnnnnnnntcagacagattcacagctattcccacccgctcagggcatcgccggcacgctggctgagtttgggcaggccacggaggctgagggtggtttgggggcaggtatggcagaattcacctctgctgtcctcctaacaaactcacacagaggcgcctcataggcctcttgtcactaaaagtacgcaaaaccatctattacattctgtttgagaggaccaggagaggtaactcagtgtccaaagccaaccccacaaaattcctcggcatcccggatccgccggtgtgggaacacaccgcgtgcagcaactaatatgcccaattcccgattctgtgcacaaatagaatgaatttcaacaccttcaacagagtcgtgttacccttgcactgatgtcatgttcccacgcttccaatgtcggggttgggaccactcgcacgtggtttactccgacatcaaggaccgcgaaagcaagccaatcatgcgaggcggtagttgtggccgagtactcatgcttttcacggagtaggcctgacgcactgtggaagtgattacacggccctcccgcatgtctgtgttcatcnnnnnnnnnntgggaccactcgcacgtggtttagtccgacatcaaggaccgcgagagcaagccaatcatgcgagacggtagttgtggccgagtacccatgctcttcacgaggagtaggcttgacgcactgtggaagtgatcacacggccctcccgcatgtctgtgttcatctgcgtgacctgtgctgcccagtacgaggggcaagaaacaccgtcctgctgccgcatctgcgatgacgaccggcagtatgtcggcgaaaatggctccgggattcaggagtggacaaccgcaggagctgtcgaggactccggccaccgcaacagtatcacccaagtcagggagggcctgcacgtcatcgggttggaacccccgctgggcatcgggcaggtggcccacctgatcacacggccagacggcaacatcctttgggactgcctgtacctgtcacaggcgtctgtgccggagatccaagccctggggggtgtcagctcggtggtcatctcgcacccccacttctacacagcggctgcatcctgggcgcagacctttggctgcaaggtgtgctgctggcgtggggcgcaggtgtgtggggtgcacctcgggactgacctcacagacgctgaccgggagggttctcacacccgacatcagactgtgaggctgcccaacctgcaggggggccatgtgccatcgtgccgcagcacactcagcctcagccaccatgcctgcagcacaggtgtacgtgcatgccgccgatgcggggtgggtgacgcagcccttccccagcctgcggcaatggacgggggacaggatggatctgggtcccgggctcacagtgtaccgtctgggtggccacttcccgggatcaagcgtcctcctgtgggacgagcaggagcgtgcgcccgagggggtgctgttcacaggtatcgcagcgacagcatgtcacctgctcctgggtcaagtctgcgtgggcccatgcagactcgattcggctggggttctggggatccaagcctgggcctgggactgcgatccaaccacatgagcacagggccccagctgccaccctgcgcgcagctggaattcacctgccccctcctccccctcgggcaggcgacacaatcatgcccactccccggggggccaccttcnnnnnnnnnngctcagctggggtcctggggatccaagcctgcgcctgggactgcgatccaaccacgtgagcacagggccccagctgccaccctgcgcacagctggaattcacctgcccccccctcccccccccgggcaggcgacaccatcatgcccactccccggggggccaccttcatgtactcattccccaacatgctgccgctgccggccagggaggtccgacgcatgcggggcactgccgagggcctccgctttgaccagctgcgtggcagcttcgcgcacagagtgatcgaggagaacgcgcgagaggtggtgctgcggtctgcggccctctacatcggcctcttggatggaacagaggcacggatctacttttaaggggaatggcaccatctcccatgcagtttctcaggcgccgatgtggcacagcatcaggctgtgaggctctgcaggctctggtatcaagggagttgtatcatctttcaccacagtattcgggtgcaacaagtcgaagagtgagctcgtgcagaatctgctccagcgccgcaggcgtgcacgaccgcgactggctggcagaagagggccgggggtcgacagggccgaggcgcctagcggccgtgccgccagcaccacacgtctggtcaggcggagccagagtacagggcgagggggtcggggtcatcaaggtgggctgcagggtggcggcactgtggcagggtacaagatcgtcgggctcaggtgtctgtccaaggccttccaggcgcgtcatctgtttcgagaccgcagggtcctggcagcaagcaggggagattccctggctctgcccgccttggcgccgccggccggggccttcgaggaccttccacctgaggtcctggtcctcctggcagacctggcacgagggtgaagggagagcgttgggccagaggacatgcagcgctgtgatgtgtgaagtgccgggggccccaccagactgtcacccatggttgtggcaagtgggcccggggcctcctggcatcctccccctcctcacgtgactctggccgggggcctggcggggccgggccggttggtttgctgagcggggtcctcgctgtgcgatgagggggaggggccgctgccggatggcgtgccgtcctgcgatggagcgcgcagggctcctgccgtccccgcagcccccaacccctccgccgggccctcttcgggcagctcatcctcgtccgattcggcgcgcagggactgcatcaggccgtgcccctccggctccgcctcggcgagcctcgcgtgcttcgccacccctgcccggccgctcgagggcgtcccgccctgcgccccgggccgcgccggcttcgacccggaggtcggcttcccctggcggccagcgctgtccttgctgcccgccgtgcgcttgctggggccctgggacgaggaggccatgggggcggcctttttatcccgggcctccaacctcaggccgccatacagctccatgtagccggggtgcaggagggcgatctggaagccggcaggcagctgccgatcgatcctgttcgggcgctggcctgttggtatggagggggaggggttatcatgggccgctcgaggaggtgcgacaggggtggggccagggcctagagtgttcgcagcagggctggcagtcgtcggcacctctcggcctgcagggttgnnnnnnnnnnaggccctggggtgaggaggccacgggggcggccttttgatcccgagcctccaacctcaggccgccatacagctccnnnnnnnnnnctggtatggagggggaggggttatcgtgggccgctcgagggggtgcgacaggggtggggccagggcctcgagtgtttgcagcagggctggccgtcgtcggcacctctcggcctgcagggttgcagtgctcggggatcccagcggcacccccgcctcacccgccacatcggccaccaatctgaagagctttcgcggcagcccaatgccccccgggagctggacgggctgcagcggggtgtgtggtgtggagcgtcgggcacggcatggtctcaatgacctcagcgacaggggtttaccttgcatgcgaggcagccggtcggtgtccacagggagggggtgggattgctccccttgctcccccatgctgacactccccnnnnnnnnnnnnnnnnnnnnnnnnnnnnnnnnnnnnnnnnnnnnnnnnnnnnnnnnnnnnnnnnnnnnnnnnnnnnnnccacccgaaccccgcactcaccgccgggggcttgccgcctgtcaggcggctgcatagttggctgaggacccccagccccagatcgcagaccagcgccacacgggcgtggctgccttccaccaggcccgagccgtcttctgcatcgttgcagggattgggtggtgggcgggtggaaagcaggggtctgcggatgtgtcctacaatctagaaataatcacggctgaggtcgaccgcggcgggagggcgaggcaggtctgtgccataccacgggccggggtgccacaccacaggttcaccgggcttgggccgcatgtgctgtcgaacccggtccctgcagcggtacctccaccttcccatgctgctcgcagactcccacttgccaaaagtccctgattgcctgcaacaacccccccccccttggccccctctccccacccacggccagtgagacccgaccacaacaacgcaccgtggggcacggcgcagtagcgcagggtgtgcaggagcttgctggccggcccagcacatcgagccacggtgtcggggtgggtggcctcgccggcaagcggggtgaccagcacctccagcgcaaactgcggagggggtgcgaaggaccagggtcaattgaagtggcggtgatgggccaaggtggggggtcatcgtggcgttgcacattcctttctgccatccaagggggggggggggggggggggggnnnnnnnnnnnnnnnnnnnnnnnnnnnnnnnnnnnnnnnnnnnnnnnnnnnnnnnnnnnngttgccctccacacaggacccagcagcttcctcctggcgcctgacgcagtgatcacccctgcccaagaggaaagaaagcccgacctggagcatgtgcacaaagggctgcagcaagtcctgcggggtcgagggcgcgccgccattcccgtcgtcatctgcgtccccggcggcggccagggcgccgcccgcagccgcggccgtcgccgccgccaggtcggcggcggacggcaggtcggggtgctccgccaggatgtacaccagggaagccagcaggaagtcgggcaggtcccgcagcccgggccccggcgcggcagcgccggccgcatcgggcgcgcgcttggnnnnnnnnnnnnnnnnnnnnnnnnnnnnnnnnnnnnnnnnnnnnnnnnnnnnnnnnnnnnnnctgcgccgcgccacgatgacgtaggcgcgcagcgcgcgcagcgcggccgcctggttctccggcactgggtcggcgccgccggccatggccaccacggccgcgtacttgctggcccggcggggatggccccccgcctgcaatgacgcaggagaggtgaggcgattcggagtggggtgggagctgggatgtgcagggggggcctgcccgggcggacgcaggtgggagtgctctgccgggctgtggactcagggaccgtgtgccatcgactacgctcgcacccttgtgccacctagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacggagcgatggatcttaaccagcagggcggcgcgtggctccgcgtggtagtcgcagtacgcctcggccagggcgctgtactgccggcggctcaggttgccatcgtgcgcccgggccaggcggaccagcccggcggcggccgcaaacctcacggcggccgcgtcggagctgccaaagtcggagcggtcgccttgcagtctgggccagtcgagtggggacaggggttggcggtttgtggagcgatgatgccagggcagggcacacccgggaagccccgctctccctggatgccactccgcacccacccaaagtcgtcaaagacgggnnnnnnnnnngagtcgagtggggacaggggttggcagtctgtggagcggtgatgccaggggcggggcacacccgagaagccccgctctccctggatgccaccccgcacccacccaaagtcgtcaaagacggggtctgtggggtcgttgttcgtcagcgccaccaccgtggtgagcaccctctccagcgcggcatcgtgggtgggcgtgggctcatgcggggcgtggacagggctgaaggnnnnnnnnnncagtgagcaccctctccagcgcggcatcgtgagtgggcgtcagctcatgcggggcgtggacagggctgaaggcttgcgtgaggctctgtggtgggaggggagggtgccgggtctggaagctggggcattggcctggggcagtgcttctagggatggcnnnnnnnnnnggagggtaccgggtctggaggctggggcgttggcctggggcagtgcttctagggatggctttggccccacactcccctctcctgggggaggtatgtccttgcaaccccctggaagaaacacagtttgctgtccaaacccccttgcatctatgcgcaggggcttgccttgacaatgagggccttgatggccnnnnnnnnnncacccaacaacgacgcacactggcaccactgcttgccagcgatcttgacactgnnnnnnnnnnaacccaacaacgacgcacactgacaccactgcttgccagcgatcttgacactgnnnnnnnnnncgggggagatatgtccttgcaacccctggaagaaacacggtttgctgtccaaccccccttgcatctatgcgcagggccttgccttgacaatgagggccttgatggccacctgggggctgggtgagtcccacgacagcccggtctgggagcttgccgcatccaggggtcggcccctgggttgacgggcgggaggacggcatgtgcatggtttgactgccggccatgannnnnnnnnnnnnnnnnnnnnnnnnnnnnnnnnnnnnnnnnnnnnnnnnnnnnnnnnnnnnnnnnnnnnnnnnnnnnnnnnnnnnnccaggagacctggtctgggtgaaacagcgcctggcaatcccttgcttgtctggactcccccaagctccctcacgtgttcccaggacggatgtttcagatccccagtacctgctcaggtcggccgggaggagctcgtcaaggaccagcgtgacgaagcgaggcgccaggccattgaacgcctggggtgctgacctgccaatgctggagatcaccttgagcctctgctttgacggggcggaagaatgggaatctgaaggttctccgagcaaaagagctgtgcccaacgaccacatccaatcctgggcatgcctgtagattgtgtgcaagctgacgatgcaaccatgccagtcactcttttgagggccgagctcattgcgcttgctcaccgtcgccagtctcttgtgatcctccagggtgcccggaatggaaagcacgacttcctcccccaaggcgctaaacatggtccttgcctcctcctgtggcagcagggtcacggccgcgcgtactgccgacttgaccccggccaccgtgccatgcaggcatatctctctcaggctggccttgacctgacggcaggggttgaggcggatgcgtcgaggaggccggactcgatgcaggaccaatctgccagacagcgcatcagcaccacctcggctaggtgtgagggtgctggattctgacaatgattcagcttgcgccgcaatagaggcgatccgcaacggccctgcctcccggaccccggcacagctgactgtacctgtgggtatgcgtcagcagggacctccagttcgcgtcccgcctgggccaggatctgcgccccaaactctgccacctcagcatcgtcggacgccagcagggcgagaaggggagctgagtgagcgcccagtagccggggcgcaaaggccgcaacccccctgatcagatctcggactggagcgaggaaaaggagacggatgttgcagagggccgtcattcgtcactgatcagatgcaaggacttccccggcaggtgccagccttcagtcccaggcgccagcacagataaggagccccaggccaggcccccatccgctgccctccgttgcactcacatctctcgtcagcctcctggccctccaaggcctgtccgagcacctcgggcgagatgaggttcggcagggcttgcatcgcaagcgcccgtgccacatcagcgtgccgcgtgccgacacgctgtgtggggggagcaaggggtgggagcgccgcttgggtgcaagagggctcttgacacagcgggatcaaggtccggacggcaagagatgctcgtcaatcccacgcagtggtcatcatcccgttctgccaaccccccttccgccacaccccccctccccgcttccacacatcattcggctccaccnnnnnnnnnncgccaacccccctccgccaccccccacccccccgcttccacacatcattcggctccacccacccggatgagctcggcctgcgcctccagtccctggctcagggtcgagcggctggagctcagggtggcgaggctgcgcatcaccgcccgttccctgctttccagcatcgcgacgatgctctcggccgccttgccgtgcgtgccgagggccgcagccagacgctgggcgtgctgagccagcggggacgcggcgcgcacctgacccagggggtttggcgcagatgaggcgctgctgtgctggctcgcagccgccaccccccgggcgaggcgggcctggaactcgcacttggcccccaccacgcctccgaacgcggcccgctggcccgggtctgcagtcggagtggtggaggtgggctttccggtgacgaatgcaggagcgttgcgaaccgggtcacagtttactcgagggagaccgccgcatgcgccccactgtcaggcgcatgcgctccgcaccagccatcccacgcccacgatacgggcccccttccgttcnnnnnnnnnngccgggtctgcagtcggagtgcttgaggtgggcttttcggtgacgaacgcaggggcggtgcgaaccaggcctcactttactcgagggagagtcacgcgtgcgccgcatgcgccccactgtcaggtgcgtgcgctccgcaccagcgatcccacgcccacgatacgggcccccttcccttcaccccctgccccgccagccatctcacccaggacactccacagcctggcccaccacttggccacggccccaggcccctgcccggggtcaaagaggccgtgcaggcagagctgctccgtcgcggcggccgccagctcggcgtcctgccgcgccgcggcgcacgccacgcacagcaggaccgccaacctgagcaccggctcgcgcgcgtccggggacgcctccgcgctgcgcccgcggcacagccgcgccagcgcg

SEQ ID NO: 26385 - DNA, 67 bp, Chlorella protothecoides
aagtgggaatggaccgtgtcacccagcagcactgactgcacaagttgttactgcattccatgcaaat

SEQ ID NO: 26386 - DNA, 139 bp, Chlorella protothecoides
agtgggatgatatataagcagaatgttcttagctgcgctcctgtgtagtagcactcacccatcgctggtgtggactgccccccaggaggaccgacatcatccgggttggtgcatggacgggcagcatcggtgcatgtgt

SEQ ID NO: 26387 - DNA, 505 bp, Chlorella protothecoides
  modified_base (162)..(380): a, c, t, g, unknown or other
gcgtccaggaagacctcattcttcttgtatcttatgctgtcctggcgccagccgaccgcgcccgtcacctttggcaaggggtcacggcatgattggatgcaggggaggcaggagatcagacaagttcatagcaaccggagcctgataaccaaatgaacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagttgcatggcatcccagtgcttacccacatagtgatcctagaaccttcacgaccaccccagcatctcaaggatggacaaagctgcacttctccccccatttccccgctgcggcgggccccc

SEQ ID NO: 26388 - DNA, 61 bp, Chlorella protothecoides
tgcagaacgtgttccgggccaggcggaccgtactcattcaccttgtgtgaaattgttgttt

SEQ ID NO: 26389 - DNA, 61 bp, Chlorella protothecoides
gtgtgggctggcagcgaggggccctcacacaggatgcgatgtctggatgctggggctgcca

SEQ ID NO: 26390 - DNA, 94 bp, Chlorella protothecoides
catgtgatgctgaagggtttcaacctcagtgccggggcagctggtgagaggaatctcctggggggcgggggcagcctccagggggtgctccatc

SEQ ID NO: 26391 - DNA, 109 bp, Chlorella protothecoides
cacagcctccattccttccccagttgaagataccccacctccccctccctcccaagaatacccagccagccaccgatccacgcgcctgtcttgtccaggccgtagtcca

SEQ ID NO: 26392 - DNA, 63 bp, Chlorella protothecoides
gaggacacagccaacatggagtgcgtcctgaagcctacaccagcacgctgtgcaaatggtgct

SEQ ID NO: 26393 - DNA, 114 bp, Chlorella protothecoides
atgtttgacagtggggatctagatcttgctttgcttcgtggaatgtttgtgaaaatggtgtgatgtaaaatgtgttgaaagacaccaatggaaacatcttgaagggagccacgt

SEQ ID NO: 26394 - DNA, 93 bp, Chlorella protothecoides
cccgcccagtggtgcggaggtccagggcgcgaggcccccggcaacgtaatcctcgcactcctgcgcaatgtgcaaccggacccgacatcattg

SEQ ID NO: 26395 - DNA, 84 bp, Chlorella protothecoides
accgcccccgggggggggggggggggggggcagtgatgttggtgtgtgtgtttgtatctgtgtgtgagtgctcgataagtttat

SEQ ID NO: 26396 - DNA, 72 bp, Chlorella protothecoides
tatctgtgtgtgagtgctcgataagtttattgcgtcttttggggttgggcgatgaaggagactccaggcggc

SEQ ID NO: 26397 - DNA, 139 bp, Chlorella protothecoides
ggcgaaacggcacaggacctcgcgcccaaggcctggagcctgcagccagcctgaggcgctgctgcatgatgtttttgcaccacagcactccagcgtcccctgcaagcgtcccccaagagatcagcacggcaacccccct

SEQ ID NO: 26398 - DNA, 189 bp, Chlorella protothecoides
ggggtgtggggtgaactgggggatctcgaaggaattggagccttgaatggaccatctcgcccgcgaggccaagcatggaactacatgcacatcaccatgccccctggcaacccgcggccctgcctcagtgcaagggcccccctcttgctaccactgatgcagccattggacacccagcccccaacactc

SEQ ID NO: 26399 - DNA, 73 bp, Chlorella protothecoides
cctgcggcgtgccatggcccatgctgggagccgcacactcaccttggcacggcgcacttggcagctgcatcag

SEQ ID NO: 26400 - DNA, 75 bp, Chlorella protothecoides
ccccccccccccccccccccacacacacaatcacaccaccagactgcacccaagccagcaagacaaacccaccct

SEQ ID NO: 26401 - DNA, 61 bp, Chlorella protothecoides
gggaaacacgtgtcgctcatgcagggagggcgatggtgcgcactacgtcatagcggttgag

SEQ ID NO: 26402 - DNA, 103 bp, Chlorella protothecoides
caaacaaggaaaccacagcaccggtgtgcctacaaatcacccacatcccaaacctctctgatcgtcaacacacgaggcccacctgtaaaaaaaagtattgtca

SEQ ID NO: 26403 - DNA, 126 bp, Chlorella protothecoides
ggtgtgttaaagtgaccatttcaggcagaactgccatgatgtcgaagccacaaccacaacccaggcgccaatccttcaaaatgctcccctctgagtacgaacccggcctgagtgagctggctgggg

SEQ ID NO: 26404 - DNA, 64 bp, Chlorella protothecoides
gttgttggacaggtactgcgccgccaggcccgtcaccagcggcgtcgcgccgaacgccctggtg

SEQ ID NO: 26405 - DNA, 6274 bp, Chlorella protothecoides
  modified_base (1197)..(1206): a, c, t, g, unknown or other
  modified_base (2395)..(2460): a, c, t, g, unknown or other
  modified_base (2990)..(2999): a, c, t, g, unknown or other
  modified_base (3422)..(3431): a, c, t, g, unknown or other
  modified_base (3809)..(3818): a, c, t, g, unknown or other
  modified_base (4016)..(4080): a, c, t, g, unknown or other
  modified_base (4340)..(4564): a, c, t, g, unknown or other
  modified_base (4683)..(4692): a, c, t, g, unknown or other
  modified_base (5177)..(5186): a, c, t, g, unknown or other
  modified_base (6060)..(6069): a, c, t, g, unknown or other
tccacccagcccctcccctccacccagcccgcctcctccacccagccccccacctccaccgccaccacgggcatctgctacagtcgaatttggtgctgttgccagtgggaagatacccatcacctatgtggtgaccactgggggatacactccctattccatcacttgcaacctgtactcaaatgtcttttacaaactcacgaccacgtctgatccatcgcccacttcttctgtctctacgatctcgggggacccacagtatgagacgatcgtgtcaaagtatgtttttggctctgcaaccctcttcttgagtgcaggtatcatcgatgagattgtgccgctgacaatcgtcaatccgccctcccctccccccatgtcctttcctcaccccccaccagcacttggacccattactggaagcgtctcaaaatctgggaacgacttcacattctcaatcaattttggaagcgtcgttccttacagcattggggtcgctttcttcactggggacaatgcactggctcaagcgggaaccgaatcgtacaccggctcaccgaccacttttaccgtgacgcttgcggcaaacttggtaccctttgtgtcttatgcccaagttgtgggatccaaagaggatagcagcaccacgaatgccctgactctgaactggtagatctgatggatcgctattgattcatggctgctacaggaactcctgcagtacctctgccaagctttcccattcctgttgcatcattccctacactaaagcgtggacataccaaaccaagaggacctgcctgcatctgtagttatgactgtccccatccttgtccccaatgtaagcatccgctcacttccaggcaagagctgtagatcccaagccgcacctcggtattcccacgctaccccccttcccacctgttccggtcatactgttgtggtagtcaatcgtgcgctctcctggcattcggatgttgtccttgtgaagagcactccaaacaatgtcgaaaaaacaagctacctcagttgcttcggggtgggccaaaaatccacctaaacccgacgcaacgagcatctgtgctgcacccagatgttgcccaccctgcaacagcacatttcccccagtccctctcgcgcagcccatccatcctcgcgcatctgtgaatataaaggagcctggagtgttgtaatgacctnnnnnnnnnncaatagcacatttccccccgtccctctcgcgcagctcatccatcctcgcgcatctgtgaagataaaggagcctggagtgttgtaatgacctggccgtgggtaatatgtaatcctgttggtacattgatggagcaagattgctgaaatccctcgaagaccgataggcggaggtgcccgagcgatcactgccgcactgcttcaccatttcacagcaggacgccgcacgcaggttgtagggaggagggttctgcgatcagtgtttgaaagccctcgaaaaggtggagggtcgaatctcgaaccccctgttgagcttccacaatattcaactgagagtatgggggcggattctcgtagcgatattcgtccgagcttcgtgggcctcgttgtagctgccatcttcgtccctcccgctgcggtagggggctggtctggtcctatctatgcttgaaccctgattagaagtcgatgcaaggctttcatggggccacggcatcttccagcactcgtgtaacttcgcacgagtgaatgcacagttgttactcccgtccactgcgccccttcacgccaggtgctcatcaatcgaaatgcttttgacacccacttcttcatcaatttgatcctgaccttcctggcttggattcctggtgtcatccatgcgctctggatcgttttcaaggagccagcagacattgacaactacttgcacgatccactcactcgacctggggcccttgtgtgagtgacagcccatagctctcccgacatgttccacaattacctgtacaaagcgcagacaagattcacttgtcaaaccttctgttaccgtgcccagcaacgccagaatgtcctactacccacagtatgcttcctaagtgggcagcaccagatatgtagcgcttgccaacactgtgtagtattgatgtagagtcactgcgcttgcatgccaccccaggtgagctcaggacgcgacattgaggacgggtgacaggttctgtggcgggggatgttgaagtcctacagcccatacaggaggacttgtgccgactgtagggtatcttcaacgggatatggcacttcagcaaggatctaattcatgcataagaaaccccacgatcataaagctcaagcctgctgcttgagcctgacgtcaacgtctccttctgcgcgcgcacccggctcggtcccgttnnnnnnnnnnnnnnnnnnnnnnnnnnnnnnnnnnnnnnnnnnnnnnnnnnnnnnnnnnnnnnnnnnacaggacgcgacgatttcatgggaggccgcagtcgtgagtggccagagccaaagttcatcaagggtctgtcgacctcgcctcgcggcctggttgccaacttcacccgagtattcctggccaccgaagtgcatagcggaggtggtgatcggcatgttcattcttccaatatcagggaagcctcagggaagcccgccgccccctcaaaaaccccacattaggtggacagttgatgaccacattttcatgcaggaagccctggcccaggtggggctagacagtgcgtctgcctctgtgggagccggtgcctcatacccgtcacatcctggggacagcctcgagcctgccatccccctcgcaatcgaatctgcaggcacgctttgcattggctgaggaggagatcccagtcgggtgagtatggaatcaaggcgtccgtgtgttggttctcagatgcagtgttcttagcgagcgggatgccttgatgatcaggttcttacatttatccatagatgcgtcatcgtgaaggatggannnnnnnnnnctcccagatgcagtgttcttggcgagcgggatgccttgatgatcaggtccttacattcatccatagatgcgtcatcgtgaaggatggaacagtcagggccagaggcagcaataaaaccaatcacagtcggaatgtgcgttgggatggctggatctggttgatgatgttgtctgtagggctgcgctgcacttcctcgaggagtttgaaggacgaatgcacgtgattactatttcctcgggaccaaggagactgtcccttgtgtgcatgagcagagtattctcccgtcacctcaccaaaccaccccctgtctcatcctagatagtcctttcccccctaagccgcatgccattccctctcccaatcagggcacacggcatgccgaatttgaggcgattgatgctctgatcagggagcatggcggannnnnnnnnntgtcacctcaccaacccaccccctgtctcatcctgaatagtccttcaccccctaagcctcatgccattccctctcccaaatagggcacacggcatgccgaatttgaggcaattgatgctctgatcagggagcatggcggtgatgcagcagccgttgacttcccttcctgctcgctgtacgtcacctgcgagccctgcatcatgtgcgctggcgcgctgagcctgctgcgcttcaaggacgtggtctttggctgccccaatgacaagtttggcggaaacggcagcatactcagcgtgcatacctcaggctgtggtggctgcagtgatgcaggctggactggcggcttttatacctccaggggtggccttcttcgggatnnnnnnnnnnggtgatgcaggccggactggcagcttgtatacctccaggggtggccttcttcgggatgaggccatcctcctactccagcgcttctacagtgctggaaaccctaatggtatggagttcatggtgatgtctgcagggatccattgtacgatctgggaggcaatgtgttgaaaacccatgccacaccagccgttggacatnnnnnnnnnnnnnnnnnnnnnnnnnnnnnnnnnnnnnnnnnnnnnnnnnnnnnnnnnnnnnnnnncgacaccatcccatgcctccctcgccggtttcccctctttgcagcgcccaagccgcacagacctgtgaaggatcgcagcatcaagctggctgcagctctggcgagccattccagggacaatacccaagatctccactgctagcactggtcctgttggagcccagatcatctcggcagactgccgcctccaagccagggctgcagggagattctgcactggctgtgcatttggagattgtcatgtaaataagctaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaggtggaagtttcgccatactgtgagcatctctaggaacctgtgatgagatgctccaaggagggggcagatttcactccccttccagtgaaggcgcgcacgtgagtgtcgatcgtgnnnnnnnnnnagctgcagggagactctgcactggctgtgcatctggagattgtcatgtaaataagctaatgaccctaagactgtgcccgagcttcactgcccatctctacatttctcttgcatgtccatccatgaaataccaccatgcctggaatcgtccgccctacttgtgaaatctgctgctcagcacgtcatcccactctcaatgcttgccatgattggcaacttaaatgtgagattgccagcatgcgtctgatacctcgagtcctcctgaccggaaggtggaggtttcgccatgctgtgagcatctccaggacccctgtgatgagatgctccaaggaggggcagatatcactacccttcctgtgaaggcgcgcacgtgagtgtcgatcgtggacgctggacatgtcccatcttctggccatgccaaggaacaaggttgattgtttcattcagtcctgatacaagcgctgcaaggagtgatcagggctggtnnnnnnnnnncctggccatgccaaggaacaaagttgactgctccattcaaccctgatccaagcgctgcaaggagtgatcagggctggtgtactccccagcacgtcgtggagctgccgaccgcgatcctggttggcgtgcaccttccctcgatgaattagcgcccctgccctcgtgcgcggtcttagctgcccttctgtggaactccgcgatgcagtctctcgtggcgcatggatgccctccccagcagcgcagccctctgtcccctgacgaggtctactccgccctcaccgcctccctgtccgctgatggcacgactcgcacccaggcccaggccttgctgcaggagtgggaagcggattcatcccccggcttcatcggatcactgctgaatatcgtgcatgaagtgaacagcgtgcctgaggtgaggcatgcagggtgcggtcatgccccatgcatggggctagggaactccaccgcttgacatcctagcaggtccttgcaccattccttaccttgcttgcaccaacaggaggcccgcctgatggccaccgtggtggccaagaacgccgtcggctcctcctggcgcaagatcatgggcacgcgggagtggtcgcgcgtgccaggtgcggcataggttgttgcgagggtgggaaggcccccaccaggctggacagcagtcggctggcccacaccttcactggccctgtagtgctctgaaccctccccaggcaccttgatgctgccgcttccaagggctatgagacatgcaggactgccgctgccaccacttctcgcccacctgccgactgaccgcaacttcacttcgctcccccccctccccacacacacatcgcgtgcagatgccgaaaaggcgtacgtgcgnnnnnnnnnngggaaggcccccaccaggctggacatcagtcggctggcccacacctttactggccctgtagtgctctgaactctccccaggcaccttgatgctgccgcttccaaggactatgagacgtgcaggactgccgctcccaccacttctcgcccacctgctgactgactgtatcttcacttcgccccccccccccccccccccccccccc

SEQ ID NO: 26406 - DNA, 61 bp, Chlorella protothecoides
ggcccccaacagtggaccaaagcgctcggcacccagccgcaggacaagggcgcaagggctg

SEQ ID NO: 26407 - DNA, 72 bp, Chlorella protothecoides
cgtgtgacgcaagctacgaggctgtccgctcagccttcacgatttcacaacgatccggaaccctggcagggt

SEQ ID NO: 26408 - DNA, 63 bp, Chlorella protothecoides
cttgcagaccaccggccaatgcacctcgcgtctttttcacagtcctgctgcattttatggggc

SEQ ID NO: 26409 - DNA, 61 bp, Chlorella protothecoides
ggacaggggtgggcacgggggagctggcggcggaggaggaggtgctgccgctggaacccac

SEQ ID NO: 26410 - DNA, 79 bp, Chlorella protothecoides
gattgaagcttgcaatccactggcaaaacagctccgtgttcgtgcatctctgccctcattccctgcactcccccccaaa

SEQ ID NO: 26411 - DNA, 68 bp, Chlorella protothecoides
agcacgtccagcgcggccgctcgcacggcgcccagcttggggctgcaggggcgcagggctgtgaggtg

SEQ ID NO: 26412 - DNA, 61 bp, Chlorella protothecoides
ttgagctaggccgcagttgccttggtctccacccccgacttctcaacccaccagtccacaa

SEQ ID NO: 26413 - DNA, 456 bp, Chlorella protothecoides
  modified_base (160)..(362): a, c, t, g, unknown or other
ggagggtcgggcatgtgggttgggcctgtgagacgcccctaggagggatgagattacaagcagcagggtccacaaagtgccactgagtggtccagcgcaacggctttcccactgcccacctgttattttactgctggtggcactccacatggggacttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcacaggcgaggcaggagagaatcggggtactttggtcatgagggagtggcgtggctgaaagcgttggggagctgggcttgagaccggacgc

SEQ ID NO: 26414 - DNA, 72 bp, Chlorella protothecoides
tccatcgtatgcagcatggaggccgtgaccagcatcctggttgatatggtcaccttcgagattaccttcgac

SEQ ID NO: 26415 - DNA, 69 bp, Chlorella protothecoides
cattgttgtggtgcctctgaatctggactaatctttatttaccgttgaaatgagcctgtcagattacaa

SEQ ID NO: 26416 - DNA, 68 bp, Chlorella protothecoides
caacgctgtgcgaggatgagcatggcttcgtcaccacacacacacacacacacacacagaggcaatat

SEQ ID NO: 26417 - DNA, 61 bp, Chlorella protothecoides
cgcccgctggaatccctgcgagcagcgatgtggcgcaacgatatcggtcattgtgcaggcc

SEQ ID NO: 26418 - DNA, 92 bp, Chlorella protothecoides
gggggtgcccttctttggaggaggtgaggagctcttctttgaaggaggagggaaggggctcctccttggaggaggagaggcggggctcctct

SEQ ID NO: 26419 - DNA, 77 bp, Chlorella protothecoides
ctcccccgacggttccatggaggataccctagtccaccccgatgcagtgttgtctggtgctgtccacaacccttccc

SEQ ID NO: 26420 - DNA, 73 bp, Chlorella protothecoides
gaggggtgacgccagaggtctgcaggagggcaggagtaaaccggccgagcatgacaccaggtgactctggagg

SEQ ID NO: 26421 - DNA, 97 bp, Chlorella protothecoides
gcgcttgattctggccaccagtgctgggcttgcaccacgttcgcttcgagggagtctggaatcaccccgggcaaggcagtggcaggcatggctgaag

SEQ ID NO: 26422 - DNA, 172 bp, Chlorella protothecoides
gttgagctgggtgcagcacgtctcgtcccccgccacgcccgaggaatagaactggagcgcggagttggcgcagatggccaccgacacgggctggtgtgcgagcgccttgcgcaacgcggcggcgctgcccttgggcacgtcctcgaagccgttgatggcaacgacgtggcgg

SEQ ID NO: 26423 - DNA, 3024 bp, Chlorella protothecoides
  modified_base (282)..(400): a, c, t, g, unknown or other
  modified_base (1191)..(1200): a, c, t, g, unknown or other
  modified_base (1556)..(1687): a, c, t, g, unknown or other
  modified_base (2013)..(2022): a, c, t, g, unknown or other
  modified_base (2561)..(2570): a, c, t, g, unknown or other
  modified_base (2934)..(2943): a, c, t, g, unknown or other
gtcgaccgcgccgccgtggccacgccgctggccgccagctgggcgctgagcgcgctgagcgcggccagctgcgcctcgcgcgtcaggtcacggggcggcgcggggggcgagtggggacccggggccccacccgcctcgcacttgacggccgcgaagcgcgtgccggccaggcgcttggcgggcgcggcacccggcgccctcggcgcgggctccggggggtcataggtgaaggtgaccttgatgcggccgggcgtggtgggcaggatggggatgccgtgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggggtgcagcgcgcccagcggcaccgaggcgtcgccggagggctgcgcggcgggggagcagcgcgccgcctcggcgccggtggggggcgacagcgctgtggcatggccggcggtcgcgtcgcccggaggactgcgagcgccgagcgcctgctggtgggtcaccgccgcctcgacagccgtgaagcggctgcggcgcttggtggccccggcggcgcgcaggaagtgcttctgagcgtggctggccacctgggtgggcgtgcggcttgggacatacagcaggctgatgtgcttccactgaccctgggtggaggagaaggagcggaagggcgcgtgagtagagaagggggggcacaacacggtgcggcgcagggggtggtggggtgatgctaacaacggcacggtggcatgtccaagggagtgcaaatgtcaagagccagaaaagtacttcgatgtcagtgcctggcagggaccgatctggctgagaaccgggttggccgcccgggaggtcattctgtcctctcatattccggcaccaccactacccggccgcgctagtgggcacacaccccgccaccttccccgtcgataccttcccgagctggcgcaggcctgccagaaaagcagcatgctctgtctcagaccatggctcgcctgccgaggagcaagaaggaagcagtgagaggtccggcacaggggaatctgcattacaccttgtgccggccttttgggctgcacaacactcgtactcccaccccctaccttttcgacactctttgcgcccgccaccnnnnnnnnnnaggctgcacaacactcatactccaaccccccaccttttcgacactctttgcgcccgccaccgtatcgctgcttctcagatcgagcgagttcttcgttcagggtgaggcgaggtggcagctcgaaaccggctagcggggaagcgcacatgcctgccgaccacacggcctgcgccgactagaaggtgcctgccggccccgtttgaagctccagacacagcatgcgagctgtgtgattttttccagttaccgggaggtgcaggcgaccagtcgggaggtgtagaagtacgtacagcttgcggcgctctcgacgacacgctggccctagagatctttttagatttgtattcactggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcaacctgacgctggtccggccggcaaaggaaaatccgaaaatgtagggttcagagcgaaaactcgccaccggctttgtgtggaggaatgggttcccaggactgtacggagacatccctttccctccacaccggactcctagcaccctgccgggtgatacttgccaaagccaaggagcctttgggccagtggtatcaagtggtcccatctcctttgactgtgccaacagcacagaatcttgggcgccaataaagttaccatacacttgacagcaatgttatacgactttaattggcggctacgcaggcagaggcctcctggtcnnnnnnnnnnaggttcccaggactgtacggagacgtccctttccctccacaccggattcctttcaccctgccaggtgatacttgccaaagccaaggagcctttgggccagtggtattgagtggtcccatcccctttgactgcgcaaacagcacagaatcttgggcaccaataaaggtaccgaacactcgacagcaatgttacacgactttcatcggcggctacgcaggcagaggcctcctggtctccagagcagcctctgatcctgagattgccgccgcctgtccattgccagccccggcgcgctttgccgccacctgctcggccgtgagtggcagccaatacaggctgggcttggcggcagtgcgcctgaacaggtcgtccagctgcagcggctccccgggttcatcctgtgcctacaggggacggaagttagtggtagggtttgtgttgagggtcagaatgcatatggtcgacttcaagcacagcacccctgcctggatacccctgagcccctctagaggattccagggccatgcatcaatgcacannnnnnnnnngagcacagcacccctgcctggatacccctgggcccctccggaggattccagggccatgcatcaatgcacagccttcctgagcaagcacaccaccgcgccaggccttgcatcgcctcgcacctgtgccggtggtgggcgggcatcggccacccgatgagcgccgggcgccgctggcgccgcgtcgccaccagcaccaggaccccgcctcgcggcctcaccgccgtcgctgctcctgcgctggagcagctcccgcaggtcccgcacgccctccagcggcccggccgccgcgcccctcgggccggcctccagcttctcacggtcccagggtcgcacgggcgccgccctcgtgccctcgcgcgcagcnnnnnnnnnntgccgtgcccctcgggccggcctccagcttctcgcggtcccagggtcgcatgggcgccgccctcgtgccctcgcgcgcagc

SEQ ID NO: 26424 - DNA, 61 bp, Chlorella protothecoides
acaacaggcgcccagccctagccccgaggaatctccctctccgagccctgaggagtcgccc

SEQ ID NO: 26425 - DNA, 113 bp, Chlorella protothecoides
ccactgctttgggggcaggaggtgtgcaaactcctgtgtattgcaggatattcctggaagcatccccagtgtgtttgttctcggatttgatacccaccctggaatgggtgggc

SEQ ID NO: 26426 - DNA, 63 bp, Chlorella protothecoides
ggcgccccacagtgagggaagccattattaaagtatctgcatggtttcagtttccattcgagc

SEQ ID NO: 26427 - DNA, 61 bp, Chlorella protothecoides
aacggactcaagaatgcatccgaccatgcccaggccttgtctgcctacctgtgcaaggcga

SEQ ID NO: 26428 - DNA, 95 bp, Chlorella protothecoides
cccggcgcctgccgcgacgcccgcgcccaccaacccagcggacgcggggacccccgcggtaatgactatggcccaccttttggagatggtgaccg

SEQ ID NO: 26429 - DNA, 61 bp, Chlorella protothecoides
ggaggtacggtaatgtggcaggagaagagcacctctgggtagccgttctatgcccttgtac

SEQ ID NO: 26430 - DNA, 103 bp, Chlorella protothecoides
tttcttacaatacagcaacgcatcaaaaccacatttcaagatgcggtatattatgagaataaaattggtcgttgggaggtgaggcccagactggaacgacaca

SEQ ID NO: 26431 - DNA, 71 bp, Chlorella protothecoides
tgccgacagagtccccaccaccgccgccaaagaagtcgccaccacctccgccgacggagtcgccaccacct

SEQ ID NO: 26432 - DNA, 113 bp, Chlorella protothecoides
gtcaagggcaagggatctggtcaatagtctgaggcatctcatccgtgaccctgaacaatctcctatcccacgttctcccacatacaggtgatggatctgtccacaaacgtcct

SEQ ID NO: 26433 - DNA, 70 bp, Chlorella protothecoides
aatgtttcggatgtgctgcgatgcccgcgcacccccccacttcttgccgacaagatcacctccaagtcgg

SEQ ID NO: 26434 - DNA, 197 bp, Chlorella protothecoides
gggaagcggcaaccaatgaggagtggggtgcggagggagggtggagggcgaggcatgtgaggacagagggtgagggcgagaggggtgagttgtgcgggcggcccacgttgcagagcgatgaattcttggcaggtgtgggtgggcgtgatggctccagcagcccagtggggctatgcttctcagactgattgtctggc

SEQ ID NO: 26435 - DNA, 66 bp, Chlorella protothecoides
ctgtgcggatggcggccgcgtccagctcgatgttctgggcctccagctccttccacagctcgaatg

SEQ ID NO: 26436 - DNA, 61 bp, Chlorella protothecoides
ggcgggacgggaggccggcctgcgaagagggaggggagtgaaggggtgatcgtagatgagt

SEQ ID NO: 26437 - DNA, 72 bp, Chlorella protothecoides
gcgtgccctcttggacacccagggacagccttccacgtggcagtcaagctcggggtccactcgcctgccggt

SEQ ID NO: 26438 - DNA, 116 bp, Chlorella protothecoides
atcttgtgctgcgcctccgtcgtgggtgttggagaccgagggtggcggcgtcctggcttaggacgcgcttcagccaccaccagtcgcgcctggaaaccgtcgctgtgccgtagctc

SEQ ID NO: 26439 - DNA, 75 bp, Chlorella protothecoides
tcatgccctgccaaggtgggggggtggaggtgagggcacctgtggcatcgccggcatcgcagtcgtgctgctgct

SEQ ID NO: 26440 - DNA, 205 bp, Chlorella protothecoides
cagctcgccaggggcgaggagctggggaggtaaggaggaaagaagggtgattgttgtcatggggaagctctggccatgttttgggagaaaaggcctctacccatgacagcttgcccatcagacaagcatcatgaggtcaagagtaaattccattgtactcagaagccttcacaacaagtcagtttattcccatccctctgcacct

SEQ ID NO: 26441 - DNA, 2066 bp, Chlorella protothecoides
  modified_base (93)..(102): a, c, t, g, unknown or other
  modified_base (525)..(534): a, c, t, g, unknown or other
  modified_base (1141)..(1150): a, c, t, g, unknown or other
  modified_base (1496)..(1694): a, c, t, g, unknown or other
cgccttcttcttcatctccttcttcttctttttcttcttcgtcttcttcttcggaagatctgggaagccgttccaggtcgtcttgatggaggnnnnnnnnnngcaggtcccggaagccgttccaggtcgtctcgatggaggttgtggcgtagtcaccgagcacctacagtttgtgatagcgcgggcacacggtgtcactatgtgtgtctgggtgtctcgatcagtagagccacgcatacttggggacactccagtggcccccgaagccccccctccaaagtggcacaccaagtcctctcacaccttcccaaatcggcctagcgtgcccgcctcgccgggcgccgtccgccactcgtccaccgtggcgtcgttctgcgcctgttgttccctcttctccgcatcgtccagcttgttgaccacgccgagtggcacagggggcgtctgagagtcctacaacacagggcgagaaaacacggggttggatgtgtgtatttgcctataagttgcagaataccaactttaagnnnnnnnnnngcctgcgacacagggcgacaaaacgcggggtgggatgtgtgtattcgcctatgagttgcagctaccaacattaagaatcacttcctcactccatcagagccatgcctgttgcataccgatcaaataaaccaactcagtccacccaacacaatcacctggcccgcggatgcaagaggtctcgaagtcgagggggcatcatccgccgccacgacatccacgtccatcggaccaggggtttgttgcgtgccttggcccggctgcgctggctcgctgttgtcattgggtgggggtgggtgggtgggtgggcaggtggggagggtgaggaaggactcctggactacctcgtgtcatctacagcttcatacccatgcacgtacccaagtgcatgcatgtacaagcatcgactcaacgacgcaaatgccacgatcaagcctcctcgccaacccaagcaagcgacttcgccacacctcggaggaggagggacagaggcggccagcgccaaccaattttgatgtatgacgtgtcggtgtttccccggctgcgactcgatccccgcacagcccatcaggcagttatggcgccggatggcagcctcggccgtgggcannnnnnnnnnaatgacgtgtcggtgttcccccaggctgcgactcgattcccgcacagcgcatcaggcagtcacggcgccggatcgcagcctcggccgtgggcacccagtcccgaggcttcagccggttgcccagcttggggagctgtctcggcctggccccaggcaccctgttgaaggagtggatgcgaggacagtctgcggctagacctccatgtcatggcaaccccagggggggggggttgccggtggtgaagattgcgagagacgctatgcctgaacgtcaacccaacccaatccacccaccccttaatataaccgcacataaagagtatcacactcacggctgactgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagaaaatccgatatgtttctccaagtcgacggtgagaccttaccctgaggatgtcgatacagtcggatcccgtccatgcaaccaccggatccaggacaacccaactgtgaagtcctacatttcgacttcccagcgcacgccggaactcaccaagacattatagatggtgaggatggcggcaaagggtgtttgtgggacacggcgaggtgtagacttcgggcgtgggtgcgaccgggggaggcgcacagggacagcgctgggtcgacactgatgccggaaatgggtggatccggtctcgtcaaaaataaacagtgctcagatgtacaaacaagataagatatcggtgcaaagtcggccagattctcgccc

SEQ ID NO: 26442 - DNA, 61 bp, Chlorella protothecoides
cagccccagccgccagcgacgtcgcagcgctccccccagccccggccgccgctcccgacca

SEQ ID NO: 26443 - DNA, 61 bp, Chlorella protothecoides
gtgacaggagggttggaggaggggtctggttgggtctggatgggggggccacgtggccttt

SEQ ID NO: 26444 - DNA, 67 bp, Chlorella protothecoides
cagcttccaggacatcatctttgtggggcaacgcacgaactacaagagcatcctctacaagacctac

SEQ ID NO: 26445 - DNA, 61 bp, Chlorella protothecoides
acctacgtgagagtgaaagtcaggaggctcggcttggaaggtggagcagagggtgcgttga

SEQ ID NO: 26446 - DNA, 3011 bp, Chlorella protothecoides
  modified_base (690)..(699): a, c, t, g, unknown or other
  modified_base (1840)..(1849): a, c, t, g, unknown or other
gccctccccccccaccaagcccaaccccgtcacgcacttgagggggtcggagatggggtggaagacggtgccgacgtcggactcgccgccgatgatgtccacgatgaccgaggggttgttgaagtggcagatgaccatgcggcacccggccgccgtcgcgatccccgcggcggtcagcttggtggccattccccccgtgccccactgcgtccccgcctccgcggtgtccaccgccaggtcgtgcacgtcgtccacctcgtgcacgggtgtggcggtggggtcggtggaggggttgcccgtgtacagcgcgtccacgtcggtgagcaggaagagccagtcggcctccaccagggtggccacctgggcggacagcgtgtcgttgtcgccaaagcgcagctgagccaccgccacggtgtcgttctcgttgatgatggggatggtgccgtagcgcagcagctcatggaaggtgttgcgcgcgttgatgtactgcgaccgcgtcgccaggttgtccagcgtcagcagaacctgggagcacgtctgcatcgggttgtatttatctaattatccatttgcttggggggagatggtttggatggggaaacgagtggctgggaactgaattagttgggaatctgagactggcatgatgcacaggcaggcacacgctcaccaggcccagggcggtgaagnnnnnnnnnnaaacctgggagcacgtctgcgtcgggttgtattcatctaattattcatttgtttggggggagatggtttggatggggaaacgaggggctgggaactgaacttgttgggaattggagactggcatgatgcacaggcagacacacgctcaccaggcccagggcggtgaagagatcgtcgtagtagcgcatgagatggatctggccgatggcggccagggcctgcttcttggccagctcccgggggcgggtggacaggcccaggcgctggcagcccacggccaccgcgccggaggacaccacgatgacgttgaagccgaggttgtgcaggtcgcggcatgtctccaccaggctggccagggagctcaggttcaggctcttggtgctggcacggatcaggctactggttcccaccttgatgacctgcaagggtgggtgggcacgggaggagagtgggcggcggctcgtgccagtcgcgccctcggggtcgggcagtggttaacgtgggcaccccacgccagtccgacaggggcccgcaccactgtctgctggcccttgggattgtgaagggcaccagagctgtcgatcttctccattttcgcgagatcgaggtggcggaggtgggtatgggtggggtcctaagtacgtgctgccggtgggtgctgccttgctgtcggtggtggggagtcggaggcgtcctggctacacaatctcaggctgcacgtcgagggcgagtgcagcaatttgtgtagttgaatcttcccagtcagacgcgaaccgagttgccaatgggggaacgtgaacaactttctatcttgctgctctgcatcgaagctgggagggaacccacccccgagtccggatggcgaagcccaacgcgcaaatctggcgggagcaggaaagacaccagggacagtgtgcactcactcacaggaggacctggagcaccagtactgtctgaatctctaggattataagccaggcgatacgggaccgtcagaaggccgctccgcctggcagcgacccggatgtctgccgatgaagggcgagtcgggaggcatctctgtcacctctctcgcctccgtcgcctatagaaattctgcattcaaatcaaacttgttcccccactcccctccagacgcagnnnnnnnnnntgagtcgggaggcatctttgtcacctctctctcctccgtcgcctttagaaattttgcattcaaatcagacttgttcccccactcccctccagacgcaggatgtccgaggacggagtgattccggagagggactccaggtccagggatggtgaccgggtatccagcgacaggaagcgggataggtcacgggaccataaggagaagcaccgccacaggagcaggagcgaaaggtcaccggatgccagggatcgggaccggcatcgcagcagggatagatacagggacaggagcagggagcgtcgaagcagcccatccaggtgtgggcctgtttcaaggagggggccctattgcatatcttgcagacacgcattgctgcagaggtcttaaaggaggactccctgtgcctggccggggagttgggtgggagtcctacgtctgcatgggtatgatttcagaatgcaggtctcagaatgtatgtccatatgattccctggtgtttcaaatctcacagagttctcctgccgcctcacctgcacgcactcccttctttccaaactcaaaataaacccaatccccccgtccctctccccactccctctgaagggatcgagcgcggcgccgaccttcgcccagccccccccgcttccggcgcgggcgggaggacttccgccgctccccaccccgtcgccgcgagatgacccctcctgaggtgcgagtgcagcgtgcgcgcgagaaggagatggagaagatggaccgcgacatgcgcaccatcttcgcttacaacctggcgctgcgcgctgaggagcaggacctgtttggcttcttcgtggccgccggcccgctgaacgacatcaagatcatccgggaccgcgcctcagggcgatccaagggcgtggcctatgtggagtaccagcgcaaggaggacgtgatggcggcgctggcgctgacgggtcgccccctgctgggccaggcagtgatggtcaagatgagcgaggcggagaagaacctggcctgggaggcggcggaggcccagaaggcgcaggccaaggacatggaggcgcggtatggcgcgcccggggccgacggcgcagcgccggcgaccgcaggcctggtcccgggcctcgccgccgcgccggccgtggacctgtcggacccggcggcc

SEQ ID NO: 26447 - DNA, 61 bp, Chlorella protothecoides
ttgagagtgggtgcctgcatgaaagtcgtaagggttcctggaaacttgccaggatgaagct

SEQ ID NO: 26448 - DNA, 78 bp, Chlorella protothecoides
gggaaaggtgcggcgctcgaaatgtgctacacagggctgcagcgcagggttggcatcgctcgcggacttgccagtcca

SEQ ID NO: 26449 - DNA, 80 bp, Chlorella protothecoides
tcgggcgtgccgcccccgcgtctgccgcctggggtgtcggcctcatccggcttccggaccgtcgtgcgtgttgctgcccc

SEQ ID NO: 26450 - DNA, 101 bp, Chlorella protothecoides
cctccgcctctccgccttctctcccccgcccttccaaatccaacgcccgccccacctcgtgcagtttgcaataggagtcgaggtcgccgccctcacacagc

SEQ ID NO: 26451 - DNA, 61 bp, Chlorella protothecoides
cgtcaatcgcccacggctgaccatgcacgccccctgtcccccccacatggcctccctccat

SEQ ID NO: 26452 - DNA, 70 bp, Chlorella protothecoides
ggtggagctaggaagtggcgggacatttcctgcatcagatgagaaagggaaggtgttgagtctgctgctg

SEQ ID NO: 26453 - DNA, 72 bp, Chlorella protothecoides
gtggagtgatctgggcaccccttgcgggttcaggcaagatgtatgcaaggctggcatggaggcagtgtgctg

SEQ ID NO: 26454 - DNA, 73 bp, Chlorella protothecoides
atgtcccatggtattctcctctctacaatttccccccttccctccccccaaacacctcagctgctcgctgcct

SEQ ID NO: 26455 - DNA, 108 bp, Chlorella protothecoides
ttgtgcatgggaagatagtcttgtcagacacactgatcatggtgagatatcagtcgagttgagatatctgacgttcgtccggcttggctgtgagagagacatcgcagc

SEQ ID NO: 26456 - DNA, 68 bp, Chlorella protothecoides
tctcaccacatgcagtggactgggacgcacgacccaaacctgtgcactgcatgcagcgcccaggcccc

SEQ ID NO: 26457 - DNA, 74 bp, Chlorella protothecoides
gattgcggggtctgccctgaaagatccgtctaagtccgtcccgggatgacaatcaacattccctgctccacgtc

SEQ ID NO: 26458 - DNA, 641 bp, Chlorella protothecoides
  modified_base (135)..(144): a, c, t, g, unknown or other
  modified_base (448)..(457): a, c, t, g, unknown or other
caagcgctccatcaggcggccacgctccgcacaacaatgacactcacagcatctgtcgctgtcccttgcgcaaaccctgacgatctcaagctacacgcacctcacacctgccccaccctgtccctccccgaagcnnnnnnnnnngcaacactgacactcacagcatccgttgctgtcccttgcgcaaaccctgacgaactctcaagccacacgcacctcccacctgccccaccctgtccctccccgaagctcacctcaacaaagttcttggtgtcgttggccatcgagaggatgctcagtggcacatcggggctggtgtcctacattaggacatgggagggccaggatctggacaggcttgccgaaccactataggtcctggccccagttcggcacttaatcaggaccaggaacgaattggacgagtggtgtgcacccacacaacctnnnnnnnnnnattcttggtgtcgtcggccatcgagaggatgctcagtggcatatcggggctggtgtcctacattagaacatgggagggccaggatctggacaggcttgccgaaccactatgggtcctggccccagctcggcactttatcaggaccaggaacgggttggacgagtggtgtgcacccacacaacct

SEQ ID NO: 26459 - DNA, 234 bp, Chlorella protothecoides
gaagtgagtcggaaggaggggtggtggtagtgggcctcatatggtgccctgtgacctccgcctggtggctcgcatcctcgacagaactcccttgcttcgaccgcttccccagcatggtcggatgtctttgctgctgcaacatgcccagcggccagcacccgcatctgcgcctctggacccgacgtgctgcccctcccccaccctctcccctgcccctcccacaggcgatgagtc

SEQ ID NO: 26460 - DNA, 173 bp, Chlorella protothecoides
gttgaaggagtggacgcgaggacagtctgcagctagacctacataccataggacaggggggttggctgatggtgatagctgcgcgagacacatgtgcactgatgtcgacgcgacccggtccgcccatcccgtcccaactgcacgataaaagtatcacactcacggctggctga

SEQ ID NO: 26461 - DNA, 61 bp, Chlorella protothecoides
gccgccgtgggccattgtatggctgtgatccctggatcgccatgctggttgccatccagtt

SEQ ID NO: 26462 - DNA, 103 bp, Chlorella protothecoides
ggaggagagggaggggatgacgggcttagaacgacccagagcaggggtggtctcaacatatgggggtccacgatcgatgcgccaacccggctccgcgaggccg

SEQ ID NO: 26463 - DNA, 61 bp, Chlorella protothecoides
gatggtgggaatctagagggcgtgcggcaccgaggccgaagcatgcatgtggtgcttaaca

SEQ ID NO: 26464 - DNA, 69 bp, Chlorella protothecoides
cagagacggggtgagagggcagagacggggcgagagggcagaggggaggatcgtcgtcctgcgccccgg

SEQ ID NO: 26465 - DNA, 80 bp, Chlorella protothecoides
ccgccccctcccgccggagctgaagggcgctctgtgcatcccaggtgggccccgccactctgtacgtgcgttgaggcaga

SEQ ID NO: 26466 - DNA, 61 bp, Chlorella protothecoides
ggctggcggccatggaagcactgatgcagctggtcccatcgccggcagttccctaggaact

SEQ ID NO: 26467 - DNA, 7010 bp, Chlorella protothecoides
  modified_base (671)..(680): a, c, t, g, unknown or other
  modified_base (2300)..(2309): a, c, t, g, unknown or other
  modified_base (3185)..(3194): a, c, t, g, unknown or other
  modified_base (3643)..(3652): a, c, t, g, unknown or other
  modified_base (4481)..(4490): a, c, t, g, unknown or other
  modified_base (4874)..(4883): a, c, t, g, unknown or other
  modified_base (5240)..(5249): a, c, t, g, unknown or other
  modified_base (5679)..(5688): a, c, t, g, unknown or other
  modified_base (6386)..(6395): a, c, t, g, unknown or other
  modified_base (6677)..(6719): a, c, t, g, unknown or other
ctggcgcctgccgccgcacgcggcgcgggcggtgccgtccctgcccgccgccgccgccgcggcgtccgcggagctgcggcccccggcctgggacgaggagggctgggcgcgggggcgagcggtgcaggccccgcgctggccgcccagctacgcagcgccggaggcggcgccggcgcgggagaggggcaggggccggcagcacggcggaccgcggcagcatggcgggccccggccgccggccaggagacccggcggtgccctccagggcagggccacaggctgatgggcagatgtgccttgaaatttccccttgcattggtgttaaactatcaagaagcggcgtgtaagaccttgaaacggtgatgaggacaatggtccgagctggctgccccatgtagttggcgcacacgacctgaggctgccctttccatgtcggtcggtccgtgacgctcggcgatcactcgcagaagggagcatttaccaccaatgcggtgcactgccttcttgcgacaagcccaccatgcgcacatgagatgtagactgccgacgcttgctcatgtcccagatggcgcgtggcattccaaggactgcggctcgggccctgagtggggggctggccaagggggatcgctgcatgagaaccagtgcagcgcctaagcctgccagcctcnnnnnnnnnnaggggggctggccaggaaggatcgctgcatgaggaccagtgcagcgcctaagcctgccagcctcccagttctggggcgggacatcaaagtggagattaaaacggtgcagactgcctccagacccatccgcatggtggttccggatgtcgaccagggtgaggcgcgcatgtgggttttttccgtgctgggagtggagggggggggcttttccagcccgggtcccctccttaaccctgctctcatgcgccatgtgaatgcccaccccagtcctgccaagtcaatatttcctgccccccccaaaaaatgacagtcatggagtactatctgtcctctggccaggactccagggacccctactggtgtgcggtctggccctccgcggtggcgatgagcgaccacctgaccggcatggatctccgccagctcagcgtgctggagatggggtgcggcctgggcctcgccggcatatcagcggccctgcatggtgggggtgcctggctgtggggtggtatgggccgctgttccttgcaccctgctgtcctcccctcggggtcctggtgtgctgccccgcaccttcagcaggacagcctgtgcgtctaggtctgcagcacgacttgggggcctggtgttccctggcccccacccccctttccctccccccacccaccgcctatccacccctcggcacaggcgcggcctcggtcaggctgtacgaccaggagcctctggcggtgcagtgcgccctcctcagtgcccagctcaatggcgtgccggtggtgcagcaggatcccggccccccatccatcgagctgatgccagactcttggtgggactgcctcggggaaggtcccccgaggccagccgcggaggggtgtaccccggtgtgtgccgcgcagtatgactggaactccgggctgggtttggcccccgcagatctggtgctggcatgcgacgtcctctatgactcagcctttgtcgaggtgggggaaggatggcagaagggcggggaggggggcggcggggagagctgcctaggcacagcagccggcctgacgaaaagcatcttgggagcatgtgactgcagggaactgtgggcgtgggatgtgccacccacacctcactcatttaccttcgtgaggtgaccctggcgcactgctgtttccaccctgcagccgctggcgcgcctgcttccaaagcttctggcgcgcccgggcagcaggctcgtgctcaccgacccgaccaagcgcacaccgggccaccgccggcagctgctggagcggctgacggggcccggcgctgacctggcgctcatgcagcggacagaggtggaggccctggcgggagacccgccggcctcagacgtccaggtccttgtgttgcaagccagacagccgggggacaccctgggagtgccactggacgactgaggaccaggtgcttgtcctgtgctggggagcatggcatgcagtagacagcgagtcacaatggacgtaaagacagcatggactgcgtgtattgcatgcagcacttcccatgtaggacatcaggtgtagaatcgtacatggggaagtctgactcctggctgatcgagtgtgctgaaacgggagcatcagattcgcnnnnnnnnnnttgtagaatcgtacacggggaagtctgactcctggttgatccagtgtgctgaaacgggagcatcagattcgcttcgcaacctgtctccatgcggataatgaaccaccccgcgatatctcaccccgcccactaatgcatgctgcagcacctccaaggattttgcggcattcacaggtcctgattcagacataagaatcgtttccatattgttcctcggacagatcggtgtgcagcagctcctgggccgaggcgaggagggaggactcccatgccgccacgacgacgagcccggcccctgaagggcgggccagccggccgggtgcaccacatctcatccacggatcagtgggcatccatgctcgagaaggcgggggaccgcctggtgatcgtccagtattaccagtccaccgtcctggtctgcaaacagatgcggctctacttcacacgactcagtgggcagcccaacttccagaaggtcatcttcgcggaggtggatgtggaggagctgcaggtgggtccctggcccggtggaggagggctgcgtgggttctgatgcctgcgtagtatgggaagagtgtgctgggggtgcagccaggatgcatggtctgcaggcatgagctgcagggcaaacgccgacgtcgacgcacaaagaccatcctccatcacagaaactggcgctggaggcgggtctggaccggatcccgacctacatctgctacatccggggcgagcccgtcgatgtatgtggctttgacccgcatggaggggtgtacttcatggccttgctctcaacaccgcagcgtgttccataaccttgacacaaaggccccactcctcgcacccacccctgcatccccacagaagtatgtcgggggnnnnnnnnnngtgacccgcatggaggggtgtaccacatggccttgctttcaacactgcagcgtgttccatgcccttgacacaaaggccccactccacgcacccccctccctgcatccccacagaagtatgtcgggggcacgcctgctcttgtgcaaagcctggttgatcagtgcctgtcaaaatactgcaacaccagccggagcgggaaggcagagctggcagtgaaggtggccgtcgccgtcggcgccgtgaccgcaggcgagccgggcctgaactccttacggaatgtgttctggtcggggggacggggcctcaggatcgtcctcgtgcatgcgtgtcatgagcataaactctccgaggcccctgcaccttctcagtcccgcgaggcctgacaaccccctccctggctggcccactccccgcaggtctgggcctgctctacctcctgcgcgccgtgnnnnnnnnnngttacggaatgtgttctggtcgggtggacagggcctcaggatcgtcctcgtgcatgtgtgtcgtgagtgtaaactctccaaggcccctgcaccttctcagtcccgcgaggcgtgacaccccccctcctggctggcccacaccccgcaggactgggcctgctctacctcctgcgcgccgtgctgttcgtggacgtggacacccagctggcaagcctgaacgcatccatctcgcgggccagggagcggtacagcgagctgtcccgcacgcgccgcaggcgcgcggcgcggcagcagatggaggtcctgcgcaaactggaggacaggcgggagaggctcacccggcccagcgcccggcagctgcgcgaggccgcggcgcgacgggaggcggaggagcgggaggcggcggcgcgaaaggcggcggcggccgagcgacgggcggcggccgcgctgaagaggagggaggccagggcggccgaagcgcggcggcgagcggaggcagggtctgacgactcgggtccagagtcggaggaggaatgacgtgccggcgccaggctggcatggacaccaagcggattgttcccgcgccctaggcctggcgcggcagcgtcgccggggggggcggccgcacagcacccacatccccagggtgtctgctgtccctgccaggtggatggttcccgcgcccaagcaccgtgcatgtggtatttcagccatcaaggcagttgcccaagcagtcatggaggttcagagggtgaaggccatcagctgcatctgtcgctcgaccagtctctgacattcggtcaggagcatgggagagagccagttccannnnnnnnnnttccctgccaggtggattgttcccgcatccctgcaccgtgcatgtggacagcgttggcatttcagccatcaacgcagttgccctagcactcatggacgctgagagtgtgaaggccatcagctgcatctgtcgctagcccagtctgacatttggtcaggagcatgggagagagccagttccaaatgcgatcagctgggtcgctggctcggcgggtggtctgtgaaggctcctgggttgccgcatgcctgttccatggccaggggccgtgcatggcctcatgccgcgagcatgtcagtcacgcggccgtcaggtactcggcctcatcccggcaggcgatggcgcgcaggagcggggtcatgaccaggtcgtcgtcctcctcctccnnnnnnnnnncggccaggggctgtgcatggcctcttgccgccagcatgccattcacgacgtggccgtcaggtactcggcctcatcccgggaggcgatggcgcgcaggagcggcgtcatgaccaggtcgtcgtcctcctcctccagcagcgcctgatttccctggggaggcgcgcttgcgtgcagggtttgcaaggcatgatgtttcccctcgacgggtggctcaaccatgccctgcacctggcaacagttcaggggactgggcgtgcccagtccacaggcccagtgcacctcctctgcactaccaagtctgcctcagcagccgattaccgggccgcccactcaccatgaaagatccgcagggcgttnnnnnnnnnnaagttcaggggactggggcgtgcccagtccacaggcccagtgctcctctgcaacaccaagtcatcctcagcagccgattaccgagctgtccactcaccatgaaagatccgcagggcgttccgtacacgctggggctgggtggggtggggggtgaccccccacacacacatccaaccccaggccgggccgaagtcacagaggcctgcagccactccagcaggctggcagcctgcctggcccagatgcccctcggctctggagcgagctgctgcagcgctgcacgcacggccgtctccagcaggctgggggaggcctccaccactgcagggctcgctccaggtcgagtcttgaggcgcggcaaggacctggctgtcattgggctggccgagtcgggtcgagctggcctgggccgaatgattggggtctccannnnnnnnnnccgctccaggtcgagtcttgaggcgtggcaagaacctggctgtcattgggctggccgagtagggtcgaactggcctgggccgaatgattggggtctccagcagatgggcagggagctcagggaactgggcagggggctcctgcgtgtgcgcagggagctctggaaggtgtggactcaggctctccagtgtgtccatgggccaggcaggctcctcccgaagccaagcgaagctctggctggtgctgctcgcgcatgatgctgcaggggaggcggacctcgcccgcaccccttcatcaagccagggatctggagtggcgagccaggaggcctccacatcgctgaaagcagccattgtggaagcgaatgattgtaagacctcgcagggggcggccttgcgcgtctccatgccctcgttgccaaggaagggctgggggctccgaggaaaagtcgaccgctgcaaattcatgggcgtcgtcgaaatgagctctttgaatatctcgcttgtatcaagcacaccggtgctgcactcaccgtcgagtttggggcgacattctctttaccaggattctggtcgggttgtgctcgttgcaggccagcgccctgcagccaggccgacataatgcatggattgactctgaaaatttcaataacatttgtatgcaaattgcttcgtgagatgtggtcatttgtttggtctnnnnnnnnnngggaagggctggtggctccgaggaacagtcgaccgctgcaaattcgtgggcgtcgtcgaaatgagctctttggatatctcgtttgtatcgagcacaccggtgctgcactcaccgtcgagtttggtgcgacattctctttactgggaggctggtcggcttgtgctcgtcgttgcaggccagcgcccggcagccaggccgacatattgcatggattaactcttaaaaattcaataacatttgtatggaaacttcttcgtgagatgtggtcatttgtttggtctnnnnnnnnnnnnnnnnnnnnnnnnnnnnnnnnnnnnnnnnnnnctggggtcgtcccggagttaacacatgtagagggctgtcacctcgaaaatcatacccgtcccaggaggggtggcacgtgctgccatgatccactatgatccctccaccggagtctttaacccaaactgcacagcagttcctagggaactgccggcgacgggaccggctgcatctatgcttccatggtcgtcagccatctacggatcatagacatggactattccacccacgcggcagatctaaatttcgcccatcaacccgccccccactcatcttcgactcggtttcttg

SEQ ID NO: 26468 - DNA, 68 bp, Chlorella protothecoides
gggacccttgatgcatgttgcggctgcaaccggtagctgctcaaggcatccttgacccaggttccctc

SEQ ID NO: 26469 - DNA, 128 bp, Chlorella protothecoides
caaggtactgctagattcagtatcatgcgtatccagggtgcggctgcttgcaacatctgaagtgcagctcccatcgtggacggcacatgcacaccaaggagaacaggcaactcccagattcaagagga

SEQ ID NO: 26470 - DNA, 110 bp, Chlorella protothecoides
ctcgcctgccgagcgccatctctgcatgtgcacccacgagcggcagtggcaccggagcgagacgtggcgcaatcttcaggccggcgcgagcttccaggtctggaaacata

SEQ ID NO: 26471 - DNA, 163 bp, Chlorella protothecoides
gcagaatgtggatgttattctctgggtcaccaggagtttggagcccctcctgggaggggtgaatatttatcaggacttgggcgtgatctgtggcggcttctttgcatgccatactgggcacctttttagaattccgttttgaactgcgtcaacgtgttcttcc

SEQ ID NO: 26472 - DNA, 61 bp, Chlorella protothecoides
aaaaccaccgacggagcggcggcgcccttggttcctcggtcgggcaggaggcggggcctgg

SEQ ID NO: 26473 - DNA, 123 bp, Chlorella protothecoides
gcagagtgaagccctccagcctccgctggagcaggcgctgcaggcctggaggcccctcgtttcacaccatgcaggcaggttgccccttccctccgagagaacctccccccctcacccttggct

SEQ ID NO: 26474 - DNA, 79 bp, Chlorella protothecoides
ccacgccctctggtcccgcgtcatgggccctgtgtccctggagatcattgagcgcgacgccacgcgcaccgtttctcgc

SEQ ID NO: 26475 - DNA, 557 bp, Chlorella protothecoides
ggcctcgcgctcggccgtggccgcgccgcgctcccgcgccagcgccgccagcgaggcggccagtccgtccatggccgccaggctggactgcacgaacgcgcagtcggcacgcagcgcgctcgccgcgtgcgccagccgcgtcgactgcgactcctgcgcggggtgggggcggggcgctcggggtgtgagcacgagtgtgggatggggcgtcgctgcgggcaatgcacggcgcgatgggtgagagggccttgccttgccttccggggccgggccccgccagcccggcggggcgtggagacatgcaccccggcccatgctgctcaccgtctcgctccctcccccctcccagtccgccggccgcctgctcccacgccactccgggcccccaacctcccccttccccctcctcacgatccctcacctccatctgcacgcgcacgtccttgagcaccgccacggccttggcgcggcagacccggcgcaggaggtccacgtcggcgcgcacccgctccgcgcccggcccgcccgccgccaccaggcgcagcgcgcgcgggttg

SEQ ID NO: 26476 - DNA, 61 bp, Chlorella protothecoides
gatattgttgctgcaaggcctggcgtctctagatacttgcttgatttattggcactctgaa

SEQ ID NO: 26477 - DNA, 2885 bp, Chlorella protothecoides
  modified_base (1132)..(1168): a, c, t, g, unknown or other
caccccccacccccacccccaggctcacctgcactcccccagcagcgcctcgatgttctccggcgaccccggcttagtcgtctccaggcgcttgcggtaggccctcaacgcttcatcccagcgctgcagcttctcatacctgcgtgcgtgcgtgcgtgcatggggtttggggtgagtgcctgggatgctggtggggaagggctgcgatgagcacagcataattctgtggtttcgagcccttcactccggtccacaggggtgctgctgagaccgcctgccgctccagacaaatgcaccaccttcagagccaatgccccacgtcggggtccgcaggcacggtctccttgtcaccttctctcaacccccccacccccccttagacggtatcccaccaggactccttgagggtcatttccttggtcttctgcgccgctgtgagaatgcccaccgccgcgtccggctggcgcaggtggttattgatgctgatgagcgcctcgatggccgtggagggggaggtgttgtactccagctccttgtagtgcagcgccttggcgtaggcgtggcacttctcggccagggcgcccagtgtcctgtgggtgagggtggagggggggcggtggtgggcgtttgacacggtcgagccggggcttgattgctctcgacgaccgcacgccaccgaccgctcacagccgtctgtcaagccttcccggagcagcacagcaccattcaccaaggcgccaccccgcgcggtcactcccataaatgaaaagaacatggactccctatcaaaacacccctacccctccacatacacacgtacaccgccccaaagtcacaccctcccacacacaccgcgtgtccaggggcagcgccttctcatcgtgctccatgaactctgcgaggttgagcagcgtggtcacgatgtcggggggaatggtggggctggccagggccgcctccagcgaccgcaccagctggtcctgcaggctctcctccagctccgaccagcaggagacaaagcccgccgcaaacagctcccgcgccatggccgggttggcctgttgtgatgggcagggaatcattgggtaacgggtgtgtgtgtgtggggtggggggggggggggggggggggnnnnnnnnnnnnnnnnnnnnnnnnnnnnnnnnnnnnntccccagttatgttacaggggccgcctcggatggtagcgtctcgctgccgcagctgccggggcccggcacagggtcctcagactcgtcgcccactgccacacaccatctgcctcgcttctaccacccctgccacacagtgaccattccccacaaccgcacctgggaaagggaggcgcaggcacgcagcgccttggagggcgactgcttcagcagctcgatgctgaagttgcgcatccactccgcccagtcgtccttggtgctgcgctggctggactcccaggcacggcgcaggttgccgacgccgtcgtggcggccgccattccgctgcccgccgatcgtgtctgtgcgcaggtgtggggtttactggcaagtttggaggggagcggcgaggccggaggtacgggatggagcggatggcctgaggtatgccagccaccgaaggggtcgagagtgatctgcggaaaagcagccgccgcggaggaaaggccagcgtcccacaaacaggcacaggctgcgggccactcctggccagctttgagcatgcggtactatgggtgccggcggggatcctgggacaggaccttttacatgggccccagccggggtttctgaccctccccagtcatacccttcccccctttctttgcccaccacaatctcaccgtacagcccctcgtcggcagaggtctgggagacgggggcggcctcgtaggcgtaccgcccgggcgtgttcaggtaccgcgccaggtgctcctcggccaggaagccgctgctgtgctcccagtcctccgcatccgacatgcagggcgggtcctgctgctgcagcttgccggcgatgcgcaggaaggcggcgtggggcggcatccggtgccgcgccaccgcctgcgggtggttgtttgggggtgaggggacgagcatgcatgtgctgatgcctgctcgcaagcccatgcctgggctggccgctctggtacagtccctggggctggagagcgtctgggggttgccgctgcgcatcctgggcacccacgcgcagcggcgtcgagctgcagacaccccaggcacgttcccccacctccaggccccccccaaacctccctgcaccttcttgatgacggggacgaagaccgcaaagtcggggccgacggccagggccacggcgcagatggtgtccagcgcccgctctcgcagctcttcggagctggagtccagcagtcgcgtcagcgggtgcagaatggccgagctgtaccctgttgagatttgaaggcgaggagggctggtgttcgactgaatgggcttccttccaacggcggggcacaagtgaccccgagggcgccgcagccgcgcagaggccatgcgcatcgcacgagcactcaggtatcgggtgctcgcctgcgtcatgtcccgtgttaccgtcctcctttacccccttttcacgcttcccgccacccccaaggccacctctccccaatgaatatggcacccacccacccacctgcaagctgcatcttgggcaggacctcctgcatggtcaccaacgtctcctcctgcacggccaggggcgcggccgaggcgccgggcgtgatgaggcggaccagcactggcagcagcagctgcaggctgctctccagcaccgtgcccagcgagcggatggcctccagcgccggtttgatctggaatgagtgggtgggtggttgggataagggggaaggggggggg

SEQ ID NO: 26478 - DNA, 72 bp, Chlorella protothecoides
gggctgcactcactcgctggggtaaaggacctcgcttgggatatcgatcagcgggtgtgcagtcaaagagca

SEQ ID NO: 26479 - DNA, 73 bp, Chlorella protothecoides
atcgatcagcgggtgtgcagtcaaagagcatgcctgcccaggagacagcttcctgtctgccccccaccatgca

SEQ ID NO: 26480 - DNA, 117 bp, Chlorella protothecoides
cagcatcgattgcctgcagaacagaatatgccatcactggaacatgagtcacacgcacataccttcattacttgctgcttctcaacgatgaacttgccctccttgtacttctgggac

SEQ ID NO: 26481 - DNA, 88 bp, Chlorella protothecoides
tatgcactattcaccccacaggtggagctacgaagtggcgggacattccctgcatcatagggaaagggaaggtgttaagtctgctgct

SEQ ID NO: 26482 - DNA, 1206 bp, Chlorella protothecoides
  modified_base (380)..(389): a, c, t, g, unknown or other
  modified_base (447)..(456): a, c, t, g, unknown or other
  modified_base (600)..(609): a, c, t, g, unknown or other
  modified_base (695)..(704): a, c, t, g, unknown or other
cagcagcgcatatgatatttgcaggttcgtcctgacctctatttggtctgaacactggaatgcataacaaatatgaggacattcctcatatggctggcactgcctgataaaccctccccaataaacgcattacagatggatgggctacgccaaggcgggctctttcagagagaccacccttcacgtccttggcgtttctgccagtgccataaaaatgagtccctttgagatcatcgagaaccagtccgcaaggatcttggtggccgttgagtgcctcaaagctggacagaaggcctgcagtgccgacatgaatggcaatattggtaccgggaataacggaaataacaactttggcgactacaacgacggcaacaacaacnnnnnnnnnnaggattgcagggatggcacattggcacttggacgcatggtttgatatgataagagtgnnnnnnnnnntgggagggggggaggtctgttggctttaagacatgtagctttcggagttgaaggtgcaggaggctgcccctgtccttctctgcccctaagtttagtatgttgacattcaaatgtgcagggaactccaacatgggagacctcaannnnnnnnnncgagtgtctcaaggctggacaaaaggcgtgcacaatggacaaggacgggaacattgggaccgggaacaaggggaagaacaactttnnnnnnnnnnacgttggcacttggacgcatggcttgatatgataagagtgcaggattgcaggcccccttcttcccctgccactgattataccatgcatacggccaaccatgcagggaactccaacatgggagacctcaactggggttacaataatatggacaccaatctgcggtgcaacaacgcgattggaactcggaaggttgtgaacatgtgcagtctgaaggaacttcgcaagtcggtgctcagggattacaaccaaccaccgccctcacctcccaagaagtcatccccgccgcccccaaagaaggcgtccccgctggcccccaagaaggcgtccccgccgcccctgaagaaggctcccccgccgccctccacaaagatgtcgccatcacccccttataagatcaccacctccaccgcaatctcctagtcctccactcccatcgccacctcccacatcaccctccccctctacgccatggtccatcctgccgcccccgccctccatcct

SEQ ID NO: 26483 - DNA, 81 bp, Chlorella protothecoides
ctctgtggagaggtctgcagggtgcacgaagcactgcatggtccaggccatcgccacggactcactcccgctgccgcggag

SEQ ID NO: 26484 - DNA, 61 bp, Chlorella protothecoides
caacgcgatgccgagtgccagtgtctcccagcgagactggggacgcagtgaggaatccata

SEQ ID NO: 26485 - DNA, 61 bp, Chlorella protothecoides
cggtctcgacctgcggatctttcggccggcacctgccaagattttagaaaccttctggggt

SEQ ID NO: 26486 - DNA, 80 bp, Chlorella protothecoides
ggagctggtggcagccatcacgctgcagtctacggcagacatcgcggcgttgctggccgccgcgcgcgcttgtgtggctg

SEQ ID NO: 26487 - DNA, 128 bp, Chlorella protothecoides
cttggtatgctccgctcagttaatggatttgacttcaagaactgtcagtgttggagtcattgtcatggtcatggtgtctggcacgccaacggcacccgcattcagtccgaggaagcatcctgtgaggg

SEQ ID NO: 26488 - DNA, 61 bp, Chlorella protothecoides
gtaagctggtgctggtggcgctccctgtggtgcagggcgcttgcccagaatcaatgacacc

SEQ ID NO: 26489 - DNA, 177 bp, Chlorella protothecoides
tttactggagagttgtgcatggatcgaatgccacgacattctgacgaagaggcgatcgatactcagggcaccctccacactctgatctctcgccgcaagcgtcgatacatgagcatcctcccccctcttgaccccttccccacccttacccatgcccaggtttcctacatgatcctc

SEQ ID NO: 26490 - DNA, 138 bp, Chlorella protothecoides
ctggtctgatgctcaggtgagggggtggggttccaggctcattcaggcgcccaggtgactccccatggcctccggggtcaagacacgctggcgcatgtgtgagcccttaccctccctcctgcaggaccccaacctgca

SEQ ID NO: 26491 - DNA, 4248 bp, Chlorella protothecoides
  modified_base (2233)..(2242): a, c, t, g, unknown or other
  modified_base (2315)..(2324): a, c, t, g, unknown or other
  modified_base (2473)..(2482): a, c, t, g, unknown or other
  modified_base (3585)..(3594): a, c, t, g, unknown or other
gtcgccgcgccctcctccaggtcggcgacgaagccggcgcccagggcgcggcgctgcgcggccacggtggcctcgcgcagcgcgcgcagcgtgcgcccgtactcgggcacgtacccctcctcctccgcgtccacgaatggggagaggtgcgggggcggggccaggccgggggcgtagcgctccaccggcgcgtgcacacgcgcgttcagcgagtcccacacccactgcggctggacgtaggcgcgggtgaggtggcggtggccctggcgcgggcggtccacgacctggtgagtgatgcgctcgtcgccctccgccatcgtggcccccggcccgtcccaggtggcctcgccccccgccgaccggatggtgagcaggagcagctcgcgcgggacctcccgccccaggaagaagaccaggccgcggaagagcgtggcgcacaccgccgtctcgtcgtcggggtccaccagcaggccgggggcataggagccggccagggcctcgtctgcagatcctgcgtcggctcccccgtcagagtcgccctcgtccacactctcttcctcctcctctccgctctcgctgcctccctcaaggtcctcgctctccgggtcggaggcgctggcgtcttcctcctcctccccgtccccggccaccttgtcgccagccccctcctcctcctcgccagaatcgatgtcaaactcctcgccctcactcccgtcctcgccctcagcctcgccgccgtcctcgctggccggcgcggcgagaccgcccgcgcccacgccgcccgccacctccgcctcaagctggcgcacgcgctccgtcagccggcgctgcacggccgcgtcggcggccgcctcctcgcgccgctcgggctccacctcggcatgggtgtcctccagccgccgccccgccgcggaggccagatcgcgcatgaccgcctccagctccgccgcgccttcctccagctccggatccagcaggggcgggtagcgcaggcccagcaggtggtacagccggaagttcacaaactgggggtgcgatgattggtgggggaggtggggcgtcagaggtggaggaggggatcgagggatgcgcagggcgcgcgaggtggggcagggttcctcaaccaaaaaaagcctttgaagtcgtcatgccatgcccctcccttgatccctcgacttgcccaacaaccgggacttccaccagccctccagcccacaatttcccaccccaccccagtgtccagattcaaacctgtaggagggtctggtagaactccaggaaggtgagcatgacgcggtagtccacgtcctgcggcagcacctgggacaggctgtgcggcaccagccaggtcaccgcctggccctgcacctcggcctgcaggtagaagcccttgaccgagacaaagacgcggcgcagggcgtgtgcacgcaccacccaggcctgccactccagcgccagctggcgcgcgacgcgcacgacgcgggcggggatgccggcgccgccctcggcgggcaacactgcgaacaggtgggccatggtcaacgggtcatccaggtcgcgcagcgcgtccacgaaggaggggtagcgctctcggaccaggtggtcgagcgcgtagcgcgggcggcgggcggccaggcgcgccgcggccgcggcgttcttctttgcgcgcgcgcgccgcaccttcttctcgtacgcgtgcagctcgcgcatcttggccagcaggggctcgtgcaggaggaaggcgatgtccttggcgtggtagtaggtcttgtgcgcgccctgggtcttgcgccgtggctcacgtgggtgcacgcccttgaggatgcacaggcgccggaattcgcccagcttcagctgcagtttcttcagggcctggttgcgggtcatgaactgggccgaggacccggtcttgccctgggatggatgggtggagggggggggaaaggtcggtgactcggctagaacggagtgctggacactggcgggtggggcaatggagcatgcggcagcccagcaccccaatgcagaaccaacgcccttcgcaccttcttttggatcaacatggtgctctgtttatgaaatcaacgacgcacagggcgagtgtaggggctgtcgcgcagagaagccactcgtgggtcgggggggcgcgccggcgccgggacaggtttctgcttgtaactcccctcgtattgtcgaaggcgattaattatgcatcgaagatccaatttacatnnnnnnnnnnaaaggtcggtgactcggcgagaagggagtgctggacgctggtgggtggggcaatggagcatgcggcagcccannnnnnnnnncctgtttggaactcctctcgtattgtcgaaggcgcttaattatgcatcgaagatccaatttacatatagcatgcgtgctgaacctcagcaagtggctgaaggcagcggcagtatcctcccccagtccccactgcgcaccccagggcgcnnnnnnnnnngggctgaaggcagcggcagtatccttccccagtccccactgcgcaccccagggcgcgaacatgcagaatcagcgaacggaagatcgcacgagggtttaacaaaccctgacttctcctccctgaatccccgtcatgatgacctgccgcaccacggagttcccacacttctctagggatcaagctctggcatctggcaccttcaagcgtgtttattggagcgggagcctgcgggagcgggagccgagggtagctggggagcggaggtggcgcagcaactcccgccgtgtgtccctggctagccgagcacgccgtgccccctggaactgaatgacgagtgtaatcaacttcaggttcaagaatgccttgcagcaggactccgtgagtttcgatggctccgtcatccaggtgggggacatcaagcgcctgatcgctgtcaagcgcggcttgggcccggagggcgcccaggagctcaccctctacgattcgagcacctccgaggagctgacggacgaggcgaaactcatcccccgctcctcgctggtgctggtgaagcgggcccccatcaccagcttcaagccgttgagcgccgccacagcgccagcgtccacccctgtcgctgggcagtccctgcccaccgaccacgccgtcgacgccggcggggccgcggatgagtttggcggggacctgtactccgacgtccctcccactggcattggcgaggaggaggccgcactgcagagcctgctggccggcacagccgccacctggcagcgtgaggtccggcagggcgccgcgcgcggcagagggcgcgggcggggcgggcgtggatccgtgccgctggagtaccgctgcccgaggtggggatacgaggtcgcggagcggtgtgcagttcccctgttgtgtgatggcaattttcctgtccacccccctgcctgcatcctcgcgcacctcctgctgtatgccagttccactggggtcgattgcggtgcgggtggatgtatggagcacctgcccccaaagtctgccgggaagtttgacgcgacaccagaccccgtgctcaagcggggcaggaaactgtccacagcaacaggggccctccagcnnnnnnnnnncaagtctgctgggaagttttacgcgacaccggaccccgtgctcaagcgtggcagggaactgtccacagcaacaggggccctccagcactggtgaataaaagcagatgcacccatgagcctgtcttccaggagccatgggatacagggcatctcccgcacaaatacccttgcaatttcctgcctccgtgttctggcttgcccttccaggggctcttagttacccgaaatgccccccacaaacctgcttccccttgcctgctctgctcagacgtgtggactttcctccccccctgttgctgcaggtgtgaggtggccggggcccactgggtgcagaactgccccacccagggcgacccggcattcgaccgcaagcgggtgcgcccgcccatcggcatccccctcacgcggctggaggaaagggaggaaggcggcctggtgctgcccaacggcgccacggggacgctggtgcccaacgaggacgcttttgcgcgggaggtgctgggcttgcccaccgcgacggagcccggcgcagacctgctagcgctgggcgtcggcgaggagctggcgccgtccgtgcagccggcgctgccggcgtcggggtccaagccccctccgcccccgggatccaagccccctccgcccccgggatccccg

SEQ ID NO: 26492 - DNA, 64 bp, Chlorella protothecoides
cgcatctgcaagatgaccgtctgacatgcatcttcatggacacgaggaatctataggggctaaa

SEQ ID NO: 26493 - DNA, 68 bp, Chlorella protothecoides
atggacacgaggaatctataggggctaaaacgtgatgcgttgaggaggttgagtcttcgagcttccca

SEQ ID NO: 26494 - DNA, 100 bp, Chlorella protothecoides
tttcctcccccaggctgtcgggcccgtggctgtgacgtccacccttctgggcaatgggctggagaagatctttggcagcctgtccaccgaccctaacaac

SEQ ID NO: 26495 - DNA, 70 bp, Chlorella protothecoides
aagttacgggccttcctgagcccccgagcgttatttgccgggtggggctaggcgccataagaagtgatca

SEQ ID NO: 26496 - DNA, 61 bp, Chlorella protothecoides
atcttcgaggtgatgattggaacagcgaaagaatgcgtgaggaaaaccgtgcaaacatcac

SEQ ID NO: 26497 - DNA, 75 bp, Chlorella protothecoides
cagagcttctgttgagtggccatcgacttaaaacctctattgcaaactctgggatagagccttgtcgccaatgga

SEQ ID NO: 26498 - DNA, 140 bp, Chlorella protothecoides
ctcctctgaagtcatagagcccccctgctttggattctttgcctgccaagcgtccaatgtccaccgcatgccatcgtctaccgccaggtctgtcggtgacgttctgcattgggcccatgctgtcctctgaggcggaggtg

SEQ ID NO: 26499 - DNA, 61 bp, Chlorella protothecoides
caaatccaccccctcccagcataccttctctatcaccagtatccccgtcccccacagcaaa

SEQ ID NO: 26500 - DNA, 61 bp, Chlorella protothecoides
ggagtcgaccactgactgtggcctatgcctatcgccaccacaccttgatccaagccgtaac

SEQ ID NO: 26501 - DNA, 110 bp, Chlorella protothecoides
cccgagccactgcgttaccacacagaaacgcctcttcagaacgtcgacgtcaccaggatggacatcaggatcggcaagattctggagtgctcagtccacccagatgccga

SEQ ID NO: 26502 - DNA, 65 bp, Chlorella protothecoides
gcatacatggacctgtcgagcggcatgttgagtgcgtgtgtgtacttgaggtctatgcatatgcc

SEQ ID NO: 26503 - DNA, 110 bp, Chlorella protothecoides
ggatgaagagggaatggggccctgggtgtccagtctcatgcagccagctgtggcatgcaaagtgtcaagtcacccctgcgtccctcaggtgcaagtgactgcgttgagag

SEQ ID NO: 26504 - DNA, 140 bp, Chlorella protothecoides
ggctaatcatcaggagctggcttccacatgccatcctgccaggctggtccgtgctgcatcgctttgcgttccctaactgccgccactctgctcgctgtggctttcatcccgagagtatcaggcaaacacaccctgagctt

SEQ ID NO: 26505 - DNA, 61 bp, Chlorella protothecoides
acagacgggacccacactcctctatcagtcactccggccaccaaactcggcttacctatct

SEQ ID NO: 26506 - DNA, 65 bp, Chlorella protothecoides
atggtcaggggtccagtcgggaagtatccacagccagggcttcccacaccaaaggccgccgcctc

SEQ ID NO: 26507 - DNA, 61 bp, Chlorella protothecoides
ctggcaaccccgcggctggtaggctgctggtgcatttttcttgtgtgatccttcgtggctg

SEQ ID NO: 26508 - DNA, 109 bp, Chlorella protothecoides
aggcagcttcccaggccctggcagaggtgcacggagtcgtggaggctgacaagaacggctccttctccatcaagactggccgaccaaggatcccttcaacctcaaggta

SEQ ID NO: 26509 - DNA, 113 bp, Chlorella protothecoides
gctgtgggcatgtgtctgacacatagccaggcaacctgccggttttgtggtcgaaaagcttgatttgttggaggaagactgtcccactcgtactactggataaaggctgattg

SEQ ID NO: 26510 - DNA, 80 bp, Chlorella protothecoides
aaaattcatacacaactacatcctacggtttgataaattactttgggaaatacagggctaatcctccaccatactcaatt

SEQ ID NO: 26511 - DNA, 71 bp, Chlorella protothecoides
gactgcatggtatttgggggggagggagagtgtgtgagtaatggaggaggttgcgcagctgcaggtggaga

SEQ ID NO: 26512 - DNA, 65 bp, Chlorella protothecoides
ttcgttacagaatttgcagacaaagatgcttaaaccacccgaacccctccctggtccaccgctgc

SEQ ID NO: 26513 - DNA, 61 bp, Chlorella protothecoides
atgcaccctgtatgttgctgtgcaaataccatgctgttgctgatccattgtggccaggaac

SEQ ID NO: 26514 - DNA, 413 bp, Chlorella protothecoides
  modified_base (102)..(337): a, c, t, g, unknown or other
gccacccaggactgtgcccgccgatcagagcggggtgagtgcatgccccaggcagtgcgattggatcgacggggaaccctatgcaccttgcagtctgcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaggattgcctgcgtggatgtgggttgggcagggactttcttggccagtgatgtatgcaatgtcatgtggaaag

SEQ ID NO: 26515 - DNA, 1826 bp, Chlorella protothecoides
  modified_base (1131)..(1175): a, c, t, g, unknown or other
cggtggcgggggggggcgggggggtttaaaagggttggtgcaaggacgaagggcttgaggagcaatgcaggcattgtcagggagaagatgcatcgtgcatgcacggctgcaccgccagccgtgcatgtagcaaccctcgtgacacccctgacccgggggactcctctcgcctacctggctcggctcggcagggagcgcaggcgtgccgcccaggcctgccaggaggtgatgacaaaggggtggtccaggaggcagtagaatatgatctgggcggggcagtccagggccacgcctgcaaacggcgatggtgggaggtaggagagggcaccgggttggttagcgatcaggcggcaggctggtgtgaatattgacaacgcggaagagccaacacatgcagcgagcatatgtggcccgcccagcgcatttcagtgcaggagtcgaggcatggctccatgcgagcgtcgcccgcacaggtttcaacagcctgatgtgcagggcacgaaatgtgcaagcccacctgcatcggcgcccttcagcatgccgtacagggccatgcccatgtccaggggcaggccggagtcaaacactgcacgccccttgtgcgtcgtgcacagctccacaccagcactgccgtcaccaggtgcccgggactctagcagccccttctccttgctgggtggggggtgcaagccagggttgggggctgatcagccactgagccagccccagaaatgaccgtggcaagtacctggtggtttgcatgctgaaacagggcaaagaacaaccagaggaggatgcagggcccctccagtccctgcaccacgcaacgtgttaagaagaggacaggatgcccacctacatcttcccctcccatgcaatcccagcagccgacaaaccgcgcacccccaccaaagagagtgaagggcggctcgagctgcgtgcaccagttggctccagggcctctgcctggatgccagggtgctgctcagcagcttcatcacgcccggctcatcccgtgccaggccagtggcacagccttccagcagtaggagctccatgtacgacccagctcctggccccggaagtgctgtcaatgtgattggcagagggggggggggggggggggggggnnnnnnnnnnnnnnnnnnnnnnnnnnnnnnnnnnnnnnnnnnnnngggataggcaacgaacatggctgacaggttggtctcagaggtgatcacaccgggctggttggggagcgggatgtggctggcaaacaatcaggaagtagcggtgccaaggagagcatgaggattggggcacaccgtgcgctgtagggacaagttgacagcgtcctgagcccctgctccaccaagtgtgcatcctgccggcttgtgttcatgcgctcaccgggtaggagctggctcgtgaggggcggcacaggttccacgagcaggcgactcaccgcttcccactcctggccgcccggcgcgcctgtgaaaggcgcagcggcggagattgcgtgggcagtgctgcagctggtccatgggcaggcttgccccggcgtctacgaccatggcagcagggcccagccctcacacgacagcagtctcacaccggcccgtgcacttacctctgcccatgaggaaggactcgccggtctgcgccaggcccgcccggccggcccgcccgaccatctgcaggtactgtgcgcgacgcacgggcccagggccctgatggagggatcggaggatgacacgctgcgccggcaggttgatcccggcggccagggtggacgtggccgtgaggacctggcgggggggacacaagggaggcgggggggg

SEQ ID NO: 26516 - DNA, 61 bp, Chlorella protothecoides
taccaaggaggtgaggagtgtgggggggggtggaaggggactgggggctggaagtggaggg

SEQ ID NO: 26517 - DNA, 62 bp, Chlorella protothecoides
cacctcatcatcgttggcacagacccagacggccgcgtctcgcaagaggccatgcagccccg

SEQ ID NO: 26518 - DNA, 61 bp, Chlorella protothecoides
cagatcaagccggtgcgttgagggggggggggattgtggccacgagttcagcccgtgatga

SEQ ID NO: 26519 - DNA, 161 bp, Chlorella protothecoides
cactagcagctggagacggagttattaggttccgacatggcttacaatagtgcgaagtgcattgccgtgtgtccacgttgtaagagacttgcagttgttgatttcccaaattatctttttgagatccgaggttcttacagaggtattgacgacagtgagag

SEQ ID NO: 26520 - DNA, 61 bp, Chlorella protothecoides
gctgatcctctgtgatgtcaaaatggatgggcttgtgccgggatagcgtgggtttcgggct

SEQ ID NO: 26521 - DNA, 73 bp, Chlorella protothecoides
ggtgtgcttgggtggggtggacgggggggactttttcaagagtgtggcgacatgcatctcaagggcagtgagt

SEQ ID NO: 26522 - DNA, 68 bp, Chlorella protothecoides
ttggctgggtctcgaacccgacctggggattggaccctcctgagcacatgctcggagccatgtgcgtg

SEQ ID NO: 26523 - DNA, 61 bp, Chlorella protothecoides
caccagctgaggagaataggaagccaaggggggggtcgggatcgattgggtggaggacaga

SEQ ID NO: 26524 - DNA, 73 bp, Chlorella protothecoides
cattcttccggccgtttgctcgctgggccccatcccacgccaacaaacccccccccccccccccccccccccc

SEQ ID NO: 26525 - DNA, 61 bp, Chlorella protothecoides
ccactcgaacagtgcttatgaggatgagtcagatcggattggcaaggcacttgctcgtggt

SEQ ID NO: 26526 - DNA, 61 bp, Chlorella protothecoides
tgggttggtctcctggcaacggcgggggggggtcctgtgtgttgactggagagctgtcctc

SEQ ID NO: 26527 - DNA, 63 bp, Chlorella protothecoides
tgggtttgtggatgggggttgggctggcaccaatatgactgccagtcacgagtcagcctttga

SEQ ID NO: 26528 - DNA, 112 bp, Chlorella protothecoides
ccccgttgtaggaagcagccccaggaaggcctgcacagagcctatgccacatacacaccgggccacccactgttgcacccccagcagggcatcccgccacccaccagccatg

SEQ ID NO: 26529 - DNA, 61 bp, Chlorella protothecoides
aaatggaaggttgaagtcttgttgcatccccagtgcatccatcctctcattccagattgtc

SEQ ID NO: 26530 - DNA, 105 bp, Chlorella protothecoides
gggggggggccgggggggggggggggggggatcacacaatgtggttggctgtgtatgcaaactccccccccccctcccatgcagccacatgtgcaggcctttggg

SEQ ID NO: 26531 - DNA, 160 bp, Chlorella protothecoides
caggacccaggccagggccatttcggccggtgtcaggccccactcccgcgccagctcagcgtactgcctgacggctgccaccactggttcccggcgtgcataccgcttgccgtcctctgaataccgttcccgatggagattcaaccttggggtgggtgca

SEQ ID NO: 26532 - DNA, 61 bp, Chlorella protothecoides
gcgaacacttctgaacgatctcttcattacacctccttttcggctcctctgcgactgctat

SEQ ID NO: 26533 - DNA, 61 bp, Chlorella protothecoides
gggagggatggtcgctgactccacatgcgcatgccagcactgaagcctgggcccagctgca

SEQ ID NO: 26534 - DNA, 159 bp, Chlorella protothecoides
ggggtggcaacccaggtatgtggtgggggggtcatgtcaagaatggggcgggactttgggctgatcatgtgcagcatgtgtgcttggaggggtgctgatgaggctgtcgcagagggctccaggctgctccaactgtctctggacagcttcaagcccact

SEQ ID NO: 26535 - DNA, 111 bp, Chlorella protothecoides
aaactgtccagcaccgcctgacaacacccaggaaagatcttgacgacgagagcaagctctggcatgtggtcttcccacatgtgcacaggctgattacacaaccgtcccagg

SEQ ID NO: 26536 - DNA, 3143 bp, Chlorella protothecoides
  modified_base (490)..(594): a, c, t, g, unknown or other
  modified_base (913)..(922): a, c, t, g, unknown or other
  modified_base (1446)..(1455): a, c, t, g, unknown or other
  modified_base (1657)..(1666): a, c, t, g, unknown or other
  modified_base (2003)..(2012): a, c, t, g, unknown or other
ggtgcgaatggacccggacttgctgaagcctttatgcctgcaaatttggagaggtgaacgagcattatcgggttgtgcttgccatagtatatggcagatggtatgtctgctcaatgtttctatagaacgtgtccagccagtggtgtgcaagcacattcaatgatgcgacccaccagtatgtggtacttacttgcagatggcatcagcactgtcgaccgttgtcagatacacatgggctcccagactgcaagggaatcgaaagtatgcgcgaattgttggcgtagggtcgggaagagacatgcgctagtggtccatctcaggtgcaatctatacgtgcgtgactggagaagcaggtctgtcggccctagagatatctgcatagggaccccaggctcgaccggactgatgtgagcgagggctctgtgttgacaatgacggcaagggtgacgcaccttaactccccgctctcttctcccacaacgaacaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgagcgaggaaactggggaagtgagcgaaaatggggcactcgcggaggggagcggacgtgggatcgacatcgaccagcgagcgctccaactcaccccaaaggcgcatcttgtaagcagcagcacgatcaaagctagtaatacaggggttttagcgggcggcgacatcccgcaccccgcggcgctgttactgttccgcccggctggctttgcttgtcgggatagggtgtgcagcctttgtgtgagcacacctttaattcgctattcaacgttcgactgatgggctacaagggttgtggtcaacctactttgccctgtnnnnnnnnnnagccctagacagagctgcatagggaccccgggctcggccggagtgatgtacgcgagggctttgtgtgaacaatgatggcaagggtgaagcaccttgaaaccccgctctcttctcccacaacgaacaaagcccaagcctcacattgcactgggaagcgagacgaaagtggagctgcatgtggcctgcggtgggcgcgaaagcggggagagtgagcggaaatggggcactcgcgaagaggagctgacgtgggatcgacatcgaccagggagcaatccaacccaccgcgaaggcacatctggtcagctgcagcacgatcacagctagtaaaacaggggttctagcgggcggcgacatcccgcaccccgcggcgctgttactgttccgccctgctggctttacttggcgggatagggtgtgctgcctttgtgtgagtgcacgtttactttgctattcctcgttcgactgatggactacaagggttgtggtcaacctgctttgccctgtactctcctcatttagtttgnnnnnnnnnncaatttgcaagggtaccaagggcggcctggaagttgctacccgcggcgttccggagggactccaaccggtcgccgtgatcaaacgatgcggcagggttaccgaacatggaaaatggaaatgtccgattctgtgagtttccggagcttttcgagctgaattccccgccaaacagaatattgcatgccaaactacatgcgacgnnnnnnnnnncaagggtatcaagggcggcttgggagatgctactcgcagcaatccggagggactccggccagtccccgtgatcaaacgatgcggcagggttaccaaacatggaaaatggaaatgttcgatcctgtgagtttccggaacttttcgagctgaattccccgccaaatagaatattgcatgccaaactacatgcgacgctccatgcaaggggttcgggggagagggggtgggcgtgggggtaacatgctcggtgtcgtgggaattccccttgaccgggtcctttccccactttccgcctattcccgctctgcaccaagtccacgccgccttgcgacgtctnnnnnnnnnnattccccttgaccgggccccttccccactttccgcctgttctcggtcggcaccaagtccacgccgccttgcgacgtctacgaaacccgaccatcacattgcgttcgcggtatcgtctgtaacactcgtacttcaggtcatacacagcggtccttgttgtggggatccggccagccccgacaacaggtaaagacccggcgaggagagtaggaaagcagggggattgtggcagcacgtggccgttgccccccatgtctggtggtcaagagaatgcgacggacagtgcgggaaaactgtggcattgctgcaaatcagggtcggcctagtttctgaggtatgcatatatttctctcgaacatcaatcgtgcctccatccatccgcggaaggagcagggcaggagcgggagtcgtggcaatccgtggctatctgccttatggttctcagatgtctctgggcagcttactctctctgtgtgccttgtgattacagaccagcaacactatcaagtagccctcatggggacgtatatcctagatgcatccagaacaccccaaccctgaaagccatcaatgggaagcaatgcaccagatttaccagttcaaggtcaggacgtttgtgctgccctgtccatacttgacggccactacttgggcgtacgacgcgagtgctgcaccggaagcatccaaggttattgtggcttcatacggagggacaggattgtaagtgtttttagtcctaattatggcatcatttggcgcgaagagtgcggagtagataatctggggggtgaagctagtgattgtcaaagagaacgtgaaggtagaacctgttcgactgacggttccagtgatggccccaagcgctggcggtggtggggcagctccgggaggaggtggtgaagggttgagcagaaccagcggcaccacctccttcagggtataaccttgcgtgtacaccaaagcggagccaagagaatattccttcataatcttctccgcgaatgactccgacttgatggttgtgatggaggacgaggggctgcgatcccctgtcacaaacttttgggctagtgaagatgagtacaactcgcacgagaggaagttaggaatgtaccccggagtggtaacaaca

SEQ ID NO: 26537 - DNA, 67 bp, Chlorella protothecoides
gcacagatgtataccagatccattgcacttccaatgtaaagcctaccctgtaacgtgctgtgaacgt

SEQ ID NO: 26538 - DNA, 74 bp, Chlorella protothecoides
tgtttgaaggcgccggttgtatgatgcccaccggcatgcatgtgaacttcagatgggatggcaccttgccgagc

SEQ ID NO: 26539 - DNA, 61 bp, Chlorella protothecoides
tcagcgactggctggaggaggagctgcaggtgggcagacgttaatgtccagcctatagcca

SEQ ID NO: 26540 - DNA, 247 bp, Chlorella protothecoides
cctgccagtatctgagctcctgcacaaacgacgtccttctaattcttgatagagatgggaaattgttacggttgactgatatcacgtcctcttacataccacactgcagggatagctaatcccacgggagaatgagataagctaatgcaatgcccttgggatgctaaagaacattagaagtgatagatatgaaaaaagcgtcgccacgatctttggaatgattcttttcatcggtaaacgtccgtac

SEQ ID NO: 26541 - DNA, 118 bp, Chlorella protothecoides
cgcacctccctcacaggaagcaagcgggggctgtggcccttgatggcatgcactgcagtccctccctgtccctgacttcatccatgctgccgatctgcagtccatcgccgcccggtac

SEQ ID NO: 26542 - DNA, 189 bp, Chlorella protothecoides
cccagtcccccaggccctgtacattggacatggtgagttgtttataccagtactgttaatcctgcgccctgctcgtgatcatctatttcaacaatcctcggcattactctcgaagcaaccagtaacctccagcggcccacgtccctgcggatattgcatgcttacagtcacccccagtcccatgccaaa

SEQ ID NO: 26543 - DNA, 2007 bp, Chlorella protothecoides
  modified_base (97)..(106): a, c, t, g, unknown or other
  modified_base (274)..(283): a, c, t, g, unknown or other
  modified_base (408)..(417): a, c, t, g, unknown or other
  modified_base (1018)..(1033): a, c, t, g, unknown or other
  modified_base (1285)..(1294): a, c, t, g, unknown or other
  modified_base (1365)..(1460): a, c, t, g, unknown or other
gggggtatcgatcatgaacgagcctggcacccagaggcgcagcaatgctcaatgagaaagcaccgacccccccccccccccgggccccccccccccnnnnnnnnnnacacctgcttcaggcgggcggtcagatccaggatgacgtggtactgctccagggaagaggtgttcttctcgtcgctgaagcgcagcacgcgcgtgggcccgtcggcatacacggacacgtacaccttcttgctgaattccgcggccagcaggctgaccagcttctgcnnnnnnnnnncgacacgtacaccttcttgctgaactccgcggccagcaggctgaccagcttctgcttcaccacgtccggcacttcggccgacagcgtgcgcgacaggcgcccctcggcgctggcgcgctccgcgnnnnnnnnnnatccggcacttcggccgacagcgtgcgcgataggcgcccctcggcgctggcgcgctccgcggcgccgccgtgggtgggcagcatgagcaccggcgcgtcacccagctggtcgggcgcgtagtcggcggtgcgcgactcgctggcgcggcccaccacgcgtgcctgcacgcgcagcttgttcatgagcatgggctggtcccaggcgtaggccatgacctggcccgggctcagccggtccatgaagtggcgcgagttggggcggaagaccaggggcagctggatgaacaccaggtccacgtccttgcaccggttctcgatgcggtacggcggcaccgaccccagcgccttgagcgtgacctgcacacacccactcccgcccacggtgacgttggcggggatgttgaggtagcgccgcccgccgcggcggtgccggatgcgcaggccaaagtaccactccgtctccgggatggggaagccgccgctccaggcccactcctcgccgccgccgccgggcgccagcggctgcacgatcagctcgcgcggcttctccgcgtcgtcccaatacacggccgagcgctggccggggtccagcacgtgcgcnnnnnnnnnnnnnnnnatcgccagccccgtctggttctcgatgatgtacttgggcttcagcgtcaccagcttggtgtgcctgggtttgcatgtcggagcggggggtaggggtggggagagagcttgggggcgacaaaacgtggtgtgtgcgcagtgtttctttgtgtgggggtggtctgaggcggaggtgaacagagggtgcgcatgcatgcctgacaccaagggccgtctccttcatggcccctccctgcctgcccagaccacctcnnnnnnnnnnaaagccgccggaggcgcgcgacccgtggctccacaccggagggtcgcgcgtgcccagctgcttgacgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcatgtcggagcggggggtagggggtggggagagtgcttggggggcgacaaaacgtggtgtgtgtgcgcagtggttctttgcgtgggggtggtctggggcggaggtgaacagagggtgcacaagcatgcctgacaccaagggccgtccccttcgtggcccctccctgcctgcccagaccacctctttggacctgccgtcctcctcatcccctgaccctgacccccaaccatcaatcaaccacctcttcccgcctccacacacacacacacaaaagtaagcacctgtagatgctctccggcggcccggcggcgacgtccaccgcaaactcaaacaggcgctggccggaggtgactgccaacgaagcggcccggtcccgctccagctgggccaggtggtcggcctcctcggggctgacctcggccgaagcggcggccgcggcgcgcgccgccgctccaaaggacggcccgctggtggcggcgaaggagcccgcgggcgcggtggagcgacgcggcgcgccgccccgcgccgagcgcggcgggccctg

SEQ ID NO: 26544 - DNA, 75 bp, Chlorella protothecoides
cgcctgctgggggcgctgctcgccctcgtgcacggccggtgaggggctgcgatgctgcagggccttcggctcaga

SEQ ID NO: 26545 - DNA, 78 bp, Chlorella protothecoides
cagtcgaactggaagatcgccaccgtgcctgcccttgttgtggggagcgggaggttggagaatgtctagtggggcaat

SEQ ID NO: 26546 - DNA, 92 bp, Chlorella protothecoides
acaatcctctcggcggcacctgcacagcacgggtccgccttctgccgatgagttgcgttgtcacaagtcctatccagccccggagaactttt

SEQ ID NO: 26547 - DNA, 76 bp, Chlorella protothecoides
ctcggtcttcggtttggtggggagagcgacgcgtgccctcgcggatttccctgcactgcgcctccttgccccacga

SEQ ID NO: 26548 - DNA, 118 bp, Chlorella protothecoides
ggagtgggatgtgtggagcgccccctacattcggcgcctggtgtccaagttcaaggccgcccaccccctggtccccgtgaccctgtacgccaacggctccgccggcctgctggagcgc

SEQ ID NO: 26549 - DNA, 61 bp, Chlorella protothecoides
ctcatgattggggcggcgtgagtgagtcgagtgcgggcggacagattgtgctctgccgaat

SEQ ID NO: 26550 - DNA, 131 bp, Chlorella protothecoides
caggatctgggagtggcacgcttcgtgagccgtcttgggggactggtcgcggcggcgggggaggagcgcctggcgctccagggccggtacctccacaccccgccgctccatcgccgttcatgcaccctggc

SEQ ID NO: 26551 - DNA, 107 bp, Chlorella protothecoides
gccgccagcacctatacggcggacgggtgcttcaggtgtcggggcatggagtcttcttggagcgatcactacgtgtattcaatcccttttacacctgaaataccttg

SEQ ID NO: 26552 - DNA, 135 bp, Chlorella protothecoides
agacaaccgatagcgactgctggctgattcttgggtcagtggtgagtatttacatcatgtattgcaaggaccttggtgcaatgcactgtcgctcatgcccacctcccacttccaccatgtgtccctggccaggct

SEQ ID NO: 26553 - DNA, 70 bp, Chlorella protothecoides
taggcaggcactcggtgccacaaagacccttgtcattccagccccttagagagttgcacccttccagaca

SEQ ID NO: 26554 - DNA, 77 bp, Chlorella protothecoides
acaagggcgcaggagagcgtggggaagcctgcacgcagagcgctgactgtgatgcggtggccctttcccgcgtatta

SEQ ID NO: 26555 - DNA, 61 bp, Chlorella protothecoides
tgcccattcatgcgtgggtgcttcatgcacttcccttcatgcgtggatgcccattcatgcg

SEQ ID NO: 26556 - DNA, 61 bp, Chlorella protothecoides
gtgttctcgcagatcactttaagagggtgcgcccgccacatgtgctcatcaccacctgctt

SEQ ID NO: 26557 - DNA, 62 bp, Chlorella protothecoides
caggcgctagaggctcacaaaacccttccccaccccccttcccacagccgctggaacatccc

SEQ ID NO: 26558 - DNA, 61 bp, Chlorella protothecoides
tgtggtgaggcatggacagagggacaagagaaggtctccctgccggcagccggtacaagct

SEQ ID NO: 26559 - DNA, 203 bp, Chlorella protothecoides
gagggttctcttctggaaagagggaccaccagtcgcggcgaaacagtaggttttatcttttcctgcacaaattgctgtcttaacatatatgtgcaggtgtgatcctctcctgtgaggcttcccagggccccagcatgacggttctggcaaggaagcagacagtgctctgacacagctgtcagcagagtctcaagcacccctcg

SEQ ID NO: 26560 - DNA, 90 bp, Chlorella protothecoides
tttgccaggcgctggggcggtcacctcgaattactgttgaaagcctgcgatacgtatcctgcacggccacgcaaacacccctgttccgac

SEQ ID NO: 26561 - DNA, 74 bp, Chlorella protothecoides
gcgcgccgctgccggccgcctgcccggcccagcggccgccgctgggcggcaggcggcccagcctgcacgtcgag

SEQ ID NO: 26562 - DNA, 80 bp, Chlorella protothecoides
gggcgtgggaaggcagtgggatcgccgttggggcaccaaggtgggcacctggcgccccggccctccaccctgtcgagcgc

SEQ ID NO: 26563 - DNA, 114 bp, Chlorella protothecoides
gtggtggtgggggggtggggtgtgtatgtgtgtgaagtgacaacaaggtgatcgcacagcaccaaacaacgccgtagagcttcacgggagcgaagtcgtgccgcggcccacgtc

SEQ ID NO: 26564 - DNA, 100 bp, Chlorella protothecoides
aggtacccggaagtggcatgttgtgggccaggaggggcgatccgctggagcagacatgctgcaggcggtggtgtggcccaaggccacacgggcaggcact

SEQ ID NO: 26565 - DNA, 95 bp, Chlorella protothecoides
tgaatctacattgttttcagcgaaagtttatcgcgctctccacagccacagcatatttgggtatcggtgtgattgcatggtgagaatgtatggat

SEQ ID NO: 26566 - DNA, 68 bp, Chlorella protothecoides
gagcctcgaggggcgacgaccacctcccacacgaacggctgtcgctccaggcatgctctggacagaaa

SEQ ID NO: 26567 - DNA, 153 bp, Chlorella protothecoides
aacaatgtgcaacccagatcgtcgactggctgactggtctccattcctgcatgccccgcatagcattcatgcgtctcggcatgagcacatctccaaaccttggcctcatattcggctccagataacagctcgccccacctcaccagagaacag

SEQ ID NO: 26568 - DNA, 64 bp, Chlorella protothecoides
agatgctggaaagacaggatgcatgcacactacaggtactccacaagattctctctggagccat

SEQ ID NO: 26569 - DNA, 78 bp, Chlorella protothecoides
catgcagacatgccagtgtagagactgcgcgggcctgggggagaaattgggggtgatgcctctgcagctgacccccac

SEQ ID NO: 26570 - DNA, 72 bp, Chlorella protothecoides
ctatccccctgtctgcatcccctcactcccaccttgtggcgctgaagtggggtgctatcgcgttgtacacgc

SEQ ID NO: 26571 - DNA, 100 bp, Chlorella protothecoides
gtgaaagctggcaaggggtgtcggccccccagcaaagagggctggcatggatgagatgtgcccctacccattcaagatttccagcatcagcaaaagtgtg

SEQ ID NO: 26572 - DNA, 14343 bp, Chlorella protothecoides
  modified_base (896)..(930): a, c, t, g, unknown or other
ccgccggggcgccgggggccccgccgcccgctcgccccgcgcgggtcggcaagcccaccacccgcccctccagcacgcgcgagcggcgtacggccccctcccggtcggcgagcgtgagggagagcgcgtgcgggggcacccccccgaccatcatgctgcctgtggcggttcgcaggagcggggagggggccccctctggcgggtggccggacggagctcggccagtcgccggcaggtggccgggcgcggagtatccagctgccggcaggtggccggacgccgactgctcggacgccgacaggtaggccggcgccagatgtccggctgcaggaaggtggctggatgcggagtatccaaccgccggcaggtacgccgcgtgcccgaccacgggcgacgccgcgggcgccagcgcctgagccagactgcccggttccgccgctgccagcggatgggctgcatgaccttgcatggagactgcgacggccggtcccgcggggagctgggtgacggagttactgcgcgggctgatgctggcagcggggatgaggccgatggcctccgccgtgtcctgcagcgtgcgcagccgccgcccgccggagctggaggaacgcggagccgattccggggacgcggaccgtgggcccccgggcccgaggggcgccggcgcagcgcctgggtctcggacagactcgggcaggggggcagggggggggagggcgccctgctgggcctccgtctccgcggcccactcccgcatctgccccgccagcagcgcagtcaggctcggctcctgcaggaaggccatcaggttgccgctgccgtcctcgcatcccaacgagcgcgtagggctgtgggaggaggggtcccgtggggggggggggggggggggggggggnnnnnnnnnnnnnnnnnnnnnnnnnnnnnnnnnnnagcatggagacgggggagagggtgcctggtgacacacagcctctggtactactgtggtgcgtgctttggtcagcagggctcagtgtctcctcggcccacccggtgagtccccgcccatttgtcaagcatgcccactccgtcaggcagctgatgagacagcactgtggtttgcatgccttgtcaaggtggattctccaacttcttaagcacgcattttacctgaggtttgcgcggaggagctcgtccaggacattgtcggacgtcaggtggcggaggtgggcgtctggcactgatggaggagggccggcgggggcctcctctggaatcgagaaaaaggaacctggaggagatgcaaggagaggggccgctgagtggagtggggaggaacgcacgcccggaagtcccccattcccggaagagctgggcaggggcacctgcaccgcatctcagaccagagaggtcgcccccccctgtctgaccaccgtgtcttctcgtcccgactcgcaacatgcagatttcatcattatgtgaacggaacacgcacctgccgtcctctcgcccagcaattcctgccagtctgcgctccctaatgtgaggtgccgcaaggggccccgtggcccaattgtcatagcaggagtctctgacgctcacaggcgaggcccaaagaggctgccacgcattttatatccagtggatgcggtcgcagaggaggttggccgggatgtgcgggttgcgacagcactcggccttgaaggtctagaccctccacactgcaggtccggaggggggcctcagcttgtatgacaaagcccaaattacaccgtcctgcactttaataggcattagatcgcgcataaagggcgtctactcctgtgcagtgctcgcatcgccatcctctcgcaacagtgtcgggcaagtgctcaaaaggggggaatcccgggtcgaacggagttttccgcgtgctgggtcggtccgggagcctttccgagagagaatccacgcgctccaaaacagcaatgtcggaagggcaaatgcgctcttggatcggaaacacaggaagctctttccaacgcgctcttttctgtcctccattgggtcccgccatactgcgccgtgcctgtgctgcaatacctggaggaagaagttgaccatgcgcttcctcggaggctatgccaagtacggtccagggatcaacgacccgagctctaatggcttagatgcacatagtatggccagatcggactccgtgggagacagagatgagtgcatcgcctcccgcagagtaggcgcagatcacttgtgcaccacacccacctcgaccaccacctcccactccaagggtagaatgagcgattaatattatgaccagaccaactcttcccttcgaagtaattcgtgaccctcggatccgccctattcacccgcaggagtcggcggtagttgacgccggggctccttccgagcggtcggggccgtcgctcgccgccgcacggtgcgagtgggaggctcgaaagaggaggacccacaggggcgaatctgccactcctcgcaccgggatgccttggagatcacaacttgatcgaatagagaatcaggtcatcgctgaaatggacaaactgcagcagctgggcgcgacactcaggcgaccgccaacagtgacgtctaaaatgaagacgaatcgatgtgacagcgagcagtgtccccctccacaaccgacaggcatgatgcaaaggcccagagtggatccagttgctcggcacaggtgggcgacggtgccagtgtgcggggcgatggggttgacaggccaagttactctcttaacactgtgcatgctgatctcagctaggtcctgtactctttcctgggttgttcggtcaggaggatggtgaaggcagcatcggaatgtgatccatgtacactccctgccccatccagggagctggagatgatctgggcagcagacccatttctgaccgctggtggtcatgagcgccgagctcggcggcccctccaaggctactcggaatactttgcggggctgcatggtgcagtttgaccttgagtgacgctccctgtcagccacacaacctcatcgtcgctggtggttgtactcaggactgatcgtggcagccacatgcaattgttgttgaaaatgggaggacggcagggcttacgaatgttgcagaaggctgtacaccttggactaacactgcagtttcacgaaggtgtaggagaagcacagcgagaagcaaggatgtgagcaggggaatggagcattggcaggcagaggatgtacaatagcgctaagcgatcccctggtcatcgataccaaaggtacataataaacaggacaacagcaaggactccaccgtaaaggatgtagcttcgtccctggggtccattcattacctgcaagtcacagacacagtacaatgtggagcgttgttgatgccgttagcccggcttgcaagcaccgggatccctttcattccactatgccccgcaacaacaagctctcacctgcttaaacttgttggcagatgctctcaggcccagctgtatcccgctcatgctcattgactgcagagtggggaggatggtgcaagagcgtgagctgcaaagctaacagctggaagaccatgcacctcgcacatgtctgtatacaaacctcgagcccatgtcagcacatcactgtgccaatgtgtggcctcttgtcgttcctcaccatgttatcaagcacagtatggtgttcttccacctctgcatgaatgccgcttgttatctgcggaggaaagcatgtgttgggcatctggcggggctcacacctcagagaactgggcctgccgctcaacctcctccagcagaaactgcgagtcccactcacattcctcagcatgcccacgcgatccccaagggctgcaatgtcgcgatcattctccttctcgagggactccggatccacagcctgcacgggacgccgtgaatgctgaagttttggcgtacaacgaccgaaaccccactggcccagcggtgttggtgagccccccctcacctgcggggcagagctcgctccaaacagaggggcccgacgatctctgcgtggatgagaatagataaagcattatttgaggaggagatggacacattgctcttgcactgctgaccctgaaggcagtcttgatagtcctgctaccgcgagaccagcccgagacttgcctggcgagcgacgacatcccgaaactcgatctcacatgcccaagccagatcgatgaagacaattttaggacgaagggactggcacgaagcccttggatgtctgtcgtggagtgaactgggttttcgaccacgcaggtccacgtgggagactcggcagagttgcagccggttacaatcgttgcaaaggcaccgtggacaattcttccaagcgccttggagtgtggaatgaaacatgtgctgggcctaccaagagcagtgtaagtgccggccctgactagaagatcagtacgggtggaaaaaggacaaagcaatgagcacacttgacactcctcttaagggcactgccagcccatactagcaacccttctcctttgctgagacccagcagggagcaacgggaaccttgatcccaagcagcttttggaagtcgggggcagggaggcatccatggggatcccccacccccccttcccactgctgctgcaggtcgtccagcgccagcgtcgggcaggacagcaggatcatgcccacgaccagcgcgacctccgcctccgcgaagtagcgccctggacacctgtacaggcacggaccgggttgcaaactccagtcagactgtcaggcgggaaggacgccgcgcacagaggcaatggccgtccgcatccatgtgcccctgcatgtcggcccggctccccctcacctgtacttcccgcccccaaatgctaggcccgccaccccgccgacgcccaagatgctggagtgcagtgccgtcttcccacacaggagcatgccctcccggtccgggttgtagtgccgggcatccggcccaaacagcctctcatcgctgtggctctcaaagggggacgtggccagcacagacccctgtcgcggtgggcacggcaggcattgggtgagatgaagcagagtcgggcagcagcagggggccttgtatggaacatgaccagtgccccatgacgtgtcagggagtagaggtgcacccccgccgccgtggtggggcagagaccttgcaaactgtgccaaaggcccaggcgctgccggcccaggcgccagcgcgatcgctctcgtcggctgccccccgcacctcacggggaccagacccgagcagatcccaccacccagcacccaccttctcaagcagcaggccctcccggcctgggagtcggagcatcacgtccgaggccgcgatccgcacgtcgatggagggggcccgcaatcggatggtctccgcgatgcacttgttcagcgcgctactccgggagcaggccaggtccaccaggctggccgcggggtcggtgctggagcgcgtcgcctgcagctccgcctccacgcgcccccgatatgcagcattctctgggagcagcaggaacgcaagtgtccagaaggccgtgggggtggcgttcgcctgcgtgcatgtggggggtgtgacaggtcaagaggttggcggcgggggggggatgctgggcatgcggagaaagtcatcaggcccagtgggcgcagcagcccctccatgctttgactagacatcgcaggcttgcgactcggcgcgaggctctatggaatcaagttcccaacccatcgctgccttgggatcgcccaggttcatccccttctcctcacctgagacgcccacatgaagcacagcatcatgttgggtgtgcagctgtcgggcagctgcacgtcatcaatcagcctcttcaccaccgtccccttgccgatgctgtccctgagcagcgcttgcctgcaaggagcgaggatggaggggggccagctggtcagacgggtctgaggtggtgcctgctctgccggctgcgggttcaggctggctgccagtcatggcctcagggacctcaaacaggctggccaccgctggcaagcccttcctccagcgatggaccagggccaccacgctcaccggaacgtctccaccagccttgatcgggcccggaggaagggccactggaggcagagtggcaccggcgaggcagccatctcgaaccccgactcaaaggtctggaaggactgcagcagcgaggcgacgtcgacctcctcaaggaagctggacccaaagaatgtgctcaccgagctgcggaaggtgatgtcctggatatatttacagagatcaacctggtgtggtgggaggggggtccgcggggatggagtcagcgggcccatggccatggcggcgagctcgggcagcacagcggcatggtaccccccccatgctactccacaccctacccggccacgcagggggttgacctccagctcccggcgcaggaaggagtgaagggggtggagtatgtttgggagcgtgcctgggaccagctgccaccgcagcgtgcgcagcatgagcccgtgcttgccaacaaagtgctgaggagggagcccgaagacccggtccgtgaactgtggggatagggaatgggccatgaattggaaaaggggcgagagtgcagccatttgccaaaggtgggagaccgacaggccaaccccgtgcccttgggcacaatgcagcccagcaggttgcgccaatggggagtggttggttcccatggcccccatccagcacgacttctgagtatgcacaaccggactccagcctccatgacaggctgaaacttcatgagccgggagccaacatgcgcacctgttgtacagcgggtccaaagcttatttgttcctctggggccgtgaaaaagggggcatatgcctcgggtgccaggagccaggtcattttctgaccgagcaccctgagggtgaacacgtccccatactgcgagggacaacatgatggaagcaaggttcagttattctgtctatggcaccagtaatcgcgcgccatagggttgcgggcggtgtgccatgaagcccgtcgcaggtgggtgtcagcgacgaaaatccacatgaaaccgcaccgcacccgtacctgtgcgtgacaggcagcgataaactttgaacctctccgacccagtgccagaacactcccgagaaggggaagcccaggaataattggcggttgtgggagtccgggagaccctcggaggcgagaggtccacgcgacagccaggcccagcagcaagcaggcgagggcggcgatgcaccctccctgctcgacctcaagccagactgtcagcaagaacatcctccatgactgaaaagagttggacttcattgctgctccgctgtagtaaggggtcactcgtgcgaaatccgtgagaatcttagctggggtctctgggcaacggtacgttgcgccttatgcataacacccacgtccaggggtcgaccttttcagtccatcaagtcgtattggttcagctgcgttggcaactccttatgggcatcgtggccttctcaggctccggcttccgctgcggacacccgtcattccccctcctctttcgggagcagtacgtggcgtggctccttgggagagagaggcaccaacccctggctagctgtaccgcacacacacagtactgcgttgcaacacctcaacctggtcattcagtgagcatcctgctggtatggcgtaggtattgctacagtccggttccgagagagccttagggcaggaagccctcgtacctgcgccaccttcggcctgtccgcactgcggttacacttggtttcggaacacgatcatcgaccacaccgctggcccgtccctgagaccttctctccttctcatgttgagccggccttgtatctcgctgtgcagttatcagcgcttgcacacctgcgtcgcagtcctgagaaccccgctcgccgccccccgcccggccagaagagacacctcttgccgagactcgccgtcaccttgcgaggaactcgttcgtcgtaacaactcgataacgtccgccgtcgactcccgacttggacacgccccttcctccccccgcacccgagactcgcctccgtgaccaccgtttcatcattgcgatccgagctgccgatattctggcggatgccctcgaggcagacgacgtggacacaatgctcatacagaagtactctgatggcgaccaccccaccaccttcctctcctgcccccctcctcccctccggatttaagtttgcgattcacaaacccgaggccgccgctgagtacgcctcaactcatggcggccctgcatcgagagcgccatgtcctgattagtgttccccactgatcaccaggctctgaagtggctgcttacaatgaaacccaataaggaggccgccctccctctctgggtaacatctcagagatgcttgacatacagaatgccgccagcgctacgcctgatgtcccatcctgcagctccggccgccacctcctgaacttcccacattggtgaattcattcctgtcctgatctacccgggggactcatcaatcgtcaggctacctgcaccatgccctcgaccatcaccaattcctcttcccagtgcctcctggaggaaggccgatttcgtcgcaaggactccaacgtattgtatgagcccaaggccagcgacctatgccactgtctcctcaaaggtatcgacaagccgggctttgctgggtagccgcggtgcaatggtacataggagttttggtggcaggcctacacctgtcctggccccgccagggtgcaatggatgcctctgatctcctcagtgtccctgttaaatgggtccagctgcgtttacaactgccgcgtgcatcgctgcttcctggggctcgccatttagtgcatgctgaagacggcatggtgcacccatgcacctggctgaggggtatatatggcatcctgtgctccattgcatcaccttgtcctcgccattccaataggctggagtttggctgaccaaaagaaggtcacaacccggttataaagggcgtgtaggccagaaatacgagtacgtcgccatcccgacgtgggcggggatggcgaggtgacgggggatggcgaggtgacggggatgggagaattgcggaggtaaccatgcccagtattcgattcagatatcatcagccaaagtattcgcaagaatgtacgattgtaacacagcgtcagctccaactccatcgctaggacatgcctcaggggttgtgagtgcgaagatcggcatgaatgcctccctcttcttccgagcctctgctctgaggagaggggcccctggcagaatcgcgcatcgccatgcgcgcacagtttgccagtcatcgagcctgaagacccaacagacgctggtgtggagtgcagggacccccaggaggcatctgacgagtgcggcctgcatggcacgcgagcgtgcctccctgcttcatgcagaccttcgccccgctcaccgcgtcgccgagtgtcgtgcttccagttgtgtgcagtctcacacaggctttcgtgtcgtgcgggcattcccagccgccgaccacgggcgtgcactgccctgaatccccccatgcactccatccccaggtatttgtgcccccccaccccctcgtgtcccactgggtggccgtggcgcgcaacgctgccagcccgccccccatgttccgcgctgcgctggccgagctgggccgcctcctcatctacgaagccaccagggactggctgcccaccctggagggcagtgtggcaacgccatgcggcaccgcagaagtgacgttcatcgaccccgggcagcccgtgaaggtgggatcctgcgagtggccgggccttcccgaggccctgcagctgcccctggctgtgttgatcgctcctggaggggcggtggactttggcaaccgagaaatgaatagctggctgctgctgccagggtcatcatgtgcagacccccacaaccattacgccaggtggtgcccatcctacgggccggcctgacgctgctggagagcgcggcgacgctgctgccctcctcccagaccttccacgtggggtaccgccgtgacgaggagacgctggtcgccacgccctacctcaacaagcttcccgccagcttcacaccagaggaccgcatccttgtcacagaccccatgctggctacaggcaaggcagcaaggcatgggaatgggatatggggggaaagaggggcccattccccaccccctgcgctcaatcccgtgtgtccccatcccacaggaggcacgatgcggcaagtgatccaggatctggtggatcggggggcggcgcccggcatgattcgcatcgtcagcgctgtctgcgccccgccggccctcaagctcctggccgacaagtttgtgggcctcaagatatacactggtgagggatggagggcagtgcgcggcggcacaggatgtgctgctccaggtgtgaggagggacagcatagcaacccagggtcaaacaatgtcagtgcctgcctgtacgggtggccgccactgtctgatcagaaccccaggtgctgctttggccgagggaaggggagcggatgtggggcagtctgatgctgacgtagagctctgccgccgtcaaatgttgaacggatccctcccccacaggtatcatcgacgccgaagtgaatgagcaggggttcatcatccctggtctcggagatgcgggggacagggcattcggcacatgacagattgtcattctacgatgctgcgttgttttcctcattccatatcaatcgtgcctgtaggtaatactggggtttgcgacgggattgccgcacacaaacttgcgccttgccacatctgtgaaggacacgctgaaggaagcctgcccggcaacactcctgctcttcgcattggttcactgaagaatgcgctgcggttgttgaccttggaagaaatcttcttaacatgtgaggggcagaggttcagggagaggcatgcaaggacaagcacacatcgaattcttggctgcagtgggatcggcctgcatccatgctgggcgctatggcgaactcaccatcgtagtccggttgatgctgcagtatgcactggaaatgtgatccccgttaagaacagccaaccatgggacatgaaatcagggggatgggattctccactccatcatctcatcaggccagtcccaccaggcgctcagaaacttcccagagtcggcggcccttctctccgtcggccacttcgcccgacacctggagggtagatgaggaagaccactccaatgaaatgcactgaacacatgtcatgcgccttcatttgccgcttgtggatgccattcacgcacaatgctcgacatgcaacaagccatcgacttctggttagtcagtacagcaaccagatcgcaatccaccgccaaaaggcagcttcctgaaacccacctcattctcaaatgccccagtgtcgttattccagctccagtacacgccagacttgcccagtgcaggatcgctgatgacctgcgaggtcatgaacggaacagagtcaggctgtctaattgggcaactcactgcgataatcatcccatatccaccgacaaggtgcagcggactgtgccagtcctgaacacgcctgatcgttgttggggctttcaagaacatgtgaaatccgtcataatttcgatggattgcccccccaaaaaactgggtggcccctcctactcccagtcaacaaatgcccaatctgagccagaaggcgcacctgtgccaatcgcttgccggcctcctcctcgctcacataccccttggtgatgtacttttggaagaggggaaacagggtcttgaacaggccgtagtgggaccggaacaagcctgatgaggcgatgcacctgcagagagtgggagtcatgagtatgggtgagagatggaaaacaggggccctgtcatcaagatcatggcgcaggtggatgctaccctaatacatgcattcactgctgtgggcagcttgacaaaaggggtgttcttgtgcaggcaggccatccttctggaggtctcacatcccagccatatctctgcagggcccagcggcacctgtcataaccctgtctccaccctggcctcctcacccggggtacagggacgagaaggtgatccccgtggagtcgtggtagcggcggtgcagctcccgcaccgtcagcatgttgcagagcttggagtccttgtaggccttggccccgtcaaactcgccgccgtcgatcatgggcgaggcctggcccaccttgaccccggcctccagcccgctgaggtctcccaggtccgccttgggggggacgttccctgccagagtgttggtgttgccggtgatggacccgacgatgacgaggcggggggcggggaggggcgacttcttgggcgcggccttcaggtcctccagcagcaggttgaccaggaggaagtgcgcgaggtggttggtgcccacagacagctcgaagccgtccgcggtgggagtgggctccttggcggtgggcaggtagacggccgcgttggccaccagcgcgtccagtcgccggcccgaagcgcggaagctctccacgaagtcgcgcacggagtcgagggaggccaggtccaggtgcaggatggagtaggagtcccttgggatgcccagctcacgggccatgcgggcagcctgggtgggcatgaagggagggagagggattcaggtggggtttcaaccagacatgtgcgagagtaggagcagcgaagggcatcttcaacatggtgcaagctgccaaaaccatcgtccaaagcacaaggaaagaatcaagaaagccatagaagtgggaccgatagtaagctcctctgtgtgccgcctcgcccagagcatctggagtcagtcagtctcccctcgaaaccctcccatgcaatcacccccatgccacccccatgacaacttgtgccacgacagagggacatgttctcatcacacccaccttgctgtagtcccgcaccgccatgaccacgtgccagtctcctgtggcagcaagtgccttggcagcattcaggcccaggccagaggacgcccccgtgatgatggctgtaggtttctgggtctccttggagcccaacttcgcactgcccgagctggtgccacgggtggcgggtggtgaggccacggcctgggagcgcactgccaggcgagtgtgccgtggctgcccgggctggcgctgagccgcggatcgggaactggcgtggatcgcagagatcgaggacccgctgctgacgacgggcaccatcgcaatcgacgccctccgacccgcaccacagaagggtccagcaaaattcatctgcggcggataaagagagcgtgaggtgtatcttcctgatcaatcgggggggaaatgaagtgggcaaataaaccacgctcccgtgactccatgcaggacgcaccgcggatgtcgacattgtcctccgggcttggcgctcttgcttcaataatcgcactcgatttgttcttatatgtaatgggcattcgcatccccgctcgtaggcagatttcgtgcgtccctgaatctgcaccccggagatccgacagggtgagtcgggaagaaagaggagcacgctggatatgtctccagcgcccaggaattcccggggacgaaggtgtggcgccccatcccaaatgttcctcccgaggagcacccacatttgaattcccacgcgcgtcgcgaccgcggtgacccagagcccacaccggcactaatccagcaagcagtggcagcccaaatcggcatccagcatcgagtgtggtgatccatcgtgctgcgggctcgacccatggagcaccctgcgtgaccccgacggcgtggaaccgggccctggagccatcgatctgaaccaagagctgccaaggcgtggcagtcgggtgtcgtcgggctagcctgcgcctggagcacccaccagcagcggggggcgctatggctcgcatccccgaggccgacccccttcgcacgccggagcagcctcgacgggcgaaacccattaccatggaggtactggatatggtgcatgcaatgccatggtgcaaggcgcaggctcgtgacgcagactggctcatggtcgggtgcaagcttcccccgcctcccgcccatcccatccgacctccctccatgcgcaggcggagccctccccgtacacgcatttcgtgtgccagctgcccgccatttctccgcctcgcagcaatcacagcgatggtttcggagcctttcaacctctgagcagcccgggcccagcaggcttcggcttcggcagagggccctccaggtggggggaggggctttgggggggcaggg

SEQ ID NO: 26573 - DNA, 71 bp, Chlorella protothecoides
ctgccttggaatccaggtcatggctgcaagccttggtcacatggcagccggagggctggatgcgcgccgga

SEQ ID NO: 26574 - DNA, 144 bp, Chlorella protothecoides
acaggacagtaaccgccctccacttgcgctggggctggtcccaagcgatgagcagagtggatctcgtattcggacctcggggtcccaggcattgaccccaatgccatccccccccccccgctcacccatcatgcgcagggtgtc

SEQ ID NO: 26575 - DNA, 116 bp, Chlorella protothecoides
aaagggcctgttgcctcacatgctcggcgtgcgaccctcagccctcagcatcttggattctcctgcttccaaggagctgcagagcggcaaccggctccccacaatgcgcaggaggg

SEQ ID NO: 26576 - DNA, 118 bp, Chlorella protothecoides
atatcagcagcaaagcagggaaatacaggagacagatctacgcaaccaccttcactcatcccctcgcacagctcctcaaccctcgcacccctgcactcactgctgagcgcctccttga

SEQ ID NO: 26577 - DNA, 189 bp, Chlorella protothecoides
tccgcgcctggcatctgcccggcatccccgggttcggcaacggtgaggcaaggacccgacgaaggagagcgtctcgctgcccaccgcacacttttggggggtgctttgcaccagggctcctgaagcgcggtcacctctcccacaatcctgccgccctgccccacccttccgcagtgctcaccgacagtc

SEQ ID NO: 26578 - DNA, 131 bp, Chlorella protothecoides
atgaaagtccatcccacctccacacaacatcgccactgctccccctcgcaaagcacaaacggcctgccacgccgccaccctcctcgccgcacggacaaattccccctcctctcctttccgcacaccaccct

SEQ ID NO: 26579 - DNA, 64 bp, Chlorella protothecoides
tggtgtaagactcaagcacacctcagagctgaatctgcggagcccgtgccgccctgcacggcat

SEQ ID NO: 26580 - DNA, 114 bp, Chlorella protothecoides
atacagaggtatcccatgtgctgggcagggggagccagggtgggctcctacaccatgtcgtcacaccttccatggatccccttgctcgcccactttcctccagaggatcgtggc

SEQ ID NO: 26581 - DNA, 80 bp, Chlorella protothecoides
gcagccttgcttgggaagcagcccagacggcattgtcgaataatcctgcgagggtcccccagccacctgtcaagacttcg

SEQ ID NO: 26582 - DNA, 4415 bp, Chlorella protothecoides
  modified_base (1495)..(1504): a, c, t, g, unknown or other
  modified_base (2010)..(2019): a, c, t, g, unknown or other
  modified_base (2534)..(2543): a, c, t, g, unknown or other
ctcccccccccccccccccccttttcctgcggcgactccccccattaccccccccctccccttcccaaactcttacctggtcaatctcgtacacaaacctgttggcacgccccacgatggccctgaattcacgcacccactccccattgccgaccatgggcgtgccggtgccgatcacgctgacagaggcgttgggccagagcgcactggcccaaacgccagtgagcgaagccaggcccgaccccaggctgtgccctgtgcggtaggaaagaggggggggagggatttatttatcaagtgtgcaagtcagtccagggcatggtggtcgagggagagggagtttgaggcgtgcccgcgtccctgcctgctcctgccacgacgctgtagggctgcctgcgattgcactggcccaggcagcgggccgaagcaaggcacggccacacagctctgcgccttcttgctccttcgattgggaccccccgccccccctgaaaacaaaaaactctcctcacctgcggcgacaaccctgcgcggaatcaggccgccgctcagatccaggaccacggcggtgatgttctcctcggcgctgggcgcggcgtcggtcaggctctcgaactggttcaggaagccttggtgcacgcccacgccgtcaaacacgtcggcgccggtggggcgaaagtcagaggactgggagaccagcaggtcctgcacccagtctgcctcggtgtcggtgccctcaaacactatgtaggcggtctcgctggcggcgtcccaggccacggcggccgaggcgccggtgccgccgctctgcaggtagcgccggggcaggccctgcacagggtggaggtggatgggtgtgaggcatggatggcaaggctgatgattacgagtgtgactgtgcatgcaggtgagggcatgcctgtgacaatgaaacaacctggagggctgaggcgttgttggggcgccacagcaggcaggcggcggccgcgccttcccgcgacttgcagaggatgggggggcaggccgagggggccgggccggggctagtgggcgagggggcgatgtcgcccagaggggcggtggcgcccgcctgggcgtcggcggggtatgggggcggcaggtttgggagtagcgtggcgttgcccacggtgttgggcccgatggtggagttcactgagtgattttgggaggggattgaggggaaggcctgggatgaggcagagcagcacaagactggcaagcaaatgctgctctgggctgaggatgagagtcggtggatccaggacgatgttctgtttcatgccctgcacatgctcgaccaatttctcacccggccctaacaggcccagtccccaacaggcccagtccccaagctgatggggtccccatctcacccaatcccaaacacgtccagtccccaggtgatccacaccctcccacgataaccccctcctcctccaccctcccaaccaggcgcccacctgccatggcggcnnnnnnnnnncaacacgtccagtccccaggtgatccccaccctcccacaataaacccctcttcctccacccccccaaccaggcgcccacctgccatggcggcctgatcaaagagactctgctgagggtcgtgctgcgtggcgttgatgatctgcacgatgtcgctggagttaaagggccagacgtagtacaagctgaccagctggtcaaaggcccaggagaactgggggttgaacccggtccagggcatgccaaaggtgatcacatcgacgttggcccgcgggaaggccagcgccagggccgggcccgccagtgcagccaggccgccccccgccgcctgacccgtcacgatgatgtgcaggggggtctcggaccccatgatctcctcaacggcctttgtgcgggggggcggggtgtgaacaggggttcaagaaggcacatagggtgtggatgcgcagtttcatgtctgggtaaggctgcttcagggcccacaaaaagccacggggacaacgaagannnnnnnnnntgggggggcggggtgagaacaggggttttaaaaaggcacatagggtgtggatgcgctgtttcatgtctggggaaggctgcttcagtgcccacaaaaagccacggggacaacgaagagagtggggatgaggacaagggtaccatgggcacggccatctgcatacgacctggggcaggaatccctgtgcaaagtcatggagtcaccaagatcccctggcaggcctcggcatcacccacatccaagcgtccccacctccaccagcgtcccgttggtggagccggcgccgtccagcaggtcattgaaggagtcgaggaggagtgtgggggcggcggcggtgccaatccagtcctccaggtagggcactgcctcggtggtgttgaaggagtccaggggattgctgttcagcctcccgccctgtgtgcaggagcttgatgagttttaatgctcacttaccatggcgatgtcgcttgcccgcagatgcgagaccatggtgtcacaagggaacgaccgaaagnnnnnnnnnnacgacgtcgcttgcctgcagatgcgaaaccatggtgtcacaagggaacgaccgaaagcaggctccattctgcaccccaaccaatgacccctcctcacatactccccctctctcactcaagattcagtgcccatgcagccaccccactcgcacctggaatgcgacgatggcctggttgagcccggcatggcggattgttaccaccgcgtcctcggccaaggccagctgcacagcctcatcctggtagtcgctggcattaagattcacggcatactgcagcgctaccagggtcttcacgacgatgggacctggtgtgggtgggtgggtgggtgtgttcaagggggaagggggctgggtgcctgaggcattgatgccagaggaatcgaatattgggatgagctgtctacaaacctggcaccagaccctagaatcgggtggcatggagcccatgcgggtgttgctccgtgacatcaagatgccaatcctcatcacagccacactgtccaatacaattcagagtggaaggcatcggcgtagtccacacccgggcatgcacctccatcgctcaccatactgaatggagggcaacagcggtgtcacctcccctccgctgaaaaatgtacgaatgtcgcttccagccccgctgacagctcccaccgcggtgttcagacccgatcgcacggtgtccagcgaggagtccacaaagtctccagtggcgttggcagcgtcggacagggcaccccccacagcgttcgctgcatcgcctatggcccctcccacggtgctcacggcattcccagcaaagttggtggtggcatcagccgcggtgtccaccgcgttcccgacagtccgggtggcatcgcccagagcgttcccgatggtgtcgaagatgtcagctttgcatggccctgccaagagcagcagcgccagaaaggcaatgcagggggtcgcacgcctcatttcgcccaatttcgaggtctagctataattacaaggctttcgtgcgcgattgaagaatggttggggttacatttcgttggtgagtttgcaacgccatcgtaccgcgttcatggagagggggatgtacgtaatcagctcccattctcgacgtggccaacttccatttaccttcgctcagaaatacaaacccttcttcagcagatctgtgtgcgttacaagaataaaatggtatgtcaacctgaaggaatggcactctgccaagcatgatatacatgcctgccaaggatctgggaagggaggatgccacgcacaatcatgtggaggacccagaacgcattctcagtttgatgtttattcaaacctccagagggtttgagggtaaaaggcggtcgccctcaccgcctgaaatttgaatctcgccgtccggcaatccaattcctgctcccatgggcaacctctggaactctgctgctcccccggtgtgggcggtgggcgaccccagcgagatgccattccccgccacccgtgcctccttgggcacagcaaagctctccacctccccgcaggagacaaacagcacgatgcctgccgcgatgaggccaaagcatgtcaggaactgagccagggaggtgcccgtgaagccgtctgtgacatgtgaggggaggggaggatctcagtggactgcaagataccccagcagagggtggcaagggcgacaagcaaggcagcgaacatcaaggcaccccaattcctgtcggctgtgatcatcctatgatgtgtccgacgccttatgcagcctcgacaaggaagtgcatggcatggccgtccccctcgagtgcatctttgtgcaccggcacggggtgcaagcaaatctgctccccttcccttcgccctgcctcaccgcccccccccc

SEQ ID NO: 26583 - DNA, 65 bp, Chlorella protothecoides
ccagcatgaggaggtagatggcccaccatgggtaccccgtcttcagcatggaatggcagatgaac

SEQ ID NO: 26584 - DNA, 61 bp, Chlorella protothecoides
gtttgttaaaccctcgtgcgatcttccgtttgctgattctgcatgttcgcgccctggggtg

SEQ ID NO: 26585 - DNA, 61 bp, Chlorella protothecoides
ctgccctcaggagctcctccgtcgttccgaatgtccacaggcgtgtttgccaccaatcccc

SEQ ID NO: 26586 - DNA, 81 bp, Chlorella protothecoides
tggcggggctggggcgcctgcaggccctggagagcctgcgcctgcagggcctccgccccgaccccgccgacctcccgggcc

SEQ ID NO: 26587 - DNA, 77 bp, Chlorella protothecoides
tgcattctttcatcagcaagcatgtcgcaggtttgctctctcagatcgcgccatgccaccacccatggtgcccaatc

SEQ ID NO: 26588 - DNA, 75 bp, Chlorella protothecoides
gaacaccagggcgggatgtgagtgcaggaagttgctagcggcacacccgcccatgggtccacgcgtcatttcttc

SEQ ID NO: 26589 - DNA, 80 bp, Chlorella protothecoides
cataaaatcgacatgtatatcatcagggtcattttaattaccgttgagtagtcctccgtctgctaggtagtcggaactgc

SEQ ID NO: 26590 - DNA, 64 bp, Chlorella protothecoides
tcgtttgcatgaacagccctcaagacccacgggtccccaatcctgcccccttcccacctctgcg

SEQ ID NO: 26591 - DNA, 95 bp, Chlorella protothecoides
caaggccagtgaccatcgttcggggaatgaggcaaagacgtttccctcctgtgttgaggaggtaggcatacagctcctcctccagcaggcggcga

SEQ ID NO: 26592 - DNA, 110 bp, Chlorella protothecoides
tagttgagggctctcggtgtgaggggccgacgcctccgcacagcacctccttcatggcaaggcataaacatggccccccggcccctccacgcacatgctcgtcgccaggg

SEQ ID NO: 26593 - DNA, 90 bp, Chlorella protothecoides
tgtagatcatggccatgcccaggttggcctcgacctccttgtccagggtggcctgcagggtcgccacatcagcgtcgctcagagcactca

SEQ ID NO: 26594 - DNA, 70 bp, Chlorella protothecoides
gagcctggagaatgtcttaaggcagtgctgcagggaggacgcagctcccagcatgcccggggcgtggggc

SEQ ID NO: 26595 - DNA, 71 bp, Chlorella protothecoides
ctctgatgccccagccagcaccctgtgcccagagtgagctttcccctcgctcgcacagccacccccagctc

SEQ ID NO: 26596 - DNA, 80 bp, Chlorella protothecoides
gcgaccctcgctcgccacttgttcccaccgccccgcgcggttccctgcaccttcctgctcgggcacgcctgtcacagcct

SEQ ID NO: 26597 - DNA, 77 bp, Chlorella protothecoides
ggctcgcctcgccagcctccaccaggcctcaacagtcccacggccatggggtggggtcacagcgcgtcggtctcggt

SEQ ID NO: 26598 - DNA, 77 bp, Chlorella protothecoides
ccaaattgacatggagcgtcacctgaattggaatcatacgcccatctacccatgcaggcctcagagaaccaaggagg

SEQ ID NO: 26599 - DNA, 76 bp, Chlorella protothecoides
ctgtgcccactctgtgcatggcagcatgggggagtcccggtaggtcgggggcatgggagagcgcacgtgccgtggg

SEQ ID NO: 26600 - DNA, 78 bp, Chlorella protothecoides
tccgcccagcccagaccgtgtgccgtcccgaatgaagctgttcttggaaggcactgcgccagtcatcatcatgcattt

SEQ ID NO: 26601 - DNA, 75 bp, Chlorella protothecoides
aaccagaaaggttgctgcctgcggaggacaaagagccggcccaggctgcccgcaggcacgtcaccaagaccccct

SEQ ID NO: 26602 - DNA, 61 bp, Chlorella protothecoides
ggctctcaaggagcggcacccgggcgcctacgtcaagtacatcgacccctcctacctcgtg

SEQ ID NO: 26603 - DNA, 61 bp, Chlorella protothecoides
tcaagtgaagttgggctgcccgttggcggcacgcagccggttccactggttgccctgcggg

SEQ ID NO: 26604 - DNA, 65 bp, Chlorella protothecoides
cggtggatgatgccgtgggcgtgcaggtactccaggcccagcaggatctggcgggtgtacacctt

SEQ ID NO: 26605 - DNA, 98 bp, Chlorella protothecoides
ggagaggtcggcggccgcagccagcaccgactgggcaggctccgagcccagccaggcggagatggccccggcgggggcctccaggcggcacccctgcg

SEQ ID NO: 26606 - DNA, 274 bp, Chlorella protothecoides
catgtggtgctctccccgagccctccctccttgctcatcgatatccgcgctctgcgcagtgcccacgccggccgaccatgtccatgaaacccaatgcacatgccgccttggctgtagcagctccattgcagaccaaccacatgagcacacgttgcgggggaccaggcgggccccacgacaccttgcacctggggatgtgtgggggcgcgccagccgctgcacagcacgcaccaacacaccgcgccccaccgctcagccgggcgcgcctgcctcc

SEQ ID NO: 26607 - DNA, 78 bp, Chlorella protothecoides
aggggtgtctagcatgccctgctcaggcgtgatgcgtccacgttttccgtcgatttggcgtcgtgcaccttgaagccg

SEQ ID NO: 26608 - DNA, 165 bp, Chlorella protothecoides
gtgagtgcgggaggatgtggttctgggtatagggggggccaaagtcagcgcacacgcatggagtatctcatgtgccccggggagtgcgctccaagcttttcctcttctccctgcaataatcagtgcacacaccatcatcactccttgttctccctcgcagctggt

SEQ ID NO: 26609 - DNA, 64 bp, Chlorella protothecoides
tgccccaagaaatcgctacctctcccgccctcctgggcgaccccgttacacagagtgccccaag

SEQ ID NO: 26610 - DNA, 97 bp, Chlorella protothecoides
ggtggaacatcgcgcaccgcatgatccagcaggctgctctgccgccctttgcttgggacgtctgggaatgtacagccccaaagccaggggaatcagg

SEQ ID NO: 26611 - DNA, 166 bp, Chlorella protothecoides
gtgtgtgtgtgttgggagtgtgtgcattgggagctcgacctggtcgtgggagccaagtgtggatcctttgggggaggctggtgtttgagcgggtgcgttgggtgcagggacgccaggggcgtgggaggttctcctcctgcatgaggaacctgccgtgcggagcacg

SEQ ID NO: 26612 - DNA, 165 bp, Chlorella protothecoides
ggacgaggccgcgcaggagtgggccgtgcatgtcacccgcgtgggcgaggacggcgcggccggtgggtttgttgattgtgtggcggtgtttgtccggattggtcgtgttttggtggggttcgtggaagggggggattgttgtccaatggggccactcctggattg

SEQ ID NO: 26613 - DNA, 74 bp, Chlorella protothecoides
tcctattagaggtgtgtgttttgtgttgggattctgggcatggaaattcttcgtgctgcgtctggctttgcacc

SEQ ID NO: 26614 - DNA, 64 bp, Chlorella protothecoides
cgcagagcatgcgcacccggcaaaaggggtggacgtaggggtcggtagtagggatgtgccgcca

SEQ ID NO: 26615 - DNA, 77 bp, Chlorella protothecoides
ttgaagcgctcccaggtacagcctccggccccacggaggtcctgtcgatggcagccaggcttacgtctcccacaggg

SEQ ID NO: 26616 - DNA, 66 bp, Chlorella protothecoides
ccgcggcgctgggcgcgctgcagggcagccccggcttcgaccaccaggtgcgagggccgtggcagc

SEQ ID NO: 26617 - DNA, 260 bp, Chlorella protothecoides
ggactacacctggagcttcctcacgcacgtgggggccccagggccagatctagcgacggcttagtgaaacctattccggcagtaaccacccgcaatgttgcaccttgcgcgatacaaagcaaataaattgctacacgaaatgttgctttagggattgtgctcgatgatgcggcggcctatgtcctggcaatatactgcttctccggcccgtccggaggtttcccagctgtagtgccgcggcaacgtggaggccagtgagg

SEQ ID NO: 26618 - DNA, 68 bp, Chlorella protothecoides
gaggggtgaggactgcattggggggggggggtgcctgaattcgagtctgggcgccatgtggctacgct

SEQ ID NO: 26619 - DNA, 61 bp, Chlorella protothecoides
gggcccggtcaaggggaacccccacaacaccaccccccttccttgaagtgtgacagtgacg

SEQ ID NO: 26620 - DNA, 62 bp, Chlorella protothecoides
ggccgacaggggtcggcactgttcccatgcccgcctgcaaggccccgcacacattcgcggcc

SEQ ID NO: 26621 - DNA, 23764 bp, Chlorella protothecoides
  modified_base (652)..(661): a, c, t, g, unknown or other
  modified_base (795)..(804): a, c, t, g, unknown or other
  modified_base (893)..(902): a, c, t, g, unknown or other
  modified_base (1396)..(1405): a, c, t, g, unknown or other
  modified_base (1530)..(1539): a, c, t, g, unknown or other
  modified_base (1985)..(1994): a, c, t, g, unknown or other
  modified_base (2411)..(2420): a, c, t, g, unknown or other
  modified_base (2977)..(2986): a, c, t, g, unknown or other
  modified_base (4045)..(4054): a, c, t, g, unknown or other
  modified_base (4732)..(4741): a, c, t, g, unknown or other
  modified_base (5075)..(5084): a, c, t, g, unknown or other
  modified_base (5738)..(5747): a, c, t, g, unknown or other
  modified_base (6038)..(6047): a, c, t, g, unknown or other
  modified_base (7000)..(7009): a, c, t, g, unknown or other
  modified_base (7088)..(7097): a, c, t, g, unknown or other
  modified_base (7254)..(7263): a, c, t, g, unknown or other
  modified_base (7876)..(7944): a, c, t, g, unknown or other
  modified_base (9728)..(9737): a, c, t, g, unknown or other
  modified_base (11090)..(11099): a, c, t, g, unknown or other
  modified_base (12493)..(12502): a, c, t, g, unknown or other
  modified_base (12794)..(12803): a, c, t, g, unknown or other
  modified_base (12873)..(12882): a, c, t, g, unknown or other
  modified_base (13021)..(13030): a, c, t, g, unknown or other
  modified_base (13363)..(13372): a, c, t, g, unknown or other
  modified_base (15065)..(15074): a, c, t, g, unknown or other
  modified_base (15220)..(15229): a, c, t, g, unknown or other
  modified_base (15703)..(15895): a, c, t, g, unknown or other
  modified_base (15960)..(15969): a, c, t, g, unknown or other
  modified_base (16497)..(16506): a, c, t, g, unknown or other
  modified_base (16919)..(16928): a, c, t, g, unknown or other
  modified_base (16992)..(17001): a, c, t, g, unknown or other
  modified_base (17093)..(17102): a, c, t, g, unknown or other
  modified_base (17562)..(17571): a, c, t, g, unknown or other
  modified_base (18486)..(18495): a, c, t, g, unknown or other
  modified_base (18779)..(18788): a, c, t, g, unknown or other
  modified_base (19166)..(19175): a, c, t, g, unknown or other
  modified_base (19468)..(19477): a, c, t, g, unknown or other
  modified_base (20317)..(20326): a, c, t, g, unknown or other
  modified_base (20936)..(20945): a, c, t, g, unknown or other
  modified_base (21674)..(21683): a, c, t, g, unknown or other
  modified_base (22116)..(22125): a, c, t, g, unknown or other
  modified_base (22688)..(22697): a, c, t, g, unknown or other
  modified_base (23119)..(23173): a, c, t, g, unknown or other
  modified_base (23665)..(23674): a, c, t, g, unknown or other
gggtgggttgggggttatggagaggggtggatgagggaagtgaagccttggaagaagacctcatcaccagccagcacacagtccagacttctgcgactggcacagctgaatggtcgcacacaggggcacgtccgcacagcatgccacatggtgtaagggtcggcacgtcgggcttcccagcaaaggagttgcactcacccacgcgacgccatgcgtctcctcccctgcctcccaggcgcctgggcgggagagggagtccatggccacggcggtgaggtctgacaggggcacgcccctcagctggacgttgtcggggaggagcaggatgtcggcgcaatcagcctcctgggggccatcgcccagggcctcataggccgagaccatgacggggccgaccaccgtgccatccttgctggcgatcttcagggcccgcgccaggggttctatgctggacaggctgggggtgtacaaggaggggagggaggaggggtcaatggcggctcttgggaaggaaagtatagagatggattggtgggcatggtacatgttgattacataggtgcttacgaatatgctttcacttattttttaaggcttactgcttcatattagtatcgcatgggtcctcttgaaggcgaagccagggctcgannnnnnnnnngtttttaggtttactgtttcatattagtatcgcatggtcctcttgaaggcgaagccagggctcgacccccgcatcaacatcgagtccaccgcactgacctctccaccgtccggggccaggcttggtcagcaggnnnnnnnnnngggacatggggacaggactggggccgaaggggcgaggcccagggcgctgcgaactgcgttcagcatggtactagtcctgaagcgacccnnnnnnnnnnatgtgacgcttgtactccttcaccgtgccaggctccacggtcttgcacttcgccagcatggctgggtcgcatgtcgggcatggggacaggacaggggccgatggtgtgaggcccagggcgctgcgaactgcattcagcatggtactagtcctgaagcgaccctggatgtatctggatgaagtgaagtcgagagctctgtggcctggatcaccaaaagtacacagggctggccgaccgtggatggcaagggagcgtgccagcaaagccagtgcgccgtatgccccagagcagtcgggtcgactgctcggctatcaaatcgaaaattggctggatggtgggctccgatgtaatgttgacaggtttttgatatgttttattcccctccagtcaaattattccgttccgtacccatgccagggtttacgtcacgatgatcggcggaagggggttctccacaatgctgcgcgcgtacaatcatttgctcagccacagtnnnnnnnnnnttggctcgcttccaatgggattcgttaaattgattgcatagggctcgctgcgcagcggtgcatcacttgttgtattatttcgcgcccactcttcggcagaggggtgggccgacgactgtcgagannnnnnnnnntcccatgccagggtttacgtcatgatgatccgtgggaggggtttctccacaatgctacgcgcgtacaatcatttgctcagccacagtctggctcgcttccgatgggttcgtataaatgattgcatagggctcactgcgcagcggtgcatgtcttgttgtattatttcgcgcccactcttgggcagaggggtgggccgacgactgtcgagagacaaaaaacatccccacatggcccgactatcttcacaaaagtccccctctggtgcatcttcttacaatctacaggctcgcgtgaatggaatcgcagggatagacaggttgtcacagccggcctcggggtccaaccttaaggaatagggtaggctttggtcgtcagtgctgcaaaaggagattcacaaagcaagtcctcccatgtgaacacatggcaagtcccaggaggagtgccnnnnnnnnnntggtccaaccttaaggaatagggtggggtttggtcgtcagtgctgcaaaaaggagattcacaaagcaagtccccccatgagaacacatggcaagtcccaggaggagtaccagccacgacacacaactctccatccttacctggggtgtctgctgagggcccttggtgatgggaagctgtgtggccttggacccgatgcccccccagagcagcaggccagtccctcccactgcagtgagtcaatgcgccgggtgtgattggccatcaagggacataaagtcgcagagtcgctggtggtggaattgcagaatcatgacgacatgttgaaaccctccggctgattgaaatgcctttcagttagtgcatgctggcacaagacatgaaccaaccccgagcactcacatccggccacaaaggnnnnnnnnnngtcgcagagtcatgacaacatgttgaaatcctccggctgattaaaatgcctttcagatagtgcatgctggcacaagacatgaaccaccccgagcactcacatccggccacaaaggcgagcaggtactccctccgcgtcaggcccgctgccgccctctggaagaactccccctggatggaaggatacctggccttctcctcatgcccgtacagctcccagctgccaatggtgttctccaggtcctgaagcagggggaaacgggcaagggacgctgtcgtctcagcatttaagatgcaggcgcgacagcggaacaatcgttacggcgacccaagcctactccccctcctcacattcaggtcgaaatacttgttgtcgtcgccatacttggcgcgaggcaccacggctgccctgttggttggcacggatgagggttccatcaatagtgttggcagtgacctctgatgcaagcatgcgagcatcacagccccttgacgcagtcctacctgacgggcgctctgctctgggagggccgagggccacgggcgacaggcctcgtnnnnnnnnnnggcatctcagccccttgacgcagtcctacctgacgtgcgctctgctctgggtgggccgagggccacgggcgacaggcctcgtaccggtggcaaaagtgcaggccttgaatgccgtaacgctcgccatgatggtcaatgtttgcggtgattgtgtttgttgcgagctcctgggagggcatgaaggggaccccatgggcccggcaggttgcgatcggatcctcaccctgagcagcaggcgtcctttcttacccgacaggtttcgacccttcggccccccaggagccttttgaagatttccgatcatcccgacctgaacacggtatgctcagcggaagcgactcactgaaaaatatagccgaatactgtgtcaatggactcgggtctcccgagcaagtgacatgtcgggttgggatggtgcctttgtcatggggggtcctggagagtgcagcacccttgataccaaacgaaatataatggaggtacaagtccatgaatgttacaatagatgtcagatacacaatccaagcgcttcattcgctttgaggctacccgagggcactgggaatcagatagctgaggcaacttgagatgcctatccctccaatccccaaaaaatcatatggacttcacccaacgacagctttgccggactgttttggatctcgtgtttgcttcaatgtctaagtattgaaaaagtcatcaggatagacactgaaagcaccattaagcacttacagcaggacgctttggggcccatccctgattttccacatctaggaacgtcagacaggaacatgcagctgggatgtcaatacgtcgccgagaatccgtactcctgagtgacaaggagatggcattgcaggtggtcagagggtgtactggtgattcccccagtagattctcctcctgtttcattgaccgcatgtatcagtgctgggtgtgctacccaaactttccccttatgtcatttttagacaggtatgcatagtagggtagagtctcgcctgtcccgtcaatgtaccctaattccagcgatcaaggtaattttgctgagggtgnnnnnnnnnnttgtttccctctacgtcgctgaggccatatcccagcgatcaaggtaattttgctgagggtggggtcccgtccataggtagtccggacctccggatttccggtgtggtatgtcgcgcgcagagccaagctcaccaggctgccttgcatacggcgaattacacggattccactatatcacatgcctgactcatatctgtaattttgagcgtctgtaggctcagataagatccaggcttcgccgggcaatggcgaggcacgggccgcgaaacgcggtgtgcatgctcgccttcatctgcatcgccgcatcctccaaggtactgctgggcgaaagatgaattaattgtgcaagcgctgacattcgaatgcgccgcggtcgcccagcaattctctgactgggtcctaccttcccccacccgggcttccgtgagcagctgtgcctcagcaaggtagattttttcgactcccctttcaactacacgcccgatgatggtgcgtagacatgtacgggtggccgggcttgtgcaggcatgacacgcttctctctcatgccgagcggcttcccctgtcgcgatggcgtattggacgcgcaccggatggagctcaccggtctcagatctctgccccctcttcccatgcagaggacaaggccatcgtatacaggctcttcactgccccttnnnnnnnnnntccctgtcgcgatggcgcatgggacgcgcaccggatggacctcaccggtctcagatctctgcccccatcttcccatgcagaggacaagtccatcgtatacaggctcttcactgccccttcctgcgccatcgattccacttgcgcgccagaatttgacttcctgcagcatgctgtggtgcagatcaccaatcccatgacatccaatttctgcactggtgagggcaggggctgggttgacccacagatgaccttcgcatcctttgagagggcttgcatgctgtagctcgatactcaagcaagcagaatgcagcactgacttcctgccatgtatgcnnnnnnnnnnggggcaagggctgggttgaccctcagatgaccttcgcatcctttgagaggacttgcgtgctgtagctcgatactcaagcaagcaaaatgcagcactgacttcctgccatgtatgcatgacctgctgagtgaatggaggagcgcaagtcatcactctctgcaaggggggtatgcccaggaggtgtccttggaccccaccatcccagatgactctcctcactgtactcccacaggaactctgctcaagggcccgggagacaagatctacgtcctgtctgcctaccactgtctggcattcatggggaagaggttcatgtatccatggagcacattctcgatcatcttcgactacaagctcccctgcaatgcttcatttgtggaggacgtgcccaggacctttgatcgctatttgacggtgaggtgcattgccttggaaggccaaaggtgttaaagctctcgaatacgaccaggcttccaggccccgcctcccacccctggagtggcacatatttctatgagtgacatgcaggacactccacgtaccatgcttgcctgaggagatgggtgaatctcgccggccccatagcagacccaccataaccaccaaaggaatgatcacagggtttggcagttgttttccaagatgtgtactccnnnnnnnnnncacgattgacatgcaggacactccatgtaccatgcttgcctggggagatgggtgaacctcgctggcccctagcagacccaccataacctccaaaggaatgatcgcagggcttggcagttgttttccaagatgtgtactccgatgtgggtgtctttgagcttctccaggacattccccccgagtggggcgtcgtccttgctggtgagaagggcgaccctgtcaggccaggcttccagggtggatttacctttgaagctgtcgttgcaatgcatatcaaattcattgaggctnnnnnnnnnnaggcgaccctgtcaggccaggctttcagggtggattttactttgaagctgttgttgcaatgcatatcaaattcattgaggctctgctgccaacttgatttgggagatggcctgcaacaacttcacaccctcctccattacaatcgtgaacaggctgggaggccgccaatctgggcagcaacttcacctatacctgcatctctcagccggcgggcgatgtccagaagatcgcctatggaaagtgagtgggtgactgcgtgcatgggggagctggagcgttctctccacaggggcaatttgagaaggtaacgagctattgtatttgccccttcccttgccatgcgggctagaggaggagggtcttctattgggaacaaggggtggtcacagctcagctctgtcatcatgcgattggaaacccggcccctcctcatgctgggctcctagcctccacatgaccaggccctttccccctgttctgaggcgcagggtgtataaccaaatccccagcgtcatcctggatgccgtcaatgaggaggttgatgtgtacaacgtgagttgctcgacccatgcctgcaatttctatgccacccacgtccaacacggcagcataacccacggcagcagcggggccggcatgtttgccgacgagctgggcaagatcatgggggtcctgtccaccgggcgcggcagcgtctgccccggcacggtgaacaaggatgacccgcgcccatccagggtcgtctttgggagtctcggaggggtgagaggggtgggagtgaggaggaaactatctgggctgtagagcaggcggtgtggagccaggcacagaggcaccaccatgcaggccaggaattgcagaagctgatgaggtccgagagcctgccatgtcatgcctcccacaagcctgcctcgcaccaacgcgcaggcctgggagcatgggctccaccgcannnnnnnnnnttgagagcctgccatgtcatgcctcccacaaacctgcctcgcaccaaccgcaggcctgggagcatgggctccaccgcannnnnnnnnntagtggttggcgggttgaagaaaggtagtgtagagtctcgcataacagcatgctgccaataggcagggcccaatactccacatggcacgctcgatcgccgctaaaatctgcggggttgggcgttcggcgcagccctggctattggcccaggcgaggnnnnnnnnnntcttcaatcgctccatcgaggacgagggcggggctgagtttgaggagtacacccgggccctgcccaccatcactgtgggcaacatcgtgcccgaggtaaacccccgcaaaggctccacatccttctccattgcgtgagtgggctgggggaagggaatggatcagtggttggcgggttgaagaaagttagtgtagagtcttgtataacagcatgttgccaataggcagggcccaagactccacatggcacgctcgatcgctgctaaaatctgcggggttgggcgctcagcgcagccctggctattggcccaggcgaggccagcatacccgtggccccatccctgtccctgcgacgggagtcagagcaacactggtactccggcccatgactcaactgcagccgctttgttcccacgattcctggaaaaccagatgctctctccatgctctaatccccacaggctgcagcaggagccagacaaggacaccaccatccgcctcacccccctccagactgacctggtgagcgtcacgccgcagacgctcaccttcacgcgcagcaactggcgcacgccgcagttcgtcagcgtcaccgcaggtacattgggggatgnnnnnnnnnnnnnnnnnnnnnnnnnnnnnnnnnnnnnnnnnnnnnnnnnnnnnnnnnnnnnnnnnnnnntgtcatgccgacggattccagccgtccctccagctgccatgcccaggcctgtgccacccacagccccccttcccacatgtccacagtcccaggcagggcccaccccgaggccacgctccagtttgatgttgcgctgacctggcccgtcgtgagcgaggccggtgggtggagttcgcgcaccaagaccatctcgtgagtggctgggtggtgttggctggaacgcaggggggtgagattcatccagtgcccaggtgggcgtgccattcagaggtcccagcccagacccatggagcagcactgcccagcaccttgtcctcccaccactccctctggaaacccacccacaggggcgtggtgtgggctgaacgcaagggcaacagcttcttcaacccgcaggaggtccgcgtccccttccgccacgtcatggacctggaggtgggtagcaggaaagggaaaatgaagggtcgtgggaaggatcgctgggcattgctagcatacgtgggggcctcctgccaggggccccagccagtgagacccgcaagcccttccgcaacacctccccttcccttcccctgccgctcagaggtataacccccagatcccgctgatcatggaacataatgggcccttcatacccgccaagtactttgtctacactgcacagaagacagaggtgaccaggaaggggtggggttgggggggaggggaagatgacaccatcgttgagagtggtggaggctacccttcccctagacgtgagcttccagaaccacatcccctcacgtcgccaatttgcttcacatgcaagcccagcacgccctcccaaccccctccgctccctcagggagttgcaatcacagtctgtccgcatgagaggggttcaaaggctcagaagatgaccctcgagcttctggatgcaacgtggtccacggagaatgccatcctgtgagcaggagtcagggtgggaggggggtgcaggggtgaggtctgagccctgggtttcggtctgcacaggccccctcaggaagcccatcctccttttgaatccacgcagtcacaatcagacagaggtggactcccccagaccagggtgcagccgcatggtagcggcgcttcggaagggggagagtgagtgcttggtgggcggtcgggtgaggagggcgttgaaccctcgcttgatccagccattgcggtcgggggcagggcggtctaggcgcatgggaccccaagccctgccccctgccagcgcctccccaccgcagacaggctgccccggtgcagcggcgctgtgccacatgacattcacccacacattcctctccgctgaccgtctctccagcttactactttgtggcccacccccggacccaagtcaccatccccggccagtctaagtccctgaatgggaaagcatccatgaccatcgccagcatgcccctcgccgaggtgtgcaggcagggcatgccagtgcagggcggtgcaggggcagggccttgagactgggtgggaaggcaggcacacgggggagagagggaagggcccctcctcgctgaccccatcccaccctgcgcacacaggctgtgactgagagtctgaatcccaccaggctcaggatcccagctgtgccctcgcacgccgtcctcccggtaagggagcgctttcctctgagcctgcaccccagcaattatgatgatgggagacataggggtgccctgctcacagtgagttttgtatgcccagcctatctgttgaattatctgccccactttcccgcaatttcttgnnnnnnnnnnagagcgctttcctctgagcctgcaccccagcgactatgatgatgggagacacaggggtgccctgctcacagtgagtttcgtatgcccagcctatctgttgagttatctgccccactttcccgcaatttcttgaccctccagataaccatcgcccccgttcttgcctggctggatttggaggaggaccacaccttgaacatcaccacctgctccaacaagaccgacgtgggcgcggagatcactgtcatggacgaccagctggaggtcatcaggtgcgtgagccaggcgacaggactgggtctgggcctgattcagcgggcatgcatgcgccctgcgcagggagtgtggcgagagtgtccatggccccaccgccggggccgacaccaggctctgcacaggcgttcctcgcacgagcacctgcaatcctccatgcaggaccactgggcttgccagggacaacgcctgtgtcagcatcccaagtgtcgtggtggaaggggggcgccgctacttcatctcgataaaccctgtacagtaccaggtgggaaggcgtgcatggatgaggggggtgatggctttctggtgcatcctccaagctccccagcttgagggacagtaccatggaaagggatgggttgccctcccaacactcgctgagcctgtatcctgcgcataccccacagttttccctgggcaagaagacccaccaggtggacattcacatccttgacgcataagatcgtgaggaggaaccaggtactggcatccctctgcactcctgcatttttcttccagttatggtcgatgaatatagagcgtttctcgcgaccagccatccttgctccaaccaccctgcacatacaattcccccccatccactccacataacgagctccatatctccagatgcataaaaccttccgtcattactgtgatgtcgtgaattctatactccattgtaagcacgtgcagggtcggcgagcacagacgcaactatagaccagcatgtttgggggggggggggcgcgggcatgtcaaccttacactgcctctatctccgactccgccccgccctccgaggcggccagctggctgccgcgtcggagcagctcctcctcacgccgcgccttcttctcgaaccgtgcccgttccagggctgcacgggcccggtcccacctcctcagtatgcgcgtggccagggggtgcgccagaggctcctccccctcgcgcagggccgtgcagtgctcactgtacacgctgcaggcatgccaagtgtgtgtggagatattgggggaggggggggaaggtttgcttcagggggctttgcgccatccgctttcaggagcagcgggaagnnnnnnnnnngggagatattgggggggtggggggtgggggagggttgcttcagggggcttcgcgccatccgctttcaggagcagcgggaagagcggacggcagccccaggttgcggccgccccagctccgcacagccgccttcttagcaagggctgctttgggatgcgcaaaccgatcccgcccatccctcaccaagcacgcccacacctgaccaaggcacccacctgtaccagtcggggcgagccgtgctccaaaaggccaggcagttctgccacgcccccatgtcaaatgggttgctgcatgggggcggggcggctgggtaatcagagggtgcatgcgcgtccgggcagcacctgcatacctatcagtgctgcgacagcctgccttgggtcagcctggggtcctcaaacaaccacccaaccccatgagacctccccttgggccctcgcacctgtacagcccctgcgtgtcctggaggtaggcgtacctcctgcgcaggatcatctcgttggtggtcagcgccgccgccgtgccccacagcgcacggcccaggagtgcagcggtgcccatgcagatgcccacctggggcaggagagccggaacgggaagaggtgtactgggggtgtgattctcagctggaacgtgcgtgtgcataccagaagtgcgaccaactcagcacctgaggacgtatggccctccatcgactggggcaaagtgcccttgcagggcagtcatctcggcgatctgcaagcttgctatcacagtccctttccccctaccccacccccccaaaacaaacatggcactctcaccgtgagcacgagcatgtagaggacccccggcgacgcccgccagaccagggccatgtggggcagcacctccagtaggccggggagggtccgcaggtggagagcacggaggatgagcagcctgtgaggggagtgggggcacatgcggcaaaggagtgaggggttcgacagcgacgggatgcgcagggaaccctcgtgacggcacgtgcccggccgccacttgtgtcagccagccccctcacgagagactgtcacctccccgcacctgcagtatcggacacccatgcccagcatgacggcctcggccccgaagagggtgagcaggtaccccaggaactcgcggcggttgccgcgggccacacaggtccccaccacggggcagtggtggtcaaactcctcgcagcaccgaccgcactgcccgcagtgcttggagcggatggggcggtacgcgttgcaggtgtagcaccaggccgggttctgggcctggagcagtgcccgccggcccgggtccagcgggccgtccgggaggggagggcccaggggcacaaaccctgggtctagagtccaggtcctgggggaggggggggggggccnnnnnnnnnnacgcgaatgtcagccgggtggtatgcttgccgagactgctgtgcccaaggttgcacaggcaggcggggggatccaatgcaaagggttccagggaggcggatggggcaaacgccctgggaccacatattgccctctgctgcctcttccccctaagaaatcaccaaagaagcatgcacgctcgtacctgtactgaaggtaaagggcagagccggccagcaggaagaaggcagcgcatggaagcagggccacgacaaacatcgggaacatgccctgccatggaagaaaggaagannnnnnnnnngcgcaaatgtcagccgggtggcatgctgaccgagactgttgtgcccaaggttgcacaggcaggcgggggnnnnnnnnnnatccaatgcaaagggtttcaggggggcggacggggcaaacgccctgggaccacgtatggccctctgctgcctcccccccccaagaaatcaccaaagaagcatgcacgttcgtacctgtactgaaggtaaagggcagagnnnnnnnnnngagatggatctccagagtacgtacacaagctgaaactatatcaccagcttctcaacaggccaaccaagcacaagcaggaggagcatgctgcgtggcctgtatttccggctgcgccgccttctcccgatcacaatatgagcctccctttcccactcacaaaagcaaacgtgaaaatggcagcgagctctaaggccacaactgtggcagcgggaaagtacgagaaggggatggcgcgggtaggcatccccgcaactgcatggcgttggaggtacgagtggacgtgtgtgctggtttctggccggcgggagcagccggatgacggcgtgggggcannnnnnnnnntgttggaggtatgagtggacgtgtgtgctggtttctggtcgacgggagcagccggatgacggcgtgggggcagaagtgcaagtgacagcaccaccgcatggtgtgagcgccagggcctctcgtggtgccctcccatccactttaatcaaaatatggccgctgatcgcatcccggaactcacctttcacgagacagagcgaagtccccatgaggaaggccatgggaaccacaaagagggctatgaggaagggtagaatatttaggaggaagcacatcgccaccagcgcagcaaaaaggggaggaaatgcgacgtccagatgcacgaggtatgctctatcgcaaagagattggatgtgggggttgagtggacaggtgggcagagcaggatgacagccatccaccatgcccatcacccagtgtcaaggcccaattacacacaggcagcccacccatgggagcccgaggactactcaaatctccaacaacccagtctctacctctggtacagctcccagcagctctgagcttcctcggactccattgggtcttgctcaccgcacttccctccccccgacgcatgcttgcatcttggagccggctccaccctgccgtgtgtcacatccacggtggcagacatagcctctggaccccctcgagccaggtgatccagcgcctggcgcacagacgcctcggtcatggggcccttgccggccacgccatgcgaggccaggcgctcattcaagcgtttggctacttcctggaaaaccctgctctgctgctctgcagaggcctgagcggtgggctggggctgctgggagggaccagcctcgccgttctgagcagcagtgccaggtgcttgaaggccgcccagccctgtcagggaagattggcttgcctgcgtggttgggggtcgagctagcgcctgtgggacgacggttaatgccaacgcatccaacgagagcaccacatacaatgccgaccatcaccttggctgcgaggagggtcttgctggaggtaggtcggggtggaagacccagccccagtcctgcctttggcatcagacccagcacacggagtgtgtgctcgaaagaaccatggtacagaggtaaaataatctgcaatgtacctacgtggctgttgtcgtggtcacgagagccctttccacacccagggtgagacatgggatgtcgctgaagtctttaccatttcgggcgccacggccggcttgcccgacctcgctggtcgtccagcgcgccgagatcgctgggtgtatgtgagagggccaggacccgactaccctctcctattctcaccctagcacacctggatcacatcccacgcagcgagctggcacatgcagtgagttcgggggcgacggggcccacctgcactcctccgcgctcgctcagccccagactggcgtccctgctgcgtccagccctgaggctgcggtctggagtatcgtaccgaggccattttgcatttgggatagtaccaggaccgcgatctgcctgtcgctccactggggtccagtcggcaccggccggcaccaggggaatggcagtctcaccccgcctggagctgacctccgaggagcagcagctctttgataccctcctggccgcgtccaagcaggtgcatgtgtgttgggcagctggccgccctcaccattcctgttgttacccaggtctcnnnnnnnnnnatccaagcaggtgcatgtgtgttgggtagctggctgtcctcaccattcctgttgttacccaggtctccgcgcccacacctggccagacccccatcattccctcccagctggacctctctttccccccctccctcccccctcccccnnnnnnnnnngctggccagacccgcatcattctggacctctctctccccccctccctcccccctcccccccaaacacacgcgctccatcccacccacacgaaacaacaacaccacaggccggcttccccaccaccctgcgctgcgcggggggctgggtgcgcgacaagctcatgggccgcgcctccgacgacatcgacgtggcgctggacgacgcgctgggcagtgcctttgccgaggcggtgaacgggtacctggcgggccaggggcagggcgtgcacagcgtggcggtcatcgccgccaacccgggccagagcaagcacctggagacggcgcgcatgcgcgtgaacggcctctggctggacctggtcaacctgcgctgcgaggagtatgccgcgggatcgcgcatccccgccatgcgcttcggcacgccacgccaagacgcggagcggcgcgacttcaccatcaacgccctgttctacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaccgcacaccccgaggtgggagcagggttcgaaggggggaggggggcgttcttgtgggggnnnnnnnnnngtcgcgcatcccggccatgcgctttggcacgccgcgccaggacgcggagcggcgtgacttcaccatcaacgccctgttctacaacatcaacagcggggaggtggaggacctcaccgggcgggggcttgccgacctggaggccggcgtcatccgcaccccgctgcccccgcgccagacgctgctggacgacccgctgcgcgcgctgagggccgtgagattcgccgcgcgcttcggcttcgagctggaggagtccctggtgcacgccgccgcgcaccccgaggtgggaggagggtttgaaggggggaggggggcgttcttgtggggggggacaggaaatctggcaggagcaatgggtgagggaagggggggggaagggaggtgatgccccggcaggggcctcactcccctcctgcagcagcaaaggttgcatggtggccgaccagccagccacaccaagactagcactgcgctccgcaccattgggggcaccgcccttttgggatcgtgcggctgggctccacagcccannnnnnnnnnggccaaccacaccaagactagcactgcgctctgcaccatgggggccaccgcccttatgggatcgtgcggctgggctccacagcccactgccgcaccgaccagagcctctgcaccactgcacgacgttacaagtgctgcgcggcataggcactaggtcacccaagggcatgtatgcacgcccgctcggcgcgtcccgggactcccgccccccccctcaggcctgtgccttgggatcctcctccatgggcacgggactggccgcgcggtggccgccctccggcagcgccgcggcggtggcggcggcctgcggcgcgcgcatcgcgcggtacaccagtaggtaggccatgtgccagtcgccgccgcccgccagggccagcacgtcggcctcctcccgaacctccatgcggtcgtcnnnnnnnnnntggcagcgccgcggcggcctgcggcgcgcgcaccgcgcggtacaccagtaggtaggccatgtgnnnnnnnnnnatcgaacaagatccagcgcccatcgccctgtttgacccaggcgacatagtgccccgagtcagcgctgcgccccttgtgcgtcagcaccccgnnnnnnnnnngtcaaacaggatccagcgcccgtcgccctgtttgacccacgcgacatagtgccccgagtcggcgctgcgccccttgtgcgtcagcaccccgcacagctcgtaccgcgcggtgagcgcgccgctgttggcggcgggaggggtgtttgctgctgccatggtggcgggcgctggggcatctgcaggccccgcagccgtgctggggccgggggccgcgtcgcctgccgcggcgggaccggaccccgactttgacgcgccggccttggcatcctcggccgccttggccgcctcgcggggggccttgagctcggcctgcagctcggggctgcagaactcgaagacgtcgagctgcgccgggaaggccacctagcgagggggagagggggaagggtcagagtggtgcagcttcagtcctgccattcggctgccgatgtgccaacaggactacaggcccgcgctgccnnnnnnnnnnggcgagggggaagggggaaggtcagagtggtgcagctttagtcccgccatttggctgccgaggtgccaacaggactacaggcccgcgctgccagcccctggcgccagttgcaccccgccggctgtcaccaggtctaccagcgccgcccaagaaaatccctcacctttctcaagatcttggccttttgctggacgtccgccttgtagtagaaccgaaccatctgcaccgtcaggtagggcggcagggccgtgatctgggacgacccgacaaacggcgcgatcctggttggagggttaggattgagaggtgttggcgtgaggcagggcagcatggcatgagggacggctgcatggcatcctgggcctgtggaagtagactgcttcgagccctgccagcctgcgtccttgacgccatccaccctcaatccccgtatagcccacgcaaatacagagacacaacacccgctcacctccccagtgcagcgctggtcttttcccggtcctccttgaggccgaggcggatgccgtcggccaggtggttgacctcagcgctgatgttgcacttcagcgtgtaggccgtgccgacctcctccaggctctcgccgctctcggcgcaggtcaggcgcgccgccaggcgcacgccgaacaggcgctccaccgccgagccggcggcgggggaggacccctgcagcgtctcgcgcaggacgtacagcaggttggtccagcactcctccgcgtcctgttgcatgtagtagccctccctgcagtgcatgggagggtgggagtgcggtggcaaaggtggtgcatgagggaggggggtctgtctgtgggatttggggttgggcgtgcagaatagtctgcatatcgtggcaatggttgcagaacctgccccatgctgggacagggtggcaggttnnnnnnnnnnacatggaagggtgggtgtgcggtggcaaaggtggtgcatgggggatgggggggtccgtctgtgggatttggggttgggcgtgcagaatcgtctgcatattgtggcaccggttgcagaaactgccccatgctgggacagggtggcaggttgcacgaggtctgctccctgcagaggcgtgccttggcgagctcttgcgagtcatgagcatacattcctgcagcccccttaattcccccttccacacacaccagcgcagggccacccccacaaaacctcaacccacnnnnnnnnnngtgagcatacattcctgcagcccccttgatccccccttccaccccccccccgcacagggccacccccacaaaacctcaacccactccatgccttgcctggcctgctgagcaaactggggaaacttcttgcggaggctcaggaggaaggccatgggcggcacgggctgggccgaggtggacagcgaggagaacagtgactttgtcgccgtggtgagcgtggcgttggggtccgtggatgtcagcgaggccgcggcatatcgtgccaggctgagggatggagggggtttgagggaggagtgaaggtgagctgccttcgtgtacgatcatgtggggtgtcccagggacacctgcccaggcgggaggcccaggcggcgccannnnnnnnnntgtgccaggctgagggatggagggggttgaaggaggagtgaggtgagctgcctccgtccatgatcatatggagtgtcccagggacagctgcccaggcgggaggcccaggcggcgccatgctgtcagcgacagcctcatgcccagcctgcttttgtgcgttgggtaacaatcggcttgtttggcccccaaacatattaactgtccaccagtcccattccagttgccaagcaaccccccccccccaacgggacccttctttcggtactcactcctcacgcagctcctccacgccnnnnnnnnnnccccccccctgggacccttctttcgttactcactcctcacgcagctcctccacgccatacaggcactgcagcgtgctgttcatgtagcaggtgttgcccaggttctccagccccgcgccgtacttgctgagccccatgacgtcctgctggtcctccggcagggcctccaggaaggtgggggcctgggtgggggccaccggcacagcccccgcagtgcccagcatcgttatccgggacccgtccttgatccccgtggagccccagtcggcgtcgtcgcggagcaggccccctttcaggcccataatcttctggcggtcgggggccacccccgtgagggagaagagctgcgtcttgaacacggcgggaggggcggagatgtccacctccaggtccttgaacacctccttctgccacttcacctccacccgaaccatggcggtcggcggggcaggatggaatgggaggtgtcgcgcttgggctcctggactgatcgcgggctctgtcacctggggccgaggcctgccgcggtgtcgattcagtagcccagcactctctcgacagcaaatgcccaccatcgatcgcagctttgacggttgaaagtgcatttcacgatgccgtccgagcggctcgacctcgcgtggcatgcgcagcacgttgccgtccctcatcccctcctcgggccgcatgggttcctgcaactgatcatggctattctcccgctttcaacctaagatccccaacccctgcacccttcagttatcctcttccccacgaagtactcctcacaaagtattccctcccaacattacccccatgcacagatagcgtctgccctggagnnnnnnnnnnggtgctccccacaaggtattccctcccaacattaccccatgcacagatagcgtctgccctggagcaaaaggtcagccgggagcgggtgggcactgaggtggatggcatgctgggcggccccgacccggtggccgccctggacctgctgcgccgactgggcctgatgcacgccgtgttcggccacgacctgggcaccgacgggcgacccggggtggcctgggaggccctgcgcctgctcgacctggggctgggccgggaggcgcggcgcgacctgatggccgcggcggcgctgctgccggtgcgggaggaacgagtgccggcggccaagggcaggcacacctccctggcggccagcctgctgcgcaccgccctgaagtggcccacccggagtggggagcgggtggaggccctgcatgccgccgcgccccagctcctgcaggtcctgcaggagggcctccgggtgaggacttcattggggtgtgtgtggaggatgaggggtccacaactggcgaggggggaggggtgggtgttagtgcacgacgcgtggtgcagtgcatggggagccatgacccacgccgcgactcctcccgcaccccaaccaccagaacannnnnnnnnntgggaggggtgggtgtttgtgcacgacgcatggtgcagtgcatggggaaccatgacccacgccgtgactcctcccgcaccccaaccaccagaacacgccccgaccatgcacacgcgcgcagggggaggacggggccgtgggcaaggagagcctgcaggtgaccctggggcggtgcctgctcgcgctcaaggacagctggcgggaggggtgcctgctgggcgccctgctgggcagtcccaccgaccctgccggcaccgcagagggctgccgcagcctggtggccgcggtggggggctggggcctccagggctgctgggagtggaagccgccggtcaacgggcggcgcgtcatggcgctgctgggggtgagcgggaaggaggtggggccggtcatggccgccatcaccgactggcagctggcgcagccgggcgggagcgcgcgggagtgcgaggcgtggctcctcacgcagaccaggtgggcgcccagtgtgcgggaggcgacagcgcccgaagccggggacggcagcgttgaaaagtgacggccacacacggagttgtaagatgcaaacggggcccatcgatcaaggggggtggccagggtattcaagcgaagagcccaggtccactccaggccccgtcacgttgggaacactggcacagcgcacgatgaggagcagaccggcaaaatgccaaaaaaattttggaaccatttctcgaacgaagcgtgtcnnnnnnnnnntttggccagggtatttgagcgaagagcccaggtccaccccgagcctcgtcacgttgggaacactggcacagcgcacgatgaagagcagaccggcaaaatgccaaaaaaaatttggaaccatttctcgaacgaagcgtgtcatccttgcgcaggggccatgctaatcttctctgtatcgttccaagtttatcatatgcccgaaggcaagatgcaatgaatttgtccgatatatgtaccgtacctatcggtatgttctcgggttatgggttgccgccgcgaaggcaatttgctgcatcgcatgcgaagaagacacccctttggcatgttccaaatgcattgtcgacagaccaagcatcatacctgccataaacagcagtttaggcttgcatatttgcagaagatggtgggtgccctggtgcgcgtgggagaagtnnnnnnnnnnggatggaatgaatttgtctggtatatgtaccgtacctatcggtatgttctcgggttatgggtggccgccgcgaaggcaacttgctgcatcgcatgcgaagaagacaccctttggcatgtttcaaatgcattgtcgacaaatcgagcattatacctgacataaacagcactttgggcttgcatatttgcagaagaggtgggtgccctggtgcgcgtgggagaagtcggctgcgcctcagatggcagcaggaaagctcatgccgtggggcaattgtcccatgtaacatgtagagctactgcaacacaaaaggacctgaactggtggtgcatgtgcggtgagtgggtgcctctagcggagtgggtggcagttgggaagccctcgcagtgctcggtgaattgtcatgactccgtattcgagtggtcgacattggatttgagatctctgaagatgctgggtcgcagcccgattgccggtgtgtgtcgcccgccgagcacggcaagcttcgcatggggttgatggtcaaagaaagtgggctcaagctggggggccccctcccccccccnnnnnnnnnncggtcgacattgattttgagatctctgaagatgctgggtcgcagtctgattgctggtgtgtgtcgcccaccgagcacggcaagctttgcatggggtttggggtcgaagaaagtgggctcacgctggggggccccctcccccccatcgatctcgaccaagcttccctggtgcatgcacacctcttaatgtcaattaggtagcagattaggtcgcagacggcccgagcatgtcccccgactcaaagcatcgccacaagcgggctctgggtgatgtcgaggacctcgtgcggggggcggtggagaagacgctgcgcaggggcgatgcctcctctgccatctatgaagccatctccctgaagcaggagaatgaggccctccgggccaagctgacggaggtggaacggatagacgacgaggaaatcnnnnnnnnnnnnnnnnnnnnnnnnnnnnnnnnnnnnnnnnnnnnnnnnnnnnnnntcgtgccccgcttgcagctgcttgcgcgtcgcgcttgtcgacgagcagggtcccgccgcgattcaggccctccaacccctcctccatgtgccaccttcgtgcaggggagatgcacaaggtggtgcgggagcggcgctccgccccgtgcctgcccgcggcgcgcggcgcggccgcggactcggtgccgacggccgagctgcggcgcatggtcgacggcgtgaatgcgcagctggcgcagcagaacgcgcgtctggacgcgcgcttcgaggccatcggcgagacgctgcgtggcctgaacgccagcatcgcgtccctggccgccgccagctcggcgctgggccccgccggcaacgggaccctgccgcgcctggggtcggcagcgggagaaggccctgcggcccggggcgacggcccctcgccgcccctgctgcaggaccgcatgcacgcaggtgctggcccggccgccgcggcgccgcagcgcatcgcggcctnnnnnnnnnnccggcagcgggagaaggccctgcgccctggggcgacggccccccgccgcccctgctgcaggaccgcacgcacgcaggtgcgggcccggcc

SEQ ID NO: 26622 - DNA, 62 bp, Chlorella protothecoides
ggcgtgttcgaggtcaaggccaccaacggcgacaccttcctgggcggggaggactttgacaa

SEQ ID NO: 26623 - DNA, 368 bp, Chlorella protothecoides
  modified_base (132)..(313): a, c, t, g, unknown or other
acaagcagggtgcaggcgacggctgcacaggcacttccgcgacatgaagatacaccattggccggcccttacaccggccccttctccccacctcgttctttacaaagcacatggtgtcgtagatggcggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcgaaggtgagggagcggagattgaacacaccctgtgcggacacttcaagca

SEQ ID NO: 26624 - DNA, 61 bp, Chlorella protothecoides
cccctcacccgtctcgaagaggccaacaggaaggacagagctctgcgtcgccagtgaggga

SEQ ID NO: 26625 - DNA, 149 bp, Chlorella protothecoides
catcagtgagctagggtttgtgtgtgtgtgtgaatgtacgaattgatctgggcacagcaaagactgtcccatgcctgcctgtacgcaacatccatggcgacagcaactgtcaccatcatccctaccccatcacccccactcctccaccc

SEQ ID NO: 26626 - DNA, 80 bp, Chlorella protothecoides
tcctcggcatctgcctgacccaccattattctgcaggggtaattaccatatttgtgaccgagtgtaagcccgccttgccc

SEQ ID NO: 26627 - DNA, 61 bp, Chlorella protothecoides
cgatgcttgaacagttcgacattccagtccaccaaaacctctgcagcgcccctcacccaga

SEQ ID NO: 26628 - DNA, 451 bp, Chlorella protothecoides
atgctgtcgaaatagttccaaggctgcacacggcatggtgttttcgagggaatagaaagttgagtattgcaggcagcacaatcaggcgaccaggcaagagatgcaacgagtgtgtcacccaggcaaccaacatgatcccggcagctcgacgctaagcacctcaccttgatgtagaagtttgcaccaaagttggagatgagaggtacatcctctgcccggggtatatgctgcacccctattgtcacccagccaataaggtcagtgttggtcacgctttcgcctgtttgtaaaagagcgagagggaggttgagaggatggatagtctgatactgcttcgacgcagggctgggaggctgaatgcttgctctgcctgatgtcaaggtgagaaaatgcattggtcaagtaccatgctagactcttctcctccaagctcacttcacaccataccatc

SEQ ID NO: 26629 - DNA, 65 bp, Chlorella protothecoides
gaaacgctgcactggctccatgatcgtgcaggccatgctgctcaacatcccaccagcagaacgct

SEQ ID NO: 26630 - DNA, 61 bp, Chlorella protothecoides
tcccttgcccccaccatcccaaaaaccaccacctggcaggcccgcgccttctacggcttcc

SEQ ID NO: 26631 - DNA, 78 bp, Chlorella protothecoides
tgagcaggggcctgcggacctccaacctcactgcaggcacgtggtggatggatttggggcagttcagggtgatcctgc

SEQ ID NO: 26632 - DNA, 75 bp, Chlorella protothecoides
tgcgcccatgtcccagacgatagaaaaggcgaggcgatccacccccgcgttcaagctgcatggaggggggggcac

SEQ ID NO: 26633 - DNA, 79 bp, Chlorella protothecoides
ctacagccgcagcggcgccacctcggtctttgcctgggcgtttgcggtggtggcctgcggctggggggcaagcaccgtc

SEQ ID NO: 26634 - DNA, 72 bp, Chlorella protothecoides
tcccgatatttgtgcactgattggtggccgactttgtgatgacccgccgttatggcgctcaacggggcggca

SEQ ID NO: 26635 - DNA, 61 bp, Chlorella protothecoides
tgcactgcgtacctgtgtctcgggagcaaactccagctggaaggtcctgcccgtcacggtc

SEQ ID NO: 26636 - DNA, 61 bp, Chlorella protothecoides
gagccgtgggcgccactgcgcaccctgacgaggcccttcgttgctccctctgcaggccgtc

SEQ ID NO: 26637 - DNA, 76 bp, Chlorella protothecoides
gaggacggtggaggagaccttttttgacttctcccagaggaggaagggaatactgagggccctggtacaggaggtg

SEQ ID NO: 26638 - DNA, 72 bp, Chlorella protothecoides
ggaatactgagggccctggtacaggaggtgcgtgggtactttcggtacggaatgggtccttgcaaggtcagg

SEQ ID NO: 26639 - DNA, 192 bp, Chlorella protothecoides
ctgcgcgacttctgcatggtgggcctgagtaactccgcccatgtcgatgtccatggttccaggaatgaatgattgcaacagagcctcgttatgcacgactgctggccagccagagcgccctgccacacacccctgcaggcctacacgtccaccttccagccactgctgctggaggaggcggcggcccagctc

SEQ ID NO: 26640 - DNA, 79 bp, Chlorella protothecoides
gggggcaccgggcacgaccgagacatgcagactacgttccatcgtcctcgtactcgataatctaccagtgcactgacaa

SEQ ID NO: 26641 - DNA, 61 bp, Chlorella protothecoides
gcatttcggttcaccaccaggaggtgttacaccgccgctaaacctctcttcggcataaaca

SEQ ID NO: 26642 - DNA, 280 bp, Chlorella protothecoides
ccgccgctaaacctctcttcggcataaacattcatcatggcacgtgcacttgtcctcctgctggtagccctaaccgtcacgacggtcctggccgagaaaacctcactccctctcaaccctgactccattgccgagggtatgtctaatgccttccagatcgtgacagaagtccatgcggccacagcaataggtgcatccagccgattttcttcccatcggctgaggttgtccccctctggtgttgttacctgcagtgttcaagggcttctccgaggagctg

SEQ ID NO: 26643 - DNA, 62 bp, Chlorella protothecoides
ctagcaaccggtgcaagcccggtagggggggtaatggtattccgtgctttcccgggtgcccc

SEQ ID NO: 26644 - DNA, 255 bp, Chlorella protothecoides
gaggcccagcgtcgacctccggcctgtgcagagggaggccagcggtggaagggtcccttagggatggagaggcgatgagactgggccctgccgggcctcgacagatgccagcgtttccattccaccacgcgctgtgagcctggcgccgggcctgggcttgtatcagtccaggctgctccttgctccagcggggctgtcacactcacaccctggccccaaacccctggtaattgccccctgtcaaccactgtgccc

SEQ ID NO: 26645 - DNA, 7680 bp, Chlorella protothecoides
  modified_base (3316)..(3325): a, c, t, g, unknown or other
  modified_base (3382)..(3391): a, c, t, g, unknown or other
  modified_base (5165)..(5174): a, c, t, g, unknown or other
  modified_base (5532)..(5541): a, c, t, g, unknown or other
  modified_base (5969)..(5978): a, c, t, g, unknown or other
  modified_base (6177)..(6186): a, c, t, g, unknown or other
  modified_base (6403)..(6412): a, c, t, g, unknown or other
  modified_base (6904)..(6913): a, c, t, g, unknown or other
  modified_base (7059)..(7068): a, c, t, g, unknown or other
gggatggtggtgcaggggatggtggggagggagggggggagggtgtggggggcattcctgacacctgaacgacagcagagtgctgaaaacccaaatcctgatcaaaataaaagccttcacaagtgccgctgggatcatacagaatatccaaggcgaagcttcgctctgtcaccaagccgctggggtccaagctgacagtccgtatgccgctcttgaatctaaatgtcaggtgaattctaaaccgcacaatggttgccgttcctacacttacggcacacaccacgttcaagaagcccgcttcgtagcatgatgcgtagttgatgatcatcgtttggcgtggtggagggggaggaggaggccgaggtggtggaggccggggagggctggggggagagggtggtggtggggatgggggaaaaggaggggggaagggggagagaggaggggaaggagggcgagggggcagccggggcggcggcggggatcgtggcgggggtgacggtggaggtgggctgggctgcggggctgtgctgaccatgggagttccacccaccttccggctgttgtcccacacctcggcgtacaccagggtcacctgtgtgatgctctgcagagaggcttggtgggaggtttccacagacatggggtgaatggtcaaaacctccacaacggtgttggcgttggcaatgtagtgcaggacgatgcgagtggccaggaagctggtgaggacagactttgcaggttgacgtcccgggtgctcctatggtgtcagactgccacgtgcacacagctgaggtgatggagatgggtggtgtccccccgagtatcggacggggactgggaatggggacgacatccagcacctgagatgtgatgggtgggcgactgttttccaaataacgattgaagtatgcgtaccccgtgccggcttccaggacgcccgcctcagtccaggtgaccagcatatgggagctggtaaatttgaaggggtggagcttcacgttgttcccccagctgtgcaccacgtagttattccaatctctgggagtctcctctgtaacgctagcaaagcacgtgaaggatgagtcggccgcattgccagagctcgtgccattgcacatgatgaagttaatgtaaatgtaggggtagtctgtggactgtgtgtggtggaggggacacgtttatgaagcgatacacggtgcctgcatctaaaaaattagacaggacgttgtaaatttgatcgcactcacccagaaagacgcctcagcgagaggcacggcgatggccaacaccaggagcagacccagtcgcgcggcacccattccggggtgcaaacgcgcacgacacgagcacattttgtcacaattcgacacagtcataattcatgaacctaacagggtggcgattatgattgatatatcccttccgcgaatgtttctcacgcatccgcggctcaaggtatgttcctgttgatacaggccccgcggaccgccagtgggtccgccggtggctccggtgaccacgggtcgcttcgtgatttctggtccagattacaaggaagccgacgctggggcatacgtggagacggaatggacctcgacagtatcactcttgagctcaagaccattgcgataatatcttgaggctggttatagcctcgtagagcagacaatacgcagacccccctcatcgaccctcacgtccacgatcggacgcactggcaaaccgcatctgtagtgcttacagctttgctgcatgcattcgcgtttcgttattcgggagcaagaactgcaggggctcaaagtgcgcaaagatctcatacgcctgcagcctagactgcatttgttgctgaggagcaggtcccagcttctctagtaaggtgtactgacagccacacctgctcctctcacacagaattccggcaagatgccttgctaacactatcatagatatgtatcagaaaatgaaaaagggacgatgcatatgtgtctgatgtacgatgtgccgtaacttgctcctgaggaaccagaggaattgggacatctgctctttgaggagtaaaacggctctgcatctgacaactttctcagaggcggtcgaagtacagttctttccagtttcctcgatgcgggctgtgtgtcattgctggatgatcagcgtctgaaacccatgtacagtatttcttgatgagaagcgtggattaagcttcctgcgtctaccccagtgcaatacgtgtgtcacacatcataccggaccgcccatgcaaactacaccgtccggacggatcgtcgtgagtgttgtgggggcgctagatcctacaacgtggcctgctatatctgatccaagttgcaaatgttataacccagtactctagtgtagtgttgggatcgggtttgatatgtggcgtgggctcggcgcagcgcgggatatatgggacacaacaacgagaggacgacgaagcccatctaccagtcttgcgatacagaaggtctctgttccgacagatttaagttcgcgcggatggtatgcttctccagttcttgagctggactgtaaggcagctgccaatatggcacttccgggcccctgtcctacctgcgacgaccctcctgcagtgctcacccagctgtcactctacagagctctcttgcaggtagtcgtagcgctctcacgatctcaggggagttgtctgctggcacggctactacaactttctataatctagcagtgacgtggacggcgaggaaaacgtgatagtctatctcctactttctctaatggcgtcaccttcccctacgccgacacaaggtcccaccacgacttgtagcatcggctcggcgagaggagcaggcattgaaaccaccatcatagctgcatagcatcacttcacggtgcagagtgccttgtcgccaccctcagtaatgagagacaggacccggataccgggtgcgttcgcgtacgtcgtattcttccaagcagcatttacactgcatgccacggtacgtgagttctcgtatttgagtgttgcaattggacacttgaggaatgtacgagcataccctgtttgagtggttgcacgtcccacacccactcttgcccctcctgccaggcatcctgcacgtcggccttctacgcgctcccaagtgctaagtgagaacccactgctcggattcggcttagttcgcgtgtctgtacctcatatgtccttcccgtgaaaactctgtccacctcgtacctccgagcatattccgtgtattatccggtcatggccttgcctcagctccatatgcaccccgcagatccggaagcaccgtgnnnnnnnnnnacgggaagggagggagctcgcctgcaaaggcccatgtgtcacatacaaggcaggcannnnnnnnnngacgggaagggagggggcttgcctgccaaggcccatgtgtcacatacaaggcaggcaaggacagctgacaggagacacatggagaggatgcaggggggtttctgaagaacggagtgtcgggagacgatgtcctgcatgccactgagttgtcagaacatgcgcagggttgtgctcgctcctgcgagcactcgcctaatcctaaacatgaagttctgaggagagaagtgacaagcaagggcatccatccatggttataggagaaacccctggcgcacaggcttccgacccaaggccattcctcccctgggttacaccagagcctttgttcccggtgaaggcggtagcgtgagcccgcgcctcgcccaggatcacatcagggactcgggacatgctgatgcctgcaacatggacaatcctgtgtggaagaatcggcctcaccagcaaggagactggaccaacaggattgattgttctgctcgacatggcagccctccttctttggaaggctcattctaacatctcccaatgcccctgtaggccggtatctctgcctgtcaccactggcagacctgcacatctaggtgtagtgcagtaggtgtctgatgtccagctgtgaagacagtcaggcacgaaggtatgcatggacgacaatcagcatactttgtcccagacatcaactaggctggtgcaagaaaagagatgccacccattgcgctgaatgccctcagcagtatggcgaggaggcagcaaggtggtgggcctgaaggcacgacagcactcatctctccttctaaaacggaaagcttcccttgttgcagtcttgtgtgtgtggtcatgtctgacgtgatagcgagtagtgctcctcacacccagctggatactggtaaatgccaccgccctgcagaatcaacgcgatgggtttcggattgaagttaaagacgatctgcctgcactatagggggtcgagtcaaaatttccgcgaatgccgaagaaaggaaaagcctccggagaaatacatcggcccccggtggggtagtacatgtcccctccctcgttccccggaaaatggctcttcccccttgtcccatacgagcagctggggccggtggcaccggcgcccaagatatgattgctcttggcttccatcttctcagctgcgtggcagcgggccctgttgccggagtgtcccattgtcacctttgagatgatgaagagccacatcgtcgggttagcgtggttgatcctctttcaagcttacgcactgcatgtcagggtacgttggacattttattatatgcttcgctttagaagactgttgggaacacgagaatgacctgtaacagagtccgtacgtcgaagacccactctttccccttaatcccctcctccaggcgtcctgcacgtcggccttctacgcgctcccgagttcaaagtgagagccgattgctttgattcggctggtgttgcgtgttcatgcctcaggcaaccatcccaccaggactcggtccagctctgacctccggatccacaccaaatctttgccggcatagcctcacctcagggattatgcaccccgcagatccggaagcaccgtgtttcttctcagtgatgacagcagcacgctcttctgcaggtacaaagctgaatccatccgtgtttggctcacagtggtgatgcccttctcctcccacctcaccaggtccctctcactccttccccttgcccccgccccaccctgtactgctcaggaagcaaggctacgccaaagctggtnnnnnnnnnnttaccactcaggaagcaaggctatgccagcgctggttcggttcggactggcctgttgggctcaaccgaccttcctgtggctacactaagtctcaagtccctgcaaaggtgctctggtagatcctgccagacgctcctggctgtggaatgtctgcggcgaggcgaggccgcctgcagagcggatgcactgggaaacattgggtctggcaacattggctggcacaactttggacggaataatgctgggtcccacaacataggtgagtaaggcctgtgtgagacctacgggaatgggacactttgtagggtgcctaatggcggcgcccagtgcacaggcattggacatgccaataaggtgnnnnnnnnnncagcggatgcactgggaaatattggatctgggaatgttggctggcacaactttggacggaataatgctgggtcccacaacataggtgagtaaggcttgtgtgagacctatgggaatgggacattgtgaaggccaagcaatggtgtggaccagtgcataggcattggacatgccaatagggtggtcctggaaagagctcttgggccgcttgccgaaaggcaagggctgagcttgggcatgcatgcaggccttgggatggcagtagaccctgagtcataccttgccttcaacggctggccgctctaggcttcataccctccctccccccctttgtaggcaacaacaatgctgggaacaaaaacatcggaagctggaaccagggcgatggcaatgtatgccatcatatccagggtttcagggcagcgtgtnnnnnnnnnncaacggctggccgcttaaggcttcataccctccttctccccccttgtaggcaacaacaatgctgggaacaagaatatcgggagctggaaccagggcgaccgtaatgcatgcaatcacagccagggatacaaggcagtgtgcccggcttccaggctggtgacgtcggcgactgtagatgtgacactggttccaagtccannnnnnnnnntcagtttccaagctggtgactctggccactgtagatgtgacactggttccaagtccaagacccaagcgctcccctcctcctcagagaagtgcttcaccccaacccttgtcaaggaagcctccaccacatcgtaccaagtatccacccccagctcttatcacaaggccgccgccaccacccagcccaaagcatgccagtcctccaccatcagcaaccnnnnnnnnnnccagtttccaagctggtgactttggcgactgtggatgtgacactggttccaagtccaaagcccaagcgttctccacccccttccaagagacatccgctgcccccacccctgtcaaggaagcctccatcaatcaaaaagagaccctccccgcctccaccacatcataccaagtatccacccccggctcctatcacaaggccgttgccgccacccagccccaagcatgccagtcctccaccatcagcaaccagtgtggctgtgaagtacctcatctgcgcaccgttgacggctaataaagtgtcctgcgcactccaggtttctacaacctttctggtgtcaccagtgacggtggtgatctcattcaagtctggagagacagccaccatcatcctccacccaacggctttgaccacatcagcaacggtttctgttacttccacatcggaccagggcacaggcagagcgttctacacggatccaatcaccaagtcnnnnnnnnnncagttcgacatctaccgagggcacaggcaaagcgttctacacggatccaatcaccaagtcgcttgtagtatcgcccatcgtgccgatcaagtctgtcccgcacctccctccagcccccccaagtgccccggttttcactcccccgnnnnnnnnnncaccaggcatcctcccccagccgcttccacaaggtcgccgcccccacccagccccaagcgggccagtcctactcctgtagcaaccagtgtcgtcgtaaagtatctcatttgtgcacctttggtggctaataaagtgtcctgctcactccaaatctccacaacttctctagtgtcaccagtgacggtgatgatctcattcaagtctgcagagacagccaatgtcatcctccacccgacggctttgaccacatcagctacggtttctatcacttccacatcggaccagggcaccggccaagcaatttacacggatccaaggaccaagaagccgatcgtgtcacccagtgtgccaatcaagacagtcccgcatcttcctcctgctcccccaagtgccccagtatacaccccttcgccagtggccccaccattgccctccccacaaccgcgctctaccccgccttctccacaatcagttcccactccaccatccaccagccccagccctcccccttcccacccgccacctcccagccaaattgcctccagtccccctcctccaagcccatccccacctcccacaccgcgcagcccaccccctcccagcccgcctcc

SEQ ID NO: 26646 - DNA, 2287 bp, Chlorella protothecoides
  modified_base (729)..(738): a, c, t, g, unknown or other
  modified_base (1341)..(1483): a, c, t, g, unknown or other
  modified_base (1966)..(2096): a, c, t, g, unknown or other
ccagcaccagccgctcccgccaggccacgcgcccggcgccgcccggcatcagcgcccgcgtgcgcgccccggcgccgcgctctgttccgctggtcgcctcggcgccggggccgagctccagctcgacggtgcagtacaggcgtgcgccgcgcagcctgcccaggccgtcgccttccagttccaggctctccacatccacgaggaggaggtccaggggcctcgcatcgggcgcaggggccgcacgtcgccgcggcgcatagctgggcagcgggcgcaggatgcgggtggcgtgcccggccggcagccgcaccatctccctgggtgggtgatggacggggtcggtgggaggagtgccgcaggcttgagcggcccagaatgggtgggcgcgggactgtgcaaagtatcacctcgccgcctgcatcaccgggctgaggggcccccgacccctcgctctacatccgagtctcccaatccccagacctccctctccgaccccccgagcctactcacaggcggttgccaaagtccagttccatggcggcatcgatgcccagcgtgttgtccaccagcacatgctgcgcggccgcgccgccgccgggcagggcccgcgcgacggtcgaggcggtgtccccctcctgccccctgcgctgcagctcctgcatgtgacgggcggcgcgggtattcagaaacccccatccgtgctggcaccgactcaaatctgcgcaatgnnnnnnnnnngccctcctgccccctgcgctgcagctcctgcgtgtgacgggcggcgcgggcattcagaaacccccatctgtgctggcaccgactcaaatctgcgcaatgcacccaatacgggcgctcatatcacccgctgcactcttacaccccccccaaagggcccgcctcccccccttctgaacccacctgccagtctcggtgggcggcgaggagggagctcacggccgcgtagctcagcgtggtgaccacggcctcgctggaggacttgagggacatgtgcatgccgggcttgatgccgtgcgcggggcgcccgcccaggttggcatcgcagatgaagatgccgttccagggctccaccaccggctcccacacgcgcagcgccccattgtggctccacaggctgagggagaagccgacgtaggcctgcaccacggtggggctggggccctggaccccggcgtccagggcccccacatccagctccagcagcggcacgcggaaggcgtcgcggaggaggacccgggtcttgccgatgcgcgccaccacgttcacgccgccctgtgggttgggtcgtgattcaaggggaggaatgagtggtggagtgatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaatctcgcagacctgcttctgcaaatccgtgcgcacaagaaacatacaccccccccacacacacacagacacacacctgctgcgccgcaacctctcccgcctcgccctccccgtcgtcctccggcagcttgagcgcccacacctcccccggccgcccccgcgcggagttgatggtgacaaacgtgtggctcgcctcgtcgctgatccaggccgacagctgggggaaggtgtcgtcctcgtcgcggacgacccaggcaggcgcggcggccaggcgcgcgcgcgcggccgcgtcggcgcgcaggcacttgacggcgccgcgcggcggcgcgcgcgtgccgattgcggccacgtgccctacggcgacgtagccgaggcggggccgcggccgccagatggtcaggcggacgtcctcccggctggtggtgtcctgccacaccagctccagctgctgcgggtcgctgagcagcggcagctgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccacgcaccaggcagtcgcccagcgacgcgtagcccggcggcgccacggggcgccagacggacacgccccgccccgcggtcacgcgcccgttgtcggtccacacgcgcgcaaagtcgaccacgggcggggccagggcgcggcggacctcctcgcgcgccgcgctgcgccgcgcgcgcaggaagcggccg

SEQ ID NO: 26647 - DNA, 76 bp, Chlorella protothecoides
ccactgctctggagcatgggcgatggcgcgacgcaccgccgtgcctcctcccgacggagggcgagcccccctcttc

SEQ ID NO: 26648 - DNA, 78 bp, Chlorella protothecoides
ccttccaccctttccacctgcatccgtgccgtgcgccgcgcctacgctgcctggcaccgtgcttgaaacccaagcccc

SEQ ID NO: 26649 - DNA, 76 bp, Chlorella protothecoides
tggaggagtttgtaggacccggagcccttggaacacaactcgagaccccagcacacaccttggccaggccatgggt

SEQ ID NO: 26650 - DNA, 66 bp, Chlorella protothecoides
cctcaagctcgacatcctcctccttctcctcctgcttttcctgggcacccgggacagcctggcaag

SEQ ID NO: 26651 - DNA, 95 bp, Chlorella protothecoides
tgccgcgacacagcctgctgccctcagtgttggggacgtattacagcacatgtggctgagcgggcaggtgcaaacctctgccctgcgaggcacca

SEQ ID NO: 26652 - DNA, 61 bp, Chlorella protothecoides
tgcgtctgtgctcgcgggactccagccccaactggtgggccgcatgtcgcggaagtggatc

SEQ ID NO: 26653 - DNA, 78 bp, Chlorella protothecoides
cccctggagtacaagcttctgtcctcaaatactcttcataaaaaaaaacagcacaccctccctctccaaccctttccc

SEQ ID NO: 26654 - DNA, 85 bp, Chlorella protothecoides
gggatatggacaatctgctggagcaggacggttgaatttatgcttattggtcgtgaaactcaaacacttatcggaatgtggtgag

SEQ ID NO: 26655 - DNA, 64 bp, Chlorella protothecoides
ctcatcggcctgccaagtcagcagcgtcacattcgggtcgtccacgcagatgagacttgccatg

SEQ ID NO: 26656 - DNA, 75 bp, Chlorella protothecoides
gggtgaagatgtcttgatgggtgggggtgaagatgtcctgacgggggttgtcaggcctttttggagggaggtggt

SEQ ID NO: 26657 - DNA, 142 bp, Chlorella protothecoides
cagcgcccaccatcctgtcactgcctttccaggtcccaccacgagtcagtgcccagccaccaacaccatgaagcccacccacccctggatggtgagctggtgatccaggattgtgccagactcatgtccccccaggttccag

SEQ ID NO: 26658 - DNA, 74 bp, Chlorella protothecoides
gcttcccaccgagaaggagtggagaatatacacagaggtcgaggtgagggatgttgccaaatgtcattgtggag

SEQ ID NO: 26659 - DNA, 114 bp, Chlorella protothecoides
tgcagaacacatttaacacagcacaagaaggactgacgcagcatcaagcccattgcacagggatcccaagacaggagacacattactcacatgcgcggatgatggcctgtccca

SEQ ID NO: 26660 - DNA, 61 bp, Chlorella protothecoides
atcagtcatggagcgcagcgtgctgggcgtgccctcctccgccgggcccatcatcctcgtg

SEQ ID NO: 26661 - DNA, 75 bp, Chlorella protothecoides
ccccccccccccccccaaaaaaaaagaaagaaaccacacgtatatcctgcaggtcggcggcggcacggtgggcgc

SEQ ID NO: 26662 - DNA, 167 bp, Chlorella protothecoides
agggaattggcagggacacccctgcctgggacttttagccagttcctgattgctgcgagggctggcccacatttagaatccctcatgtcctccctgcactacccttcctccctcgtgcctccctctcaatacatgcgaggcctgaactcacacaggaagctgcaggc

SEQ ID NO: 26663 - DNA, 102 bp, Chlorella protothecoides
tatagaattgggcgtagcgtgcaggaagggatggtactaggctgaaggtggtgttaggtcacaatgcgcatgaacatgaaatccttcaattgaaccccgggg

SEQ ID NO: 26664 - DNA, 129 bp, Chlorella protothecoides
agagacgccaggccttgcagcaacaatatcaaaatctgggggtccgcagtgaggcatgagcacagcaatgcacatcatgtgcaccccttccccatgcaatggatggagcacttgatcacaatccagggt

SEQ ID NO: 26665 - DNA, 96 bp, Chlorella protothecoides
accacaggaggagcattggccaggcagccctacaacgtcacagaagacagtactcggtcttactcgctcaccacgagagagcgggactgtttgcaa

SEQ ID NO: 26666 - DNA, 61 bp, Chlorella protothecoides
gctccttttggatgaagatacaggccatcatctgaacgggagggtgcactgagttggatga

SEQ ID NO: 26667 - DNA, 129 bp, Chlorella protothecoides
ggccagcgcctcggcctccgccagcacgtggacgcccacctgaggggggccggttgggtgatgggaagacgttggatggcgtggggaggaagggcgtcaatgtgcccagggcatgaggggacgaggcgc

SEQ ID NO: 26668 - DNA, 76 bp, Chlorella protothecoides
atgtgcccagggcatgaggggacgaggcgcgacgatggtggcgagggggggggaccatgcaggcagcgacctcgat

SEQ ID NO: 26669 - DNA, 68 bp, Chlorella protothecoides
ggaagctggctggcacctgggtcaggggatgcaagagggtcgagggttcctgagcaattgtgatcatg

SEQ ID NO: 26670 - DNA, 93 bp, Chlorella protothecoides
atccgggcaatctgatggtgggttgccgtctgccgggacctcgctgatggagcagctcgagacgggacccccccccccccccccccccccccc

SEQ ID NO: 26671 - DNA, 108 bp, Chlorella protothecoides
ggctgcgtgcagcgccgacgcgctttcctcaagcagaatgcgcgcctgggggtccatcgcgccggcctcctgccccgccagcctgcatgcggggggggggggggttta

SEQ ID NO: 26672 - DNA, 74 bp, Chlorella protothecoides
tggctggtgcatgaatgttgaggagatgatcgcccacctctggttgcgatgcctctgaatcgcccactcttttg

SEQ ID NO: 26673 - DNA, 68 bp, Chlorella protothecoides
gcgggaatggccagaagaagagaaggggtgaagtgtgtgggccggttgccgaaacagtactgtgaagg

SEQ ID NO: 26674 - DNA, 79 bp, Chlorella protothecoides
gtcgagagcctgcgcggaagtttatcatataatgttcgggggtctgttcagaatggcaggctctcgctgtgcaggactc

SEQ ID NO: 26675 - DNA, 79 bp, Chlorella protothecoides
ttgtccctccccgcactgatgtttcatatgaatacgtgaatttgtttcagtcttttgtgtcgacatcgtattttcctgt

SEQ ID NO: 26676 - DNA, 78 bp, Chlorella protothecoides
tgcatgcccagcctgcttctgaaagcctgcctcaccaaacctcctatacgatcctgagcatgcacacagcaataccac

SEQ ID NO: 26677 - DNA, 184 bp, Chlorella protothecoides
ttcccgggatgcgcaggatgagctcggcaccgcgccgctggaggagcagccagaccctggtgtgtcggggggagcggaagacgagccggggcaggctggttctggcacaggagacacctcagaggcgcctgcgaccgacggtgtgattccctcagaggaggcaggccaagacgtcgccgtagcg

SEQ ID NO: 26678 - DNA, 79 bp, Chlorella protothecoides
gcgagcctgggggtcgcagccggtgtggtggaagggtgagggaatgatgcatctgatggccatcttagaggcacagcgt

SEQ ID NO: 26679 - DNA, 73 bp, Chlorella protothecoides
accctgtcctgtttttgttctcgccctgccctgccattctcttccccccccaaagagagaatactccctcacg

SEQ ID NO: 26680 - DNA, 16392 bp, Chlorella protothecoides
  modified_base (6656)..(6696): a, c, t, g, unknown or other
cccccccccagtcctccagtcctttgcctcacccggggcatgcgcttgatctggcccgaaggcgtgaagacaaagacgccacgccccagcagatcatcggtcacgcactgcacaaactccatggctgagagcacagggggaaggggagagatgtggttgcaggactgtgacaagcaccgcaaggcctgcgccctccagctcgctcacccctgagcagtcgagaaccggatggacttccaacaggggctgctgcagacatcactctccacaacacgatgctgcgaggcagtcgacgcggtgtccctgctcgtgcccgtccccctgcaccgcaaacaatgttgctcctccctgccccaacccctacaccatacctgtcagggtgcccaggaactcctcctgccactggcgtatggagttgagccagttgatgcggcgcgacatggcccccgcatccagccgagcctgcagcatgaggccgccgccttcggcctcggagccgccgttccaggcgagggcccctgcatcggatcccgaagagccgttccagggggcgacacgcgccgccgtcgtaacctgcctgccatttgcagcgccgctgaccgacggtcggctgccattcgttgctggactgccgttcgtggcttggctgccgtttgtcgccgggactccactcccagctcggctgccgttgcccgaagcaccgccagccgccccctggcgctcgccggcgggagcgccagcccagcccagccagccccacagcggccagagccggcttgccaggtcggcgacgggctgagcgggctccgcgctgggcggggcctgcgccacctccgcaccctgccagcagtccacagccacgccgtactctgccaggtgctgcatggcagccgtccggatctgcacatcgatggagaacaggcgtggggaggggccctcccccgcttcgtcgatctcctctccgcccgccctggcgtgccggggcatgacctggcgccgcagggagagggttcaggagccgagggtcggacaaatggaggaccttgggcatgcacggtcggggaatctaggtcccgaccgtgcatgcagcaaggcgatccttgttgagagaagtcgctgaaagcgagcatacgcctgtgattcggtataaggacaccctccatggctgcccaacccctgctgccctggaccccgtccccaccccgctcgcaaacccctctcggccctcactttggtgtgcagggcccggtagttgttcatcttgggctgcgctatgtagtcacgaaacgtgccggggatggggatccacatgctgtgcaccaggcccagggtatggtagcacatcaggctgtcgctggtactgcatgggtgggtgagtgtggagagggtacatgagctgatggagtatggaggagaccgagacagaatgggtccccaggaacgcttgatgtgggattctaggccgggtcggcccagcaacctgacgcccccccacccccactccatcctcctccaccaatgaagtcagggatcttacatttcccacccaggtccctgcatgcatgcaggatcccagtctgcccttctctctggggatcccggcccccaaacaatctctgttcccccccacataccccaacactccccgaaccccttcccccctcaccctctgtccgcatcctcgcgacccgggccagggctcagcaccacgaccagctggcagacgtcgttcacgccgtgcacgctttgctcctccgcctccatcttgcgccagatggagtagagcgagcggcagcgcgcgcgcgcatccacgcccagccctgcgccgcggatcagcgggtcggcggccagcgcggaggccagctcgtcgcgcgcggcctccagcgtggcggcctgctcgcgccacagccgcgccaccaggcgctgggtgaagaggtggcgctccggccaggcgtagcggaaggccaggtcctccagctcctccttcaccgcatacaggcccagcaggcgggccagcggggcaaacacctggcggcggggggaaaggaggaagaagaaaggggttacatcctcattttctgggggtgcgccgataaattttgatcaaggtaatgtgtttcaagctaacatccatctgctgcctgctacctatccccacgtaagcccgtaccccccctgcccaccatctgcaccattccaaaccccagcctcaacctccccccctcctccttgctttccaacctgcagcgtctcgcgcgcgatgcgcgtctgcttgggcccgggcatgctccgcatggtgcgcatgttgtgcaggcggtcggccagcttcacgatgatgatgcgcacctcctccgtcatggccaggaagaggaagcgcatgtcctctgcacgggaatcgcccccgctcgaccccggcgggcgcagcgcggccgcggcgcccagcccgccctcccctgcctccgcgggccgcgtcggcagcttgctgaacttggtctcgccctctacaatgcgccgcacccccgggccgaagtgaaacccgatctcgtccagccccaccacgtccccgcagtcctccactgtatcgtgcagcaggcctgtaaaggggtgtaaaggaggaaaaggggccagatcttaggcgcatacaacgctttcagagggaggaggggggggcggcggcgaatttgccggaatgactccacacagagcacctgggcggctggcatgatccatgaagagcaaagctcgcgtcgccagtaacaaagccgggcagtcttgagcacagtctgggctggcagcatggaaccccaaggccattctccccgctcttgttcaaaacacttcgtacccgccaccaggctctcatggtccatcctcagctcggccagtatgcgagcgacctccaccgggtgggtgatgtagggctcccccgaccgccgcttctggccggcgtgggcgtcgtaggcgaggctcaaggcctctcgcaccctcaccacctgtgccgcagcgaggggcttgcacgtgtgaaaggtgtgtttcaaggagcggaatgtacagcactgccagcccattctgtgagtcagcaacatgtgcgtgccgccaccaccctgtccagtccccacaagactcgcctcgtgaggcggtaggtaggtcagcaagggcgccagccggccctcccacaggaaggcctcggacaccgcaccggtccggcaactctcgctgtagacctgtgatgggaggccgggtccgccagctcaattactggtgcaacaaagggacatagagatacaatttgccacgattggcgcctccgcatccaggaagccccacgccacccccacctgctcgtcatactcatccagtgctctggtgcgcaattgtctggcgtgtgcctgcagcaggcatgtgcgtgcgaacggtggagctagtgagtcggatcgttccgtgccccgacttccagcactcccctggctcacctgcctgcccagccctcgtgcatgggcggatgggccctgagggggcctgggaagggtatctgtgcatcgtcgcgccttgggccgacgtgagggcgtccatcctgcagatgtcaaaaggagttgtaatgatcccgcgggtgtgcagcacgaaacaggatggcgcccacgaaacggtgcgcacctcgggacggggctgcgatcccgcccagcgagggtgcaccggcacagtggacctggcaggcgcgcatgactgggcaactaaacggtggctctcgcacgcattggatcacggggcggttagggggtgtgacgcgctgtcatggggacctggagttctgaggccttgctgtgggctggggtaccctcaccaactaaaggctcggacgcccagttctagcatctgggacatacaacagccagtgcagcagtttcgaggggtatgacggcgaagcaaagcttccatgggtcagggtgggttttcgggattctccccccattcggtgagggcagatcggatccttcatctcggccggggtcgcctccttcttggatctacctcccaacccttaagagagtgtacatccactccagacggttctgggtcagggtcagccaaacaagcatgcattcttacccaaattcagattctcacgggctgtctggccagcaccacgtagtcaccgtcggccaggggggtatcctcgggtatcagccggttgttaacattgacgaagcccgggggcgcaggcgagccctgctcctgcgctccgcgcgaagactccacctccatcatccccagctcctcgaccagctcccctggggcatgggaggatggggagggcaggtggaactttgtccccggttgaaactgccccagctggcccggcaggcagccaccaccagatcagcgcccatgcactccaaacgcggatcccacctgctgtggttccccggggacggtgcaggatgtcccccccaggccagaccacgatgacgaccatggggttcaccaccggctggaccggggcgggggccacgtctattgaccccgggggccgggataggtccccgccccactccaacatgcagcgcagcaggtgcacctggcaggaggatcatcaattggagtgagtggtcttgcacagcagggccatcctctgcatgcccacagtaagggcttggagtgccctagcacggactgctccgaggagcccatccggcaggcgctggactcctaccctgcagtccccgctttgcacatgtgcagatgtcatcccgccgtcctgaaccagtctcaccccccggtcagctcaccctgctggcaacaaaggcggtgtccgccgcctccccaccctccaccagcacaggcttgcagggaatcgcctctggtccggatgtcgtctcgccaggattgctcgaggcctcgcccacctcagcaggagggagggaggctgtccccggcagcggccccttccagtgtaggggaacaattgtgctggagagcttgtgcccgtagcggtccaggcagtggtacttgccgtctggtgtggagcatggggtgagaatgaggaagagtgatgggcatgctcattgaggggcgggggggggtcagcacggcaccagcgtcagctgagatgtattgccaaggcaggcttgatccgagtcacgattggaccctgctgctcctggacacttttcatccccccggaggttgcaagacacaagccctaccccctgcttaacgcaagcacagatcccccatccccccttgccccacctgagcacagtgagtagcgttccagcttgatctggaggtcgccgtggcccggggcgaagaaaccgcggcgctcgactcgccgtagtagccggctgcgtttggttgcgtgggagtggggcggggcgagacgggcgtgggctggcatcgctagcatcatatgttgggctgaaggctcgtgcctcgtcctgagccattgcgccacccccaccaggcctttcattggtgaagccccaccccccacccccgggacacctgtattcctgcgtgctggcgaccacgacgctgtcggtcttgaatgcgcggcgggtgatggacaccgccaccagcagccgcatcccgcccggttcctccacggccgtcaccaccgcgtcgcgcagcgtgccgtcgccgccgatctggagcacggggtggcctggccgcagcgaggcgggggaggggccgcaggaaaatgcgctcagcgcagcagacgggctctccttgtacacccagtgcgcggcggtggaacctgagctcatggggacggagttgtggtggtggaggaggagctgtgattgtgggtttggcgtgcgtcagtggagccgggcccccttcttcccccgtcgcacaactcaatcccccttgccggtgcggatgcggccctccctcccgtccaggggtctcaccgtactctgcctggccgtgcatggtggaggtccggatctggacctccatggccacgccctccggaccccgcaccgccgtgtggagggactggtaccccgacggctgagggtttgttggggttgagaagggggaaggtgatgccctcgcaacaggccgccgggcggggggggccctggcaaaccaccccctcggcgcccctcccctgctgcgccccgacaggcatggaatccagccgcccctcccctccccttccctctgtccccaccttgggctgagagatgtagtcgtcatcctcccccggcacccgcttccacagccggtgtacgagcgcctgtagacggtagcacactgcgatggcctcgtcctcacggctgcggccagggtgtgtgtgtgtgtggtttggggaaggggagggacaagggtctgggcgctgagtggactcaggcggccaggatgggaggcttgccctcgaggatgagggccactgcaggcatgccaccaagcctggcgccggtccctgccgtcaacgacacagacagatcctcatgaagccattccagggtgcctgacctccaaagctgccccacctgccctccatgtcgtccacgatgaggcgcagtgcccgggcgtccagtacctgctcgagggggacccccttccgcaccatcttcttgtaagtagaatacaggctcttcactcggccctgcattgggatatcagggggggggggggggggggggccnnnnnnnnnnnnnnnnnnnnnnnnnnnnnnnnnnnnnnnnnggccgaaagtgtctgagcgcgggcagcaaagctccacagtcacagccttctcctgcttgggaatgcactgcgaagcaagggaccgcgacggactccctgccctggaatcccaataggggtgtggcctcacctccacgaccacctccaggcccagggctgtgccctcggtctccatctcctgcaggacctgccgggcacaggcctgcaggacctccagagcgtggcccaccctgtgtagataccagaaaatccagggggagggaagggcatgacgagggaggtgctggagggatggctgatcgtttcttcgcccaataccatcttgtgctcgctgaacagcacccaggaggaacggaaccccaatgattactttgtctggagtcacagtgcactgcactttccgcctctcaatcaagaaaacaaaactaacaacccacacaccctggcctctgctgcaagcagctcatgttgagcgtggaggcatcgaatggcagcacgctctcgatccgggacatggtctgagtaaggtcgggaatgagacataaggcagcaggcaggcgtttgtcaagacctgcacaaacacaccccggcctgcaggcaccgaccaccctctgaggcatgcagacagcagctgggtcgcctcagcaccacgagcccacctgtcgctgtgttgggctcagccagggcatggggctgggcgtgcgtgttccggctacgggccgccgcctggtctgagacgggtcctgtggtgcatcgaggggcgctgggatgcgctcagagccagccaggatgaggactggcaggggcggcgagcggcctgacgagtcagctgccagatcttgggggagccctggaggggcgaggatgcaggtgggaaaatcctcgggctgcacatcagcccccccatcacgcctcccgcccacctggtcggggctcaaggcgtcccggcgggcatccagaggggcccaggccgcccccaggctttcctggaccgccgaaaagtccaggggctggagcacagcaaagcagaggtcctccagctcgccctgaaaggagggtcgacagggtgcaggtgcgtgtgagtggggccccggaagccttgctcccggttcatgccgggcctggcaatcacgacgcgcagcaccaggcccgcctggtgagttggtgccgctcgcgacgctcacttaccttgatggcaaacaggcccagtcgctcggccagggtgcaccagactcgcagcgtttcctgagcgacggcgcgctgcttgtcgggcgacagggcgtacctggatgtgatggatgagggcaaggatcagagtctgcacagacgacgtcacaggccagctgtgtgagcaccgatgatagcatcggcaggcgcgagcctgccctgcccacaaaaccgcccaggccagccagcaactcacacggtgcgcatgttgtgcagccggtcggacagcttgaccaggatgaccaggggctctgccaccatggtcaagatcattcgccggagcgccgcgctctcctcgtagctggcggccttggcctgggaatggggaatggggggggggggagtgtatgcccctcgtaggagatgcgcctggtatgaaaggcaggccagactggggtgccagcaaccggctggagctccctcccgtcccaaatgacaaatgcacgcaacaatcatccctggctgcaaggccccatgcccaggcatgccaccagctgcccatcctccgggcagctcaccgacagccgtagtcgccggcggacgagttggtgtgtggcgctgagctggctcaccatgctgacaatggaggcgacctggcggtgtggcaggagggatgggtgtgccagcctcttcgggagccgtccatcgacgtcaggggcacagctcgcccaccgccctgcatgcaccaccaccgccacccactttcggccccgcgaccccctgaatatcgctcagggtcatggatgtgtcatcgatgacgtcatggagcaccgctgccgccacaccatcctcagctctgtgggagggggaagggccgggcaccgagtgctgggagtgatgatcgtgctacacagctggcagactcgctcacgccagggacgacagcatgcgcgccgcagcaggccggacagccacacaaacatgacagtgactcaatacagttggcccctccacactctcacctggcatctggctcggaggggcagagcaatgcctccatgatgcgggccgtctcgatgcagtgggtgatgtagggttctcgagtcttgcgcacctgcggcgatcgttgcagcaaaacaggggagctcatcttccagccgacccccacatccagcaccacagtgagtgacattcccatccagcaccgatgccagcggccgaacccatacgcagggtgcacatccacctgtccggcatgggcttctgccgcaagctctgcagctgcttggaacctgggtctgttgagcagccggctgtcgctgacatccactccatacagtagctctgggaactgtatgcatggaatgaggacacaaagaggttgaaagcggtgaagctcagccaacacacttggtgcgaatggccgagcgcgagggagaccttgcactcctccccaccttgccgcacacaccttaacatgtcctccgcctctcctctcctcccgcctctcagccagcattcgtggcttggagttgagggcgatcgtgccacccaccccggcagcggctgcggccgtgatcagcgtcgccatggagccgaggatgacgttgacggagtgcttggcatgctgcatcgtctcagtggagacctcgctgacttgcgctgcgggtggcggttgagatgggggcgctggtggctcgtcatctcccttacaccatgccaagacagggagcatgggatcctaaaatctgcaggctaggcacatctgagccccttatacgatcctggagagcctaagcaccacacagcaagctccaagtacctatgagtcggctgtgttctgcgatgagcgggagagctcggcaaacatgacgaccccaagcacgccctgcacacgaccctttttctggccatggtggaagcgtctcccgcccggcatggacacatagaggactcattatcaagcgtgcatcatgtatccactggctgtgctggagtcatgttccgctctgtcaatcatgaagaacgctcatgcgcgatgaccgggagtgcagcccatgcagcttgctgtcttcagaagaagctatgtacgacgatattgttctccattacaagctatactgtattgttcacacgttgaatgtgctctggcatgcgtttatcgccctaactttggtgcgaaactccaccacaactccgagatgctgagcggatggcgggaggagcaggatccaaaagatttgtccttcggtatgcatatcataaatgatcgattaacatgagcaggtggaagttgatagcactgcgagacctgtgattggaacttcaagactatcaagtgctcgtgtgaacctgcgaaagttctgtaccggtgggctcggggacagtttgtccaaagtcttcaacatcatgcagaatcctggggcagtcatagttttacaagaattgctactcgtcccggcagacatactgtccagatttgacgcaacattgttctatacttgagttttgactagttcgggggaccgttttggggttccacaatcaatcagaattgggagtgatcggcaaacactcgcatggctgcctgggatttaccactgaatacaggccacgtcggtttacagaccattgtgtggcatccacgagcactcccttcaccacaagcaccttaattgagaaagaactctcgtatggagtttttttgcatcctatttcgtgcccacctgttggatcccctctgtgagaggagaagtaaggggcatgagcaggatcgaaatggaaagcgcgcagcgccgaggattcgccccacacacgaggcccgcgcgtcacgaaaagtaacaagaagggaggacgggcgccaaagtttaaactcgaaatcgcagtcaaggtcagaccccctttcaggatgccggaatcctccaaagcaagcgttcgcaccgcccctacgcacgctccgtttcgagacctcgtgctcaacgcggtgcggggattgaaggagcgctccggctcctccctgtacgctatccgtaagaaagttgcggatgagaacaccagcctgacgggcacatgggagaagtctgtgtcccgtgccatcaagcagttgtcggagcagggggtcctggtgcgcaacaaggcatccttcaagctcgcacagaccgccaggaagctgcaaggacctaccccggggaagaaggttaggattatcgtatacatattggatttggggttgacgagactgaccactcccttttcgttccatggcaacaacggattccgcaattatcctcgcagaacccatccttaaagaagaagcgaaccaaggccacagatctgaagaaggccgccaaatcagcctctgctaagctcgaggtgaacatgggaccaaacaatgacatggtgttgtcttttccatgtgaatgattgctatggtgcctcaagactcaccgaatgggtctgttgctgtactcccaactcctttcccccctgcatagtccagctgatccctttcttttgctccatcaacagacaaatgctagcaagacagccaaagcagcaaagcctcgcatcaagaaggctgctgccactgtggctgacgaagtgaagcctgccgccgcagaggccaaggaggcagtgacggatgtggccaagaccgcgcagaaaaagggcaagcctgccattgacaaggctttgaagagtgctaaacctgctgcggaaaaggctgtgaagaaggccaagcctgctgtcaacaaggccatcaagaaggccaagcctgctgtcaacaaggccatcaaggacgccaagcctattgtggacgcagcggtcaagaaggccaagcctgttgtcaacaaggttgttgaggaggccaagccagttgttgacgcagctgtcaagaaggccaagcctgtagtgatcaaagctgcgaagacgacgggaaatgcggtagcaggcgcagcgaagtctgcggcccagcaggctggggcagccggcgagaagctgaagacggcagctgcgaggaagatcaagcctgccgtggatgcggcggccaagacgtctgcacccaaggccctgtctgcaaagaaggctggagtgaagaaggccaagccggctgcacccaagaaggctatcgtgaagcctgcctcacactgaccaggggaacgatgcccctgacccctgccccactgacctgacgatagtatccatgtgtgtgccactacccggttcccttgattcctcatgtaaggctgactccccatcatctttcgcagcagcaacacaacagggggactagacaaagtagggagcggggtgggcaacgtcgcgtatcgcctcccactgctcggacgtcagctggtcccgcacctcgctcaggccagcctcctgtgatgcggtgtgtgtgtgtggttgagcacacgaggcggcgagaatggaagcaggggcaccaaaggcccaggcgccgtccaatgcacgtggtcatgccccccatgcgcccccctctcacacacatcatcccggcgcacctcatgcgtcctgcggaactcggcgagcgtcttcgtcaccgtcaccctgttggtgcaccgaatgggggatgagcttgcgtcggttgggtcacggagtgcgtggacagcagcctccgcatggcatggcctgctgggcaacctggttgtagcaacgcatgtctgcccacccctccacgatcggtgcagggtccgcaaaaggtcccactacgctccctggacccactcaatgcccccaaacgaccatcagggaccaaggcagggcgaccccccggtggtaaaaacgcgcctgatgggcgcgggctcgccggccagccgcacgagggccatgagcaccccgggcagccaggcggggacgtcgtaggggctggaaaggacgaacgcgcgcaggccctgcaccgccgcgtgtcgccgggccaggctggggcccggagccgctgccgccgtccccggcagcggcggcaggggaccgggcaccatccgcttccggccgcgcttggcgggcagcaggcgctcgacgtcggccaggaaagcggcgcgcagggacgccgtcttggactcctccatgcccttgagcaggcctgtcacggcgggcgggaggacgatcgaggggcggcggagcgcgagcgtatcctgacaaacagctgcgcagtggcgacgaccccaggcccgcggacagacctgggccggggccacaccggtgcctcgccggtgcctcgccgagcgtcggtctcccctccccccccctccccctcccagcccagcgccccctccctttccgccctcgacgtacccgacagcgtggcggccgcaaggtccctgacttccagcttggcatctgaaaggcgttcgaccacggcggtcacgagcgcggcggtgccggcggtgcccagcaggaagacgtggcggaaccagaagtactgcaggtacaccagggccgacgcacgctcgggccacagctcagcgccacaggcctgaaaagggaaggaaagggggaactctggaggtatacatcaggatgtatggggcctggctgagaaggctgtgtctaaagctctgggactgggatctcgctgggaatggtcgcgacgcgggatcatcggcgggacagtgcgagaccatttggtgatgcccatggcccaccatgggcgctgatccggcatcgccatgaccctacacccaaacccacccccccggcgcacctggaccagggtggcgagcacgctcttcaccagcgccggctgcatcaggggcaggtacttgagcagggatacggccttgcgcgccgccatggacaccgcctggagctcgctggggatgaggcgctggatcttgagcatgcccggcagcaggcgcaccagccagggcaggagcaccgtgccctcgcccccctggatggcctgcgccacaaactccacgcagtacgcgacgcgggtcagggctgcgaggggttggggatgttgtgtgttgaggaaaaagcgatgatgtcggggccggacttggtggcaggtgtgtcgaggggatgggtacggtcaaagttcccaggcggacccccatctccacgctcggcgcctggcgaggtagtccatgatgtctactggcaggtgcctacctcccctccttctccaaagcccttccctctcatcatgcattacgagagcgggcaccccagggcagcctgcacgacagaaacatgccacccaccctcccaaacccctcatccaccgagagaaccccctccagaacctctcgccttgttgaaacctgggcgacgcgctctcctttcccagcggcgcgcgtgccaggctgagggccgagggcgaggcctccaggccctcggcaccctcgtgctgcatgagcaccgcgctcccagggctgggctccacctcggggtcgaggtcgtcgccggcgctgcccgccgccgcgcccagctccgacggcgtcaggcccggcccggcgtggggaggcgggctgagcgaggccaggctcgcgtcgtcccccgcgcccgcggcctcaaagtccatgccgtcctcccccgtcgcctgggagggcgtgggcgtgccgggctgctgctgcaccggggcgtcccgcgccaccgcaaacatgatgcccaccgaggcgtcaaactgtgtgtgtgggtgcgaagaacaaggtggatgtcatgggtggaggaggagggcgcggcgggcggctgaggggaagcgagcgcaccctcccacacacgcacgcacactggcgaagggtgaccggcagcgagctcacgcccgcacccatgcgctgctctgggctcctctgctccccccatgctctcctctcaaagaggtccttcgcaaggacaccatgccgtgaatatcctggccctcctttcctccccgcgcgcacctgtgtcacgaggtcgtccaggcacgccaccaccaggggctccagggtcaagcggcagctgccgttggcgcgcggcgcggccggcgcctcgcctgcccgcgtgtccaggcgcgccacctctgcctggtctagcacggatgcggtgagcagcgcgcccaggcgcgccgcctccaccctcaccatctggcccgggtgggaaacgagttcagggacctccctcagcagcgactcctgcgtaatggaggggcgtggatggcatctgaaagctacatcaatcgtgctgcatgcctgcgacgcgcccactttggggcacaccgacagaagtgggggagctctggtggggaaatggcagtgatgcccatggctcagtgcctgcaaccaagtcttaccgtcccccccctgccctatcaaatcctcctccctcttgatggccgactcacccacacgctgcaaagaaaggcggggtgggagcggttgcccagcaccgtgataatctccgtcaggaggtagttcagatacttaagccggcggtactgcgcgcccgaccccgcgcctgcacagggggatcgtgcgtggggtgagggtcagcgcatgtcacatgctgagatcatgggctgcttcgccgcatgcacatctcgcaccgtcttgacaagggtctcgcaacaggggcgaacccgtctcacgcacgtttggccctccaaccacccagatacaatttcacacccacaagcactcacccgggtgggcagggccggccaccagcgcgcacagctgcgccagtgcgccgtgccttcccgccgtcgccagctcgtaggcggcgtaccgcagcgtcccgctggcccaggcggaggtctgctccagcggcgccgaggccagggcttcttgcaaggcggggcccacccattcgtcccaggaccctgtgcatcgagttgggacgggaggtttggggtgggggcagtgcctggtccgggccagccgatcggcggtgggtcaagctgggcctgttctggcgcactcaggccaaaagcatgaccaaattatgaggcgggtcgactgcggctgtgttgccagatgctcggcgctccctagtcgtcacaccctggcgcgtaccggggaggcccctccccccctttaacagttccctattttcccccacaaccctccccaacctccccttccccctcaccgtcctcgaaggggacgcccgaagccaccagccccgccaggcactcccccgccgcggcggtggccggccggtcgacgtcctgcggtcgcgccagggcctccagcaccgcggcgcgaaggcccggccccagaaccgccggagcggtgagcgccagggcctgcaccagtgcggcgtgctccggcttgaaggtgccgtcctggacggcagccacggcctcacggccgcatggccagacggagaagcggagcacagaggagaccgccagcttggccacaatctcatcggtgctgcccagcatgggccccgggccggagccggtgccatccccatcccccgcccccgtcaggttggcgtggttgccggccaggcacgcgaacagcgcggcgggggcgccgcgctccatggcgccgcgcacggcggccgcggcggccgcctcggcgggcg

SEQ ID NO: 26681 - DNA, 67 bp, Chlorella protothecoides
ccggcctgtggccaggtctttcaccacaggaatgaatggtggggctcagaactactcatccccaatg

SEQ ID NO: 26682 - DNA, 196 bp, Chlorella protothecoides
aggagcagattcagtccgcggggtctccgagatatccactatccacctaacacctagccaagtcgcctgtcgtagctcccaacaccgctcttaaaacatttttgcttacaacaaaccattttcagtggtcgacgtaggactcagcggtctggcacatagccggcagcatggcggagctcatccacaaggtgtccca

SEQ ID NO: 26683 - DNA, 211 bp, Chlorella protothecoides
aggaaggggggggggggcaatggggggaaaggagaggaggagaggtggaagactggatgagcgcctggggcgccgaaaggatggctttccctagagtgtcgatgagggtcgtggggggggcaggagcatagcaggggggctcatatgcaggagctggggggaatgtgacgcgtgctggcaaatggtggtttgtgaggctgcatccctgccg

SEQ ID NO: 26684 - DNA, 61 bp, Chlorella protothecoides
aatcatgagccgtagtgtgcctgcagggttgattggtgatcctggggtgttctcctgattg

SEQ ID NO: 26685 - DNA, 4214 bp, Chlorella protothecoides
  modified_base (418)..(427): a, c, t, g, unknown or other
  modified_base (752)..(761): a, c, t, g, unknown or other
  modified_base (1046)..(1055): a, c, t, g, unknown or other
  modified_base (1519)..(1555): a, c, t, g, unknown or other
  modified_base (2393)..(2402): a, c, t, g, unknown or other
  modified_base (2493)..(2503): a, c, t, g, unknown or other
  modified_base (2705)..(2714): a, c, t, g, unknown or other
  modified_base (3026)..(3105): a, c, t, g, unknown or other
  modified_base (3281)..(3290): a, c, t, g, unknown or other
  modified_base (3858)..(3867): a, c, t, g, unknown or other
ggctggaggccgccgccgccaccgcacacctgtcggcgctgggcgcgctgggcgcgcgcgggtcggcggccatcgccgccgcctgcgacctgcggccgcgcctggcggcgcagtgcctgcgcaacctggagcggtacgagggggcgggggcgggggaggagggcgccacgctggccccgctggccaccgccacgctgaccagcctgcgtggcttcgacgacgacgccttccgcgcgcatgtgcacgacctcttcccgcgcctggtggcgctgatcgccgcggagggcgcgccgccggaactgcgccgcgcgctctccgacctgttcctgcaccgtgtgggggccatgctggtctgacgtggtggggaaaatggagaatgggcgtgtagtcttgaggtgcagccctgactgcttcctgnnnnnnnnnncttcctgcaccgtgtgggggccatgctggtttgacgtggtggtgaaaatcggagaatgggcgtgtgcgtcttgaggtgcagccctgactgcttcctgcgggtgcccgtctgcccttgctttcttgggccccccctcgcgtgctgaaggtgtctgcaagttatgacaccctggttgtgatgaggatgggggaggctcaacacctcctgaaggggccatgtgtgatggatgacaacatgcttggagaattctccgagctgcagcataggaagggactgcatggtgctccggtccttgtagttgtggacagcaggccgcgaggcatgnnnnnnnnnnggaattctccgagctgcagcacaggaaggggactgcatggtgctccggtcctggtagttgtggacagcaggccgcgaggcatgccgcgcatgggggccaccatctcactagccacattgagaactatctgcacattccagtgctgcaaacacccctgccgaccttgcgccgcctggtttggcacttcaaagacatgaacttccatgtgcggtacaatgttttgcctcgatggcaacccacttgatagaaacggtttgtgctctgaggcaagggcggtggcccacnnnnnnnnnngtttgccttgatggcgacccacttgatagaaacgggttgtgctctgaggcaaggtcggtggcccaccgagagctgtggtggggtgtcctctgccggccaaacgtggcttggtgagcgccagcgtatcaattcccattcgcatcacattcgaccacagagcccctgcaggccctccctgtgcatcggtttgtccccaaagctacagctcttccacgccctgacgcacccggctgtagtggacggcatgcggggcggtgtagcagccgcatcacagcttcgcaggcccatgctcatccaccacaaccaccctgcacaccctccacaggtgccgtgggcaacgcagccatagccacagcaaagggccccgcatgagaaccccggcaatgcgccgatcagttgctggcgctgatgatggctgtcttgccttcccgcatgcggcggggggggggggggggggggggggnnnnnnnnnnnnnnnnnnnnnnnnnnnnnnnnnnnnntgagagagggtcccgcacaaaccgctccgccagcttgttgatagcaaactcccggcagacagaggccttgaagcacacatgccagactggctctcccatcaggttccacatctggcccttgcacaggtgggggtcgaaccaggccacacgctcaaggagcacctctgtgctttctgtgttgcatttggggcattggagatgaaagggtggatggaaaggaatggttcactgatatgaaagtagatctggggttgttgatgcagtgacaggccacggaatggcgttcatgatcctgaatccaccccacactctggcctcactaatttttgcagctcctgcacatgaaccagagcctcagcatggcactctccatagttgtggcctgctgtctgtattgcgtcagggcacgaaatgcctcggtgctgcatgctgtccgactgctgtactcatcgaccgcagtgtacatggccgggcggccaggttcccttccgacgatcgtatggatatcggctccccatagagggcggggttgactgcagtaggtggagccgggtaggagatcagccatgttgttgcaacgagatggggtttggcggaacaccatcttggtagacaacacattgctgaccactgccagggacacagtagggacacctcccaacctcaatggcaagtatacaagagactcactgcattctgtgtatgcaagagtcactagcctccgggcagaacgagcagaagatcccatccgaccttatgccaatcaccaatactgcttgtcggctgtcgtcttgccaggtctttcggggcgtcctagactagccctgcatggtggtgnnnnnnnnnncccgaccttatgccaatcatgaatactgcttgccggctgtcgtcttgccaggtcttacgaggcgtcctagactagccctgcatggtggtgnnnnnnnnnnngagccatttgggccgccatagggtcatccagacgccatgagcggcggtctgccagtggcagatggaggtcgagacgccgcgcccggagcgccagtaggtgatgaggtggttgtaagaactccagcccacatggagcgaatgactgttcctccttctctcgccactacgcattggcgagacggcaggcctccaaggccttccnnnnnnnnnntttgccagttgccttcgctttttcaacttagggggcagaggggttaccgcggcagggaagccagttgggctgccatagggtcatccagacgccatgaccggcggtctgccagtggccgatggaggtcgagacgccgcgcccggagcgccagtaggtgatgaggtggttgtaagaactccagaccacatggagcgagtgactgttcctccgtctctcgccactacgccctggcgagacggcaggcctcgaaggccttccgcattttgttgtgcaggcggcggtctcgaggtcgctggatctccataccagagnnnnnnnnnnnnnnnnnnnnnnnnnnnnnnnnnnnnnnnnnnnnnnnnnnnnnnnnnnnnnnnnnnnnnnnnnnnnnnnngagacggtcagtcacggtttcaaaatcaacctccaccgcacctttgctgccaaactggtccacagggtgaaagcagtgaaaaaagatcctgatgtccaacgctttccacggggccaggccggggtgaaggaaaaaaatgccctccttgcatctcagttgcccctctctcaccaatnnnnnnnnnnacggtccacagggtaaaaagcagtgaagaaagatcctgatgtccaaccctttccagggggccaggccggggtgaagaaaaaaggatgccctctttgcatctcagttgcccctctctcaccaataggtagcaatacaccacctcggtcatgaagtggacgctccaatacttttctgatggcatcttgagggccatcagcttctgcccgtcaccggagctgagctttggtggcggcgccagagaaactgcgacctcgtcatgatggcaatgacatatacagcctcagacccctgtttacatggcaacataccaatcagatgacagaggtggtgctacacggctggcttctgagattccatcgagcagctgcggttcaagggccagcaactagcttgagtgtggtcgttcagtctgctttcaacattcctggtgtttgtcaggtgtgtcagagcttgattgcggccgacggctcctgcagtcacaccttctcccatcctgggtttgccctgttatgtggcttgcacctcatgtggcagacagacgcaggacaggaccgacgcacgacttcnnnnnnnnnngatggcggtcgacggctcctgcagtcacaccttctcctatcctgggtttgccctgtcctttggcttgcaccacattcggcagagagacgcaggacaggaccgacgcacgacttctggaccccaagatacagagagtgatcaggacaggctcgacctctggctccagcatgcgacccgctctacaaattgagagttacatgaccaacctagatctcctcctattctgttctacatcacaatgcggtaagcgaagactcaattcgtaagcaacaaacaaagcgtcagcatctcaatatcaaccttgtaatggtacctcgcatgtgcaggtggtgggcagcaatcacagg

SEQ ID NO: 26686 - DNA, 113 bp, Chlorella protothecoides
ctgagcgcgcagtggtcgtagttgggtgcggcctgccacggtctggtgcacagtcgtgccctccgcagcattgggtgctcagctctacagtgctggccctttttcagagcctc

SEQ ID NO: 26687 - DNA, 76 bp, Chlorella protothecoides
tactgcaagttgcagctcacacaggggcttcaaaattcacgcaatttttccatgcgccgattcggagtcgctcttt

SEQ ID NO: 26688 - DNA, 79 bp, Chlorella protothecoides
atgatgcactttgagttccctctgcatccctgagcctttccccccccaatccaccttcatgttgtgcagcatgagcccc

SEQ ID NO: 26689 - DNA, 95 bp, Chlorella protothecoides
cccagaagttggtcctgcaggacgcaggtgcgttggagcgtgtgtgtgctgattggtggatcaaagcttgaggcaccttcctctgtgtggtgggg

SEQ ID NO: 26690 - DNA, 61 bp, Chlorella protothecoides
agtcgaactccgtgccgtcggcttgcagggtgccctgcgcccagcttacagcgagcggtga

SEQ ID NO: 26691 - DNA, 118 bp, Chlorella protothecoides
tcaaggagctgcgcaaggtgaatcgatcggaatggatggcacccgcgctcacccaggggcctgtgtacttcctggtgggctgcccttcgtttcgtgcgtccctgctgtcgcccaccta

SEQ ID NO: 26692 - DNA, 70 bp, Chlorella protothecoides
taggcacaggccagcgatgccactgtgaaataagtagaacaatgcttgcagcctgccatcacccacccca

SEQ ID NO: 26693 - DNA, 77 bp, Chlorella protothecoides
gggggcagagctcagggagggatgcgcctttagagatgtccgcccccagagaatccgagcgcgcgagcacgtgcgtg

SEQ ID NO: 26694 - DNA, 61 bp, Chlorella protothecoides
gcccttggttctgggtggccaatgtgccgcaccctgctgatgaccatctggccaatcacgg

SEQ ID NO: 26695 - DNA, 61 bp, Chlorella protothecoides
ccctgctgatgaccatctggccaatcacgggccgcgaccggggcgcggacgtcggcgggaa

SEQ ID NO: 26696 - DNA, 80 bp, Chlorella protothecoides
aacatctcgcacgaggttcagcatcacgtgggctataccacccctcccaagatcggagagaccggatcagagcaaaagac

SEQ ID NO: 26697 - DNA, 67 bp, Chlorella protothecoides
gccacacccatcatcccacccctccaagcctcccaagtgaccccgcccctcacctctggcggcgccg

SEQ ID NO: 26698 - DNA, 131 bp, Chlorella protothecoides
tcccccaacgtggtgccaaggggggtgccaaagcgcaagctgcgcccgccaagaggggtgccaacgcgcaggctgcatccggcggtcccctggtccagacgcccaagcaggcgctggcaaggtactgccag

SEQ ID NO: 26699 - DNA, 169 bp, Chlorella protothecoides
ggtgcttgggggaggaaagaccgtcttgggtcgggtacgcgagggtgttgtaatcggattttttcgtatgtgtgtgtggtggtggtgggcaccagggaaggcaagctgggtgtacgctaatccacagtccttgaatgagaataggactgcttgtgctggtctacagagt

SEQ ID NO: 26700 - DNA, 72 bp, Chlorella protothecoides
ccgtgtcggggcctgaccccgacgaggacgaggctggcgagggtggagcgggtgaagccgcgccgcgccggc

SEQ ID NO: 26701 - DNA, 91 bp, Chlorella protothecoides
tgagaatggaagcatccagacaaacatcatgctgtccacaggccaaagtctgaatcgactcttgctggttcatgatgttggttgtggaggg

SEQ ID NO: 26702 - DNA, 61 bp, Chlorella protothecoides
ttgctggttcatgatgttggttgtggagggtttggttgtcgcctctttcccgactccatct

SEQ ID NO: 26703 - DNA, 64 bp, Chlorella protothecoides
cccagccactgcggtctgctcgtgcttgcaggactgacattcctccccatactgccccacagac

SEQ ID NO: 26704 - DNA, 73 bp, Chlorella protothecoides
tggtcaggtactggagcctctgcagtaccaactggcctgttcaggcagctcccgccagtcacgcaaatgcatt

SEQ ID NO: 26705 - DNA, 61 bp, Chlorella protothecoides
gaaccttgtcgataatctgagagcttgacagtacaaacttgaacaccatcggcagacgcct

SEQ ID NO: 26706 - DNA, 148 bp, Chlorella protothecoides
cagcttggtgacgtagacggccagaggcccgcgcgggttgcaggcgcgcatgtggcccgcagcctccgagtcctggggccccgtgtaccaccgcgcgaccttggtggccgtgccggcgcgtgcggagggcaggctgcgcaccagcact

SEQ ID NO: 26707 - DNA, 74 bp, Chlorella protothecoides
caaacaaaactcccggagttgaccttctgatctcgtgactgtgtgtgcctctgcagctcaatttgagtcggcgc

SEQ ID NO: 26708 - DNA, 61 bp, Chlorella protothecoides
cgcgcaggttggcgacgaagatggccaggcaccggcgctcctccgtctcgccgaagaggtc

SEQ ID NO: 26709 - DNA, 68 bp, Chlorella protothecoides
ttgacgccatcgctgttgtcggtgcgctggctggggttggcacgagggtggggcgctggtgctcaaag

SEQ ID NO: 26710 - DNA, 492 bp, Chlorella protothecoides
atgcgcgcgcggatgtccggcagggggctggctccgcggccgggcgaagcgccggccagccccgctgcggccagcgagcgcgtgacgctggcggtgagccggcgctgctgcgccaggggcatgcccaccaggcccggcgcggcggcgtgcggcggcgagcctgcctctgctccagtggcccgcctccccacgccaccgactccacgcccagcgtccggcgaggcggggcgggagggcagtgggtcggcgatggacccctccgtgagctcgaagatcgtgcgcagcgtgtcctgcaggtcgtcgtcgaacgcgtcccagtaccaggtgcggaagaggcggaaggcggtctgcttctgcaggaggcagcgccgcaggcggtcgcgcgcctcggccgcctcggccaggttcccgcgccacgcgtcccaggccgcggcgacgcggtgcaggcgccaccgcgcctcgaagcgcgagagcgcggtgcggcgctcccgc

SEQ ID NO: 26711 - DNA, 61 bp, Chlorella protothecoides
cagaagcagaccgccttccgcctcttccgcacctggtactgggacgcgttcgacgacgacc

SEQ ID NO: 26712 - DNA, 66 bp, Chlorella protothecoides
ctggaggacggcagggtaaggaacagggcatagttagaggtgatggtcgcgacaattgataagaat

SEQ ID NO: 26713 - DNA, 112 bp, Chlorella protothecoides
cgcggagacctgtcccaatgctgcgtcggcggatcaagtctacacatgtatctacaaaggattccgcatccgggcgatccaccgtcctcccatctcgcgtcccgccggggca

SEQ ID NO: 26714 - DNA, 67 bp, Chlorella protothecoides
atcggcgtcgccctgccattaaagcccgctcgcgggtcgcaaactccctctccacagcaaacaccta

SEQ ID NO: 26715 - DNA, 61 bp, Chlorella protothecoides
tggggcaatcgtttgccgtgcctgccctcccagactcccaacgtcaccccaacacaaaccg

SEQ ID NO: 26716 - DNA, 80 bp, Chlorella protothecoides
ctgacttcgttccagccatgcatagatgcattgcaagtggtagtggtgcccacacttgagcgtgatcttgggattctctg

SEQ ID NO: 26717 - DNA, 71 bp, Chlorella protothecoides
aaagtcatgctgtcaccaatagttcattgctgcagcatgtgagtcactccgcaaaacccattgtcactcga

SEQ ID NO: 26718 - DNA, 71 bp, Chlorella protothecoides
tgccgcagaggcattcgaacccgtgaatgaggaggtttgcagtagctgcaacaaagttgagtgccgttact

SEQ ID NO: 26719 - DNA, 64 bp, Chlorella protothecoides
cctgcctgccgcggaagaagtccaagaacatgctcttgacccgccgcaggacggcatcgctctc

SEQ ID NO: 26720 - DNA, 77 bp, Chlorella protothecoides
gcaacagatttcctggacaccatactcgtattgcctgcaggtctgacgatcatattgaccaagagcgaatggtcttg

SEQ ID NO: 26721 - DNA, 64 bp, Chlorella protothecoides
gcgtcggggctggcttcatgcggcgccgcgcacgcgaggaggtacccggcagccggcccatcgt

SEQ ID NO: 26722 - DNA, 61 bp, Chlorella protothecoides
ggcagaggggcctgaatccaacatgcccgccggaggactgcagagggaaagcagtcctccg

SEQ ID NO: 26723 - DNA, 61 bp, Chlorella protothecoides
atccgacatgaagggcaggagaggggcaggtggcgcggtggcgacctgaaccgaatcggtc

SEQ ID NO: 26724 - DNA, 119 bp, Chlorella protothecoides
ggcaccggcaagacctgccgctccatggcattcattcaacaaggtgaggttgatgtcatgagctcactgttgggcttcatcgagcatcgatggcagcgaacatggtgtgcatctgacgc

SEQ ID NO: 26725 - DNA, 6508 bp, Chlorella protothecoides
  modified_base (703)..(712): a, c, t, g, unknown or other
  modified_base (2756)..(2765): a, c, t, g, unknown or other
  modified_base (3147)..(3156): a, c, t, g, unknown or other
  modified_base (4184)..(4193): a, c, t, g, unknown or other
  modified_base (5082)..(5091): a, c, t, g, unknown or other
  modified_base (5555)..(5564): a, c, t, g, unknown or other
gccgaggcgtgggccctgcggtcccgcccgcgccgccccgcggggcctttgagcatggccgcgtgcggcacctggccgcggggcgggggctggtaggcaaagtccacgccgcggatgcggtggatgcggggcacgctctgccctgcgaaccgcccctcgcacaagtccttgtagcgctccaccgcctcggaggccaccgcgcaggcggcgcgcaccgaggccgggggcccctccacgcggaaggtgcgcgtggggcggcggcatcgggcgtcgccgggggacgtccaggaccagacctccgcgcccgtggcgcggcagacgtcgcggatggaggcgccggaggggccaatgacaaagccggcagcaaggagggtgatgcgcagatgcatgccgcccgtgggggagggctccgcggacacgatgccctgctccagctcctcggtgccctgtccttgctggcgggggcctgggggagggtggaagaggagcggagtgggcgtgggtacctaggttctacacagcttccaacttcccttggacgcttgcggtacaagcattcccatcagcagtacgcattctctggctgtgaacatgaccaacacacacacacaccgcctgggacgactccacaggggtggcttttatatggagtacccctcctaggccccccacccccatcaatcgagtctcaccactaggctgnnnnnnnnnnaacacacatacaccgcctgtgacgactccacaggggtgggttttatatggagaacccctcctaggccccccaaccccatcaatcgagtctcaccactaggctgcacccactgcacggtttcgggggcaacaacgtcgccgatcaggttggactgcaagggggtgccatgcccggacccagtgctgctgcggggggaggtggaggaagacaaatccagtccctcctcggaggaggagcagcgcggggccgtgacgctcaaggcagaatccagcgaggtctccaaaccagcgcccgccatgaacgcgtttcttggttccctgaaacacgttgggggggctgaatgagtgtgggggtgcgtgtgcgaggtactggcagcgccccccatatcgtacaagcttacctgaggagcagggactctggcagcacagagaccgagccggggggatgtcttgcgttcaacatgtcgactgtacgtttttcagggtattgaggcgttcgggtgaagaagctgtccggttatgagtaagaaaatctgtactgctcaagtcggtcagcatgacgaatctcgtgacctcctccctgtacagcgttgctgcgaagatcctgtgcctacctcgacccgcggttctttgtactgtggattgatttaatcgaatgctttttcgattggcttcaaactactccaggctcgatgtgcgtaccagcccgagtgcacactcggctgccaacacaagaacccctttgtgcgcgagcgaagcggacgcacaggactccttcaattattgtcccacgaaattttcgggtaagagatctggcttatgcgggatgtcttgtgcctctgaacagggttcatagcacttcattgtcgaacggatcgctggtatgatcgaccccggctgtagccgacacccggggagacatccaccctctccgtttgccgtgctgtcagccctgttctggggcttccaattcctcctatgctcagggtttctcctgggaggtgctggcatgtaggatagcaactgtgaaggactgtcgactcgctcccactcggcgaaaaggcccatccgcttccgagttccgtgtggttaggatgtgcgactctattccctggcagccacgtgatattacctccgcaactgcaagcctatcgcgaatcctttgtaaggcgcaaaggctgctctagaaaatatatgtggtgtgtgtggctgttcagcgagcacacgccggctcgcggtggggttgtcactcgcgtcatcatcttctgagtatgaggacgccagcttctcccctccgctgtctggtgggactgaggaggttaagagcgttgctctgtactcgaggagttgaggatctaccgtgccgatcggaacgatgaattgtgggctcatgggtgcaattgcggcattcgaggaactggttctgtctggagatatcaggagatatcccgggtgaagcggcactcatgttgacctacccaccctgctcctcgccgatcctctagggtccatcacgacagctcatcacgatccagaattggaatcttgatgtagtctgcatgccgtgccaatcattttagtgatccttggtttcaccaggatcacttctcggtctatcacacccaagcacttgccggcagcacgaggaacaaccaagtcattccaccaccaatgactgtgtcacatcacatctgaaattaccttcggatataaaaagatcaccagctcgcagaggctgctatcgtcgaaactccaaaacggctcctaaagtaggaaaaaacagttcgtcacggggacttcccacgtggtcacccaccgcagtactattcccgcccaatccagcttaattaccgaggtctaatgggatcggatgcgttctggatggtatgaacgaaccatagtaatcgacgaattcgcctgtatataatccacatacgattacgaacatacttgctggcttgacgggcggcacgagtgaagtgaactatgtcagggatccactttcagggagataatcaatgccttccagcactgaaagtcccccnnnnnnnnnngtagtcgaattcgcctgtatataatccacataggaatacgaacgtacttgctggcttgacggacggcacgagtgaagtgaacaatgtcagggatccattttcagggagatgatcaatgccttccagcactgaaagtcccccaagcatacaggcttgtacaccctggcacgtaatgggtactggtcggaactatccacccacataatggaaagatgggcgctcgtttttgagaacatggcctgtgacactccgctgttcctgctcacagtgctcggtcgagtacctccccctagaagcctatcgcgcgcgcgcccttgctcaggcccgcaaggcatcatttccggtgcatgcagacactgctcagcgatcaagccgttgccgnnnnnnnnnnttttttgagaatatggcctgtgacactcctctgctcctgctcacagtgctcggtcgagtaccttcccctaggagcctatcgcgcgcgcgcctttgctcaggcccgcaacgcaccatattcggtgcatggagacactgctcagcgatcaagccgttgccgataaataaagaaacctgcgttgagtggaactcggcatgcccaaaaagagggtgctgtcgccgcagtccgtgtgggacgagccggcgctgcgcctggccttcgaccgggccggcgtcaaggccctgcacctgcctcccctctaccggtaggacttcgaattgtggcaccggcacggtcactgacatatcgcgcgagctgcttggtgcggaagcgtcacccctacccccaacccctccaggcacctgctgcgacacccggatgccagctggtccgacgtgcctgacctcccccgagccgcggtggacctcctgacgcgcgacttcgcggcgcacaccactaccctggtccatgcccagacctccggcggcggcgatgccaccaagctgctggtgcgcctgcaggacggactgcaggtggaggcggtgatcatgcagtacgacacgacgtccgccccgcccgccgcgcccgacggcgccgcaccgcccgccgtcaccggctcccagcgctgcacactgtgcgtgtccagcgaggtgggctgcgccatggcctgcaccttttgcgccacggggacgatgggcctgtcggccgacctcaccgcgggcgagatcgtggagcagctggtgcacgcgcggcgccagcatcccatccgcaacgtcgtcttcatggtggggaagggtaggggatgggtgaagggtgggtggatggggtggggtacaggtgggcgagccactctcaagagggcagagatgctggtgcagggggctgtcgtgacagcggtgaggtccacggcagtacgccccccccccgactcctgcctggtatcaaaccgtcgagtttgatcaccaccactaccaccccaagggcatggnnnnnnnnnnaccacggcagtacgcccccccgactcctgccttgtatcaaaccgttgagtttcatcaccaccactaccaccccaagggcatgggcgagccgctgaacaactacgtggcggtgcgcgccgccatcctgaccatggtggacccggcctccttcgcgctgcgccgctccgcggtcacgctttccacggtgggcgtggcgccgcgcatccgccagctggccgccgacctgcccggggtcagcctggccctgtccctgcacgcgcccacccaggagctgcgcgctgccatcgtgcccagcgcgcgcgcctacccgctggaccgcctcatggccgcggtggccgagtaccaggccgccagcgggcagcgcgtgttcgtcgagtacgtgctgctgggcgaggccaactgccgcgccgagcacgcgcacgcgctcggcgccctgctctccgggcgcaacgtggtggtcaacctcatcccctggaaccccatcctgtcccccgcgatggacttccgcggccccgcgccgggccaggccgcggagttcgcagccgtgctgaaggagcagtacggcctgcccaccaccatccgccaggagaaggggcaggcgagcgagggggtggaggggggccggcggctggctgaggaggtcgggaacgaggcgatggtgggaagggtgtgagggatcgtggggggaccagtgctcccaggactggccagataccttgagccggcgcgagatggttggcccctgggcccccagcgtgctgcttgccccaggtgcgaaacggacctccccagacacctcctccggccctgctccctcaccgtcattcccaccgaatcctgcaggacgtggcgggggcctgcggtcagctggtgctcgagcagggggggnnnnnnnnnnagctgcttggcccaggtgcgaaagggacctccccaaacacctcctccggccctgctcccttaccgccattcccaccaaatcctgcaggacgtggcgggggcatgcggtcagctggtgctcgagcagggggggagggcgtgcgggcccggcggcagcggcggcggcgggtgcggggacctggaggacctggccggcagggcggtggccgcccggtagcttgggcactgacagtctgtgcacctgcgctgcacgaaagggccatgctctcactgaacgtttgccctttcaagctggaattttccccttctctcactttgtttgacatctatctttcgctccggacatgtacacgatcccttgttcaagctgaggtaaaagacttgaaggagttgcctgggaggcggggcctccgccagggattgcctgacctgcggagggctccatccccagcctcctgatgtgcnnnnnnnnnngtctagcttttgctccggacatgtacacgaccccttgttcaggctgaggtagaagactcgaaggagttgcctgggaggcggggcctcccgccagggattgcctgacctgcagagggctccatccccagcctcctgatgtgccttccacagcgtgctctcacggcgaggcgggagcactcgccgcggcggtttgattgccagtgctgggaggcaggcaggcacagtgcttcactcgcaggcccttcacgtaagtcagcaagggcgtgcaccgaggaggtggagcgccaagtagctcagaagccgatgcgctgcccggccggcacgtcggccgcctcgtccagctccacaaactccttggagtagagggcggcaaatggcggcaggctgttggcgcacacccggggcagcaggggggaagttttagccaggcccgcaggttcgtagccgcgctatatgcatgaggggggttgggaaagagcggggaggcggtggcgggacggggcggagaatgataccgtcagattcacatgctggaggaacatctgtcatgccaaatttgctacttccacatctacatgtatcttttcagtcatccctgccaacattgaggcctgaacacgttacggccacccccttttccccctgtaggaaagaatggatccaccccccccccgacgcacccacctccatgaaccagtcgtagccgccgcggccgacctgcaccagcaggcagcggccgtagcccgcgcgccgcgcatcctgctccacatagtccagcaggctgtcgcccaggccattgcagcggtaggcggggtgcaccaccagcgccgccagctccatcagccgcgcgccgtcctgcgaggcgcccaggtcggccacgcaggcgcaggccaggacctgctgggtggggtgggtgggtttgtggctgggatggcggggtgggt

SEQ ID NO: 26726 - DNA, 76 bp, Chlorella protothecoides
gtacgctgcgagcgcctgggcagggccggggtgtgtgtgtgtgtgtgtgctggtgggcgacagctgcagagcctgg

SEQ ID NO: 26727 - DNA, 61 bp, Chlorella protothecoides
gcttgtcgaggattgttgggtgatagctggcccgcgctctgatgatcatcctgcgggagtc

SEQ ID NO: 26728 - DNA, 238 bp, Chlorella protothecoides
gcttccttcacggattggagctgggcattgcagtcggtgcagaccaaggacagagcctcgtcggccatgtgaggttgaggcccaagagcgtttcgactgatctgagactcaatagaagctagcctgcatccgttgtagttgtcgagggcagctttgactccatcccgatgcctatggccctttacaaacgcaagatcatgtgcgacacaccagcggaaatcttctgggcgcgatctct

SEQ ID NO: 26729 - DNA, 204 bp, Chlorella protothecoides
cccaactgcaaacaccaatgtcagcagtgttccgcaattcctggcaagaggagtgggtgcgatagacatagcaatcgacgcgttgatgcatctgtgagcattaccatagagccctgacgaccaagcaaagggtggctatgacaaggaacaccaggccccattggttcactggattgaaaactcacagagcattggcaaggggat

SEQ ID NO: 26730 - DNA, 76 bp, Chlorella protothecoides
ggcaaacgacgccgctgcgggggggaggcaatttatgcccctgcatctgcaagtgacgccagaggaactgggtgcg

SEQ ID NO: 26731 - DNA, 103 bp, Chlorella protothecoides
gtcggctgctgatgccggcctggccactgggaatccgctggaagggcaggctccccgaccccgaccacttccctttgatgcgcaaggtactggaggtggccga

SEQ ID NO: 26732 - DNA, 61 bp, Chlorella protothecoides
ttcacgccagcaggtggaaagaaaggacctcgaaccctgcgatccaccagtgcgatgtcct

SEQ ID NO: 26733 - DNA, 93 bp, Chlorella protothecoides
atgcgaatctcgtgagcacgtagcctcgagagcgttccgcagacaagtccttccgggttttctagctttcttcaattatcccccctgcggcat

SEQ ID NO: 26734 - DNA, 129 bp, Chlorella protothecoides
cctgtgggtggtgagcacgatgccccttcccttctttccttccttgaccacatcccagaggttctggcgcgaggctgggtccagtccctgtgcattggtgtcgtggcgggggggggggggggggggggg

SEQ ID NO: 26735 - DNA, 258 bp, Chlorella protothecoides
gcagacgaagccgaggtccgcgaagaagccgagcaccgactcaacggggccactggggaggtgggagggtttgcagcggggtgctgagtgtcacacacagcaggggcaaggtccctggtcgtggtgcaggccaaactgcggtgtggcacaggagctgtcgctctgtggcagccgaccggggtcggtgctgtgagcgctcgagccaagccccgcctcacggacgcccctccggcagggcaacctccactcaacgcactg

SEQ ID NO: 26736 - DNA, 61 bp, Chlorella protothecoides
tgtacttgaccgtctgtgcttgagggggggtgttgagggcggtgacgggggagggcaatcg

SEQ ID NO: 26737 - DNA, 85 bp, Chlorella protothecoides
gatcgcatgggccaggcccttcaatccccccgacacccccactgacccggccacggctgcttcgctggactaccagcatgccaag

SEQ ID NO: 26738 - DNA, 281 bp, Chlorella protothecoides
aatttccttggtgtcttgaaatcttcatttgaaagtgtacccaacaactccgattccttttctttggagttttgcagggtggtgacatgggaagttttgaacaccagaggaaccgacgcacggtccagaaagttggcatcattccgatcagtgttgcaagttacggcattatgttttatttttgtgggccgggttaagcatctgtttgggatcagtactcacctcctttacaggtaacactgcttcgtcaatttgtgaagcctgattccacgtatggcgaa

SEQ ID NO: 26739 - DNA, 76 bp, Chlorella protothecoides
atgcatcaaaaccagcatcatggctggatatcgaaagtgaacttgatatatgctcaaaggtagtatgtgaccaagc

SEQ ID NO: 26740 - DNA, 104 bp, Chlorella protothecoides
ccttctcggtgggaagctgcagccccgtcatcctcgccacgccggccctgtcaaactgctcatgccgccgcaaaagggcccacagcgtcgtcagggtgccggtg

SEQ ID NO: 26741 - DNA, 79 bp, Chlorella protothecoides
gcaacacgacgcgcctcttccaggtgggttacttttgttaattcgcccacaaacctcgcccgcatccctcctccccaga

SEQ ID NO: 26742 - DNA, 71 bp, Chlorella protothecoides
cccgccagtgtcagcagccttggcgacgctgggtcggatgccttgcgatggaagaaggcaaggcgccttca

SEQ ID NO: 26743 - DNA, 180 bp, Chlorella protothecoides
aaggccatgggaaagttgagggtagtggaggactccatttcgaggtatgcccaggtgcccgccgcttcaaacccttgcagcctgtgtggccaggacggtgatggaggttgctaggacgaagggatctacctcaatgtcaggagtatgcatagttccctcaaatctagacgacggcgcccc

SEQ ID NO: 26744 - DNA, 79 bp, Chlorella protothecoides
aggtgagatggggttggggtcaaggtccatcttggggttttgggggatggggtgagtgacacagcagccttctcatacc

SEQ ID NO: 26745 - DNA, 74 bp, Chlorella protothecoides
agcacgcccacaattgatattatctatcctttattgtactagaaaaatactgaacgagtgtgcgttcggagagc

SEQ ID NO: 26746 - DNA, 77 bp, Chlorella protothecoides
acgtaggtgcatgtgacgtcttgatgcacgcagggtacccaagctcctgctctactaggagctaggggcagtaacaa

SEQ ID NO: 26747 - DNA, 132 bp, Chlorella protothecoides
tggcgtcgcctcggtcgcgccagacgctgttgtcccatccacagtctttgactcatccgccgacttcgccacgtctgtccttgccccgcccacagcagcctcgccttcgttcaggagggcggcggcctgcat

SEQ ID NO: 26748 - DNA, 76 bp, Chlorella protothecoides
cagcgtgatccagtgcgtcccctctggagtgccgctttgccagccaaatctggatggcaatgtgggcactggcaat

SEQ ID NO: 26749 - DNA, 152 bp, Chlorella protothecoides
gatgggagcgggcatcctccctgcggcgccccggccctgtcgatgctgtgcccctgctctgccccctcaccgccccctcttcccccttctcctgccaggcggacgggacgctgtgcatggacatcatccaggaccagtggtcgccgtgccac

SEQ ID NO: 26750 - DNA, 258 bp, Chlorella protothecoides
cgttgtttgggtgggaaaatgtaaggaaggacccgcaagtttttcctagtccagattatggtatccccaccttgccagcctgactaaaggagcaattcctttgtcttatgcgccgtcccaagaactctcctggccttgcgtggtcgggtgctcgatcctttcccacctgagccctccctcgataactaacaacaccccccaggcgcccggcgctgactcaacagcccggttcaaacgacagggcgctgggcctggccg

SEQ ID NO: 26751 - DNA, 80 bp, Chlorella protothecoides
gatcactgatcatccacctctgatcggcattgctcggacactgaatggccttgatcagctttgcgcaccatcgcagagga

SEQ ID NO: 26752 - DNA, 77 bp, Chlorella protothecoides
ttcagggcggagccagcgtttggcggggccctcttcccctcccgcgcgagcctggtggcttggctggagtcccacct

SEQ ID NO: 26753 - DNA, 3529 bp, Chlorella protothecoides
  modified_base (887)..(896): a, c, t, g, unknown or other
  modified_base (1386)..(1395): a, c, t, g, unknown or other
  modified_base (1573)..(1582): a, c, t, g, unknown or other
  modified_base (2019)..(2028): a, c, t, g, unknown or other
  modified_base (2213)..(2222): a, c, t, g, unknown or other
  modified_base (2731)..(2740): a, c, t, g, unknown or other
ggggggggggcccgagtatggggctggaagcgagggaaaaaggggcgagagatgcaccggctgtgacacacaagccgccggctgtgggaatcagtgaccttcacgagtccgccaccgacgcaatcacgcaagcccctttccctgattaccagggactgccagcacaggaagctcacccttcatctggggcagggcatccaggtccagggcaccctgcaggctgagaccaacccgctcccactcaaaactgctgtacacttccaggaacttggccaagacctacgggaaggagagggtgattggaaggtgcaggcagactttgacaaagtgaagctcaaagcagagactgcccctgtactgtgaatctcccagattaacacggctaagcagaccttgaccaggggagagtttacgaagccccatcaaaacacaatcacagaagccctcccatccaagtacaagggaccaggagcttgtgaaaccagtctacaagaaggtccccaaagtaatgaacacacctggaggggggtgtgcaccacgctgtggtgcaggttgatgacattcagcacaagggtttccagggcgtaggaactcagcaggccatggtgggcgcccagcaggcgggactcgtagtagcaccaggccttgatctgcagatcttggatggggcaaggttgagagggtactcctcggttggtaagatgggcactgcctgacaaggcaggtgacgtcccggcgctcacaatgtgcccagaaaacctgcacagtggcctcacattctgacacctggtactgctgcctgccttcaccgacccctcccattcctaggatcccacgattgaccccaaaccgccgtgcctcaccaagaggatgctgcgcttgaagannnnnnnnnnatgctacctgccttcaccgacccctcccaccccaagaatcccacaattaaccccatcccgccgcgcctcaccaagaggatgctgcgcttgaagaggtgggccctcccaatgcggcggtccatgctctccagaaaggccaccgtgcagaggcctcccaccgtctcaaaggagatgtccaccaccacacccgacacgatgcacttcaccagctgcacctcggcctggatgacctgtatgtcccggatggggaggtggacgggcccccgcctggcctcccactctaatgcacggacgaggcgaggggcccatacgccccgcagggtggcctgatccgtgcgtcgtgagcagaagatgctgacgtcgacgtcaccatcggggaggtaggtgcgcagagggacagatccgaagaggaaggcctccacctggcatggagtttgcgtgatgcgggttggtgacgggggtgcgccagaagcagctgtgggatgtcgcnnnnnnnnnntagagggacagatccgaagaggaatgcctccacctggcatggagtttgcgtgattggggtcggtgacggaggtgcgccagaagcagctgtgggatgtcgccacctccaccctcgctccatccctggttgctatgaaacgcacctcatactcgttatggaagcatttacggatgatggnnnnnnnnnnactccatccctagctgctattagacgcacctcaaactcgttatggaagcatttacggatgatggagcagatcaagcgcgctatggccaggcgcctcgcttccgaggcagggctgggctggagtgccgacagcagggccgtcactcgctgttctgcagcaggatgacgcatggttgcagatagaatccatgcgacgcacacccgctcgcaatcctgcccaaggactctctcacacaccatcgcctgtcgggacatggttcacagagaggagcgcatgttcccgcgcttggtctcgcgatctccacgtcgacaaacgatgacgtgcgccatgccgctcgaatcaggcagtgaacgccatatgcgttgcccgtaaatgcttttgaggattcccccatcctgttttgctccccgggcggagctgagcgtgcttggccaggnnnnnnnnnnaaattccccatcctgttgtgctacccgggcggagctgagcgtgcttggccaggtcccggaacagcacctgctgcaccccttccaccgcatcacattgcgaatgggcacagcgaaatccccaccctgacaagtaggatgtgagtgcaccccccttcagaacatgggttcagcctcttctcgaagtnnnnnnnnnntagcgaaatccccattctgacaagtaggatgtgagtgcacccccctccagaacatgggttcagcctcttctcgaagtagcgaggtggacatggggcggaagcgacagtctggacgccgggcaccgcccccagcttcctcgacccctgcggccctgaagtcccagccagcctctccttgcgcgcagtccgccgagccgggtccggtgagcagggcttttaccatgtctcgtgcagcccacggctcgggcacccggtagagtgtcgcgccgatcgtgcagttctagtgcgcccggatcctccctcatcctcaccgacatccgtccaccgtcccgcccgacacccccacccccccctcagtccctagccggacacgagtcgtttcaggactggctcagtaattccagcaccgccagccagtcctctggcggcctgcacgttgggggtcctgggcagccccagcacgcaccacagggcggcgcccccgccgcggcctccaacgccgcggtgcnnnnnnnnnnggggggtcctgggcagccccagcagggcggcccccccgccgcggcctccaacgccgcggtgcagagctggctcaaacggccccccagctccgcaggcagcgtgctgcgctggtccggcgaggtgctgggcgggcccctgcccggcgcgggcgcgcgcccctctgacggtcgcgactcgctggcatccagcgccgcgcggctgagcagtgcgcgcgtcagcgtcacctccagcgccgacaccgtcgcctcgacctactccctggcgggcaaggggcgcgggtcctttgcgctggagcgggccagcctggagtccaaccgtggcatgctggacatgtttgcggcggggcctgagacgccgcccgcaggcgacgggagggggccctccgtgggcggcacccggccgtcctccatgggcggcgaggccggcgcccaggcgcccgcaccccgcgccccctccctggccagcctgacctcagcctggggcctggcgggggtgcacgccgaacgctgcgcgcgcctcgcggtgttcgccccgcactcccccgctccgctctccgttttggagaagctgtgggagacggggacggcggaggcgggggccaccgtcgctgccatggcgctgccgggcgtggtcagtgtggcccaggcgccagatggcatgctctggtgcctgccgcagctggactgcctgctctcgctgcaggtgtgtgtgggggggggtagggcagggggtttagggagggcaggcggggttggggagggcagggggtttttgggagggcaggcggg

SEQ ID NO: 26754 - DNA, 61 bp, Chlorella protothecoides
gggggctacttgggcctctgggcggttgtcacagggtgagtggggggccgaggcaggcggg

SEQ ID NO: 26755 - DNA, 61 bp, Chlorella protothecoides
agaggcagtggggggagaggcagtggggggagaggcatggagctccaggacccacatcact

SEQ ID NO: 26756 - DNA, 556 bp, Chlorella protothecoides
gccgcggcgcgccaggtggggcgccacctccgccagccgcgcgcgcacgccggccagggtgtcgtagggcagcggcgcgcccatgacctcgctgagcgcgcgcaggaccttccagtcgtcgcgcgcggcgccgggcggccccaccgccgccttggtggactgcgcgcgcccctccgcgttcacgtacgtcccgaacttctcggtgtaggcggcgccggggagcacgacgtcggcgcgcgccgcgccgcgctcgccgtggtggccctgatacaccacgaaggcgtcggcggggacgtcgccctcctcgaagtcgtccgcgcccagcaggtagacggcgcgcggcgcgacgcccctggcccccgcgccggggacgaagcccaggtccagcgcgcccacggtgcctgccgcgtcggccagcaccgcaaacccgttccagccctcgcgcactacatcgccggcggcgaggagctcgtaaacgcgcgccagcacggcgcgcgcgtcggggcgcgccagcacgcccgcgccgaccaccaccaggggcctggtcgcggcgcgc

SEQ ID NO: 26757 - DNA, 71 bp, Chlorella protothecoides
gtgtccccctctggtaccgaaaccagcctcaacacacccctccccacacccacggcaggcatgagcatggg

SEQ ID NO: 26758 - DNA, 102 bp, Chlorella protothecoides
gagcagccgacgcagcacctcaaggtgtgctgggggagcgcatgatgaaggggcgggcaatgggatatcaatgctggcaggcttgcacagaaaatgccgctg

SEQ ID NO: 26759 - DNA, 124 bp, Chlorella protothecoides
cagcggccgcagcttcaccgcctacatcttccagaggtcggatggcggctcagaggagcagcagcggaaggctgcccccagtaccagcgtgcaagaggaggtcccaacgccctgccggtcccaa

SEQ ID NO: 26760 - DNA, 320 bp, Chlorella protothecoides
gccgccttctacctctggctccaggtgcccgggatgggcgagggtctgtggactggggtggcgatcgtgctcaaggagagctgatgcctgcttgctgccctgcacatggctgcagatcgactggctgcaggccagattttgggaaaggggaaactgctgtgtgtgaagcgccaggcatgttgatcgccctggtggtttggggagagcgccgcgcctaccgcaaagcatgcacgcacccccctcagcctccccctggcaaccccagcattgcccctctgtagggggcgcatggggcgcatgcggtgctgcactttggcatg

SEQ ID NO: 26761 - DNA, 14562 bp, Chlorella protothecoides
  modified_base (2171)..(2180): a, c, t, g, unknown or other
  modified_base (2518)..(2527): a, c, t, g, unknown or other
  modified_base (2885)..(2894): a, c, t, g, unknown or other
  modified_base (3469)..(3478): a, c, t, g, unknown or other
  modified_base (3994)..(4003): a, c, t, g, unknown or other
  modified_base (4444)..(4453): a, c, t, g, unknown or other
  modified_base (5250)..(5259): a, c, t, g, unknown or other
  modified_base (5335)..(5344): a, c, t, g, unknown or other
  modified_base (5639)..(5648): a, c, t, g, unknown or other
  modified_base (6149)..(6158): a, c, t, g, unknown or other
  modified_base (6372)..(6381): a, c, t, g, unknown or other
  modified_base (7848)..(7857): a, c, t, g, unknown or other
  modified_base (8236)..(8245): a, c, t, g, unknown or other
  modified_base (8461)..(8470): a, c, t, g, unknown or other
  modified_base (8547)..(8556): a, c, t, g, unknown or other
  modified_base (8633)..(8804): a, c, t, g, unknown or other
  modified_base (9294)..(9303): a, c, t, g, unknown or other
  modified_base (9654)..(9663): a, c, t, g, unknown or other
  modified_base (9868)..(9877): a, c, t, g, unknown or other
  modified_base (10109)..(10118): a, c, t, g, unknown or other
  modified_base (11085)..(11094): a, c, t, g, unknown or other
  modified_base (11742)..(11751): a, c, t, g, unknown or other
  modified_base (13811)..(13820): a, c, t, g, unknown or other
ggccaggcgagccagggaggggtgccccagctggccccaccgcgcgtcgccccaggagaagagccggccgtcggcggccagcgccagcgagtgcgcgcgccccgcggcggccgacaccacgcgctcgccgcgcgtggcctccaccagcgtcagcacgccctcgtcgtggaaggcgccgtgccccagctggccgtgccgcccgcgcccgcaggaccagagctggcccgcctccgagatggccagcgtgtggttggcccccgctgccaccgacaccacgcgcacgcggtggagggagcccaccaggcgcggcgcgcacacctcgatgggcgtccagcccccgtgccccagctcgcccgaggaggccaggccccaggtgaagagctcgccgcggcgcgagatggaggcggtgtgtgagctccccgctgccaccaccgccagctgcaccgcgtcggcggcggcggcggaggaggagggcgccgccgccgcgccgccagatcccgcgccgccagatcccgcgctgcgggccacgccgggcacgcgcgtcggccgcagacgctgctcgtagtcgcccaggcccagctggccgtggaagccgcggcctgtggtgtgcagcgcgtactcggccgcctcggcgtgcgccgcgcggtcggccgcggaggacagcagggccacggtgtggtaggtgcccagcgccagggccgtgccctgggctgccgcattggactgcgcggtcacaaacgcgtacagcgtcacatacgactcgccgtgcctgattttgtgggaggggggttggacgggggttagatatggtgtgagggagtgctttcgggtgactcagtggatgggaagcagggacacgatgagttccatgccagtctcaaccccaggaccgcatgggcatgaggaccccccaacccgacccatacatccaacacgcacttgaagtcgggcttgaggcccttggcacgcgggatgaaggagagatggtgcatcgccaccttgtcggtgatgccggacttgatgaagaaggagcaggagctctccagggcgccgagctggcggggggtgcagtagcccaggatctgctccagcgtctgcagcatggaggagacgtgggggtttgagacccaatgctcctcggcaacacactatcttcctgagggcagcagcatgtcgcgcgcatgtgggcgcgttccgaccccaccgcgtcgggaccaagggatccagtcggttggcaggaccccaagcctcacctccatgggcagcaatcccaggtatccggagaggggtggcacccgtttggcagcaccccgctgccgcacatgtcgcagcgggcaaaggatcttgggtcgctcctccagtcgggggaacttttgcggggggtagattttatccagggtggtgtgctggggagaggagagcacgcagggagaggcgtccatggctgctcgcttgttacaaaacaaggctgggttgtccagcgcgagttcgctggtcgaagcggaggtgctggggtcgcacatgcctactggtcgacgggagggcacggtcgctgggcggggggggtgagggccagttctgggttcatgctcattatttatataccacactgaatatgactcgggggaaggggcgcgatggaggcaacagacgtgcgttgcgaggccatggtggttacaccttgcggaacccaacccccgatgcaggcatgcagtaccccggcggtttgtatcatccaatgtcgtcccccagatctcgacatgccggcggattgccgggtctaaatacgcatgatataccagcagcgaatacaaactctgcttgaatggtcatcagcgcgtattttgggagtgctgtgacgcatgagcgcgtgtaaccgctgtacgaggccgatggggtcaccgggtagtcatcacgctagacgcgaaattctctgttccggacatgcccaaacagtcggatgtatggatcttacaactgggattgagcaaataagagatacagggtcaaagcgcaattgcaattatggacagtttcgatcggcgggctcccggtatggcaccccgagtagctcgaagacgtcctcctggcgcaggatcctccttcctgcgtgccaccctaccggccatgcctcccgcccccccttcacgatgggaggcgcctcgtcaggnnnnnnnnnntgtgccaccctacgggccatgcctctcccaaccccttcacgatgggaggcgcctcgtcagggaccagccgggccttgccatcgatcttgcgcaggagcctgtgatggttaggatgggagttcagtctttattcctgaatcgcgggctcatctatttggtaggtgacatgacgagtgtgtggctgtagcattgctcctcgtcaccactgtagtgatcctctgcaccaggcgcctagatcaccccaatcgtccaacgccgcctggtaccctctggcctcccaccgcaagggctcgccgcccatttccttcacctgtgggagttgaggtacatgcccacgnnnnnnnnnntttaggatgggagttcagtctttattcctaaatcgtgggttcatctgtttgggaggtgacatgacgagtgtgtgactgtagcattgctccttcgtcaccaatgtagtgatcctctgcaccaggcgcctggatcagccccaatcttccagcgccgcctggtaccccctggcctcccaccgcaagggctcgccgccccatctcctgcacctgtgggagttgaggtacatgcccacgtccttggcatgctggcgcaggagccgcaggtaggtgcgggagccggtccatcccaccagcgccatggcaaactcctccgacggggccaggatgatgtccagtctccggaccttgcccgcagctnnnnnnnnnntgccatggcaaattcctctggcggggccaggataatgtccagtctccggaccttgcccgcagctgtgcgacgcacgccatagatgtggtcaaacctggggaggggccagcggtcgcatgcacaaaatgtccagtctgggtaggggcaacatcgccgggcgcagggtccctgccgcccgcataccctgccctgcgccagcatgcatacctgtccaggctctggacgccaggcgcggccgaatcctccagctccaagtccttccgcatgcgctcgaggtgcgagggcatcagcccctcctgcgcttgcaagggaggggaggttgtgaacggcagcgcatgccccaatcacagccgttgccagtgatgagtaagaacaggctgccgtgaagtttcacgtgagttgcatgattcgattgccagaccagctcgccaccctcccctccctcttgccaacacaatggacagcagctgaccgctttctaacctgtaccaggcacatggcctctgagggtgagaacatgtacccgcttgccaccaaattatctagcaggccctgcactgcatggtctacacccnnnnnnnnnnagtacccgcttgccaccagatcatccagcaggccctgcactgcatggtctacaccccttgtcttatgcgtgacaagaaggtctgcagccagatgccatgcaaggggggtaggaagagaagagggcctggtttggatgctgagctcagaaggatgaaacaacgtgtcgtgaagaagcatgaagaagcaaagggcccagagcggtcagacaccagcaccatgcagcgcatccagccgcgtatgccaacaccagcagcccgagtgctcaggcactgcccgccgacagcaccacatgtcccacctgtgtcgtgcgccgcaccccctcgagcctcgccgcccacaacctccaccgtccatccgtccacgccactcgacctggtcagggattcctgcacccgagacaccgcctctgccacctcctcagcacctgctcgggggagtgagtcatcatcctcagccctgaccatcgctgcaaatggtacaggcatccaagcttgtgctcacaaagcagacaagannnnnnnnnnagcacccgagacaccgcctctgccacatcctcagcacctgctcgagggagtgcgtcgtcatactcagccctgacaatcgctgcaaatggtacagacgtccaagcttgtgctcacaaagcagacaagacacttcactcaactggtgccctggagcaggtctgccctgtgcttcagggaaaagtgctgggccacactcagagctcccttcctgccctgcgacaacaaaccgccctctgccacagcagcatccaggtcctcgtaactcctacatcatcaggactgtcggactcaagtccctgctgtttgtctgcctgcacagcaacaccacactgagcccatcaccagctcaaccccggccgctcttcttgagcaaccagctggcatatacactaaatgtgccccaaaacccgaaccaccttgcctcacctcagccccagatcnnnnnnnnnnatcttgagcaaccagctggcatatacactgaatgtgacccaaaacccaaaccaccttgcctcacctcagccccagatcccaccaatgcttggcggtcctttggccgacaccaggcagggcatggaatgcagcccgggtggcacctcctgcggggttgaaggcattgcgtctggttgactcagctcctggagacaggcattccatctgcctttgtggagtgggatgcagtatgccacaatccccttggtagcgcagtacctatagtgtcaggccgtggggttccccgcgagtccttgactaccaagttggccctgttagaatgatgtgcagcatggtgtgttgggcaggtagggggaagtccatgttgcagagttcactgcagcctgctgaccaatgacggtagggcgcaactggaccatgccagctgcctgtcaatggtagtatgagaatccgcaaccccacaggatgcagcacgagtacagattcacacgcgccttcacctgaacttgaccagggcgtcgcatgttcccgtccggatgatgtcagagatctgctcagccgttgctggtcccacaaacgggagctgtccaggcctgaccctgccctccaacttgtaggaacacccctgcaccgccgtggctgccttggcataccgtactatctgcgttgtcatgatgaatctgtggcattgacagcttctcgccgacaaggctgcctgctcaacccacgcctcacccatgcgagcccgcacacaatggcagcacatccctcactcgatggttgatgacgagttcgcnnnnnnnnnntgagtacagagtcaaacgcgccttcacctgaacttgaccagggcatcgcatgttcccgtccggatgatgtcagagnnnnnnnnnngctgtggcattgacagcttctggccgacaaggctgccggcgcaacccccgcatcgtccatccgagcccgcacacaatggcagcacacccctcactcgatggttgatgacgagttcgccgtgctcggtgaagtagtcgtcttgaatgcctccctgggaggtccatgcgagaagacagagaatgaccccaggcaaagctgcacatgtgggcaaccccaacggtgcatttctggcagaaggtgctcacgcactcctcccacgtccatacctcgtagcccgcaagctctcgcagcgccnnnnnnnnnnggtctttctggcaaaaggtgttcacgcactcctcccacgtccacacctcgtagcccgcaagctctcgcagcgcctgcacgatcgcttcgttgccaatgccccggcagcgagccgtgttgtacacaccctgcgaggagtaggcgaaacataatgaggggcggcacattggtccagcatcacgacgcacgcctatggcatgctaaaatgatgccatgtgcacgcccacatcttgctgcaccacagtcatttcaacttgcagatgcaagtgccaaatctgtgtcgcactccacacccatttttcccctgggccctgcccctacctgcagcatgaattcgttgagtgtcatatcggcgcattctgctcgccacagcgcaggacccagccaagtcctcctgtaccgagtgccccgagcctctgccttcatttcaggcatctgtccatgccgtgcagcctctgcattcgagctgtggttacctgtgtagcggaagcacatcatggannnnnnnnnncgcagcctctgtaatcgagccgtcgttacctgtgtagcggaagcacatcatggagctcactctcggccgcagcatgaactggagcggcagtgggacagactcccgagagaggcagagtgctctccaaaatacccaccagctctgtacccaaggcagtgagcagcctacctaccctcatgaaaatttgggaggaacctggcctcacatacacggnnnnnnnnnnaaaggcagtgagcagcctaccctcatgaatctttgggaggaacctggcctcacatacacggcgaccctgcaggaggcaggtctccagccatgcgggtgtcacggccgtcaccccaggccgctgctgcagcaggagcttggtgtcggtgcctggcgcgccctcttgaagggcatgcgtgatgcctgggtcctgagcatgctgagtcaccctccctccaaggcgctccatgccagccctccatgccttgagcttggtgctgacaaaacggatgcccgatcgtggaatgtacccctgccgcagcggcaggcgccggaaaggatgggtgattcatggctgcatgtgctgtattgctccgtggaatgcatgtcaccaccccccgacacccacatgggttccatcaaggggttgcccagcttccgccttccgtttttgcccggagaaactcattatagatcattgctttgacaccattggacacatgcattcctccctctcatgctcctgactgctgtccccatcggcgggacaaggggcttcattcggggcgctgctcggaacccgtcccctataaagacggtcgaaatttccgtcaggtcaccgcgcaccaggctcctcaccaggcaccgtgccgacagcggtcgagataccatgaaggagacggtcatccgggtggaggatcagccgctgccgcggcccgtggacgatgggtccctagagtgggcgcccggagtgggggtgggcttgcccgaccgcgttcgagacggtgagccggggtgtgggaccggcacgcgtccgcagatcggtctggatgctcctcacagccgacactccgactccaaccgccccacgtcccagcctctgtgtccgtcagcgcggccctcatcgccacagccgtgaggaatggcgcggcgggcgccatggtggccaccacccgcatcctgctggccttcaacgccctggccttctcccggcaggtggtggtggccatggtgaaccgcggcagcgccgccgaggcgggccagctctgctgcgtggccgtggaggggggcaactccgacatcgtggtccgcctgtccatcgagctcctggtctccggcttcacccgggaggccgccgcggtcgcggccgccttctacgccgcggcgcgcatgcgctgggccagcgccgaccccgtggcgcagctgctcagccaggccattgtggcggcggtgcgcgctgagcacgctgagcaggtggccgatgtgacagaccagctggtggagggcagccagaacgagctggtgctggacatcatgcgagccatggtggcggaaggtgggtttgcactggctccggaatttaaggttgtgacgcgggaggagagattggcttttctgctgagtgtattctggctcggagtgggttaccaggcttccagggaggattgggtgtgtcgaccccagctcccagggttcatcccccttctcnnnnnnnnnntggagtaacaggttgtgatgcgggaggagagatcggcttttccgctaccgcgtatgctggctcggggtgggttaccaggcctccagggaggatcgggtgtggcgcccccagctcccagggttcatcccccttctctccctcctgcgcgacctgcacaggccacgggcaggaggccggggagatctcggtggctgccctgaagctgggcaaggcggacgtgctgtcccagatcacccacgagctgggcggggcgggggaggtgggcgtcctcaccagcgtgggcgtgaatgcggcggtggctggggcgaaggccgccgccgatagcctcatggaggccacgacgcacctggcaggctgccagccgtgcgccgggggggcnnnnnnnnnngatgcggcggctgtgcccctctcacacccacccctctaacggacctgcccatgcctgggcgggggagctgacccttgtgcatgggtcaccaacgctgcctatgctggctgacccaacagcctaccatgccgtgacatgattgtacaggtcttcaattttatcaatataatggcttttttgtgaacatgattttgtgtggcggtggccgaggtgaannnnnnnnnngtgcgctgcggagcccgcgcagaaggcgctgccccccgcaacgacttcagaccgcgaggcggagtggatgaatgcgnnnnnnnnnnatgcgctgcggagcccgcgctgaaggcgctgcctcccgcaccaacgtcagaccgcgaggcggagtggatgaatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatataatcgcgttttttcttggtgaagatgattttgtgtggcggtggccgaggtgaataaatgtccggatgccgacaaaaatgtgatctatagctgcgatcatcccgcagatagatcgtcgtcccgcactcccacacagaaattctcatgggtgagcagcgctccttcggggccgcgatggccacgtctacgtccgagctcgcccgaggggcccatcaaagacatggcctggcctcacctatgcacacagcatacgactccggcgagctgtcccaccccggcagcgagagggagcgggactacgaggctggcctcgcccgcgaaatccaattgcaggatcttagtctggacccaggtttcgatgccaatgcgacctccattgaaggagccagagatgcaccgtgagtccagtgtgatgggggccatgggtgtgactgtcccacaaagaggtggagcatcttgaacagcacagtccctattccgtcgannnnnnnnnngaggagccagagatgcaccgtgaggccagtgtgatgggggccatgtgtgtgactgtcccacaaagaggtggagcgtcttgaacagcacagtccctattccgtcgatggggtcgccttctggaaatcataaactcattaccctcacctctgcagggcgggcaagagcccagcaccgtcagaaaacggcaaagggcttccccctggaagctggtcggagtacttcagggggctgccatacaagcttcgaggttagcaaggaggtttggtcgggacatggcgagttgatgccctgcactccagcctcctcctcttggggagatgttgttgctattgaatccaggaatccttgtnnnnnnnnnngttggtcgggacgtgacgagttgacgccctgcactccagcctcctcttggggagacgttgttgctattgaatccaggaatccttgtcctggcctgatggattgcatccgccgccgccaagtcgctgctggtagcatccaggaccgcgactgctggccctctgttcacacaaacatcccccccctgcaggcggcctggacacggcnnnnnnnnnnggatgtgcgttgttttgtgggtagaaaagggggcatgccagttccacgccgatggattgcctgctcgccggggttgcctgggtggagatcggtgtgcggctgcaggccctgcatggcctccagccaatgtggcctgcttcggcgcggcggctgccacaggctctggccccctcgtgagccagtccgaccctgcagccttccgttctttcctccccttcacaccgcagtttgnnnnnnnnnntgccgctgccaagtcgctgctggtgggatccaggaccgcgactgctgtccctttgttcacacgaacattcccccccctgcaggcggcctggacacggcgcttcccatcccagatgtccacgaactgttctggtccttcgtgggggcctttgtctccatcatggccatctccctgctcaaccattttgcaggggtggaggagcagatcgtgtacctggtgggcagcttcggagcgagcgccgtgctcctctttgccgtgacggagagcaagctggcccagccgcggaacgtgaggaagatgtgcgctgttgttgtgggtaggaaagggggcatgccagttccacgccgagggattgcctgctcgccggggttgcttgggtgggaatgggtgtgcggctgcaggccctgcatgacctccagccattgtgggcctatgtcggcgcggcggctgccacaggctccggccccctcgtgagccagaccggccctgcagccttctgttctttcctccccttcacaccgcagtttgtgggcggccaaatcttgggcgcgctggtggggcttggcatccgccatgcgatccatgtgccctgggtggcctcccccctggccatggccctgtccctgaccggcatgcagctcacctccaccacccacccgccaggtgggtgggagtgccacagggatgggtaggagccttgcatggactcaggcattgcgtgatgggtgggtgactgcgcagcccgaggcaagagcggtgcaggcggagagtgggttggggcacaccctggccatcacacccctgccaagctcccttactcccctggaactcagaggagtcttctgcccagtctgcatctctgccagcccaggcgcacccctccctgcctcacatcatttcaggcggagcaaccgccctcatcatagcagcctcggcctccatccccaagtgggcaggcttcagctannnnnnnnnntcatgcagctcacctccaccacccacccaccaggtgggtgcgagtgccactgggatgggtaggagccttgccaggactcaggcattgtgtgaggggtgggtacatgtgcagcccgaggcaagagcggtgcaggcggggagtgggtcagggcacacccaggtcatcacacccgtgccaagctcccttactcctttggaactccgaggagtcttctgcccagtctgcacctctgccagctcaggcgcgcccctccctccctcacatcattttaggcggagcaaccgctctcatcatcgcagcctcggactccatccccaagtgggcaggcttcagctatgtggtgggcgtggctggtggctgcgccatcatgctgaccgtggctctgattacaaacaacctggcgccgaggaggcggtacccgaccttctggtggtgaacggcgtggcacccgcacccagcgcgcacctgccggaaggccgtcggcagggacatactggatcgtgacagcgttagtgagcggtgtaacaagtgtgagggatgcatggagggcacggcaggggagcagacaagctgtacttgtgatggcctggggctcgagaggtttaccaagcaggatgtggctgttcgaggggccgactgcctgtgcgnnnnnnnnnnagtcggcagggacctactggatcgtgacagcgtcagtgagcgatgtaacaagtgtgagggatgcatggagggcacagcaggggagcagacgagctgtacttgtgatggcctggggctcgaggggtttgccaagcaggatctggctgttcgaggggccgactgcctgtgcgcccaatccgtcactgcctcgtcaggagggccagggccagggaggatgctgccagggatgctcccaggacctgaagagtgatgcgcaggcggcgaagcaccggccgcacctcatacctggcggagaggaaggagggaaggggatgatagagtgggggttcagggtggcctgtgatgctgtttgaggctcctttggacttcccatacttcaccagcccctgtacagtcccgccgacaggctcggaccccaatcaccctcacgtacatgcccagcagccggtctctggcaagcacctctggcggcttcacaaagatctggccatcatacctgcaggggcagcggcggagcagggtggcttggagtggaaatggcggggacgatggctcgtgcaggcattgaatcactccaggttctgcctccacctcgcggcacgccttcccaacccatttcccacccgacccaccagccagactcctcatagtccacagaggccgacaggaggcggtcgcacacatacctgtagtatatcagcacggaggaaggactgagttgcagcgcttgcagcactcatgactgcctaatgggcctccaggttcagagacagagcctgcgcacgcagctgtgactaggcttccagcttccatgccgacacccgcgcgactcacttccatgtgatgtacagccggaagctcacgactgccacgacgagggtagctccaatggatgcgctcagagcaaactccaatggctgggtacggaagggtattgagggaattggtgcagggcgcatatcacggcagcctagcacctctgtgcagcacagggtgggccaagcactcatcccaaacccacctgcaccccgggatcaaacgtctgggcggcgattggtgcggcaagcaggccaaggagggaggcatacaacagcagaaatcgctgctggtaggcgcggccatctagggtggcctggttgtagagtgtgcaggggggaggggcagcttattgtggctgcaatacaaccacctaatgccatggacacctgggacagcaaacgcccgacatgggtgcaggttgcaaccccacctcacccaggtcaggagtggagaatccttcagctccttcagctggttgacgggtctctgctccctcggaacgggggtctctagccgggagtcgggacccatgggcgggccaggtgaaacatcgtccctacgagcccaagcgcgacctagccttgtcggtgccgtagatctgaacactcgatagtcatttatgtgtgaccacccacttcctgacggggagtgaggcgagacactgcgagatgccagagtgcagccgaggctgcagcgacactccatgcgcacaatggtcgagtggcttgcgaagggcatcgcgctacattgggcctgtggagacaagcctgtcatgacatgcagacatcaaactctgtatcgtggtgctccgagagcgtcaggggatgtccatcatcaggagatcgcgcgtggggcgatcttgaggctagtgagctccgtcgtcaatctagcgacagcgggcaggccactggtcgccgtatcagcgatgcagtcccttttccaatagcatgatgtattattgaatctgaaagacactctcacggagggtagtcggctcacatgttggaggcctctcgcattgccggccgccacttggagtcagagaaatgggagccgaggggcttggagggggcaatgccggatgtcgaaggattctaccctgaacaccgcctcgacctcaagatgttctcatccaaggagtcgagagggggatagattggctgccggcggtcaataaacgtgctgctgcaccacccctaagcctgagatggggcccagggatgaagatttaatgttggacnnnnnnnnnncggggcaatgccggatgtaacatggttctaccctgaaggcagcctcgacctcaagatgatatcatccaagaagtcgagagggggatagatgggctgccggtggccaatgaacgtgctgctgcaccaaccctaagcctgagatgggcccagggatgaagatttaatgttggactgagcggagcgctctgcacccagcgccgtccaactatggcgttaatgaacgtcttctactcgtatgcccagggccatgcttttggcccatcagttatctcaagtggggtgttcacagtgtactcatctactgtgccgttaatcttgtgcatgcattgcggcaacaaaggtgtacatgatgcaaggagcatggtgggagcagatcaggcaggtgagggtggtgggggcgcgtttgtgaagaacagcgcaaagccgggcaggtactgcgtgactccgtctgggtcagtgtaccggggaaggacagagtgtggcgtgctgctcaccgtctccgtttgcgtggtgaggaatccctggggttcaaagggtggaccgagcaccgaccgggcctcgtcatagtaccagtcgagcctgaagatgcccacatcgggttggtagggcccactgatcactacctggcaggagcaggtcgtgtccgaggtgaaggtgcacgtccccgacacgacgccaagcgggggtgggggaaagggcggcagcggcggcggcggcggcggcggtggggaagggggggagg

SEQ ID NO: 26762 - DNA, 182 bp, Chlorella protothecoides
ccgcgaggtggaggcagaacctggagtgatccattgcctgcacgagccatcatcccccgccattcccactccgggacaccctgctccgccgctgcccccgcaggtacgatggccagatcttcgtgaagccgccagaggtgcttgccagagaccggctgctgggcatgtacgtgagggtgatt

SEQ ID NO: 26763 - DNA, 89 bp, Chlorella protothecoides
ggggcgtgggctggcgcggggctgaggggcgaggaggcgtgacgcctggggtcgccgcgggcttgcgctctgggctcgtgcgtttaaag

SEQ ID NO: 26764 - DNA, 159 bp, Chlorella protothecoides
catcgtgaaatgtggtttcaatgggtagatagggccgacgcggggctggacacgctgaacctagggcgagtttttttggggggggagagtgggggggcagccgggggtatgcagaatgattgtatgggacattgcggtctgtgcctctgcaaagaactt

SEQ ID NO: 26765 - DNA, 71 bp, Chlorella protothecoides
ccacctccgccgacggagtctccaccacctccgccaatgatgtccccaccacctccaccaaagaagtcccc

SEQ ID NO: 26766 - DNA, 69 bp, Chlorella protothecoides
gggaatagggcattaccagaagtgacacacaccttttttgtttttatagaaaaagtattaatttgggtc

SEQ ID NO: 26767 - DNA, 61 bp, Chlorella protothecoides
gccgaggcgcatgccccggcactgagccacgccagtgcggggatcacttgcggcactcggg

SEQ ID NO: 26768 - DNA, 78 bp, Chlorella protothecoides
ggcccccagctcccccgccaatcccgtttttgactggaggacgagggcctgctcctcagcgggggtgaggaccaaggc

SEQ ID NO: 26769 - DNA, 183 bp, Chlorella protothecoides
ggaaccgcttcccccgattgcaagggcagatcagcaacctcagggcaccacgaagcatattgtgtgaggtaactacttcagacttaacatcggagcccgctgcataccaggaaacaagtgggcagcagccagtaggccggggctctacttcgaaggacgagtgatgtttgcggtcgcttccgc

SEQ ID NO: 26770 - DNA, 61 bp, Chlorella protothecoides
cctagacaaggccgaggttgccgaagccggtgccgcaaaaagcagacatgccaccatgagg

SEQ ID NO: 26771 - DNA, 61 bp, Chlorella protothecoides
taatgccgcgtgcaaggctgagcagctgcctctgcgctgcgcgctgcacagccccaccttg

SEQ ID NO: 26772 - DNA, 61 bp, Chlorella protothecoides
ttcccccagcccatgctggcgagcactccatcctgccaacaccacctttactcagtgtcga

SEQ ID NO: 26773 - DNA, 79 bp, Chlorella protothecoides
ctcgccggcaggggcggttttcagggcaaaatccccgacccgggaggccagctgcaggacgggtgcgccggaggcaaag

SEQ ID NO: 26774 - DNA, 65 bp, Chlorella protothecoides
aacctgccagtctctgagcgacgggcaagctctcgtcgttcgcattccaaagacgaagagtcacc

SEQ ID NO: 26775 - DNA, 78 bp, Chlorella protothecoides
cgatgagtattggatgggaatttaggaagctgtagcggtttttggcgctttatcttggacatccacgcgtttgggcag

SEQ ID NO: 26776 - DNA, 81 bp, Chlorella protothecoides
ctgagacaggagcccagcacggtcgagatccactttctggatgcgccgcataccggcaggcgagtgaaccccgagcttgac

SEQ ID NO: 26777 - DNA, 78 bp, Chlorella protothecoides
ctaccacaagtgtgcctgtctgttctggatccgtgcgcgcgcacgaggctgttcccccggctcctgggatgcatccat

SEQ ID NO: 26778 - DNA, 437 bp, Chlorella protothecoides
  modified_base (85)..(261): a, c, t, g, unknown or other
tccacatgaccggctcccgatcctgtgccgaccaggtgcaggcgccgacggtgttagtcttgccgtgaggtcaacgggactgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcaaccgggcattttggaggatgcagcaccggaaactctgccgatcgaataaattgattgtcaaataaatgcggcctgtcgcctactctaggaagtgacggtgctgcccaaggttctgcggctgggggttgctgtactgactcgcgagcgaggtgcgtgctgccacggagtgc

SEQ ID NO: 26779 - DNA, 61 bp, Chlorella protothecoides
ggtgaccatccgcaacctgaagcgggtggatgaggaggcgctggacctggacctggcggaa

SEQ ID NO: 26780 - DNA, 69 bp, Chlorella protothecoides
acccgatccatgcgaaagtaaaacactttcaagaccttaaaatgcttgctcgggttgcgaggcctcttc

SEQ ID NO: 26781 - DNA, 67 bp, Chlorella protothecoides
cgcccgggcaccagaccctcccactgacaaccacgcacgcccgccccgcacctgtatctgttcgtgg

SEQ ID NO: 26782 - DNA, 104 bp, Chlorella protothecoides
cagccagaacacgtggagctccagctgctgaggctctccacctggggtcgggatggaaggatagggagcctttgccatattgatcttgccaagtctcgtcggag

SEQ ID NO: 26783 - DNA, 104 bp, Chlorella protothecoides
gttggaaggaaggcgctggttttgtctctgctgccaggcaggatgtacacctagcaacaccccctggaagaagctgactgtttgctgtctggactctcagcatc

SEQ ID NO: 26784 - DNA, 61 bp, Chlorella protothecoides
tggccacaggtcggtcacatcaccaacatgaggtgagacagaggacacaaacctcccgccc

SEQ ID NO: 26785 - DNA, 70 bp, Chlorella protothecoides
gacacttagggcatggttggccatgcccaaccactaaatggaacacgcttcaagcgccaggaggatgcac

SEQ ID NO: 26786 - DNA, 192 bp, Chlorella protothecoides
tggcatgggagaggaggctcgcgttgcccgcccaggacctggctggcaggttgcgtgcttggacggcagcatcgactccaggtatctttcatgctccctggcattcctggatcttcaccacagaaaccaagcatccaatcagacctccctggacaccccacaccaggctgcccacctgcgagtcggtgaccc

SEQ ID NO: 26787 - DNA, 76 bp, Chlorella protothecoides
gcgcaagaagctggcggcctctgctgcgccggcattataaaaatctaggccatcctcaatcagagctgcttctgag

SEQ ID NO: 26788 - DNA, 153 bp, Chlorella protothecoides
gggccggcgatgagaacatcattctgtattcgtgtctcaagcaatcacatcctggtggcaaaacctgaggaatcaatggcccatgtggtcacagatatcattattcctgcagctccttacaaccatcagcggcaaggcaagtctgcttgcaca

SEQ ID NO: 26789 - DNA, 65 bp, Chlorella protothecoides
atggcgtcggcagtggccttggacacctcggcggacagcttgaccccggcgatcttgctggccag

SEQ ID NO: 26790 - DNA, 75 bp, Chlorella protothecoides
aggatggaggtcacgcgcgcctccgtctcgtacgccgcgtgcgagccgcgcagcgcgttgcgcaggccgtagatg

SEQ ID NO: 26791 - DNA, 632 bp, Chlorella protothecoides
  modified_base (475)..(484): a, c, t, g, unknown or other
gcgcgcagcgcggcggccgcgacgggggcctccgcggcctcgcgcgcgcggcgctccgcgccctcgcccagcgcgcgcagctccgccagcttggccacgtacacgccgcggctctcctcctccccctcctcgtacagccagttctcggcgtcctccagcgccgccaggatggaggtcacgcgcgcctccgtctcgaacgccgcgtgcgaaccgcgcagcgcgttgcgcaggccgtagatgtaggcctccaccgcgttcttggcgtcgttggtctcctcctgcacgcgagcctgcggatgcgcggggggaggggaatggggtgggaatgggtgagctgtgtgtgcctggatgcacacactggagaagagagcaactgactggactgtggaggagaggctggggtgtgcctggctccaagacaattccacacagagtccatgcgcagggggatcggaacaacaggcgcgctccgcannnnnnnnnnctccacagagagtccatgcacaggggggatcggaacaacaggcgcgctccgcaggtctgatcctgaggcccacgactcccgatccacaggtcctcctccgattccctggacacctcctccccgtgattcacccccctcccccgtcatt

SEQ ID NO: 26792 - DNA, 77 bp, Chlorella protothecoides
gcgaggcggacgacgtctggagctggctgggacggggacgggagggtccattggcatggtgggacggatgcgccctg

SEQ ID NO: 26793 - DNA, 104 bp, Chlorella protothecoides
cggagatttgactggtgatgtggcgcacattaatagcaaggccttcacaacccctcgcaaacattcggcgctgcatctgctctgctcggtccctactcctccat

SEQ ID NO: 26794 - DNA, 138 bp, Chlorella protothecoides
cgatcacacccggctggcatgagaggcagccaggctcaaacgcagcaagcagaggcgccccatctctttccaccagatcgaccgagtcaatatctaccaccgaactccctcacaactcgcccgcccctccccacgagc

SEQ ID NO: 26795 - DNA, 61 bp, Chlorella protothecoides
gcattcttggagacgcaggctcgggaggggaatgctgtggtcaaggggatcgtgctgctct

SEQ ID NO: 26796 - DNA, 159 bp, Chlorella protothecoides
gcgcggcgcaggcgcacattctcgcgcaccatgccggccacgttggccaccgcgttctcgaggctggcgagggtgatcgggagttgcgacgggtagattcggatcgaacggaatttgaggagggggtggccaacagcagcacatgggggtgacgcgcca

SEQ ID NO: 26797 - DNA, 64 bp, Chlorella protothecoides
aggagggctttgcggtcagcaaggaggatggacgctgccatgggtgagcgacggctgggcaggc

SEQ ID NO: 26798 - DNA, 75 bp, Chlorella protothecoides
ttgatactgagggttgtgactcgcacatcaaacttgtaacacaatggcacttcagatgcaatgcaggctgcctcc

SEQ ID NO: 26799 - DNA, 122 bp, Chlorella protothecoides
gctgccagcaaaccgaggggacttcccacggcttgctggcaccctcccgccctggatgaggtgcatgcttgttcgtgccaccctgtcacacggcgtgccagcatggtcacttggctggcggg

SEQ ID NO: 26800 - DNA, 61 bp, Chlorella protothecoides
tcccctcgtctgtatggtgtgccaggggggttggtggggttgatgcacattccctgcctgg

SEQ ID NO: 26801 - DNA, 145 bp, Chlorella protothecoides
ggcttgccatagtgaccgcagcctggcctgtgccacaatgggcacaggggaaaacacgtggggaacctgtgggccctgcaagtttccgatcccattcctcctgctccgcgctttgctcaccctgtccccgctccccgtgctccgc

SEQ ID NO: 26802 - DNA, 217 bp, Chlorella protothecoides
accagttcccgaatccaataaggaggtcatcctggatccgagtacagaactggtcgcagatctccccgatggcgcgctctgacatcaggtgtcggcaaaggcgcagcctgcagaaaggcctgtcatggtagaaggtcatgagctgttggagcaatggcatgactgccaccacataggcctggaggcggtcgatgccggcagtctttttggttggagg

SEQ ID NO: 26803 - DNA, 79 bp, Chlorella protothecoides
tgtgcggcccaccggcgagggcacccctggcggcaatctctcggtattttgccggagacttcctgctgtcgtgctgcaa

SEQ ID NO: 26804 - DNA, 91 bp, Chlorella protothecoides
taagcgatgtcgatcagcacgatgttgagcgtctggaagacagacacgccgtaagcgtacttaatcccctgcacaatcatgaagcaaagat

SEQ ID NO: 26805 - DNA, 61 bp, Chlorella protothecoides
accttgcctaattaccccgcggccgaactccccctggtatccatcccctgctagtaggtgg

SEQ ID NO: 26806 - DNA, 84 bp, Chlorella protothecoides
ccatgcttggctgcagagcggtaaggattagggcgccgggattggcagggggtttggaagggcaatacggaatcgagggtgacc

SEQ ID NO: 26807 - DNA, 406 bp, Chlorella protothecoides
  modified_base (138)..(340): a, c, t, g, unknown or other
tcccggcgtactggttcgattcacatcctcttttaaagcgcccctcccgactctcactccccccatgcactcgttgccacgccaagccccggaacccacccaggacgtcgttgtagccataggcggtggcggcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcacagaggtcactccgcacacccgagaggaacacagagtagcccagctccaggaagtggctc

SEQ ID NO: 26808 - DNA, 61 bp, Chlorella protothecoides
gattgtgataaacctgaagcaaaaaaggcttcttgggcttgaagggctcggtttaccctga

SEQ ID NO: 26809 - DNA, 61 bp, Chlorella protothecoides
ctcgcccctggcctcgtgtgtctgctgctcacccccgccctcatgtacgtcctgtaccctc

SEQ ID NO: 26810 - DNA, 781 bp, Chlorella protothecoides
atgaagcgtggaatgggagtgatgcatcgagtgccacgggtcacccacacctcccacacaacacaaaaatggcatcgagcacgaccctggttcaataggatgtgatacacgagcctttcagagaagaggacggcaactatcagttgggaggtgtctggcatgcaccagcttgtcaggaggataccttccatcgtgacttcacatgattcagccggcggcgttctacattagctcacaatcaacgtggatctggatccgctccactaaagtcgatctgtgcataactcaatgggaaatgtcagcttcaatgaggctcttgttagcgtacaatgctggtggtcgcccactccaagtagggagtggcgaaccctgttgcctctccctgcaccacctgtttaggggtactatgaccgggccctattctcctctacgcctggacccgtgcactgcgccgaacccacgccacgcgtctcagaccacgaaacccaacgcccacactggagtttgggacttggatgtggtaagtctaccttggaccaaccaaatcagttcatgttgccgggaccagccaaaccccacgatactgcacccaaccccctgctggcacggcgctggcacgcgcattaccttcatatggcatggaaattgagaatgtgatgcctctgggcagggtaaggaagccatgcaatgataggaacagactacctccccacgactgtagcgcggacgcgtatcgttgctcttgcacggatgacgacctctcctgccaccagctgttcag

SEQ ID NO: 26811 - DNA, 134 bp, Chlorella protothecoides
agggtgaggtatccaaagggattggtgagatgtgaagcaccaacaccaccaactgcactatttttgttggaagctgaaagaaacaaaggacacaggtcccgcggtccaacctctgtcaggaagtcggagtcatc

SEQ ID NO: 26812 - DNA, 61 bp, Chlorella protothecoides
caacatacggcggctcatcactagtgggtggacaccatgtcggagccgatcctggatgtgg

SEQ ID NO: 26813 - DNA, 100 bp, Chlorella protothecoides
ggagatgcggaagcacccagagggtgtgcaggccctgcgtgcagagcaggcaggctggtcgagggggaacctcctgtgtaggtgaatgtgcatgtgtacg

SEQ ID NO: 26814 - DNA, 80 bp, Chlorella protothecoides
gcgccgcaagaagcgtatccaaggcccaggtggagtcccccgcctgaataccccccggtcctgggccgaccagttgccca

SEQ ID NO: 26815 - DNA, 73 bp, Chlorella protothecoides
gtggaacaaaggcaaagaatgtacctccaatgcgcagtcatgtcccactgaagccttgcacgaatcactcaag

SEQ ID NO: 26816 - DNA, 73 bp, Chlorella protothecoides
caagcatgaccatgctcatggccatcacgaccatggtgccaagcacgaccatggtgccaagcacgacgagcat

SEQ ID NO: 26817 - DNA, 112 bp, Chlorella protothecoides
tatgctgacctcagcctcgtcttaaagatgtgagtggagtgacacagaacattggtgactggggctgatggcggccaggagatgctgcgggatggctgctgcacatctacca

SEQ ID NO: 26818 - DNA, 117 bp, Chlorella protothecoides
tgtgtgccatgaacatggtcgaggtttccacccccaactaggcatgttatgtgctccccacaccagtcctgtgcgctgaccacttgccctgctcccctctgcccattgtgtacccct

SEQ ID NO: 26819 - DNA, 61 bp, Chlorella protothecoides
catgctggggcgtctggggccccaggacgtcaacgtgctcgttgtggacgacgacgacacc

SEQ ID NO: 26820 - DNA, 61 bp, Chlorella protothecoides
tcgtgatttggactttgaaggagggctcacacccgcctgttccacgtccaccgcaccactg

SEQ ID NO: 26821 - DNA, 69 bp, Chlorella protothecoides
ttttccctgagtggggcccgctggctggccgcctttgacggcctgcaaaagtgaaggggtcacacaagg

SEQ ID NO: 26822 - DNA, 130 bp, Chlorella protothecoides
aatgctcttgtcgaatgacagtgatcatcccgccttctccagggacctgagtattcgtaacacgcccctccccagtcgcaggaccgtacaacagaggccctcaccgacatgccagcatggaacgactgtg

SEQ ID NO: 26823 - DNA, 176 bp, Chlorella protothecoides
gccggcggggaacctgctggagatacagcagctggctcaactgctcgcaatgacgtcgaccatggtgcgtgggaggggacggggcacgcgtgacctgaaagccctggatgcaggagttggatccgtgggacccagcgccccgggggccgagcgacgcgatcgtcccggcgcagacc

SEQ ID NO: 26824 - DNA, 67 bp, Chlorella protothecoides
cgtagaggagagggctgctgctgccgaggaggcgctgtcggccgtagaggagagggctgctgctgcc

SEQ ID NO: 26825 - DNA, 76 bp, Chlorella protothecoides
tccacccctgcatcccctctcatcccccccccatctccaacctatccccccctcaccgtgccaaagccgtggaaga

SEQ ID NO: 26826 - DNA, 75 bp, Chlorella protothecoides
acccgtgcgccctggaaacggcaaagggcctaagaaatttatacgacgaggaggcagtgaagcctaggtacaccc

SEQ ID NO: 26827 - DNA, 61 bp, Chlorella protothecoides
tcatccatactcccaattcctcgtccctcacccatacacaaatcaaacaaatcaaacgcag

SEQ ID NO: 26828 - DNA, 78 bp, Chlorella protothecoides
tctggggcctgccgtgtgctctgcactgcagtaaccaccggattaggatgtgtgatgtttattttgtagcaacagcct

SEQ ID NO: 26829 - DNA, 65 bp, Chlorella protothecoides
gcggtgggttctcgtggttgtgcggggagggtgaggcatgaggcccgaagtgacgggggcttggc

SEQ ID NO: 26830 - DNA, 61 bp, Chlorella protothecoides
agaaaatacacaactctctccatcattgtcacccagcctctcactgggaaggaatgtgcaa

SEQ ID NO: 26831 - DNA, 64 bp, Chlorella protothecoides
gtcataattggggctggactggccggactcaacgctgctttgacccttgaggctgcaggtgggg

SEQ ID NO: 26832 - DNA, 61 bp, Chlorella protothecoides
tgctgcattcttgcaggatgcattcccaaacgatttctcccatgaagacctacgcctttcc

SEQ ID NO: 26833 - DNA, 61 bp, Chlorella protothecoides
ccctgcgccggcgcgtgacctgggaaggggtcggactgctcgacccctacacccccagctc

SEQ ID NO: 26834 - DNA, 173 bp, Chlorella protothecoides
cggactgctcgacccctacacccccagctcgatggccgcggccgcttgacgcacggggaggaacacggtatccaccctcccgctccccaccatgcgcagatcgaggacatcctggtggccgaccgccagctggccaaggagctgctgtacgacatgcgccaggccgagctggc

SEQ ID NO: 26835 - DNA, 64 bp, Chlorella protothecoides
acagggtgtgccttcccttgtgtacatggttgaagcacaccttcaggacttgaagtagagaaca

SEQ ID NO: 26836 - DNA, 78 bp, Chlorella protothecoides
gcatggggtcgccaaggctaggatagatggcctgctgaagtgtggtggatgtgcttgggccctctgcagccaagtggg

SEQ ID NO: 26837 - DNA, 61 bp, Chlorella protothecoides
ccgtcccctatcccaatgtattgatggggcaccccctgcctctccttcccaatggttgcgt

SEQ ID NO: 26838 - DNA, 61 bp, Chlorella protothecoides
ctcacacacgaagatgtcaatattagaaacactcttacgagtagccaagacagggactggc

SEQ ID NO: 26839 - DNA, 188 bp, Chlorella protothecoides
gctggccagatctcctgctgatggctgcctactctcatgaccacctttgtgtctcatggtcccatgtggcccctctccccacagacccttggccgcctctttggaggcaggaaggtgcggggacctttgttgagtcacaagagctcctggctccatatgtagggacaccaggcttcccagatgtacat

SEQ ID NO: 26840 - DNA, 141 bp, Chlorella protothecoides
gccctgggggagagaaagaggagggggcattggctctgctgcatggccaggtccaaaggtcccttgtctggcccggccatgcagcaggcctgctggattgcaaccaaccgtcacaccactgctccctgagactcgccttga

SEQ ID NO: 26841 - DNA, 63 bp, Chlorella protothecoides
aacaggctctttgaggccctggatggtgagtgccatgaatgaggcaggctcgtgagggcatgt

SEQ ID NO: 26842 - DNA, 186 bp, Chlorella protothecoides
ccttagcgcacgctcgccgcggcgcttggctgctattacccgttcccgtgcggtctcgtccagacctggatagcaaagagcattggagcggtgtccgatctttgcatccaagagacgcaaactaggagcggggagtgtcaccaacatcctcagtcaccagatcccacatcccacaaggcaccactc

SEQ ID NO: 26843 - DNA, 80 bp, Chlorella protothecoides
ggatctccaagttgcgcacacggatggctgatgtggagagccccaaagtctggagggtggaggtccgggtggaccctgcc

SEQ ID NO: 26844 - DNA, 68 bp, Chlorella protothecoides
tttccatcaccctgccgcctgtgtctgaccctgcaagggtctctgcccctctgcagtgccaacccctt

SEQ ID NO: 26845 - DNA, 13641 bp, Chlorella protothecoides
  modified_base (727)..(736): a, c, t, g, unknown or other
  modified_base (1723)..(1732): a, c, t, g, unknown or other
  modified_base (2183)..(2192): a, c, t, g, unknown or other
  modified_base (3225)..(3295): a, c, t, g, unknown or other
  modified_base (3437)..(3446): a, c, t, g, unknown or other
  modified_base (3526)..(3535): a, c, t, g, unknown or other
  modified_base (3615)..(3663): a, c, t, g, unknown or other
  modified_base (4720)..(4729): a, c, t, g, unknown or other
  modified_base (4920)..(4929): a, c, t, g, unknown or other
  modified_base (5214)..(5223): a, c, t, g, unknown or other
  modified_base (5601)..(5610): a, c, t, g, unknown or other
  modified_base (5682)..(5691): a, c, t, g, unknown or other
  modified_base (6085)..(6094): a, c, t, g, unknown or other
  modified_base (6559)..(6568): a, c, t, g, unknown or other
  modified_base (7104)..(7113): a, c, t, g, unknown or other
  modified_base (7567)..(7576): a, c, t, g, unknown or other
  modified_base (8841)..(8850): a, c, t, g, unknown or other
  modified_base (9746)..(9755): a, c, t, g, unknown or other
  modified_base (10252)..(10261): a, c, t, g, unknown or other
  modified_base (10627)..(10636): a, c, t, g, unknown or other
  modified_base (10953)..(10962): a, c, t, g, unknown or other
  modified_base (11359)..(11368): a, c, t, g, unknown or other
  modified_base (11657)..(11666): a, c, t, g, unknown or other
  modified_base (12158)..(12167): a, c, t, g, unknown or other
acttctttgcaattgtaggtttataggcttgcaagcatgtatacagccccatgtccatgcctgaacgtgtttgtgcctcccgcagtggatcgtcgttctttcccacgctttctaaaacccctcttggattggtgagctcccggcctgtgctcataagatagagtcttgaggcaaacaccgtaattaattagcccgtatccttccctatcaagaaaattaacctcctgcaaccatgtctgggcgcggcaagggcggaaagggcctgggaaagggcggtgccaagcgccacaggaaggtgttgcgcgataacatccagggcatcaccaagcccgccatccgtcgcctggcccgccgtggcggtgtcaagcgcatcagcggcctgatctacgaggagacccgcggcgtgctcaaggtgttcctggagaacgtcgtgcgcgatgccgtgacctacaccgagcacgcccgccgcaagaccgtgaccgccttcgacgtggtctacgccctcaagcgccagggccgcaccctgtacggcttcggcgcctaagaacctcgtcaccaaaacaaacctggtgttattagacatcaccaccctggaagttgaaggctaacacctggctgttacgcgtccaaagccaaattctattggcaacgtgcatggctacagtgcaacattcgctgcattacttagggggtgcatacccgccagtcctgcagaggctctcctgcnnnnnnnnnngaacaccaccaccctggaacttgaacttgaccccacctggctgttacgcgtccaaaaccacattctattggcaacgtgcatggctactgtgcaacattcgctgcattacttggggggtgcgtacccgccagtcctgcagaggctctcctgcgtggcaggccatgacgccatcaatcatcaaacctgatgtggcggccctgaggagtggcaacacccttcaactttggtgcgggctcagatccggccacaggctccacctcgtcgtcctcgtcaaacctgttgggtacaccacagaggcatgctttgggcgaccatgccatggctttaaatggtaacacagctctcgcccctcataagctaccctcccaaggcattccagccagccagcacacgtcccacctgatgtgtgttcccacaggggtggggacgccccgcagcttcgcctcgggccccagctcaagcccggcgagagcggaggtgaggtcctctgcaccagcctgctcctcctcctagaccagttttgaatggggtccagggttcaagaattgatgtcacagctctgatggcacttggttatgatcattcgacctcgcgcaatgctcgccaggcaagggagggacaccgcagcattgtatgagggcagcctgcaaactccacacttacccaggcctcctcctccccgtaggcatcgtactcctcctcctcctcctcctcctctttctcaacttcgtcctcacagtctttgggagcgtcctccttcgcctgagaagcggatgcagccaagcgggccgcgacctccttcttcagctggcgcaaggaccttgcgggggaatgcattgtgggatttggggtgagccaaggggcatgcccgagtgttctcggtggctgaaagctccggctcagctctgaaggaaggcgcatgctgcgggaaacatggtcctgccgcccccacaaccaccaccggccactcccatgtcctgcccaggnnnnnnnnnnttgaaaaatccggctcagctctgaaggaagacgcatgctgcggggaacatggtcctgccggccccacaactaccaccggccactcccatgtcctgcccaggatttcaaacctggaatcgaagccggagctggggacagacaccttggaggctacacgtgggcgcccctgcggcagcacggcatcggtgcctgccacggtcgcagccaggagcggcggggtgtcctcagcgccttcctcctcgatggtttgatcccccagctcctccacctccctggccagggcgctgttgaccgcagtggctgcctccggtgaggcagcggtcgggggctcgcgctctgccgcgccagcagccgcaccagcggcgatgaagaggattgcggggctgaggccgggcgtaccggcagcaggcgtgccggcgctggcaggcgtgccggcgttaccattgggcgnnnnnnnnnnatgcggggctgaggccaggcataccggcggcagccgtgccggcggtggcaggcgtgccggcgttaccattgggcgtgtcggcgctcgcctttgtcccgctccccagtgagctggcgagggcaggggcggcctcctcctgcccggggctggcggaaaaggcgatggcggagctgggcccaagcacggtcacaggtcggggtcccatgggtggggcagacgccggcgcggggctggctgagtccactccggggctggccgagtccacccccgggctgcacgccacggcagcagcgatggcgtcgccgaccgagattgacgcgcagggagactcggggggtgtggagaaatcgcagggagacagtgtccccactggggagaagtaggccgaggtgaagggggcgggggcgagggtgggggcagacacgactggtgttgcctctaccagggcatcatcactgccacctaggacctgaggagcgtgtcgtgcagggagagaggcacgctgatgtgggagagattgaagagcaggctcatgtggaaccacatcttgggaatacacctcccccatgaccacagctgtcgcacagatgggcaggttgcacagaaaggcagtggcaaaattcttcttttaccagtataccctgcctaagatggtggcccacctttgcagctgccttcagggccgattctacccctgggagggtgccactcgggagcagaccatgggcaggggtgggctgcggggtacgtccctggtgctctgtgggggcctgaggcaccccaggggtcacaggggggagggaggacaggccaagcccagtgggcgtgggaccgacctcgggcaccgtcttctcggtgacgctgggggtcttggtctcccatccttcctcctgcaagggaaattctggattgggttgcggtggtagggctcatatgtatgattcgcgacaggtggcagcaacgagcagtatgacatctaatcacgccatgcaccacctgtatctcggtgttcgtgatgtcgaacaggacagcnnnnnnnnnnnnnnnnnnnnnnnnnnnnnnnnnnnnnnnnnnnnnnnnnnnnnnnnnnnnnnnnnnnnnnngcgaagcccgctgcatgatggatccatcaacgagataatctagatcttactgttcagatactggtatggaatggtttcggcaatcaaggcaacttccccgcaggatatcctacaccggacccactcacgggtctggccattnnnnnnnnnncggggggcagtcggtgacgccgcggcgggtcgtcttgcggcccgtgcgcgtcgtggcaggggcatcggtgggaagcgccnnnnnnnnnngggggggcagtcggtgacgctgcggcgggtcgccttgcggcccgtgcgagtcgtggcaggggcatcggtgggaagcgccnnnnnnnnnnnnnnnnnnnnnnnnnnnnnnnnnnnnnnnnnnnnnnnnncggagtggtttcggcaatcaaggcaacttcccagcaggatatcccacaccggacccactcacgggtctggccattctgtgtggcgatcctcgccctactgcgcgtcactctactctcgctgtacatggtgaagcaggatgcgttgctggaaaagatttgactgtgaatgtgaattgagacaacagccggcggggggcatttttgaacatttgtaccgccttcgggtgatcatggatgtcccgcagcaggcgctgcatgcgcgggccgatctcaaacatcgacagagtagcacaggtgccgggtgcagcttcagcgtcgtgggacgacctagaatccaccgagaacgctcgccaaaaggttgcattaatcaatccagggcgttaatgcccaagcgctggccatgctcgcccgcgtgatcgagctgcatcaagttgatgcgggctgggagatggtccacctgggcctccaagaagttggcactcacaaagcaccccttggccccatcaccccctttcatgagatcatgaatcgagtcagggaagcaacgttaggcacaggtactggcatgggctgctgccatgctccgtgcatatattgcatctcaaggcaaggacagtgcaggccaggggtaagagagcacacgccaatgctctcaggccttccactcgcagtgtcggcctgcgaggagcccagccccatgtgtaccctgctgcctcttcctgaagccgcgctggagtgtctggcttcgtgtgaccccgagggcctacacgtcgggcaagaggaggagaagacgccggtgcacaatcgaggcctccgatccatcttcctccagcccgagagcagcaggcccaccgacgagtcgaaggctgacgccccacgagtggacctgatgtcagaggactctgctgcgagggacgatcctgcggacctatcagaccccctccccaaatcactgccggcggaagccgagggaggtctctgtctattcgaatttcctgcaccagtggaaaatattgcagtctgttcaggtgggacgggtttgagtggcaagtcattnnnnnnnnnngttcgaattccctgcaccagtggaagatattgcagtctgtttaggtgggacgggtttgagtggcaagtcattgcgttcccaccaacgtcgcgcagtacttcacttagcgtgtggctggtgcccttgattgggcctcaagtccctgcacagacaggagagtgtcgcatcaacctgcgctgtcatcaccctcnnnnnnnnnntactgggcgtgtggctggtgcccttgatggggcctcaagtccctgcacagacaggagacagtcgcatcaacctgcgctgtcatcaccctcagctcttcgctccccattcagggcacagccccagctctggcggacatggctttgagtatgacgttttcacccaggcgaccctcaccccaggaccgcacgcctgggcaggtgggttgaggccgcacgctctcaggaacatgctttgctacagcttttccggaggaacctgtcagggtcttcgggatcacgcaaagnnnnnnnnnngtctccgctccccattcagggcacagccccagctccggcgcacatggctttgagtatgacgttttctcacaggcggccctcaccccgggaccgcacgcctgggcaggtgggttggggccgcacgctctcagggacatgctttgccatagctaatccggagggacctgtcagggtcttcgggatcacgcaaaggggtagcatcgggccaacgttcagcagagcttcgacagcattgcagcttcatccctctctgcgattccccatctgcagctgggacgctggctgacagcgaatgccttgcagaggagccgagcagaggagcggcaccgcccctggccgtcgctgtcccagctcccccctcctggcatgcccagcacnnnnnnnnnncaggcacgcttggcgtcccggccggaggaggcaccacccgcgccaggccggcgtcaacacgcgcgagtcccnnnnnnnnnnaggcttgaggcgccagcagcgcaccaagccgcacacggagacagcgccctgccagcggtttctcattgcaaaggagtccctgtgccggcgacgaatgcgggtgaccctctctcagtccagccagagggctcacacagcggaagcacgcttggcgtctcggccggaggaggcaccacccgtgccaggccggcgtcaacacgcgcgagtcccgccccctgcagcgccaagaaagcacggcctggcggtcggtgtctggccaccgacctcgtcgccgacctgaggtcgctcatgggggagggaggcgacgaggggccgccagcagtggcacagtgtcgtattgctcctggcgggagtggagcggcatgcgtaccccccaacacatcaagaccttgcnnnnnnnnnntgtattgctcctggcgggactggagcgccgtgcgtaccccccaacacatcaagaccttgcgaggccagcgcctcgggggcaggtgcactccctgagcccagccagtggacgcaggggcccgaccctggcgccctggagagctgcctggaagctgccgaggctgcagcagcgctggagcgtggccgggccgtccatcctgggttcacaacgggcctgggggcggcggtcagggtgtccagtgccaacctggcggctgcgcggaagctactggaggaggacactcccgcgtcggagccgggggcgacgcccacctcggccgccgcggcagcggcgactccggtcctcatggcagggttcagcaccggagcaggggctcccgtgcacgtctccgccggacgcctggaggccgcgaggcggctgctggacgagactgtaggtgcggcgcccgccgccgccgaccggcannnnnnnnnntggacgcctggaggccgcgaggtggctgttggacgagactgaaggtgcggcgcccgccgccgccgaccggcagggagggcccatcggcgagggcctggctgaacatagccccacgcccggcttcacgacggggctaggggcgccggtggccgtctcgtcgtcccgcctcgaagccgccaggaagctgctggccgaggagccacccgccgccgaggacccgcgccccgcccccgccaccgtggcggcgtgcttcagcacggggctaggcagacctgtgagcgtgtcgccgtcgcagctggcagctgcgcggaagctgttgaccgaggacccaccccaggccggcaagaccgcagacccagcgccgccggccgccggcccctcctcgcccatggtggggttcagcacggggctgggcacgccggtcgcggtgtccaggaagcgtttggaagccgccaggaagcttctcactgacgaagacggcgcaaacgagggccacccggcctcggccttcccgggatccagtccggccggacagnnnnnnnnnncttggaagccgccaggaagcttctcaccgacgaaggcggagcaaacgagggccacccggcctccgccttcccgggatccagtccggccggacagccagatacgcccagcctcagggtcaggccgcctgcaccgggcgagggccccggccccggcgagacgaccccctgcgccaacacgagccaccagctgctgagtccagggtccaccggtctccgctgcgggcccgggcccgggcgggcccgctctggtggggtgcagccctcaaggtttgtcttggcatgaggcatggtagggatggggagagaggacacatctgaatccatttgaactattagaaacggccagcctgtgctagaccctgggttatgccctggccgccgcttcctcgccgtgtgcgcacggatccccaggtctgtcccacttgcttccatcctccatcctcacgcccctgcnnnnnnnnnngacggtcagcctgtgctagaccctgggttatgcgctggccgccgcttcctcgctgtgagcgcacggctccccagggtctgtctcatctgcttccatcctccatcctcacgcccctgcaacccgcagactgggggccggcgggatgacgccctccacctctggcccaggcatcaagcagcgcaagaagttccagacgccgcggagcctggtgaggcggcgggggttgggggatggagaagggggaggggggcactctatgcagccatgcggtgccctgaacaaagtgtgccttccctttccaagcgcacgcctagcaggcccagcgaccggcactgggtgccattcccacgcccagactcaaaccttgtcagtttcgtgacttccccccaaaccaaccttccagggtccactggtgcgcccccgggctgccccaagcgcacccgcagcaggcccccccgacctgccgcgggccaggctgcaccggctgggcaggacgctgattgcgcaggcggctgaggcgatggcggtgcctcccggccaggcccccgacgcgcagccgccggcctcggagcccggcgaggcgctggacgcggccggcgcccaggctgcgctgctggacgccggggctgtggccgcccatgccagcctggactgggtggccaatgccctgtgcatggtcgcctggaagacgggcagggtggaggccgtgctgggggagggcgcggctgggaggctgcaaaccagggcaatgattcttgacgccctgcggcgacggtgcggggtgcggttgggggggcaggggagcatggtttgggcattcaccatcagggacatgccaccacctgcacaaaccccagggtggtttgcagatgccagaagcgcggggtatccccacgtcgggcggtgcacacgccggcaccactcccaccctttctccctcatccaccaccaggtacgagctggagtttggcagggggcgctgccctgtgctcaaggccgtgctgcagcacgacgagccggcggcgcagtgcatggtgctggcggtgatgcgggccacccccggcgacgccgcggtgcgctctggggctagaaagggtggaacaaagcgccagtagtaggatggagcgaatccaggcgggggaatgaatgtgtggccctgggctaacctgacgggcccggcaggcatgccatcgccacggcagattccaggctgcgtcggcccttgcagtccaccccccttcatgtacctgctccgcaggtggagnnnnnnnnnntgaaagggtggaacaaagtgccagtagtaggatggagtgaatccaggcgggggaatgatgtgtggtccagggctaaactgacgggcccggcaggcatgctattgccacagcagattccaggctgcgccggcccatgcagtccccaccccttcatgtacctgctccgcaggtggagctcacagacgggtggtaccggatctggggccggctggacgccccgctcgccgcgctgtgctcgtctggcaggatcgcgccggggtcaaaactccgcatttgcggcaccaccctgcagggcgcagggccaggggacccgctcacggcggccgccacctcgagtctgcagctctgcatcaacgggacgcacaggtgagtgcatgcctggcaaagtgggaagaagggatgcagacggcgcggtccagcatgtcgccctttgcatggaggcagggagcctcctcaccactgagactgcggctgcaccgcactccctaccacagggcgcctgacagctgccggctgggcaggcagtggcaccggtcaaccctgctccccctgagtctcgtggacccgggggggggcgccataccccggaccctggtggtggtgcagaggtgggctccgagcaagggcctgcaggcttgggtcacggggaggtggccgccggtgcatggaaccgtcccgccctgcacggctgttgggtggatggcagcctgggtgcgtgttctgctggttacgtcgagtctgatcatctggtcacacacacctttctccccactgggcaccagctggagcgccacattcctcctccccctgtccccgctgttccctcggcccctccctactacatcacagccaaccaaactcctggtcccatccgcagggtgtacccgccgctggtnnnnnnnnnnatgcgtgttctgctggttacgtcgaacctgatcatctggtcacgcacaccttcccccacttggcaccagctggtgcgccacattcctcctccccctgtccccgctgttccctcgcccccttcccactacatcacagccaaccaaactcctcatcccatccgcagggtgtacccgccgctggtgtggtgcagcctgtccaacggcaccagcctcatgcagaccctgcgtgcacatcgcgccacccagaacgccgccacggcccacaccgaaaaggtccggcgctgaggcccacctgctgcgcatgcttgctgcctggcgctggggtctcaccctcctcttccctgggcctgcgcacgcccactcatgagcataccatgccagtgaccccgctccccagccggacctccccctaccctcccacgcccaggcccagacggaggtggctgcccgtatcacggcccaggaacgcgagcgatgcagaaccctgctggccgagnnnnnnnnnngcccctaccctcccacgcccaggcccaggcggaggtggctgcacgtatcacggcccaggagcgcgagcgatgcagaaccctgctggccgagaccccggcgcaggaactggggccggtgcagcgcgcctacgcgcggctgcaggcggacgccggggcctcccaggactcgggcgaggccctgagccccgcgcagcgggccgcgctggatcgcctggtggccgagcggcaggcgcagatgcaggcccagtgcgaagccgagctgggtcaggcggagaccgggccggaggcctcagaggtacatgggagggggggccaatcctggagccaggccgctatttctggacacgtcagcaaaggctcactccnnnnnnnnnnttcagaggtacatggaggggggggggcgtttcctggagccaggccacttttttctggacacgtcagcaaaggctcactcctcctcacacggatgtccatgactgcttcattcaggtgatggtgaccaaggcggtgccggtgcagaccctgctgctgggggaggtcaggcatcggcacaggcggtcagggacgagcggtgcacccacccaggcgctgtgcacgtgaggtcccctgggctgtggtctttcggggagggaatgtagcagtgcctgctccaggcaatcgtatgcgtgagcaggcaggcaggcatggtccannnnnnnnnnggggctgtggtctttcggggagggaatgtggcagtgcctgctccaggcagtcgcatgcgtgagcaggcaggcaggcatggtccacgccaagctgcagcaacacgatgcccctcccatgtcccacctcgtcccatacccccggcgcccagtatctggaggccgggggaggagatgggcggcgtacgcgagggctctatcttttcagcgctgggcttggagccgcgaccccggcgcggggccgccaaccctgaggctcgggcggggctggaggtgcagacgggacgcggcactcggtggagcctggtggcccacgaccgcacggcgctgccgcccagccttgaggcggcggcggcgccgcggagggcgtggagcctggcatgcgtgccgcgaggggacnnnnnnnnnngaccgcacagcgctgccgcccagcctcgaggcggcggctgcgccgcggcgggcatggagcctggcatgcgtgccgcgaggggacgccggggaggtggacaccgcaggcttctgcctgtgtgtcggtcccgtggtggcactaggtgaggcgagctggaggccgtgagtgaggcaggggcgcactggttgggatgtgtgcgacgcgtggcgcgctcgccaggtaggatggcatcggcggtgagagtgcgcaggagggatcatcccgacgtctgctgccgcgctcttcgaannnnnnnnnngctggttgggatgtgtgcgacgcgtagcgcgctcgccaagtaggatggcatcggcagtgagagtgcgcaggagggattatcccgacgtctgctgccgcgctcttcgaacagtatctctgaatggatctgaaccccaccctcctcccacaccaagcacagggcatgcggcccaggcaagtcagtgggccttcttcgtggatgccagctgcccagcgcaaagcggcgaccacacccaccccccgccctggctgctggcggtgaggctggagggcgccgtgcagggcatggactggttggaccccggcacgcacgcgggggccgtgctggagctgcgagacgtcgtggtgggtgctgtggacgcagactctcgcgtgcagcaggttgtcgccgacaagcactcctccatctcgccgaggtgagttggggcccaagtggtgctgatagtggcttgtatgcgtgcgcagtccacacagagtgtgctgggtgtgctgnnnnnnnnnngcctgatggtggcgagtatgtgtgcacagtccacacagagtgtgctgggtgtgctgccacaccttgagcaaagacccgcagtccaattcctggcactgctcatggccgattgacttccccctttcctgtacagagatccaaagccagatgggagcgcgtgtgacatacaggcattcgtgcaggcaaacctggacctcatcgcagggctgcagtgccgggccgcatgcctgcttggcgaaggctgaggagccgccggctggcagcatggcgtcgagggggcgcccaagccatgggtacggatgcagagtcactgcgtccacctgttgcaggaagccattcacttggtgggctgtattccttgctcacagccttgtaggggcgcactgtctcccgtgacccccacagtcagggaccttgcatgcatggagggtcttgtcgcccaccatcagttgctgcccccctgatgctgggcagccttccgaaactgctccaccttcagcttgtacagctcctcatcccggatcacgcccttgtgcaaggcctgacatgtttgcgggcgggggctggggattgaaggttgcgtgtcggcctgccccgtgacgccctcgaagcccctaccggccttccccctcacctcgcgttcctcctgctggtaccagtggacggtggcaatgccccaggcggagaggagggggatcgtggccagagcgagcttgggtccggcgcgcatccgccggatgcagcgggcctcgcctctgattgtcaaggtgtcgaaggtacaatcaaaggggtagcttcttgctctcgaacgcgctcctaggaggaggttcatgaggagcctggttcacaaacgcccagccctcatcagggtgttttgcgagcgaccggatacacctcggacaatcgttcccgcacctttgaagttgatggccccctccatccttcaccctgcccctggttccctgagctataagatacaggcactgcagcaggttggacagtcatgaagggctgaccctctgcgctaggagtgcagctttccactgaaggcgcactgtctacccacgggacaggcatgagacaccgagattgctttcgctgggggccagtgacgagtccgccctgtacaggtgcgcagcggctgccacgtccgacggcatgcttccagggcttccgcctcccgctcacttgcggaaccagagcgcagagtcgtcctccttggtgtccggggcgacgtagcggcacgcgctgtagtcctcccacacagcgcgtcccacccaccgatcgtccttctggtagtactccttcaggatgggcttgatcgctgccgtcgcctcctgtgtgggggaatgtgaggcggggaagggagcggtcagctccccctcctgtgctccaatggcaggtatgaaaaccggctgcatggcggcaacgtccaggtgatgagggtgggatggatgagcgtagaattcctccc

SEQ ID NO: 26846 - DNA, 73 bp, Chlorella protothecoides
tgagtcagcccaggcgcaggccgcccgctcatcgccggcgcccttgctcagcccaggctttgatgacgacctg

SEQ ID NO: 26847 - DNA, 151 bp, Chlorella protothecoides
catctcctggttctccgacaaggtggggcccaggatttctgggtgtgggcccagcatactatgccgggcgcaggagtgggtgagatccctcgcctgcgttgcctcaccatgtttccccctcccccccgtcttccggactaggtggtgggca

SEQ ID NO: 26848 - DNA, 88 bp, Chlorella protothecoides
cattaccatgctcccttgagtcatcaataccctgtgtaacaagggcttacatagaatgctgcatgggtagaggttgcttcataagatc

SEQ ID NO: 26849 - DNA, 79 bp, Chlorella protothecoides
cctcatgcggggatattcttgagcagattgttcttcgaaaaaagaattgtttgatacgatagcgatgctcgtcaacccc

SEQ ID NO: 26850 - DNA, 80 bp, Chlorella protothecoides
gctcgccccccctgggctcgccgtgcacgggcccgaaaggacatggccacagcaggacgtctgtgggtgccgaggacatc

SEQ ID NO: 26851 - DNA, 1074 bp, Chlorella protothecoides
acgtggtggccgcgcgcgccgactggctggcgcaccgctcgcggcacgccgagtgctgggcgctgacgcgcgaggcgctgcagcgcgacccctacgccggccagtgcctggccgcgcactgcgcggcgggggtggccctgcgccggcgccaggacctgtttgtgctcgcgcaccgcgccatggaggaggcgccggaggccgccgcctcctggcacgcggtggggtgctaccacctggccacgcccgcgggcggcgaggcggcgtgccgcgccttctcccgcgccacgcgcaccgaccgcgggcacgcgccggcctggctgggcctgggcgcggcgctgggcgcctgcggcgagaccgacgccgcgctgggcgcgtaccgcaccgcgtcccgcctcttcccgggcctgcacgacccgctgctgggcatggcgcgccagtacgcggccatgagcaacgcgcccctggccgagcaggtcctggtgcaggtgggtggaggggtggtggagggtgtcggtgtgcttcttggcggggagctgaggtggactggttcgggactgtgaagcatggggtgaaatgaaggggccagagggatcaggggctgttgtgggtggctgctccacagcatgatctcgcacaggagcatgccccaagaggctccatctcaacggatgctacaccaccgcaccacgagacaaccctgcaccccaaccacgacgcaggcgcagcgcatgtgcccctccgaccccggcgtctgcaacgagctgggggtgctggccttccgctcgcgccagtacgacaccgcggcccagtggttccgcattgccctggcttgcgtgcccagccaccagtcggcaggtgggtggtaccagggcctggggtggggcggagggggggtcttgggtcggttcgatgcggggatagccacccgcgcagggcgacctgtggctgggtgatcagtggatgtcttctcgcccgcatcatggctccacaccctcccctcagtcgcccgccgaccccgctcacccaccgccccgctgccaccttccatccccgccctcccacctccccctcccc

SEQ ID NO: 26852 - DNA, 493 bp, Chlorella protothecoides
  modified_base (140)..(370): a, c, t, g, unknown or other
ccctggatcgtgccacgtcgaccttggagtggagcgcagagacacttcttgcccaaatccaccgcccgcttgatcgcttcatgcatcatatgcacccacgactctctcagcatatttgtgttggaggacacgggtgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtattgcgggagccaatccgattcagcgcaggctcctttggctcgttaagagtggcatgtaccgcctcactaaacccccatcccacccacgatcaccgcagatgtcccggactcagaaaaa

SEQ ID NO: 26853 - DNA, 103 bp, Chlorella protothecoides
gcagcagcaggggacgagggggatggggatggggatggggcttgcaacatgatgcacagcaaagggcaacgagtggcaaaggcaatacccgtcccctcagccc

SEQ ID NO: 26854 - DNA, 119 bp, Chlorella protothecoides
ttgcctgctcctccaacacatcctcctcttgggagtcagccagcttcctgagcacagagtgctcgtccgagtaggcagcctccagcgcctaaacagatataacaggatgtggtgagggt

SEQ ID NO: 26855 - DNA, 137 bp, Chlorella protothecoides
gcgaatctgcaggtgcaccgagagtgggacagtttgtggttatgtgatccggggcccgcagtgcacgcgctgaccctgggcagagtgacagggctcacatggcacggcagcaatctgtgcatgctggatgtggcagg

SEQ ID NO: 26856 - DNA, 61 bp, Chlorella protothecoides
gaagtgtgtacttgaagaggtgaatcgtttaaaaacttggcaaggatgtcctcggtaggga

SEQ ID NO: 26857 - DNA, 78 bp, Chlorella protothecoides
ccgcccttggcatcgcctgccgcctccattccctaaaaaaaacctcggttgctatcgcattgtctcacccagggcggc

SEQ ID NO: 26858 - DNA, 61 bp, Chlorella protothecoides
gttctggaccggcgccgaccaggctgccgctcctggtctcctcgcagccgggcggcatgca

SEQ ID NO: 26859 - DNA, 61 bp, Chlorella protothecoides
cttctccccttccacggaaggaccatcctcccccgtcccactgcagatgaagctgtttgcg

SEQ ID NO: 26860 - DNA, 61 bp, Chlorella protothecoides
agccgtccccgagactttcggaagtgccaagttgagctatattacagattggagctttctt

SEQ ID NO: 26861 - DNA, 61 bp, Chlorella protothecoides
gtagagataatgcaggggtatgccttgcagaggtgggcactgtgtcactacacctcgcgtc

SEQ ID NO: 26862 - DNA, 207 bp, Chlorella protothecoides
caagaaagcttgccttattctgtaaaacgaagtgagggcttttctaaaataattaggagactttgcaagcaatgatacatctgttgaacgcaacgataagataagggagcaggaatgctgtcaagttgcaacacatcatacaaagggctgtcaggcttcggattatacagagcacaaacgatttgagcgtctgacttgttttccccc

SEQ ID NO: 26863 - DNA, 345 bp, Chlorella protothecoides
tggccatgctggaccacggtgggttggtctttgggggtggatgagtcctggatgggtcatgatctgagtggggaggggaaagaggttctgaggcgcaggcgggagcggggttggtggagcgggggacagcttgcttgtggggtgggcatggcaaggcacaaggggtgggtgaggagggcaggaatggctgccgtgccccgccctgtcacgagagcggccgggtttatttccagggtgcatgttgatgctgatccatgggggcgggcttcctcccacccctgcatccctgagagaggcgctgagtacgagaaactgtgttttgcctcctgacattcttcatggccc

SEQ ID NO: 26864 - DNA, 72 bp, Chlorella protothecoides
gaatgtacttgatgtccccccgtcggggagtcgctttagggggaccttctgcaaatgcgatctgtgcaacaa

SEQ ID NO: 26865 - DNA, 114 bp, Chlorella protothecoides
tacggttggagggatggagggcaggtcctctgcaggctagtgctgcattgcacgggacaaggctgccatgtcaggccatgtcaaaccagattccatctcacaggtttgtccagc

SEQ ID NO: 26866 - DNA, 61 bp, Chlorella protothecoides
cacgcaggcatcttcctcaaatctggtgtagtttcccgctggcagagtgttgtcagtgcaa

SEQ ID NO: 26867 - DNA, 77 bp, Chlorella protothecoides
gacgacaacatgcccttgcgttgatgcacacactatcatctttctcaatatttttaaaacctctcaagactccacac

SEQ ID NO: 26868 - DNA, 76 bp, Chlorella protothecoides
gtgtgcgtatgcagtgtgagtcgaggggggttgcgcctcgcaacaacccctgctggggacgctccaggccatgcac

SEQ ID NO: 26869 - DNA, 85 bp, Chlorella protothecoides
tgagaggccaccggggtctggcgctgtgtgtcatgacgcatggccccaggaacgccatcctcacgaggcccagcagcaccaagca

SEQ ID NO: 26870 - DNA, 121 bp, Chlorella protothecoides
cgtggtggaggcgctgcaggccaggtgcgtcgggtggtgggcagaggggggagggactggcgtcagatccagcccaacagtgcacgcgggtatgtgaggggcggactcagcgtctctgtgc

SEQ ID NO: 26871 - DNA, 140 bp, Chlorella protothecoides
gcggcgtctgcccaaggcatgcattgctgcggcccagcaggaatgagggtcaatgcctggaggtttgatgcatgccagtgccctgtcaggtgcaagaatttcatgccaagtaatgaacccctgcctcttacctactgctg

SEQ ID NO: 26872 - DNA, 74 bp, Chlorella protothecoides
aaggacgtcctgaaaatgcggccctcgccgcgcagaaagtcatccacgcgctccgtgggaatggttgcctgcgt

SEQ ID NO: 26873 - DNA, 150 bp, Chlorella protothecoides
gtgcaggtgcgcccctgcgtgatgctgcgtgaaggcgtgcctgaggctcagaccgttcttagggttttcttgtggcccgtgtcgttttcaagcgcgagctgcggtgagggtgctcccatggctggccatctctcagggtcaacctggaac

SEQ ID NO: 26874 - DNA, 61 bp, Chlorella protothecoides
ggctctcatcgtcactgcacgccctgatcggggaacctgcgaaccgaagagcctgggatgg

SEQ ID NO: 26875 - DNA, 61 bp, Chlorella protothecoides
tgtgcgtgtcagttagcgtgcaggcttcgtatttgagcgagacacaacctccagtgcgccc

SEQ ID NO: 26876 - DNA, 61 bp, Chlorella protothecoides
taaacggtgttccggatggaccggcggaggtacttacaactgcggcacacggtgatcactg

SEQ ID NO: 26877 - DNA, 80 bp, Chlorella protothecoides
tcaccttccccatcttcaccgcccaggtgcaggggatgtgtgactggggacggtggggatggctggcacccgccccatgt

SEQ ID NO: 26878 - DNA, 151 bp, Chlorella protothecoides
gcctgcaccattgcccggtgcgccttcagccctcggtgccagccccggccccacagctatgccagggcaacagcgcggcacacacgtcattgaaccctagtgtcaacgccgcccatgtgcaccgccacgcatacatgcccagcgtccaact

SEQ ID NO: 26879 - DNA, 105 bp, Chlorella protothecoides
gtctcctgtagtgttccccgctgttgtgctgtaaccaggccaccctggccccaaaactctcaccaccaccgctcatcccacccttccacctgaacatcgcactca

SEQ ID NO: 26880 - DNA, 72 bp, Chlorella protothecoides
tcgtgttcggctttggtacgcagcagagtgtcgggcgggggagcctgcctggactcggtgacttgcctcgtc

SEQ ID NO: 26881 - DNA, 75 bp, Chlorella protothecoides
gccacatgaatgtcccatggattccacctactcggtttcccgcgaaaaggagcatggccgccatgctctcaatct

SEQ ID NO: 26882 - DNA, 70 bp, Chlorella protothecoides
aaaggagcatggccgccatgctctcaatctcgggcactcgaaatttgggggcgctgaggtcggcttctcg

SEQ ID NO: 26883 - DNA, 61 bp, Chlorella protothecoides
gttgatgcggctcatgatgtcgtctatcttgaggtccttggttgagattcgcaccacctgc

SEQ ID NO: 26884 - DNA, 61 bp, Chlorella protothecoides
atgagggggccggctcccttgatcgcggctgggaggacgatggtctcgaggatggcagccc

SEQ ID NO: 26885 - DNA, 135 bp, Chlorella protothecoides
caaatgtagattcctgctcagctttgtcggggacactctcaaagtatgtttcggtgtcccttatcgaggctcggtggcaatacaaagacaacgtgcttaatgaaaagctttaggtggttctcgattcgatggaaa

SEQ ID NO: 26886 - DNA, 105 bp, Chlorella protothecoides
gcaggatcctccgccgtgcgcagcgagtcctcctcggcatagccgcaccctcccaccaccatcgaacagttcatcgaccatccagcctacctctgctacaagctg

SEQ ID NO: 26887 - DNA, 73 bp, Chlorella protothecoides
ggcgcggaaggctgcggggtcgggcacctcgcggagcacggtgtcggtcacgcggcagccgttcaggctgcgc

SEQ ID NO: 26888 - DNA, 80 bp, Chlorella protothecoides
ggcgtggatgcgtgggtttcaggctggcacggggtgttgaatcccggggtgtacggcggcatcatctgctgcaaggagca

SEQ ID NO: 26889 - DNA, 21446 bp, Chlorella protothecoides
  modified_base (2675)..(2684): a, c, t, g, unknown or other
  modified_base (3033)..(3042): a, c, t, g, unknown or other
  modified_base (4663)..(4672): a, c, t, g, unknown or other
  modified_base (5130)..(5139): a, c, t, g, unknown or other
  modified_base (5444)..(5453): a, c, t, g, unknown or other
  modified_base (5537)..(5546): a, c, t, g, unknown or other
  modified_base (6085)..(6094): a, c, t, g, unknown or other
  modified_base (6283)..(6490): a, c, t, g, unknown or other
  modified_base (6552)..(6561): a, c, t, g, unknown or other
  modified_base (6679)..(6688): a, c, t, g, unknown or other
  modified_base (6821)..(6889): a, c, t, g, unknown or other
  modified_base (8341)..(8350): a, c, t, g, unknown or other
  modified_base (8600)..(8609): a, c, t, g, unknown or other
  modified_base (9531)..(9540): a, c, t, g, unknown or other
  modified_base (10977)..(10986): a, c, t, g, unknown or other
  modified_base (11559)..(11568): a, c, t, g, unknown or other
  modified_base (12548)..(12581): a, c, t, g, unknown or other
  modified_base (12773)..(12782): a, c, t, g, unknown or other
  modified_base (12861)..(12870): a, c, t, g, unknown or other
  modified_base (12948)..(13054): a, c, t, g, unknown or other
  modified_base (13372)..(13381): a, c, t, g, unknown or other
  modified_base (14456)..(14465): a, c, t, g, unknown or other
  modified_base (15285)..(15294): a, c, t, g, unknown or other
  modified_base (15834)..(15843): a, c, t, g, unknown or other
  modified_base (17973)..(17982): a, c, t, g, unknown or other
  modified_base (18605)..(18614): a, c, t, g, unknown or other
  modified_base (19621)..(19630): a, c, t, g, unknown or other
  modified_base (19870)..(19879): a, c, t, g, unknown or other
  modified_base (20027)..(20036): a, c, t, g, unknown or other
  modified_base (20426)..(20435): a, c, t, g, unknown or other
  modified_base (20506)..(20649): a, c, t, g, unknown or other
gtccacgctgccagagagcattggggtgggggccggcgcgccgctggcgccgctgccaccaccgccagcgggaccagcaccgcctcgcccggcgcccgacgcccccagcgcgcggtgcccggcgtgcacgctccacccgccctcaccgtccagcgccaggacgaggtcgtggaaggccatgagcgcgggccggtggctgatggtgatgcaggtgcaccccgcatcgcgcaccatgctgcagaagcggcgctccatgtccacgctcacgccgctggtgcactcgtccaggatggcgaagcgcggtcggtggtagaacaggcgcgccatgcccaagcgctgctgctcgcccagtgacagctcctcgccccagtccagggactccccgccgcgcgccagcaggtgccccaggtcgacgctggccagcaggtcggccagctcgtcgtccgggatgaccggcgccgcgccgccggcgccgggggtcagtgggtatagcagctgctcctgcagcgtgcccacggtgacgtaggggcgctgcgggacgtagaagatctcgtgcgacagcccgcccgccgcgtcgcctgcgccgccgccgggcttgcggatggcccccgcagtgagcggccagaggccgcccagcacgcggaataggctgctcttccccgcgccattgggaccggtgaccagcaggttggtgccggcagggacgcgcagggtgaggtcgcgcaccagcgtggcgttggcgggggtgaccaccaccaccgactcgaaggcgatggcgtcctcgcaggccagcagctggccgcgggcggggggcaggccctccggccccgtgcccgcgccgcccgcgatctccgccatcactgcctccagctccgccaggcgctccgcgtaggcctgcaggcgcatgagcttgcgcgaggcgccgcccagcgtgcccagcgcgccaaatagggagatggtgaccgaggtgtggtagcgcatggccgacagcatgcccgcccgccccctgaccgtggcctcggggcggaggtggccgccgaagaaggggcccaggatgagggccagggccaccgtggcgccaaagtacttgagcagcaggtcctgcaccatgccaaactgccactgccggcccagcaggcggcgctgcgcgcgcagcgcgtcgcggaatgcaccacgcaccacctcgccctccttatgcatgccggcgtagaaggctacgctctcgatgttggcgcgcaggcgcgtgtgcaccgcgcgatacgcgccctccagcgccgcctggcgcttgaacagcccgccgaagttgggcgcggcaaaggccatggcgccgcccacgccgagcacataggccaggagcagcgcggtgtagcggtgcgtgcctgtgtagctgtgcagggcccaggagtagaaggcggcgtccacgcccgccgacagcagctcgcccagcagggaggccaggccctcggtgagggcggggatgtcctcgcagatgcgctgctctgcggatgggatgcggcggtccacatagctcagcttgtagtagaccatgtcgtcaaagtaggccgcgtgcacgcgctgcgtcagcaggcggcgccactgcagctccagccgcgacacccagctccgcgatgtcgactccagccccgctgccagcgcgcagagggccacattctccgccaggttgcgcatgaacagcggcacgcgcttgaggaaggctgcgcggaagaggtagccctgcaggcgtgccaggcggttggacagcgcggtgcgcgccagcaccacccccagcagcaccaccactttgggcccagccacgcggaggagcaggggcagcaggcgctgcagggcgcggcgctgcgaggcggggcggggcttccgggcggagccggtggccagggatttcttggggcggggaatctctggcctgcagtgcatggcaggcggagatgtgggaggaggggttgagaggttgaggtgggggtttgcggaatggtaggggtacaaaaggcatggcatggccgagggcagcagcccaaaccccagggactgggtgcccccctgttcccatggccccctgccacctgcatcggcatcatcatgccaggctcattggccaaaaggagctacccatatcagatatcatgcacgatgtgttcaacattggcacccacgcgcaaaaggccgggggctggctgcgtccacagccctaaacactgggccgcaccttcccgacagtgaccgtctgtcttgtcgcaggctgcggctagtatgataggccaacagacccgctgtcgcagcggcgatgccgagcttaaacttggtcgacttgcggacacccagcagtagcgccagctgagccaccacggctgacttggaggatggggccaccacgacctccgtgctcgacatcctgcactactggatggtttcgggatcggtgtccaacaacatcaggggaacgaggtgcggatcgatcaccgcctcccggtctcatcgtcggcatggccgggattccgtatatattgtgtaagggtggagctgaggtggcccccggattcctctcaagctcgcgcgcgcccccagagcgcgctgctctcatcgcaagaccttgacagttcctcaggagttcttagggccacatcgatggcatcatcatagcgcccacaaattcaaannnnnnnnnncatatattgtgtaagggtgaagctgaggtggcccccggattcctctcgagttcgcgcgcggccccagagcgcgctgctctcatagcaagaccttgacagttcctcaggggttcttagggccacatcggtggcatcatcatagcgcccacaaattcaaagtgcactttctgggtagtatggcatgctaattctctgaccgagctgaacggcgctggtcaccgtccagtccgtctttgcgtcataccctctgcgatgccctgcaagagaatgcgtacgacacaattgcttttataggacttcttaaacaacaattgaagtatccgttcagctcttctgccgtagttttgtnnnnnnnnnnggcgtcgtaccctctgcgatgccctgcaaaagaatgcgcgcgacacaagtgcttttgtaggacttcttaaacaacaattgaagcatccgttcagctcttctgccgtagttttgtcgacacaggcgacatgggccggcccaggaagcccggggcggggcgaatcgccaggtggggaagtgtcgctgcacatgggacggtgtcgctgatttcatgctgctctctaccttctccaggtacttcgtctcagcggtcgcctgcactcttatccttaccagggagaacaagaggaagactcccaacacacacgccatgatggtgaagctgggccgggccgcaaagaaggccaagcagttcgaggtgcgcaagatcgttcggcgtctgaagctggcagaggccaacaagaagccggcgctggaggcgcagctcgaggcagcgaaagcagcaaacgtgcaggagctcgcctcggtcgcggggtcgcagctgggcctggtgaggggtccggctgggtcgctccccgacagcccagagtcatgctgggcggatggcccagagcgagcggtgtgcaccaggatgctctctgcgccctgcctgaaagccgtcattgtctccctcctggagggcgacgccgaggaggcaagagagggcaagccggccccgctggactctccgcctgccagcccgtcctcctcggacggcgaagaggccgctgacgaagtggacgaggaagcaggcgccgcgctcgcaaagctcctgcagcgcagcagggaggcggcagctccatcagactctgaggacgaggccatatccctggcaagcgacgtgagcgacctagagagcctgctgagctctagcggcgacgaggccgggccaagcgctgagtcgtcaaaggcagaagctgctgcgctgcccgtccaatcacagaaacgtgccaagggcgccagggtggggccgggcaagaagtctgccccggccaagcccaagaataggatggggcagagggaacgacggcggctggctacgatgcagtatggccgaccggcaccccctaccatagcaaaagaggcccagggcaagcctgacagagtcaagaaggctcctgcgcctgccttggatgccacagacctgcatccctcttggagggcaaagcggagccaggctgccgccatccctgcaaggcctgtgcctgccaccaagattgtgtttgatgactgaggtccatgtgtcacagtgaggagggcaggaaggaagtaatgaaatgggcaatgctgcgcagagggtgtcactcagactgaatgatggaccagtcggtggggagcaggttcagcagggcgctgctggatgccgtcgcatcggcgctcgctgtgctgttgctgctgctgtgagagggcatgccccagaggtcaaatgccccagactgcacgctcttctggaagtcgtgcgagctcttgaagatgatgtcatcgcctccactgttatgggaggagggcacggagaggcttcttgaggcctggacatgccctttaacattgacactagccatgaggagatggagtggtgtcgcacaccccagaccatgtctgcttcgagtcgccctcacctgtacagcaccttctccgacccnnnnnnnnnnggtcatgtcgcacaccccagtccatgtctgctttgagtcgccgccccctcacctgtacagcaccttctccgacccctttgacagctccttcttgaatatgcagctccccacagagaaggaggatgccttgaagtgcttgaacacgaacttggtgggtgtctgcaaggacgagggttttcttgcctgggtgggtggggactggaagactgcaacgccacacccacatgctgattgctggccaggacaagtctggagtactccccaatgacctctgaaccctctgcataccttcacgtaggacactgagggggtggtgcagacgacagacttgttcttgtaatcgtcagaccacaccaaggtgcagtttcctgtggcaagggtgatgttcagctcgggtccttggagcacggagggcaccttgccgccacgcttcagcgtgagtccgtcacagtacctgnnnnnnnnnncggagcacggagggcaccttgccgccgcgcttcagcgtgagtccgtcacagtacctgaagagggtgggtactttggacgattgtgggtgggaaaatttacaccggctccatgcttcctcccagccaggattgcacaagtggcctcccttgacgaccccactgacttgtcatgaaacttctccacggatttctccaggtctgtgtctattccgaagcccgtcaggttccagccggacaggtctgggatcatctccctgaaggatgacactttggacatcaggctgctgtccatggcattgaggtannnnnnnnnnccgtttcaggcgaggtcttgaatggtaaggaacacgcgccgggcctctgcgacattccagggctcccctgcaacgtaccagatnnnnnnnnnngacgacatcgacaggctcgacatcatagcctcgcccactcctgcgtgggttcagagcgtttcaggcgaggtcgtgaatggtaaggaacacgcgccggggcctctgcgatattccagggctcccctgcaacgtaccagatagcaggctgtcggaactgaacccttgtgctctcgcaccagcgcaggagagcaccgcgataagcacgagtgccttcatggtgatcattataaaggattttggtgtctttcagacgatattttgccattttcaatgcgcccgtggtgtcttaagggaattcagggacgcaccaccgaggcatgcgcccccctcgaggcacaggtcgagttccgatcacacacggccgtccctcggacgaccggacctaaaatctccaaacaaatccacctaaacttagactggagtttgaatgtgtgcattcgtgccctgagcgttacccatcggaggcacggcttccgtgccaaagcgtgtgcgactgtctttcgagctcttgaagctgagcttgtaccagaagcgcgggnnnnnnnnnnggactggagtttgaatgtgtgcattcgttccctgagcgttacccatcggaggctcggcttccctgccaaagcgtgtgcgactgtctttcgagcctttgaagctgagcttgtaccagaagcgcggggaggcggaggtggctgacgaggctctctgcccagtatgttctctcaaaaccggtctgcggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattcgagtgaacacgacggttataaaggaaggagatatggactgcaaactaaaagtcannnnnnnnnnaacgcaaggtcagactgcagtgttccttgcaccctccgttctggaatcgacgcagcaaaattcgagtgaacaccacggttatgaataaaggagatatggactgcaaactaaaagtcannnnnnnnnncaacagagaccaggaggtgcaaatatgcactgagccaggggcagaggtcccttggtcccagtgtctgctgtgcatgcgacgcaacgtcacactgcagtgttcccttgcaccctccgttctggaatcgacgcannnnnnnnnnnnnnnnnnnnnnnnnnnnnnnnnnnnnnnnnnnnnnnnnnnnnnnnnnnnnnnnnnnnngggacccaaatttgctagcaggcagaaacgtcaggaaaagaatggtgcaccgcacctacatgttctgcgattacccatgcatacattgtcatagatgggattctgggatgcaaaggatggcttcctcggagcttcaagcagggcctgctgggcttgatcccacattcccggatccgattgcagtcgcgcatggcagtggaaaagctgcattgatacttgggcatccctggaagggaaccgtgcggcgtggtgagagctgggccagtcactaccaatctaccggatcaacaccattgccctgttctcctgaacgctcctagcctcaccggactgcatcgtgtggtccctcgccagcccaattcaataagactcgtgccagatggtcttggttgaagatagtgaagtttcggtactgagcattccacactcggtacagccccatcagatccagcatgctggcgaagtcttgccgctccctgtcgaggttttgggaatgctcacagaatgagtcttggcatctggaaactctatgtcagagtgcttggctccaccttggagcctccctttcggtatagcgggacgcatgcctgtggcaagcctcgattcctgacccctgcttcctacttcaaattcagccatctgacgtcttgcatcacattctgtccaacgagcgttgctgtggaggggagaacctggagcagacgctcccgtgcctcacccagggagatccctttcgtctccaggatggtaggtgtaatcctgcagggtcgtatgggagggggacctggtgaacttcgtcgagcaacgctgcggctcgcacgcccctccgagacgcaccctgtaatcgccgttagacacgaaaccacaggttcattgggtttcacgaagatgttgagcaactcgcggccatgggcatcctgcatggaggaagtggaagggggtcgacaagccgcgagctggtatttagagtgcctcagatgccccatgaccaccaccgccctctcaaaaccattatatcatatatattgccacccaccacaagtcctatttgggcaacggcgcgtgcattatggtccaagcccgtggcgacacactcgacatccagagcatagtattggggcccaccgtcgatggggacttgccttcccatgagtaagttcgatggcctgaaatcggtttaggaagtttcaaaatatgcacagatcccgcacccatcttggcatgaggagaggacacacgagggattttaccaaggtaccatccggacgggtcctgggacggtgttgcaaagcagggggcaagtagggtgccaggagcaagctcagttttgttcatgcaatcatgcgtttgacgcacacatactcaataacggcacacatactcactgtagaatatcagcacacagcaagatggggggaagcagggcctacccagcagctcagaacttggctnnnnnnnnnnctacagtagaatatcagcacacacagcaagatggggggaagcaagggcctacccagcagctcagaacttggctgcagcaaccttctcgtccacctcagcgcgaagcgggcgcgacattgtggtggcaacaacttctacggggtcagcgccctcgttcaccacctgagaatgtaggattgtatggagcgtgctttgacaagaacttgggttgagaaaaatcgagtgcggaatcaggagctctgcctgggannnnnnnnnngagaacttgggttgggagaaaccgagtgcggaatcaggagctctgcctgggatgtgcttgcagacggacccccaaagccccaagtgcataaactttcccgcatggcctcccctctcaccctgtagatgccctcaatgacagcacaatcgatgcccatcttcttggcaaagtgataggccgagcgggaggtcagcacaccctcagcagtggcccccagactggacacgatatcctccaacttctcgcccttgcccagacgcagacctgcagtgtggacggtgcgtgcggcagtcagcgagtagttcctcgcgagagcatgggctccaagaggtgtctccagctcatttatcgtcagcagccaagcaaggtttttccagaaccatcctccttgcaaggtaccctcgaccttgttcaagatttcgtccaggcctcctttccccattgatcctcctcgcaaatcctccttgcacccactcaccaacagtgcggttgcggctcaggtccccacagcaggtgagcacgatgtcacccaccccggcgaggccggcgagggtcagggggttggcccccgaagccaccgccaggcgggtgatctcgtccagtccgcgggtgatcagcgcggcacggccattgttgccaaagccgacgccgtcggagatgccgcaggcgatcgccagcacgttcttcagtgccccggccagctccacgcccacgacatcgtcggtgcggtagcagcggaagcgattggtggacagcagctcctgcacatgctgagccagctggatgttcttggaggcgatggtgacggcggtggggatacccttggtcacctccgcggcaaaggagggcccgctcaggaacgccagcctgaggaggagaaatcgggggtgagaggggggatgaagaagccacttgcacgggnnnnnnnnnncggcccgctcaggaacgcaagcctgaagaggagaaaacgggggtgggaggggggatgaagaagccacttgcacgggctgtcacaatgatacattgtgtaacgtggctgataaatggtgacgatggctgggcctgcacaagctgtacctcgcatcactcagcacacacctggagtgcagcttctcgggcagggcgcgcttgatgatgtcatcgggcgtctccagggtgtcgttgaggatgcccttggtgcaggaaatgatgatgtgctcctcggtcagcaggtccttgatgttggacagagacttgaagaggaagggggtgggcaccacggtcagcaccagctcggcgtgcttgatcgcaaactcaatgtcgttggtcgccttcaggctctctgggagagggaggccctgtgtcccggtggtggtgtgtggtggtgtggtgggtacgcagtcggtgggctgcatggacatggccgaggtaatacacagtgcctgatgaccctcaacaactcaggcgcctgcacagagtgagcatactgagcatcttctctgtgtctgtctctgcctaccttgaggaacacggtgttctcatgctgcttgttgacagcatccacgacctccttctccatggcccagaggtaagtatcgtggcccatgccagcgcagtgggcggccagggcagtgccccatgccccgccgcccacgacggtgacggtggtgcgcgtgtcgctcagggcggaagccatgactgcagacggaagggcctgcagcagcatggggtgccggcatggaattagcatacacggccatcacgaccacgcgtcacggcgtgagcggggtgtcgaggcctcgaggttgggatcagggtgttaattccgtggtatgcatcatgtgcagcgggagccagacgtctcgaccaccgcccagggtcatcgaaagcaagcacaggacgggacacctgacaagacgccaggacgctcccgacccgaatgctgtcagcgatgggccaccgagggtaggaggtacatggcattcctccactcagaccttttactttaccatcacttccaaggcggtccccgattctggtcaggccaccctcggggcaacgcggcacgccccggaaggaaacccttcccgatatattccaaacagaggatcaacactcaccggtggattcgccaagcgattgtagtagaagcttctaacgaaggctagaactcctgtcactataaggctttgggttgttgtcgtttatgcagtgccgtcgaagccgatattttcagaagccggctgtagtaccgcggggcgtttttacatttgattgacgcgacccgacagagcagcgcaggcgtgtttcgtaatgcccgattcttcgcacaggacgcaagcctgttgctagacgtcgtcatcatacagatgttgtcttgcagctcaannnnnnnnnngtgcgtgtttcgtaatgcccgattcttcgtacaggactcaagcctgttgctagacgtcatcatcatacagatgttgtcttgcagctcaactggatcagcgtgagccctttttggatccacctggccgcggatgtcggatccccaagaggtatacagcgacaccgaggagccgtggtgtgggccttcaccccagccacctggtcctggcccttctgaagcaagcttgggtagctcgagaatctttcggtcaaatgcattcgcacgtaagagattaagaagtgaaggccggcgtaatgctggtgatgtgccctgtgcatcggaccaagcagtggctgcaaacaggcgcaccccagatcgtctggcagagtctgctggccttcctccacttcgagatccttccactgagaggctcccactaaatcctgcggggagcctgctcaatacctctttcagaccagagtctgcggcgatcaaggtgagagattctccagtaaagctcggcaccagcgcacgctctcccaaatatcaagccttccactaatctccctcatctcgacacactcttcaggggcnnnnnnnnnnaagtaaagctcggcaccagcgcacgctctttccaaatatcaagccttccacttacctccctcatctcgacacactcttcaggggcatgtgtctacgtttcttggaagaaagaggcctgggcccagcagagagcttgctcctcctcaatgtgcgacagagtcagagggtgctggcacctccattacccaccgaggatcgacgatacatgcaccagtaggctcagggctggaagtcacaacttccagcagagtcgtggagtccacggtgggtcagggcacacatggacttttaggtgatatcagaagtgctgctctgctttacagccgatcgctttgcatggtttctgacctgtggcacacatgggacaacatctacccagctttcccaacctccatgacaggctttcctggcaagcaccagcctcaccaccggtccgccagctgttgtgcatctcaggcggcctcgtgctccctcctccacggaaccattgccagacaaaagggcctccaatccaaactcaggatggggatccaactttgtgaaaatcgatctcaaggttagtattccttgctcaggctgcacccaatggcgtttgttctggcacgcgcaccggatctcagtctcactctctacaatgacaccaagcgcagaagggcaagggaaccagcaagcatccaggccgggcacagaaggccaggcaagcctttggcagattccgccgaggaggtgggtggcacgtggggggtgcgagtatgattcgtcacaatccaccagcgcgcctgctgagatacactgcggcgctccacctccccacaggatcgttcatgactcaggctggcagcggcgcggacgacctggacgggtggagagcaagcacacaaaagtgttaccggtgtggtggcgccggacactgggcagcggactgcacatccaatcttgaagccgaggagggtcaggtgcgttggcttgcaatgaagggnnnnnnnnnnnnnnnnnnnnnnnnnnnnnnnnnnccacacagttttaccacaggtgtctgcagacacgtgcacctccgcccgggctcaaggcaccacaactctaggagggaaggatcttctttcctctgcagctgctacaacaggcactgaaccctcactagaccccggtcaaccagtaatcgaggacagtgttctagaaggggcagcggccttggacgaagacannnnnnnnnncctgattctcgatgacctgggtcttgcaggctacttgacggcacaggtatgaagggcgcaagtttgcaggcagtcattnnnnnnnnnngctgattctcgacgacctgggtcttgcaggctacttgacggacaggcatgaagggcgcaagtttgcaggcagtcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatccaaccagtcatcgaggacagtgttttagaaggggcagcggccttggacgaagacagtctcaagcaggtcctgcgcacagtttttggccacacagacttccgctcctgccagcggcacgtcatcgcgcatgtcctccaagggacgccatgccttgccgtactccccacgggtaggttttggatctggctctcccgggtttgagaattgctagagtgaggaacattgtcgcaagagaaggtgccttgtaatactccgaccctgcaccgcttttccccaactgccaggtctgggcaagtccctctgctaccagctnnnnnnnnnncactctgaccctgcaccgctttcccccaactgctaggtctgggcaagtccctctgctaccagctcccggccctccttctaccaggcgtcaccctggtcatatcgcccctcatcgctctcatgcacaaccaggcggagcagatgcctgcggcactgactcctgcggttctatggtcgggtcagagctccaaggacgcagcagccaccttagaagccattgctgtgagtagagggcgtgccgggaaatcataaggggtggcaatgtgacagtggctaggcaaaattgactagcttagagcttgccactcaggcacagcttgctgttgcttgggtggagggtagatggaagctgtacgttctgcatcaggccagtgatccattctccatacaatccatggcaggctggaaagcacaaggtcatcctggtgagtccagagcgtgtgaacaacatccatctgctgaaggcactccagtctcatctacccctctctctggtgaggaagggtgggcttccatggaactgcttgtgtgttgcatagaagaggggacgcagtaccatatgaactgggcaagttcacaaggccaaaatgccgctcaacaccagtaatgtttctgaggcaaggatgtgctcttgcgcggcgggcaggcggctacctcatgcgtccaccactctcctctgcatctcacctgctcctcaggttgtggtggacgaatgtcactgcgtcaccgagtggggccattccttccggcctgcatattaccggcttggtgcggcgctgaagcggatgctacctgcaaagtcactcctggctttgaccgccaccgccaccaagctgacggaggctgccatctgccagagcctcgggattcagaccaccctgcgagagacttgcttgcgtgagaacttgcgtctgcacgtcaaggtcaacacctcaggtgggagggccggcctgggctccctggtgactggataacccacggcagtggagcctcaattagttacactcctggcgtatggtgtgatacaaagggacaaccagctcggcccaccaccacaggcatggcagagaccagannnnnnnnnntggcagtggagcctgaatttgttacactcttggcgtatggtgtgatacaaagagagaaccagctcggccccaccaccacaggcatggcagagaccagaacgtcgtacatcctttccctggtaacccctgggtcagccctggccgacacttcctcgatcctcatctactgtgcctttcgacacgatgccgacgttcttgcagcaaaacttcaggctatcggccatcgtgccaagtcttaccacgcaggaaaacactacaaggtaagtgttaggttggggttgggagtctgccggtgtttataggggctgacgagatgagggcatacttacagaggtacaatcatgatcagagcaatctctctaaacccctcatccccctgtgtttctgacaggaaagggctgaaatcgaggcagacttcagggatcgcaagctgaagattgttgtggccaccattgcatttggaatgggcatcaacctgtctgacgttggcgctgtcatccatgccaccatgcctcggtccctggaggagtacgtccaacagatcggcagagcggggcgcaatgggagtcccgcctcctgttacactgtagtcgacgatggtgagtactgcacgctcaggtcactcaccagctctggccgcactacatcgtccgcggttgaggccttgctagaacatgtcttcaaacgatgggcagaggtccatgagaaggtgactaggctggcaggggctgggcgtgcttacataaggacgtcgtagtaatgcccttgttaccttcttcggcacccccgaacatggctacatgcaggaggctgcttccgnnnnnnnnnnctgcttacataaggacgcctagtactgcccttgttaccctcttcggcacccccaaacatggctacatgcaggaggctgcttccggctgtttcggtgtccttgacctaaaacaagtctgccggacgatggacatcggggaggatgctgtagaatccgttctcagccacctcgaggtgagaggaggggacacgagtgcacactgagatttcgagggccctgtgatcatatcagtgactgtgggcgtgtttctggctcaagtcatccctgggctcattacatgctggacggcatgacattgcctaccttccacagatatccctgcccgaaatatttcgcctcctccccaagacgggcatcaaagtcaaggtctcctttttcgctgacagcgccaaaagccttgccccacagcacccgagtattcaggtgcagccacggttggcaaaggggcgtgaaattgagggttgcaacgtccttattggggctgcgacacatgcaacctagttgcttctgcaccctcctacatccacgacatcactgccnnnnnnnnnncccaggcgcttgtgacactctgcaagaatccccgcaacggcatatactctgtgtctgtcggcaaattggcgtcgttccttgcctgcacccccagcaaggctcttgtcagtttgcgagaattagctgcacgcaacctcgtcagcctggagatgtccaagcaggagggcccagcctttgagatcctacgaacgcccccggccccagcctctctcacaccagcgttggcagactggctggagcggggggtgaggaaccaagcttcacagctcgacatcgtgtacagaaccttcagccaggccgctaatcacaggctggccgaggcccaggaagtgagcctcaggcgagacgtggaggcttactttgagaatgccagcgtggaagctgccggctgcctgcaaccccacgagggagtcccgcttcccctgaggcccatcaccaaggacgtcgagacctccataaggctagtgctcaggacgctagctggccaagaagctaccaagcttcaaggcctgacggtggcccgcatgctgcttgggatatccagtcctgccttcccggcagacgtgtatcggcggaagctgcagggcttgtggggctcctgtacgaacgtctgcgcttgggaactggagtgcatggcaaccagaatctgcacttcacaggtgctgtaaagaatccgcgcgctcacggggacattcgaatccgaaggatcgacaggcactagggcgcggatcgccatctcgtccccgcgctggtcgtatattagttctgcattaccaggatactaaaaacacgcatgtctgaccaaatcgtagcagattagtctgcttgtcccgagagtatgtcgggggagcagacattcgacaacctcgccatgcacgccggtcacccccactacgacgagccgctcagcatgggacccgacgccgtagaccaggagacattgtgcaagggatctttcacttgggccgctgctctgactgccgattacgatcgccccggtggtgagttggggtgggtcggtccctatttgagaggatccctttcaccccctcaaagccgcccacccgcggattccactcagatgaacggcaaatccatcggagatggacgatggaggagcaggtgacgtttttcagggtgctccgcgagtccataggacagaagccggagaccttgtgcatcaagttggcacgccagatagagcacaagcagtacaaccaggtcggcaaaaccaagacaatgtgttaacggccatatgcctgcccatttgaagtcgaaatcgcaacccactgatcgtttgccggtcatcgacgcaggtccgggactactattatcgcttgacgagacgtctgcgagcggtgttggaccctagcctagacctgaactcggccactcaagtgcagctccactgggcgatgctgcgactttgggatacggtgaggacagtgctgcagcgtgtgttagcctggaggacttttccaacaggcagacagtgcatcaagcacacaagaccacagaaccctgcgctaataggcaaattgaaatcggaccttacaggcgcaagactttgacattcgggacatgaacatgaccaaactgtgcaagacacctaaaaagatgagggagttctccaagatcgtctctcaggtaggatgagatgtgttatgctagctctttttctaggcatcgctgagattaatatttcagactcgacttcagtgccacccacctacccatagaaagtcgcaagcattcttaagagcagacaagtgaggtacagtccgcacgagggccatctgcaagagcaaacgatcgatacaccggtcaccgaaagagcagcggatcaggtggcacgagatcctctgcgtggcgccgcagcaaatttcccaagtgttcaaaggagttcagcaccaacgggatcagtgctgggcccaagtgaccgggtcaatcagcttcccctaccacgagctaggaaggtcgatgcaattcacacacagcgccctcaacagggattcagacagcctgtcgaccgagtaagtaattggctggctttggatgcatgaatgtactacatccctgctttacaccctattgcttcccatgcagaaggctgtccgtactagatttcgnnnnnnnnnntcagggattcagacagcccgtcgaccgagtaagtaattggctggctttatatgcatgaatgtacgacttccatgctttacaccctattgcttcacatgcagaaggctgtccgtactagatttcgagtgcaattccatccaatgtaccaatctacactgatgcaaatggaagctttaggaaccaatccctatctggaaatatgctgcgggtgagtggcttcttcctgtttggtctggacagctacatattaccgattctgccttgattgatcagctgcggctctaagtccaagaaaggagcttacgaatactgtaggctctctacaaggccttaatttcaacattcaatcaaatacaggcccaagaagacgatatattccatcttgctacatttaagtagcaagtggaacgaagttcggacgtccgagaatgcagatatatacatctcagccgcgagaaacgataatggagccggtgctgaggaatggtccctgtacaacgtctcaagagaggccaaggtgagtctcacactgcatagtatgttcgaacaactgttctctggatgagagactgtcatgtcaatttcgaatattaaatccgacctgtagatgtgtgacattacannnnnnnnnnaaacaactgttctctggataaacaactgtcatgtcaatttcgaatataaaaatccgacctgtagatgtgtgacattacacacgaatgtggagaagcacacatcgtccagtttctctacagatggggctctaagaccgcaggtgaggctcgcttttccagcttgatgtaatctagaccaccaaggatgagtctcacagctttatatcctttgcaggtcaaggcgggtctgtggatcagcgcattactgacagctacgactctgaggccgtcgatgaggtgcgatattacaactgtgattgcttctatactgtgcgcatcgctgcggacttgccggatcaccaacatctcgggcagaatattacaatagcaggttgcgtgctcactgaagacagtacgcagttcattgttcgctctcgcccttccctactttaggcgcaacctgtagtagaagcagcaacaacaccaagagagacggaggaaagcatcgaaggtaatgggttgtctgcctgaaaaccatgcggcgcctcgaaggtgcttgtgaatggccaggcttctcattggtcctccatttatcgccgccttgtcttatgattattctctctaccaccaggtgtagaagctggcagctcatctcctcccacaacaagtttacataagaacggtgaagacaatggtggaaaccgtctgatgcaagaggacattctccatgcgggcaaccatttgagcgcagaacagccgttgggaccgtttcccttgtctggaccttctcagtatgcgcacggggtcactccaaggccgctatcttcatcagcggtccctccgctcaccatagatgggcttaccctgggattcgagagtctgctgggaccaataaatccttcatggcttgaaaatctccactccaaccagcctttgctgccactaggtgacagaccctttgctgatctattcaagggcacttcctgagcctatctcttccctatgacgtctatactcgcattaatctnnnnnnnnnnatgcctaaaaaccatgcggcgcctcgacggtgcatgtgaatggccaagcttctgattggtcatccagatattgccgccttgtctaatgcttattctctctaccaccaggtgtagtagctggcagctcagcccctcccacaacaagtttacataagagcggtggagacaatggtggaagccgtctgatgcaaggggacattctccatgcaggcaaccatttgagcgcagaacagccgttgnnnnnnnnnnccttatcccttcacacttgataaaaatgtacttgatgatgggacatgtgaaatccaggttgctcaaaagtgcgtccaggccaaaggtgttggggttgagtgtcatttgagatcatcgcaccacccaaggtcgctcggtactgattctnnnnnnnnnntcttatcccttcacccttgataaaaatgtacttaatcatgggacatatggaatccaggttgctcaaaagtgtgtccaggccaaaggtgttggggtggaatgtcaatttagatcatcacaccacccaaggtcgctcggtactgattcttcttttttccctcgggcgtaccagtaaaattagtaccgacaatgagcacttagataccgtactgtcccaatccttaaggtagaaagcgggcctgttttcggctccaacttaaaggggagggcaggtgtgcagtggctcatcgaagagtgatgtattatacgcgtgagatgccttcttactgcaagcgctggtgccagccagggtctttgctagcatgcgctgtcccttgtgacgagtttgtcnnnnnnnnnngccaatccttgagatagaaagcgggcctgtttttggctcaaacttaaaggggagggcaggtgtgcagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctgcttcgactggatgaggagatagagaacatcatcattaattgatgagttcgcacgcataatcgctcaactcgtcatggtcgagcatatgccatgcagggcagtctaacaaagtaatcgttaaagaacctactacaacataaaacgatggtcgtggtgagaacagatatacatcatctcgtagaactatgtgaatgcaattcgtaggggctaagcactcgctcgaagggcactggagcccttatcctagtcctctggtctcataccgatcctgcactcagacatatgcctgtaatagcgaagctcataagagtatgcacaaatcacgaaaacacgtcgatatctgcagaattctaactcttcatgctgaattcatctgtgcgatttcagaagtaagtttgcagctcttctgtcggttgtggcgtctgcaacctggcaacctgttctccagacaatcgtaatggacagcaaagttggtgcctgactggtagtcatatttcttactaaggattagcagaaaactttcgaatgccacacatattctctcgatgagtagtgctacagcaagcatcgggtggacgacaagaagtcgagcaaccggtcacaatggaaaaattccatgcttaaacgtcatcattgctcaccaagcagtgagagtaacgcccaaacctatgagacgtcatcgcatgcttccgtttaccgtgtgaaattgggtaggacgtgcctctgagacacccgctgccaagagtgaggtttaaggactgcatgagtccataaaagcaccagctaggagga

SEQ ID NO: 26890 - DNA, 123 bp, Chlorella protothecoides
ggggctgcggcagcatgggttgcagcatgcgtggtgtgtttgggaggctcggtcctgaggatggttggcagatgagcttgctacattacaccaggtattgatgcccaggaggttcaaggctcc

SEQ ID NO: 26891 - DNA, 145 bp, Chlorella protothecoides
accccacccccctttgttacaacatccccgccgccccccacacctgcgcgtgcagttggcgccggcctcggagcagaccacgaaggcggagccgcccggcagcgggccgcacagttcctcatttccggggcgcacgaccaggcgc

SEQ ID NO: 26892 - DNA, 79 bp, Chlorella protothecoides
gaggtggtaaatcacatccagagttgtgtcgatggatgcagaacccaaggtcatgagagcaagcatgccacaggacttg

SEQ ID NO: 26893 - DNA, 128 bp, Chlorella protothecoides
tcttccgtcatatcgccagcttatatttatatgttcaacgatcccgatccacgcgtcgctgcatcccccgagactttggtgaaacctcccagcagtgaggacgagagaaggaaagcgcggcccaatcg

SEQ ID NO: 26894 - DNA, 100 bp, Chlorella protothecoides
ccacgcgccagccgccctgagaagggggggtaaccaaacgtctggccgcgcacatgcaagcgggggggatcacggcgtcttcacagggcataccgcaggg

SEQ ID NO: 26895 - DNA, 113 bp, Chlorella protothecoides
gaggactacagcgaatgagagaggcctgcgcatgcatcgtctcaacaacctccccctagctgaagcatgcacccatgtcctttccaatactggagcagcaggagcactttact

SEQ ID NO: 26896 - DNA, 195 bp, Chlorella protothecoides
aaactgctgaagtaactcgatattctcgcacattcctgacatgccctttgttcccacccaaggtcacaccgacgtctcagatatcattacgaagacatatgaatgtgtacatggagtggaaggacatgctttatggcccttgaaggtcacccttcgtccttgactggcagccttaggttggcaactcattcgaga

SEQ ID NO: 26897 - DNA, 61 bp, Chlorella protothecoides
gaagaaagattctgggtacggattgtcagggaattctctgcagggacagaagggctcagat

SEQ ID NO: 26898 - DNA, 70 bp, Chlorella protothecoides
ggcccgtccggcctcgcaactttgtccagaagttcaggtcgtcgtgtagtacaaacgacactgataaagc

SEQ ID NO: 26899 - DNA, 61 bp, Chlorella protothecoides
cgcgcacatcgctccggtcgagcccggggtacctatgcagctctctctagggccgacagac

SEQ ID NO: 26900 - DNA, 61 bp, Chlorella protothecoides
gatgacaccgatctctgcaccccgtgacgagaccttttaacaagcatgctttcctggcgaa

SEQ ID NO: 26901 - DNA, 87 bp, Chlorella protothecoides
ctcggtgtacgatcccttgccccagacccacccacatgctgatccccctacgcaatgttgcagttgcgatgggaggagcatgaccct

SEQ ID NO: 26902 - DNA, 99 bp, Chlorella protothecoides
ggcgcacaacgcggtggtgtcagcctccatgccctccactatcgtcaaggcgaggctcgcttggggagcatgttttggctgccacttgccgtgcccctc

SEQ ID NO: 26903 - DNA, 138 bp, Chlorella protothecoides
ggcgtcgctgtccatggccacaatcgagcgacggctgcagggctgcggtctatccttgcgcgtcaccatcaccgcttccccgtccccttgccaaatttgtacaggagctgctgtacgacaagcagaagctgctggcca

SEQ ID NO: 26904 - DNA, 160 bp, Chlorella protothecoides
gagagcaggtgggtgcgacactctccccatggagtgagggtgatcggtggcggaagagtgggactggccccagaaactgctgccgctgcaccggcgtgcggtcgacgccccgttcaagagaccggccgagcagcagcgtcgcgactgcagccctcctggt

SEQ ID NO: 26905 - DNA, 100 bp, Chlorella protothecoides
agaggggcgtgggcggggcggggccggccgacgcagcctcgccagcctcgcagagcgcacccctgagccgcaggtccgcaagctccgcagccagggtctc

SEQ ID NO: 26906 - DNA, 61 bp, Chlorella protothecoides
ctaacacgctgaaggacctggatacttaagagtatgacttccaaatcctgttggtggaccc

SEQ ID NO: 26907 - DNA, 61 bp, Chlorella protothecoides
ttcctgctgtcagtttccatcctccagacccccgtgcagagcaactcgatgccctgccaca

SEQ ID NO: 26908 - DNA, 90 bp, Chlorella protothecoides
tccctgcccctgctcctgcagcgctggtaatccctgcccctgctcccgcagcgctggtaatccctgcccctgctcctgcagcgctggtaa

SEQ ID NO: 26909 - DNA, 76 bp, Chlorella protothecoides
gtaagtatggggaagctgcagagcatttttttgtgtgtggggggattacacacgatcccaccaagccatatccact

SEQ ID NO: 26910 - DNA, 62 bp, Chlorella protothecoides
caacatgctcgcgagtgtcccgagtgttgggcccatcatccccgcgatcaaagggggtcaca

SEQ ID NO: 26911 - DNA, 61 bp, Chlorella protothecoides
aaccccatgtgcgggatcctcggcgggcgggtctttcctttcgtacaccggaagtctgaaa

SEQ ID NO: 26912 - DNA, 61 bp, Chlorella protothecoides
tatgatcgaaagatggctgacggccatgaatcatagatgcagccggtcccatcgccggcag

SEQ ID NO: 26913 - DNA, 71 bp, Chlorella protothecoides
gctggtcgaagagtcagcagagatcccgaaccatctctttaaaaagggaaacccgcatcgcttcagcctcc

SEQ ID NO: 26914 - DNA, 160 bp, Chlorella protothecoides
taccaggtgtcagaatgtgaggccactgtgcaagttttcagggcacattgtaagcgccgggacgtcacttgccttgtcaggcagtgcccattttaccgaccgaggagtaccttctcaaccttgccccatcccaagatctgcagatcaaggcctggtgcta

SEQ ID NO: 26915 - DNA, 66 bp, Chlorella protothecoides
ggcgaaaaagaagaagtctcctcccaaaactgccaaggctcaggcacaaagcatgccagccgagtc

SEQ ID NO: 26916 - DNA, 61 bp, Chlorella protothecoides
gcgccccggggcgccgcgctcaaccggccctgcctcctcatgctcaagggcatcggctctg

SEQ ID NO: 26917 - DNA, 75 bp, Chlorella protothecoides
ctctctgcctgccaggtcacccgtccatacagaccttcaatcgcgtccttgacaccccaatcccacagccatcgt

SEQ ID NO: 26918 - DNA, 96 bp, Chlorella protothecoides
agatggtgcgagcccgtgtggtgccgacatacactgcgaatacgggcaagatttgtagatccggggcccccatcctcgcatccgtaccttgcgcag

SEQ ID NO: 26919 - DNA, 70 bp, Chlorella protothecoides
gcaggagggggaggacacggaggacgccgagggtgacgaggagggcgcggcgagtgggagcgaggcggct

SEQ ID NO: 26920 - DNA, 125 bp, Chlorella protothecoides
cccctgctgctcggagtatctgccgtgaaaaccacgattaccgcgttacaatatcatgcttgctttcttgcggagcgcaggattatgccagggaggtcacagtatggggcaatcgtcgtggggtt

SEQ ID NO: 26921 - DNA, 61 bp, Chlorella protothecoides
atgatgagatcccagaagtcgctcctacttggatcaggacatttacattccagcagcattt

SEQ ID NO: 26922 - DNA, 80 bp, Chlorella protothecoides
cggctctgcagcttcctttgtgatagaatttgacggtctcgcatccgccgcctgcagtaaatgaagagtcattgacatga

SEQ ID NO: 26923 - DNA, 72 bp, Chlorella protothecoides
ccccccccccggggggtcatcccatcctgcagttgccaagcatgctcggcagtgcgccgtgcatgcaaggtc

SEQ ID NO: 26924 - DNA, 136 bp, Chlorella protothecoides
cggcgacgattgcgccgggcccaattgtcgttgccgagcgctgtctgtgagggtgctacgttgggacgcctctgatcacccgcacccccttccagagtgcaaagactgttttcagacccactgtactttttcttcc

SEQ ID NO: 26925 - DNA, 61 bp, Chlorella protothecoides
gctcggctgtacacaagcaaccagcctgagtgccttgcccacacccatgcagtggccggca

SEQ ID NO: 26926 - DNA, 64 bp, Chlorella protothecoides
gctgcctccgagttcgtagaggatgctcggacccgggcggcggcgctctccctcacaggcgcac

SEQ ID NO: 26927 - DNA, 61 bp, Chlorella protothecoides
gctcacccgctcttgtctgagagcgcgctcacgccagagcatgtgctcgctgcgatcacga

SEQ ID NO: 26928 - DNA, 113 bp, Chlorella protothecoides
cccctgggaagggagcctgccacaaacctttcgatacggagccactcttggtgctcatatacacaactcgcgataatctgcaagctatagaagcgagctctacctccagtgca

SEQ ID NO: 26929 - DNA, 61 bp, Chlorella protothecoides
agtcctgctcactccggtcaagtgtacattctgttctgcaaagcatgccctccgcgctgcc

SEQ ID NO: 26930 - DNA, 77 bp, Chlorella protothecoides
cagagaagaggctggaggggcccggctggcatcgtagcgatgagtggcagagaagaggctggaggggcccggctggc

SEQ ID NO: 26931 - DNA, 104 bp, Chlorella protothecoides
cacatcttccaggcggatcgagaccagtaactcacacccttgtgccacacctgcaggagaagctggagaagagtggtccgtttgcagagtatgccaatgtcaag

SEQ ID NO: 26932 - DNA, 74 bp, Chlorella protothecoides
caggcccagcgagggcgccgaggtcggggccgctgcgacccggcccgcggcgccgcaggccagcccgccggcca

SEQ ID NO: 26933 - DNA, 157 bp, Chlorella protothecoides
gtgtcgtgatggatttcgaaagcctggaaaggacacctaagcatgatgcgtcagcggaaatcctatgccatgtcggagaaaagcgatcattgatgcgatcctgcgggacagaagacccaatatccattcacttgagcatcacactaggaacaggaat

SEQ ID NO: 26934 - DNA, 61 bp, Chlorella protothecoides
acactgtgtgtctagatcacttcttggcggtcgcagtatattcacatacaccatcacgtgc

SEQ ID NO: 26935 - DNA, 79 bp, Chlorella protothecoides
gagaggctctgtgcggcggtggatgtcagcaaccctccgaaacgcttcttcatgcccaccccctctccccacgatcctt

SEQ ID NO: 26936 - DNA, 65 bp, Chlorella protothecoides
ccctcagtgtcgcacccgtagtaagccaggcgctcacaaaactcattgcccaggataaaagggca

SEQ ID NO: 26937 - DNA, 73 bp, Chlorella protothecoides
ccagaggccctgcgggtgtccaccagtccccccaaaccctaccccttgccttccatgctgggcatggctcggg

SEQ ID NO: 26938 - DNA, 74 bp, Chlorella protothecoides
aaggtgtaggtgaccctgctccggtctggcttgcatgcagcgctttcttctcccgtgtgatgtgttgacaatct

SEQ ID NO: 26939 - DNA, 75 bp, Chlorella protothecoides
ttccatcggggtgcctgcccgtgcacagggtgggaagtgatcgtcacacaatatatccatgcaagcagcacagag

SEQ ID NO: 26940 - DNA, 85 bp, Chlorella protothecoides
tcgtgtagccaggctacttggcgtttattgttttccacaatgccttttatgagtgtttgactcacctcgctctcccctgtcccac

SEQ ID NO: 26941 - DNA, 61 bp, Chlorella protothecoides
atgagcttaccttgcttcaccatactggtatatgctctgtgcacgggccgcattgagcatc

SEQ ID NO: 26942 - DNA, 104 bp, Chlorella protothecoides
gtttggtgtgaggtacccccactacaggctaggcgtagcgcatgtgtactgagccccattgcagcaccttaccttcccccacccccccattcgataggctgctt

SEQ ID NO: 26943 - DNA, 130 bp, Chlorella protothecoides
cctccctgaggaagcagctctgacctgtaggaaagactgaaatgagaaatttcatgcctgcagatgtgggcatcaaagagcaccaaagcccccagcctcggtgacccctcccccacccacctgcacaccc

SEQ ID NO: 26944 - DNA, 81 bp, Chlorella protothecoides
gaatgtggagctgcatgtggcctgcggggtgcgcgaaagcggggaaaagagcgaagatgggtcactcgcgaaggggagctg

SEQ ID NO: 26945 - DNA, 175 bp, Chlorella protothecoides
aggaaggtgcaaagatgcgtgggaagccgacggcgcaatatctacttgaacgcaagagaggcaagagtgatgtgccggcccggcaaaatttcatacatgcacaccagcccctggggcacgtcagggaccccgggaggccattttgatgccaccattcccaccgatcaagaaccct

SEQ ID NO: 26946 - DNA, 61 bp, Chlorella protothecoides
ccagcccgtctgcttgagctccaacggcttgctaatctgacggtcagatgatgaagctcgc

SEQ ID NO: 26947 - DNA, 61 bp, Chlorella protothecoides
gacaatgagggccttgatggccacctggggactgggtgagtcccacgacagcccggtctgg

SEQ ID NO: 26948 - DNA, 76 bp, Chlorella protothecoides
tgcaatccagctgaccaacctcacatgcaaggtcgccattctgaaaccccccacgccgcctcaccaatggtgggcg

SEQ ID NO: 26949 - DNA, 61 bp, Chlorella protothecoides
ggcgcggacgtagccgtcggcgccggcgtccagggacttgcagcgcccgtcggcggtcagc

SEQ ID NO: 26950 - DNA, 77 bp, Chlorella protothecoides
ccatctctatacatacactggtctccccccaccccgcccgcagcactgtccatgtgttcctccagtcaacataacaa

SEQ ID NO: 26951 - DNA, 61 bp, Chlorella protothecoides
tgggcatgctcattgaggggcgggggggggtcagcacggcaccagcgtcagctgagatgta

SEQ ID NO: 26952 - DNA, 67 bp, Chlorella protothecoides
agcccttgactgcgatgaccgtgggaaaggtgacagaaggcattggttgtttggggttgtcaggcca

SEQ ID NO: 26953 - DNA, 157 bp, Chlorella protothecoides
gggacacgcaggtcaggggcttggatggggtacaggagaggttggggatggaggatggagggggcatgtgtgtgtgtgtgtgtgtgaggggggaattgcacgtgacgtgcaaaggcaagcctgcgccagctgcgccatggtgccttgagtcagagtc

SEQ ID NO: 26954 - DNA, 61 bp, Chlorella protothecoides
gggggatcacaggtgtggatcactcgtgggtggaggggatttgtaggggcgagcgtgtggg

SEQ ID NO: 26955 - DNA, 61 bp, Chlorella protothecoides
ctgtctggtggtgtgattgtggatggggggtgggaggtgggtgagcaagcgcggctcctgg

SEQ ID NO: 26956 - DNA, 107 bp, Chlorella protothecoides
ttttgggggggggggaaatgcgaatggaggtgtaagcatgaggttgtattgccactggcaagggctaaaagttgcctgctgtgtcattttcagagtgattgctggtg

SEQ ID NO: 26957 - DNA, 119 bp, Chlorella protothecoides
ggcctggcctacacctggtgggtggacatggatgggggggttgagggggccgccggcgtctagaatggcgttgcaatgctgctcaggcagccgagcctgagaataggattttggacctt

SEQ ID NO: 26958 - DNA, 70 bp, Chlorella protothecoides
aaggccaatgctctactggcatgcgtgggatgtcccaacctcacttgatggagggtgtgggcctggtgtc

SEQ ID NO: 26959 - DNA, 89 bp, Chlorella protothecoides
catgctcaggaccaagcggcctgacattcctcaggccccgcgacccttgcccaggatttctaatatctcacacccaggatgcttgcccg

SEQ ID NO: 26960 - DNA, 138 bp, Chlorella protothecoides
gcggcaagcttctgaaatgtcttcatggtagttgcgcgatgcttgccaatctttggggttggatttaaattacttgagtgcttgtgtacacactgacttagcccgcccaagtcatcctcactctgcgctgggcgggcc

SEQ ID NO: 26961 - DNA, 106 bp, Chlorella protothecoides
ggatccggatccgtaaaccgggctcattttcctcaacgaatctatcagactaacacttaaaccctgtatgtactatgctaacaatacatattaagggttcatgctc

SEQ ID NO: 26962 - DNA, 63 bp, Chlorella protothecoides
gagggcttctgtgattgtgttttgatggggcttcgtaaactctcccctggtcaaggtctgctt

SEQ ID NO: 26963 - DNA, 61 bp, Chlorella protothecoides
ccccgcgagaaagccaggcaaccttgcaggtgaccgggagtctgccaactcaccatcctcg

SEQ ID NO: 26964 - DNA, 504 bp, Chlorella protothecoides
aagcccggtagcggcatatcttcggctcgcccgaagcatacgccgcatacgccgcacgtcgatccggtcgtggtccggtgccacctgccgcatggcgagcgagagaatcgaaatggatgtaatttgcattacccacaaccctgagagaatttaccgctcacactcaacatactctagaatcttagtagcttcagatctgtaaggtacaaaggcgctgcggatccggaatgacgtccgtggtgatcggatgtggtggttgagccacgggcatatgttccgccaggtgtgggtcccgcgccgcggtctttccgcaaagtcctgcttgagatgccacggagaacatgtcgtgtagccgttcccaatgaagattttctgtcacatcgaagctgagcttgataaccctttaatccaaagtaagccagctcccacggcgtgcatcccaacgacgccgatgtcgcgaccggttgctctgcttttagtgcacttggtattgctcatcgtact

SEQ ID NO: 26965 - DNA, 63 bp, Chlorella protothecoides
tcgagcaggctacagtcgtttactatcttgcgatccccagtcttgttgaaacagcgattgccc

SEQ ID NO: 26966 - DNA, 77 bp, Chlorella protothecoides
ggctggaggagctgaaccccaactcgctggcggtggtgcatggggcgctggccacccccgccctcgcggcggcgcgc

SEQ ID NO: 26967 - DNA, 63 bp, Chlorella protothecoides
gcgatggaggcgcaggaaggggagggcagcggggcgatggaggcgcaggaaggggagggcagc

SEQ ID NO: 26968 - DNA, 186 bp, Chlorella protothecoides
tcacatcgctcagcctctgcaaacgcaggagaatactgtgaatcctgcagtctataccttttgctagcatccatgaactgaaatcaaggcacgccgtgtcatatcccaccatccaccccaaccgcctcttctcatccagcgctccataccttctcagcgcccaggtgccactcatgaagagcatct

SEQ ID NO: 26969 - DNA, 61 bp, Chlorella protothecoides
tgggtgccgcaggatccttgctcccagcacacgcccgccgtgcccagggtgtgcctagaat

SEQ ID NO: 26970 - DNA, 80 bp, Chlorella protothecoides
cactgtgcaagaccaagctccaggccagcgccctcaggcgagtcacctcacggtacagggatgggaagaggccgtctggg

SEQ ID NO: 26971 - DNA, 61 bp, Chlorella protothecoides
gccatcacctaaaattcatacatcacgcctaccctggatgcgcaggcaggggcctgcggtg

SEQ ID NO: 26972 - DNA, 62 bp, Chlorella protothecoides
actagcaatcaggcttgctgtaggctggaccacacagccaggggcattgcgtggtcgcgtga

SEQ ID NO: 26973 - DNA, 61 bp, Chlorella protothecoides
cgatctcccgtgggacgactggcaaggtcgaacaacgcttgcggcctggggaaccacagcg

SEQ ID NO: 26974 - DNA, 128 bp, Chlorella protothecoides
gggcctggccggccgccacggccagcgacatcacggactggggggagagggacacggcgacgcgcaggtggcctcctgccctggcctcctccagcttccccagcagctgcgccgtgctctgggcctgg

SEQ ID NO: 26975 - DNA, 61 bp, Chlorella protothecoides
ccatggtgtgtgcgctacgtgatgcggcggggtgggtgcaaccagggaagccatggaggag

SEQ ID NO: 26976 - DNA, 64 bp, Chlorella protothecoides
agggggaaaacgggggtgctgggcggagacaagcgtgtgcagggcagggaggatctcatggatg

SEQ ID NO: 26977 - DNA, 74 bp, Chlorella protothecoides
gcgggtgagtgggtagttgcgtagggtggcccactgtgctgctagtaaacagcacacccgcagtcgctcccgga

SEQ ID NO: 26978 - DNA, 120 bp, Chlorella protothecoides
tgctggtgcagggtgggtgtcctctgtcctcaaatctccagcaagggggtccatacttcctctgatgtcgattgcgcaacccattcagtgagggtgttcccctcgtgcccctcctcaatg

SEQ ID NO: 26979 - DNA, 61 bp, Chlorella protothecoides
cgactgtgtggcaaggacaggcatcgggtgcagggcaatctatgcagggcaggcccggctg

SEQ ID NO: 26980 - DNA, 143 bp, Chlorella protothecoides
gagctggtgtggaccaggctcccctgtagggaaaataatgggcaggctccactcaaaatcgcacgcatgatgcatgggagcagcgcccaaggaatgatgacatggggagcaacgggatcgttggcatggtgtgccacccatga

SEQ ID NO: 26981 - DNA, 181 bp, Chlorella protothecoides
gttacgaagtggcgggacattccctgcatcgtagaaaaagggaaattgttgagtctgctgccgaggcaccggcgcgtctgtgcgatgggaagcttataatggagtcctgcatacacaataaccccgcccgcatgacacaccacccatcccctggccagaatcacaccacagaccaccagct

SEQ ID NO: 26982 - DNA, 61 bp, Chlorella protothecoides
ggcagcgttgccgagaatggggagagggtgtgtaggacaccggctgtaaagcaagtatgtg

SEQ ID NO: 26983 - DNA, 94 bp, Chlorella protothecoides
ccagcgtcgccatctgcccatgcctctccccgccgaccctcactccctcttcatcgcatccccataccacatcccaacgcaccgaggaacagga

SEQ ID NO: 26984 - DNA, 89 bp, Chlorella protothecoides
ggagtggccgaagcgggaggatgaggggaacgagtgcgcggaggagccgactgccggcaagggccccatgaaggcggaggaggggtcag

SEQ ID NO: 26985 - DNA, 269 bp, Chlorella protothecoides
cttccgggccagctacaggtgggtccccggggggtggagccgggggggtgaggggtcatcgggctgcattcactgtgtccagtggtgatgggcttgctgtgtgctctgggtgtcggtacctgcgtttgagatagtgtagaacgttgtcgaaacatcccgggggccctgtctggcacagtctggtggatgatcagacctgcaatactgccctcactccctgtcctataggaagctgggcaccctcaggtcccgctttccagaggtgccca

SEQ ID NO: 26986 - DNA, 61 bp, Chlorella protothecoides
ggcacatcctcgccctctcacctccacggttcaggctgctgagggagctggtggcagctca

SEQ ID NO: 26987 - DNA, 143 bp, Chlorella protothecoides
caggcctggtggacgacaggcacctggatcacggcgggtccagggccgccggcgccggctgcgttttcagtgtggcctgtggctcccacgtgcacctctttgccgccagctcccccgaggacgcacaggtttgggggagcaaa

SEQ ID NO: 26988 - DNA, 61 bp, Chlorella protothecoides
cattctcatgcgccttcgcatgcacacaccacccttgccactgccaccaagcccgccaccg

SEQ ID NO: 26989 - DNA, 215 bp, Chlorella protothecoides
cttgctgtcatccacgatggggatgcggtggatcttgtactgcagggagggggcgaccagggctgtgctgaggcatgcgataggagagcttcatggcactctcacagaactcgagaagctcctggtcgctcggttgagcttgcctcccagcacaatgatcacgtctgctcaccaccatccacccctacccaccacaccactcccatcccagcacc

SEQ ID NO: 26990 - DNA, 249 bp, Chlorella protothecoides
ggtgggcacgatgcgccggtaagaagcaggcgcgggcagggcaggggcaggaagaggtgcgagagatgggtctgcttcgtgcgagcgacatgggcaccctcgcagtgccctgcaacatgtagatctgttcagattttccttatgcttgtcctggagagagtcgagagcttcccctgacaccatgcctggtagagttggggtctcgttgcatgctggtgaaaggcctttcgaaacctcagcaggcccagc

SEQ ID NO: 26991 - DNA, 61 bp, Chlorella protothecoides
cttgcagccttgaatccccccttcctcctctgcctgcaggtgacaggcagcgtcttgtcat

SEQ ID NO: 26992 - DNA, 61 bp, Chlorella protothecoides
tggttgcggacgaatgctcggctggcggggaaactggggacgacacgcttggtccgtacct

SEQ ID NO: 26993 - DNA, 61 bp, Chlorella protothecoides
tcattgcaagtgatcacaacatatggcagggctcgtacttttccttgaggcgctccatacg

SEQ ID NO: 26994 - DNA, 137 bp, Chlorella protothecoides
cacgtgaggggctggggcctggagaggaggttgcttacatggtggtgtgggcaatgcctacaatgacagctggacgctgtgctgaggtcttgacacaccaccccccggggtatcctggatctctcgaccactccaca

SEQ ID NO: 26995 - DNA, 98 bp, Chlorella protothecoides
gtgagagggtggcccatgccctgcaggccgagccgtgcatgcataccctccctagctccaccaccggccccaggccgcggaccagctgcctcagcagg

SEQ ID NO: 26996 - DNA, 78 bp, Chlorella protothecoides
ccccgctgagacacctgttccgcccagatttcctgggggggcctcatcccacgacccttcaccctttgtccatggctg

SEQ ID NO: 26997 - DNA, 138 bp, Chlorella protothecoides
gcccaggctccgcagcttgtggctggtcccactgatcacggacgcacgggccaccagcatgcgcacccgcagcctacacctggtttcggaagaagacctgcgggttgcggccccgccctgcgccttggagagcttgag

SEQ ID NO: 26998 - DNA, 61 bp, Chlorella protothecoides
cagcccttgagatgcgtctgtggcaggggggggaggagggggaggtgtcgtgtaaggttcg

SEQ ID NO: 26999 - DNA, 61 bp, Chlorella protothecoides
ccggagggggtcaagcctccaccggactgcgggcgctgggcatggccctgctgcattcaca

SEQ ID NO: 27000 - DNA, 147 bp, Chlorella protothecoides
cggggtggaggggttggtgggcagctgagggtttctctcagggtttgggcccctggcacccctgtccatgcgccccgaggccagcctccgacctgagataggcccaacccccatctaaccccttcaggacctggtggccgactacgg

SEQ ID NO: 27001 - DNA, 4094 bp, Chlorella protothecoides
  modified_base (260)..(269): a, c, t, g, unknown or other
  modified_base (871)..(880): a, c, t, g, unknown or other
  modified_base (2452)..(2461): a, c, t, g, unknown or other
  modified_base (3885)..(3894): a, c, t, g, unknown or other
ctcttcacgctcagcctgcccaggtgcatggcggagatggccacctgtagggttcatgtttggaagagaggggtggatgagaggggcaatgtcacgctgtcaagggcacatcaccttgaaacacctttctgtttgcctggccgattcacgtgcaagtccttcacacccacaagctcacatgacggattgcccaccacccagagctctaggaaaacatgccgctgccccgccccccacctgattcacgtaggtgatggtgnnnnnnnnnntcacatcaccttgaaactcctgtctgtttgcctggccggttcacgtgcaagtccttcacacgcccaaaggctcacataacggatcgcccaccacccagggctctaggaaaacatgcccctgccccacccccccacctgattcacgtaggtgatggtgctcaggatgcgccaggggtcgatccagagctggcggtacacgccggccatggtggcgtcgatgacgaggaagggcagcatgcagaccaggactccgacctccagggccactgtgacctggccgcgcgttgtgcgcagcagcttcctcagggagtgggtgaggtcctcgtcctgtgggttgagaaagcgaggcggtcgggattcgaaccgctgtattctgactttgcaaaggggcctggtgctgggccttggcaccatgacccgccgcttcgccacccacgaatcccccctcgacatccaacgtggcagtcaaggctcgcaggctcggatgagtcttcaatcaaccacctatctactcaaacatcctgaagaactcattcccgcccacacctggaaggctatgatgaagccgtagaagcagacgagccagcaaacgtagagcgccnnnnnnnnnntggcagtcgggattcgtaccgctgtgttctgacttcgcaaaggggcctggtgctgggccttggcaccatgacccgctgcctcgccaccccacgaatcccccctcgacatccaaccgtggcagtcaaggctcgcatgctcggatgagtcttcaataaaccacctatctactcaaacatcctgaagacctcattcccgtccacacctggaaggcaatgatgaagccgtaaaagcagacgagccagcaaacgtagagcgccagctgaaggaacaggcgtcgcctcgcataatctgtccacttgaagttgatgattgcctgagggggggtgagaaaaggggctgggagaataaaggggatgatggcagcacagtaatccatgctcgatggtactcagcaggccacgccagcaagacccagtacctgtacggcaggcagtgaaaacacaaagtaggagcagcgctttgcttggtacctgcataggagcggacaggtcagtgaagcgcttgatacgctgtcgaatgatggagggcccccaacacaatcaaagatagacttccctgcagagcttacaaattcatcaggcagaccatgcattcccagccagtctggcatccaatatacagcatacctccggagaaggggatggagcaggcccttggtatctggattggctgcaccgcagatgggcaccacgaatgcctccacggtgagtgtggagtgccatcctgagagacgaaggtgagggcatcaggaagcgagaacatggtgactacgcccttgaagtactaccagaccctgcacgaggatgggggacctgcatgcagcctcagacatgtttacctagcttgtgcctgtccagaagactcacccgtcggttcaggcttgatgtgcttgcggaggagctgccgccattcccaggcagcatccagttgcatctcatcagacccaaaggtaagcatggggccatctttgaaggcagggtatatcagattctcctacagcagcagtgagcacgatggctcgggtccagagtgtctgaacagacatcactgcccatcaccctctatcccaaggccattcccgatggagagcgtcaccctctttgccgcacccaactcctcgccgctcacctcgacttcgaactcggccagcttgtgcattcccttggtttgaatgtacttcagcacctccgattgcctgtgcctcagaagtgaggttaccgtggaggttggtatggactggagctccgcctccatgtcgatactctcggccggcccttccatcaggaggcctgcctcaacgtctccatccgaaatgtcgtccattttcccctcgaagcaggtcccgctgccaaggtatggtcaaaccacaaatggtggctggcaggctcgggcaggagtatctcgttcgccggcccgttcgaataaacagcttctcggtcactgcctcagctggcggcccaacaacagtcctcgccctcactcgatggcccacttgcatttctgagagtggcagctttccctcctgaatccaccttaacaatgtctcacgaccaagcttgagacgctcggtnnnnnnnnnncggcaggagtatctcgtttgctggcccgttcgaataaacagcttctcggtcactgcctcggctggcggcccaacaacaatcctcgctctcacttgatggcttacttgcatttctgagagtggccgctttccctcctcaatctaccttaacactgtctcacgaccaagcttgagacgctcggtcgactgtcaacatacaatgcaacctcagttcccctttgctctagttcttctacagcacccctaaggctcagacccaccatccaagctatggaagtcgcgttcgtcagacctggcctgcatcagctggaacaggtcttcctgctgtttcagcaccctcttcaagtccgcctggacctgcagcaatgcctcgacctgcatcccgccgcctgccaccccagcgtctccattcgccgcactccgtgtggtgccctcctccccctcactcccgctgccaaggtgcacccctccacgatgctgcgtctgcaaccgtttagcagatcgttttccgagctggcgggagagttggtcctcctccacctgtgcttgcaagcgcaggggcgttgtgggggatgggacgacaggtcagtagtgctcccgcaagtgcctgtctacaacaggctggaagtgccggccgccgcaagctgggcctcgcttcgcaggaaaaacacctccgccctggcatgcactcaacctctgcacctgactgagcttctcctcgtgaacagaaagaacgtgcacgtagcggggatggtactcggtccggcgcgcactcatgtagctgcgggcgacactgagcagggaggccgtgttttccacctcatcgatgaggtaggcacgggccaccatctgcttggcgtcggcatgctccatcacctgcaaagcagggtcgagatatgcgagtgtccaggctgtgcctcgggtgatcattgagggagatggaacgagagatccccagctggatgactctggcgatggcgccgcaggtcactcatgcggcaccccagagtgcactcggcgccagttctcatcaccaaattcctcatgtcaggactggccttacccggtccagactgctgatgatgacaccaaccatgaggtttgccaggatgaatccgtccacaaaaatgtatgaaaccgcgagaatcgttccaaaaacctgcatgtgacacatgtgtgttgggatggtgcgcccgaccatgcttgggcgacctagtatgtgacattcattgttgggccctcctccctggcagccaaccagggcagccggtctcaccgggagggacttggcggagtagaactcttcgagtttgatgtccccgtgcacatgctcatagatggtcaggaaggacttccagatgttcccatacccctcaggctctttgtcggccgtgcggaaggtgatgtggaaggcggcggcgtacnnnnnnnnnntcccggcagcctaacaccgactgatacacaccaactcgtaccggcatggatttggaggagtaaaagtccttgagctccaagtcgccatacacgtgctcatacatggtgaggaaggagcgccagatgctcttgtactcctcgggctccttgtctgcggtccggaaggtgatgtggaaggcggcggcgtacccccccatgac

SEQ ID NO: 27002 - DNA, 75 bp, Chlorella protothecoides
gtggaaggcggcggcgtacccccccatgaccaggaagaggaaggcgaggagccagctggtatcgcagatgacctc

SEQ ID NO: 27003 - DNA, 61 bp, Chlorella protothecoides
ctcctcttgatcgttcacgatcatggcagggggccatctccggcatgcacctgggcaggct

SEQ ID NO: 27004 - DNA, 63 bp, Chlorella protothecoides
ggttgcggcgccagcgtgcagacagggagcaccggttgcggcgccagcgtgcagacagggagc

SEQ ID NO: 27005 - DNA, 93 bp, Chlorella protothecoides
tggtgggcagagtctgcatcaggtgaccccatggccttctggccttactcaccaccacagggcgcatcgcccacctcagcccatcctgccccg

SEQ ID NO: 27006 - DNA, 61 bp, Chlorella protothecoides
cgttgccacctgaaaggccatgcccgcccagctgcaacctcccttcaaccatgcgcgcatg

SEQ ID NO: 27007 - DNA, 73 bp, Chlorella protothecoides
ctccgccagtgagcgcaagtcacatgtccttgggcgtctggtgtatgagcagggccgggatggaggcgtccct

SEQ ID NO: 27008 - DNA, 79 bp, Chlorella protothecoides
agcgccactgtacccgatggtcatgtcggcgataacccgcagcgccgcgtcgtcgttgctgcggtccacgggcttgccc

SEQ ID NO: 27009 - DNA, 72 bp, Chlorella protothecoides
aagggagcggaggtggggtgggattcgagcgctgggtgtccagtgtgggtcgtgcaaagctgcacaacagat

SEQ ID NO: 27010 - DNA, 85 bp, Chlorella protothecoides
aattgcgagaaaggatgtgcacaatgctgcatggccactgttctttctcatgctcggtcccgtgcctctgtcaagtcgccatcag

SEQ ID NO: 27011 - DNA, 61 bp, Chlorella protothecoides
cgcagctgcgtctcgggcatggctactgaggcaaaatatgaagacttctacctacatattg

SEQ ID NO: 27012 - DNA, 75 bp, Chlorella protothecoides
tggtgcaggtgccgcgggtagtcgagcattcatgttctgggatttgcaaggcgccgattgctcattcggaagccc

SEQ ID NO: 27013 - DNA, 102 bp, Chlorella protothecoides
ttgatagtaatggaggtgcttctggggcaaggcagtccttgcactgatggcaaatacgcggcagtgttcaattcgccgaagcactgtaaaagatcccctgct

SEQ ID NO: 27014 - DNA, 148 bp, Chlorella protothecoides
ctaggaatgagagcctagtcagaggagggggcgattagtttcctggcttgtgtctcacacagcatctgttttctgtggtggacaacgattacatcgactaggctgctgcaaggctaacatagttgttgaaagcatcattgagcagggg

SEQ ID NO: 27015 - DNA, 116 bp, Chlorella protothecoides
gcatccagggggcgctctgaccgcctgacgctgcacgccaagccccgcagcacggccaagcgtagctgacgcggcacgcctgctgccggccggcgccccggagccatgcctgcggg

SEQ ID NO: 27016 - DNA, 117 bp, Chlorella protothecoides
aggggaatacaggtagaaggcaggtccttctaggcaacagctttccatgctgagcgctgcggttgcatgtcacatagtcacaattttcccccaagcattcccctggcctgcgttcaa

SEQ ID NO: 27017 - DNA, 121 bp, Chlorella protothecoides
aatgtggtcccggacagggatcagcgggggggagccgacaccgcagctttcctggtgcaggtcatgacacacccggccactgcctggtccagtgataccacaaagccacccacccagtgat

SEQ ID NO: 27018 - DNA, 78 bp, Chlorella protothecoides
agccactccgtcctcgggcttgggctcgtctgtatcggggctgggggcgggctcgtcctcatcctctggctccttgcc

SEQ ID NO: 27019 - DNA, 61 bp, Chlorella protothecoides
ttcagagtgccaataaatcaagcaagtatccagagacgccaggccttgcagcaacaatatc

SEQ ID NO: 27020 - DNA, 571 bp, Chlorella protothecoides
acgcccgtggatgctgcgacggtcaggaaggcaagggagggcccgcagacacagaccccggcatccagggggccctgcccctcgcaccgccagacgacgtcgccagccggcacggccaggcacgccacggagccgccatgcgaacaggcatacacgcggctgccgagcaggcaggcgggggcgtcgacgcacatggtcaacgcaacccgccatccctcgaccaggagcgagggaccggcccgcgccggcgccccgccccagaccctggccccctgcagcgcgggatggaggctggagctggccggctcggcatcgtgcccagaacagggggcgaggtggcgtgccaggccgcggatggtggggtcggccaccaccacggccgggggaatccggagggaggccgccagcgccgcaatcgccaggctgtcggccccagccaggatcaagtcctcgcatgcctccggggcacgtcccagaactgctgcgacggcggcagccacgccggcctctgtccaggacgccgaggggggcagcgcgccggcatcgccgcttccccgcccagccacggccg

SEQ ID NO: 27021 - DNA, 128 bp, Chlorella protothecoides
ctggtccggggggatgccctccttgtcctgaatcttggccttcacgttgtctgcaggatggcgagtgcaaacggacggtggccagtccaatgccgcaaagactggagattgacagtccgactccaaaa

SEQ ID NO: 27022 - DNA, 117 bp, Chlorella protothecoides
gcatcactccagtgtcgtggtgtcatgcacaaaccagatgcctccaccccaaccccccacccccacaaactaaccactcctccaccctcatcacctggctcgccacagacatccaga

SEQ ID NO: 27023 - DNA, 69 bp, Chlorella protothecoides
acggcatccggcagcggtgctgatctacatccagccagtaccggggtcccgctggggctaccaaggcta

SEQ ID NO: 27024 - DNA, 84 bp, Chlorella protothecoides
ctgggcatgccatcgtgacgatggctcaaatatttggacctgaggtcttccaaacgttccaccctccacatgcttcacccctcc

SEQ ID NO: 27025 - DNA, 101 bp, Chlorella protothecoides
atgggctcacttgcaaatgaacaaaggaatacaaaggtgcagcagcaacttcagataagttcttcctttcatctgcgcatggaactgaatgcagctgagta

SEQ ID NO: 27026 - DNA, 63 bp, Chlorella protothecoides
gggcccaccaccagcatgccaacacaccgtggatggcgtttcagcgaccagacgctcgcagag

SEQ ID NO: 27027 - DNA, 72 bp, Chlorella protothecoides
tccaacccccaccctctccaacccccacccccatcatcatttcttcctttggctcacccaaccttgccaacg

SEQ ID NO: 27028 - DNA, 129 bp, Chlorella protothecoides
gggagcggctatggggggtggaggagaaggagggggagaagaaggagggggtgatggaggaggagaagtagcaggaggcgatgggaaaggaggagaaggagcaggaggcgatgggaaggaggagaagga

SEQ ID NO: 27029 - DNA, 97 bp, Chlorella protothecoides
ttgaggcactccacgctcacaatgatcttggtggaacgcaccttgatgacctcaaagggactcatcatgatggcaccgacggaaaggccgaggacat

SEQ ID NO: 27030 - DNA, 98 bp, Chlorella protothecoides
ctgtcgagccggaacggccgccctcgttgctcccttcccttcacaacgccctcctgctccatctcatgccacagatatacgtcccgcgcctgcctggc

SEQ ID NO: 27031 - DNA, 113 bp, Chlorella protothecoides
cagcagccgcttttggcagctggatcgcggctcccttcttcttgggctctggaagagtcggagccgggccacccagggtgcctggagccgcaagtaccttcttgctcttcctg

SEQ ID NO: 27032 - DNA, 119 bp, Chlorella protothecoides
aggaggagggggggaggggggggagatggtgatgggatgccatcccattgtatcaggggaaatggcaggttccatgagcctcctgctgcagcgccgaccattgcactgcagtctgcatc

SEQ ID NO: 27033 - DNA, 68 bp, Chlorella protothecoides
ggcgagcaggtgagtcctgccgtcgcggacttgggggagcagaaaacggtattcgaaggtatagtaag

SEQ ID NO: 27034 - DNA, 73 bp, Chlorella protothecoides
agatgtaagttagcagactatagatcattttcaattgcgctctctcactccagctggacgtcctggagatcat

SEQ ID NO: 27035 - DNA, 61 bp, Chlorella protothecoides
gcctccgggatgagccagggccactccaccaccctgggctgcgactcgggcctcttccgcc

SEQ ID NO: 27036 - DNA, 61 bp, Chlorella protothecoides
cgccggtttcgggggtgcttccgccactccccccgccgtgcatgtgcacgcatgtatctgg

SEQ ID NO: 27037 - DNA, 76 bp, Chlorella protothecoides
cttgcgcaagatactgtagaaccgaaaataccgaaagctcctgatccctacctcagcagcagcgagcctgtccctg

SEQ ID NO: 27038 - DNA, 362 bp, Chlorella protothecoides
  modified_base (104)..(264): a, c, t, g, unknown or other
caaccgactcagagtgtgggactatgtgtacacctcggatcaggtacgagaaaggtggacactcgaggggccaaggggtctggaactcaagagggaggggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgccattcacagtctgcctgggcagccagggatgcactcctcttggggatggacatcgccaggcttcattcctgcagcatgtcaggctgcatcctg

SEQ ID NO: 27039 - DNA, 294 bp, Chlorella protothecoides
ccattgatgagatggagcgccgcgcggagcagtatggccttggtgagtggcttggatgggatgtcgggccaggctggtgtggggggttggtggaaaatgggggttgctttggtgcttcctgatcaacagttggcctggggtagagtcgcgtttgggcgtgacctcggtttgcaccatgtgcttgttgctggaggctacatgtgctggattgctgttggctcatctctcccttgcagcattcctcaccctgtcccactgccacggtgtcgtaggaccctcgtctcgccttgctgc

SEQ ID NO: 27040 - DNA, 136 bp, Chlorella protothecoides
gttcggcttttgagtgggatgcattgcaacgccccacctgttgtgcttcgaacaggggtgcaacccaaacatcttcttttgcagtgcagggtaagccccctaggctatctgctatccgtgcaaagaatcgccatca

SEQ ID NO: 27041 - DNA, 105 bp, Chlorella protothecoides
cgcctccgagtggtcgtccagccacagggagtactgcagagttgttttgggggaaagaaatggcattctgagacgggtgatggagtgggagcctgcctggatggc

SEQ ID NO: 27042 - DNA, 61 bp, Chlorella protothecoides
aggcggtggtcaccgtgcccgcctacttcaacgactcccagcgccaggcgaccaaggacgc

SEQ ID NO: 27043 - DNA, 193 bp, Chlorella protothecoides
gcttcagtttggaggctttgaccaaagctcgcccctgtgatgttgtgcaatatcaaggctggatcccaattcttgtgacaccatcaagcttcggcgtcaaagtatgtgtaaattccctggacacatatatattcggtttcacccctggagcagctggcgaagatcaccacaatttggggtccactcacgtcat

SEQ ID NO: 27044 - DNA, 61 bp, Chlorella protothecoides
gtggcagtctcctcgatcttcgtgccccactccaagcagccattacttttgctctgcagtg

SEQ ID NO: 27045 - DNA, 69 bp, Chlorella protothecoides
tgcgcggtgtgcccccgctactcgaacccttggagggccccttcaccacggccgacatattggttgccg

SEQ ID NO: 27046 - DNA, 77 bp, Chlorella protothecoides
caatttcggtcaccacagctatgcaccccgatacccactctgtcaacaggtaccagcccgaccccacatatgctccg

SEQ ID NO: 27047 - DNA, 267 bp, Chlorella protothecoides
cgttgttgattcaccctccacttcagctcggcatccagagagaactgcgagatggggaggattgggcgtcatgcctcttctctctgtgagaggataatcctgtgccagaggttgaatttaggctttcgtcctccctcagacaaccatccgccttacatcattgggagtctgaatcagccaaatctcttttccatggccgtcacctatcaactctgccatgtctattgtatcggtggccggagcatatgtggggtcgggctggtacct

SEQ ID NO: 27048 - DNA, 61 bp, Chlorella protothecoides
gcatcagatcgccctccaaactcgcgagttcatcagcttttcaacctcccaaggctgtcgg

SEQ ID NO: 27049 - DNA, 158 bp, Chlorella protothecoides
ggtacctgcgtaccctcatcaggccacggggcgaggaagagggcgcgagtgtcatacgtcgagactgttgaaggggcttggggagcttccaaacgtgtgttgatgcatcaggaagtacctactacaatacacagatgcctgcagcatgctgacaggcc

SEQ ID NO: 27050 - DNA, 61 bp, Chlorella protothecoides
ctggcatgggtgggtgctggctctcaccccgcccccatcttgcaccctgcctgcccatgaa

SEQ ID NO: 27051 - DNA, 73 bp, Chlorella protothecoides
gggttggagtgtcgctgggcaggtgggtcaaggccagaggcaacctgtgagagggacctgcaccctcaccttg

SEQ ID NO: 27052 - DNA, 61 bp, Chlorella protothecoides
atgcggtggtatatgaaaattctctggagatggcagccgccgtgatcataggtgagtggcc

SEQ ID NO: 27053 - DNA, 74 bp, Chlorella protothecoides
ttgtgctcgtcttctgtcgccagcattccaagcggcttgcaggatgattgattgcaagccaacccgatgattgc

SEQ ID NO: 27054 - DNA, 190 bp, Chlorella protothecoides
aactgccccgacgtgaccatggccgagaatcggcatggaagggagggccgtggggaggggggtcggatcgatggaaatatgccgtccataagcatttaacccggtctggaaatgcaaagtcatgtgctatcgcctcgtgattgcccatgggatccgacatataagtaggtcctgccgaccgacttcacgc

SEQ ID NO: 27055 - DNA, 148 bp, Chlorella protothecoides
gtacccattcattctaggctctgtacaagacgtcaagacgcatgccaggatgcgacgaggccacagtcacaccatgtgaaggccgagtggggtgctttgtctcgagagaaaatggtacggcatggtcctggatgtggacctctgcagc

SEQ ID NO: 27056 - DNA, 69 bp, Chlorella protothecoides
aatattctcttggctccgctttggtgtacacgcaaggttataccctgaaggaggtggtgccgctggttc

SEQ ID NO: 27057 - DNA, 238 bp, Chlorella protothecoides
ggagggggtgggggccgaggcgcctggggttgcgaggaaggggcgggaggagctggaggagttgaagtggggtaagaaggccaggcggcatatgtgcactgcaagtgtctttgtgaggaggggaggggacaccgacgacgtccgagcactgcatgtgcaagaccgcctctgccgcccctggctcccaccagcaaacgcacgtcgtggctgcacggctccaaaggcctgctccaggctg

SEQ ID NO: 27058 - DNA, 61 bp, Chlorella protothecoides
gtgagggaaagtggcttgggcagtggctggggacatgcagtgaacggatagagtggtattc

SEQ ID NO: 27059 - DNA, 2348 bp, Chlorella protothecoides
  modified_base (128)..(137): a, c, t, g, unknown or other
  modified_base (623)..(690): a, c, t, g, unknown or other
  modified_base (1307)..(1479): a, c, t, g, unknown or other
  modified_base (1600)..(1609): a, c, t, g, unknown or other
aggggagggtgggatctaggtcgcaccgccccccgcccagcttgcgaccgaccgccccccgcccagcgcacccgcgaggccacgactgcccccctcgttcctcccgcatccctcaggcctgcagcgcnnnnnnnnnnaactggtcggcttgcgaccaaccgccccccgcccagtgcatccgcgaggccacgactccccccctccttcctcccgcatccctcaggcctgcagcgcggcgagcgcacggtgcccacagagcggccgcaggccatgctcacggccgccgacctgccacgctgcgagctgtccgactacatcgaggcgcgcctgacgcgcacgatcgcggaggagagggcggcgcgcgctacggcgctgggggtgcacccgtccaccgtccccaccgcccatgggatcacaggtgagagggcgttccgctggggtgggatcgggtatgaggcgggggtgtgcctggtggcggcagaatatcaggcgcgaggcttcggcgccggcctcgcccaggctctggagtcttggaggcgaggatccccgccgcagcaccgtgccatccctgcatccgcaaccgttctgctgcctgtacagtgccctttgttctcccatccccnnnnnnnnnnnnnnnnnnnnnnnnnnnnnnnnnnnnnnnnnnnnnnnnnnnnnnnnnnnnnnnnnnnnccatccccttcacacccaccccacacacacagtgcgtgtggtgaacaacgtgaccaagaagaacgaggtccggcagcgcttcctggacgcgttccggggggagggctaccccgaggccttcatgtaccgccagaaggtcctgctcctgttccagaaccgcgatggcgtggacctctgcgtctactgcctgtatgtgcaggagtacggcgacgaggcgccggagcccaaccgcaagtgcatctacctctcctacctcgactcggtcaagtacctggagccggaggaggtgacggcggcggggcgcggcgtggccttgcgcaccatggtctaccacgaggtcctgctgggctacctggcacacgccaagcagcgcggcttcctgcagatgtacatctgggcctgcccgcccctgcaggttggctgatctttttgtgagggggtgggatgggagttggtgtcttgctgagtcagttcggtgggggcaaggcagtgcctctagaggacaagaagatgcggtcagtgcataacctgcttgcagtttgcacaccttgcattgcgaccgcacatgacaccgtgacggtcctcaagcctactgagacccacaccacactcctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtttggttgcgtcctgcctttgctggttcgcccacacaggtctgaggggcacgtcgcaggtggccaaagcgcctgctgcgcccccttactccccatttcaatgccaggctgacgtgcnnnnnnnnnntttgcagtttgcacaccttgcgttgcgaccgcacatgacaccatgacggtcctcgagcctactgagacccacaccacactcctcggtaatcccagggcgatgactacatcctgtactgccacccgggcaagcaaaagacgccccgcagcgaccgcctgcgggagtggtaccacatcatgctgcgccaggtgggatggtgtctgggtggagagtggggaagagtggcgaggttttggttgcgtcctgccttcgctggatcgcccacacaagtctgaggggcacgccgcaggtggccacagcgcctgctgcgccccctcactccccatttcaatgccaggctgacgtgcacgcgatgccacccatgcactgccaacccagcaccccactcattcaccccctcacaaccctgcacaggcgcgggcggagggcatcgtgacgcatgtgtccaacctgtacgacacgtactttgaggggggccgggaccatcgcctggagcgtccctccgtcctgcacctgccctactttgagggcgactactggccgggggaggcggagaacctgctggccagcctgggggaggaggaccgccaggccggcaagagtggcagcaagggtgggtgcaggggttgagggttgttttgggggggtggttggggggggaggtggtgacagggtagctgctgtgtggtgtggtcgaatgatgtaatccggtgtgcgatattggtgagaaccccccccc

SEQ ID NO: 27060 - DNA, 120 bp, Chlorella protothecoides
tgcgagggtgggcctctgctggaagtgactttccagtgccaggcaggccagctggtctggaaacctgacatgcatactgccaggtcagacgagtggacactcgtggcagaggctcggcgg

SEQ ID NO: 27061 - DNA, 74 bp, Chlorella protothecoides
tgcacccccctccaagcctcaggccccaacaacccccccccttccaaactcacacagtcagcgtccgcatttca

SEQ ID NO: 27062 - DNA, 61 bp, Chlorella protothecoides
tccttgagtacttattggccatggctcgagagcctcctgtatatctctactcagggtacta

SEQ ID NO: 27063 - DNA, 155 bp, Chlorella protothecoides
cagcaccatcctcaccagcatccatggcaattttgtgcgttgcggggctgagcagcagggcgcaactggttcgctgttttagcgtaggcgcttgctccatttcagtcatggcgtctgcacatctgcattgaacaggagccgcctgcagcaccgct

SEQ ID NO: 27064 - DNA, 74 bp, Chlorella protothecoides
gtgggtgctgtcttcgtatggttcttagccctgttttaggagttgactctggccattggcatcctgcattgaac

SEQ ID NO: 27065 - DNA, 191 bp, Chlorella protothecoides
gactctggccattggcatcctgcattgaactcgccatccacagccttaggaggcacagcaggacctcgggcatcccccattggcagggagataaacgcattggatccatggcacacaccgtttgcttctgcgcggctacagccccccttatcctcccctcccaggtctgcaatgagacatacggcctggcg

SEQ ID NO: 27066 - DNA, 63 bp, Chlorella protothecoides
gctcgaatggaaactgaaaccatgcagataatgtaataatggcttccctcactgtggggcgcc

SEQ ID NO: 27067 - DNA, 73 bp, Chlorella protothecoides
agcagggcctgccacctcactccccacaggcgattccacaaacttagacgtcatggcgaccaagcgtaaggga

SEQ ID NO: 27068 - DNA, 80 bp, Chlorella protothecoides
gcttgcaaaggcggatcaaccatcattgaagaacgggctatcatgagcaccgtacctccctcactctatgcacgcccacc

SEQ ID NO: 27069 - DNA, 65 bp, Chlorella protothecoides
tggtgccagcggcagcgaggaggacagcctcttgaatggcctcgcagactctggagccagcggca

SEQ ID NO: 27070 - DNA, 69 bp, Chlorella protothecoides
actccatctcgaatggcctccgcaatgtccttggcattatgtcttgtcggatcaagactgagcgtgaaa

SEQ ID NO: 27071 - DNA, 121 bp, Chlorella protothecoides
accagggtgatggtgagcccgggcacatgcttctggcctgcaaggggtagcggggagctgtgcagtagcttgctccgtcgacaagactcgagataccatgtctgtgcccccatccgcaccc

SEQ ID NO: 27072 - DNA, 90 bp, Chlorella protothecoides
gtacgaattctcagccctggcgtggaatggggtggaacgttcgggagcgtcagcatgaccatccaccactggatgaggggtgactttagc

SEQ ID NO: 27073 - DNA, 76 bp, Chlorella protothecoides
tttgtgggggggggggaggtgtatggagccactgctcaaggtacattgcgattgactggggccaggaatgggaaga

SEQ ID NO: 27074 - DNA, 233 bp, Chlorella protothecoides
cttggtgttcttgcaagccggttctcgcatctgtgaatggaagacaaagtgcagtcgccgcacatggctgtgtgctgaccctcaccgcaacgttacactgacaaccagagtgacatgccgccctaccgaactgggagtatcgctctcccagcgtggcatcggcgaagagcaccaggcttccccatcgcgagccaggtctcatcccctgaccctcaaagcgcccaggaggccag

SEQ ID NO: 27075 - DNA, 407 bp, Chlorella protothecoides
  modified_base (96)..(355): a, c, t, g, unknown or other
gcagtgtggcccagggcgtttgcaaggcttcatctgcttgcaggggaagggttgtcgaacagcacgtgtccatgacgctcaaggacctccagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggctggaaggctttaagtacagaccctgtgcagagagggtgcaaggagca

SEQ ID NO: 27076 - DNA, 63 bp, Chlorella protothecoides
ggtggtggacttgactgccctcaggtccttgctgccccaaccacggctaccctcccaacctgc

SEQ ID NO: 27077 - DNA, 106 bp, Chlorella protothecoides
tcctcacctcctccaaagaagggcaccccccctcgttccccgaagagaaaatcaccatcctctccggtttgaaacacttccccctcacctcgttcgacgaataggc
